US009719064B2

(12) United States Patent
Selber et al.

(10) Patent No.: US 9,719,064 B2
(45) Date of Patent: Aug. 1, 2017

(54) GENOMICS OF ACTINOPLANES UTAHENSIS

(75) Inventors: Klaus Selber, Haan (DE); Bernhard Weingaertner, Wülfrath (DE); Hermann Wehlmann, Wuppertal (DE); Winfried Rosen, Remscheid (DE); Alfred Pühler, Bielefeld (DE); Patrick Schwientek, Bielefeld (DE); Jörn Kalinowski, Bielefeld (DE); Udo Wehmeier, Wuppertal (DE)

(73) Assignee: BAYER INTELLECTUAL PROPERTY GMBH, Monheim (DE)

( * ) Notice: Subject to any disclaimer, the term of this patent is extended or adjusted under 35 U.S.C. 154(b) by 191 days.

(21) Appl. No.: 13/814,235

(22) PCT Filed: Aug. 1, 2011

(86) PCT No.: PCT/EP2011/063243
§ 371 (c)(1),
(2), (4) Date: Jun. 13, 2013

(87) PCT Pub. No.: WO2012/016960
PCT Pub. Date: Feb. 9, 2012

(65) Prior Publication Data
US 2013/0302855 A1 Nov. 14, 2013

(30) Foreign Application Priority Data
Aug. 4, 2010 (EP) .................................... 10171831

(51) Int. Cl.
*C12N 1/20* (2006.01)
*C07K 14/365* (2006.01)
*C12P 19/26* (2006.01)

(52) U.S. Cl.
CPC .............. *C12N 1/20* (2013.01); *C07K 14/365* (2013.01); *C12P 19/26* (2013.01)

(58) Field of Classification Search
None
See application file for complete search history.

(56) References Cited

FOREIGN PATENT DOCUMENTS

| CA | 2282735 A1 | * | 3/1998 |
| CA | 2 282 735 A1 | | 9/1998 |
| DE | 10021667 A1 | | 11/2001 |
| EP | 1852508 A2 | * | 11/2007 |
| WO | 98/38313 A1 | | 9/1998 |

OTHER PUBLICATIONS

Altschu et al., "Basic Local Alignment Search Tool," Journal of Molecular Biology, 1990, 215:403-410.
Badger et al., "CRITICA: Coding Region Identification Tool Invoking Comparative Analysis," J. Mol. Evol., 1999, 512-524 (Downloaded from http://mbe.oxfordjournals.org/ by guest on May 30, 2013).
Bendtsen et al., "Non-classical protein secretion in bacteria," BMC Microbiology, 2005, 5:58.
Bendtsen et al., "Improved Prediction of Signal Peptides: SignalP 3.0," Journal of Molecular Biology, 2004, 340:783-795.
Caspary et al., "Inhibition of Human Intestinal α-Glucosidehydrolases by a New Complex Oligosaccharide," Research in Experimental Medicine (Berl.) 1979, 175:1-6.
Couch, J. N., "Some New Genera and Species of the Actinoplanaceae," The Journal of the Mitchell Society,1963, 79:53-70 (Kopie von subito e.V., geliefert für Bayer Business Services GmbH BBS-PTS-IC-LS (DTL9900221).
Coulson, A., "High-performance searching of biosequence databases," Trends in Biotechnology, Mar. 1994, 12:76-80.
Delcher et al., "Improved microbial gene identification with GLIMMER," Nucleic Acids Research, 1999, 27(23):4636-4641.
Gordon et al., "Consed: A Graphical Tool for Sequence Finishing," Genome Research, 1998, 8:195-202.
Krogh et al., "Predicting Transmembrane Protein Topology with a Hidden Markov Model: Application to Complete Genomes," Journal of Molecular Biology, 2001, 305:567-580.
Lee et al., "Three trehalose synthetic pathways in the acarbose-producing *Actinoplanes* sp. SN223/29 and evidence for the TreY role in biosynthesis of component C," Appl. Microbiol. Biotechnol., 2008, 80:767-778.
McHardy et al., "Development of joint application strategies for two microbial gene finders," Bioinformatics, 2004, 20(10)1622-1631 (Downloaded from http://bioinformatics.oxfordjournals.org/ by guest on May 30, 2013).
Nielsen et al., "Identification of prokaryotic and eukaryotic signal pep tides and prediction of their cleavage sites," Protein Engineering, 1997, 10(1):1-6.
Salgado et al., "Operons in *Escherichia coli*: Genomic analyses and predictions," Proceeding of the National Academy of Sciences, Jun. 6, 2000, 97(12):6652-6657.
Sanger et al., "A Rapid Method for Determining Sequences in DNA by Primed Synthesis with DNA Polymerase," Journal of Molecular Biology, 1975, 94:441-448.
Schmidt et al., "α-Glucosidase Inhibitors New Complex Oligosaccharides of Microbial Origin," Naturwissenschaften, 1977, 64:535-536.
Sonnhammer et al., "A hidden Markov model for predicting transmembrane helices in protein sequences," Proceedings of ISMB 6, 1998, 175-182.

(Continued)

*Primary Examiner* — Paul Holland
(74) *Attorney, Agent, or Firm* — Morrison & Foerster LLP

(57) ABSTRACT

The present invention describes the DNA-sequence of the wild type genome as well as all genetic modifications which were introduced into the wild type—and further developed strains, based thereon. Thereby the first genotypic characterization of the developed strains, including the latest production strain, has been accomplished, accounting for the major part of the invention. Furthermore, on the basis of the determined DNA-sequences, potential genes were identified and account, combined with their functional annotation, for another part of the invention. In particular, the gene- and DNA-sequences, as well as protein-sequences derived there out, contribute to the invention which were affected by mutagenic modifications throughout the strain development process, potentially contributing to the increased production yield.

3 Claims, 3 Drawing Sheets

(56) References Cited

OTHER PUBLICATIONS

Figure 1:
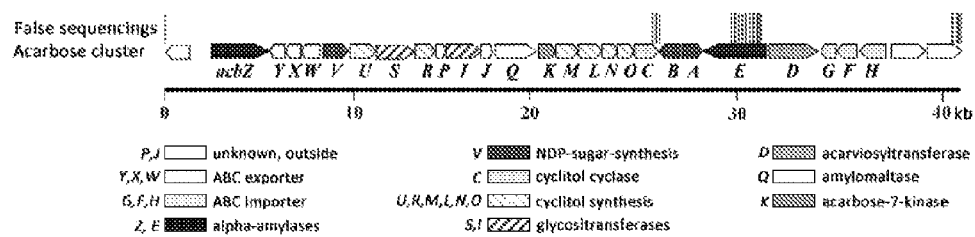

Steffen et al., "RNAshapes: an integrated RNA analysis package based on abstract shapes," Bioinformatics, 2006, 22(4):500-503 (Downloaded from http://bioinformatics.oxfordjournals.org/ by guest on May 30, 2013).

Tatusov et al., "The COG database: new developments in phylogenetic classification of proteins from complete genomes," Nucleic Acids Research, 2001, 29(1):22-28.

Tatusov et al., "A Genomic Perspective on Protein Families," Science, Oct. 24, 1997, 278:631-637 (Downloaded from www.sciencemag.org on May 30, 2013).

Ventura et al., "Genomics of Actinobacteria: Tracing the Evolutionary History of an Ancient Phylum," Microbiology and Molecular Biology Reviews, Sep. 2007, 71(3):495-548.

Wehmeier et al., "Biotechnology and molecular biology of the α-glucosidase inhibitor acarbose," Appl. Microbiol. Biotechnol. 2004, 63:613-625.

Wehmeier, U. F., "The Biosynthesis and Metabolism of *Acarbose Actinoplanes* sp. SE 50/110: A Progress Report," Biocatalysis and Biotransformation, 2003, 21(415):279-284.

Meyer et al., "GenDB-,an open source genome annotation system for prokaryote genomes," Nucleic Acids Research, 2003, 31(8):2187-2195.

Christian et al. "Targeting double-Strand Breaks with TAL Effector Nucleases", Genetics, 2010, 186(2): 757-761.

Frommer et al., "New Enzyme Inhibitors from Microorganisms," Planta Medica Journal of Medicinal Plant Research,1979, 35(3):195-217 (German article with English Abstract).

Hyum et al., "Molecular Detection of α-Glucosidase Inhibitor-producing Actinomycetes," Journal of Microbiology, 2005, 43(3):313-318.

\* cited by examiner

GENOMICS OF ACTINOPLANES UTAHENSIS

DESCRIPTION OF THE INVENTION

The gram-positive prokaryote *Actinoplanes utahensis* was described for the first time by John Couch in 1963 (Couch, J. N., Elisha Mitchell Sci. Soc., 1963, 79:53-70). Thereafter, in the year 1977, acarbose and its homologues were first found in the supernatant of an *Actinoplanes utahensis* culture (Schmidt et al., Naturwissenschaften, 1977, 64:535-536). Two years later, the medical effect of acarbose as an α-glucosidase-inhibitor within the human intestine was discovered (Caspary et al., Res. Exp. Med., 1979, 175:1-6) and within the same year, its potential application for the treatment of type-2 diabetes mellitus was propagated (Frommer et al., J. Med. Plant Res., 1979, 35:195-217).

Since 1990 the α-glucosidase-inhibitor acarbose is produced and marketed for the treatment of type-2 diabetes mellitus. Starting from the *A. utahensis* wild type strain the production has been continuously improved with regard to an ever increasing acarbose yield by optimization of the fermentation process as well as the production strain itself. The strain development has been driven by a multitude of mutagenesis experiments, which are primarily responsible for the raising acarbose production.

The genetic modifications in the organism, triggered by the mutagenesis experiments have so far only been recognizable by phenotypic characteristics (e.g. the increase of acarbose yield). More precisely, the genetic bases for the raising production yields have, until now, been completely unknown. However, this knowledge is of fundamental interest for the understanding of the mechanisms, leading to the rise in production. Furthermore it forms the most important prerequisite for the process of further, targeted genetic modification of the organism, optimizing *A. utahensis* to an even greater extend.

The present invention describes the DNA-sequence of the wild type genome as well as all genetic modifications which were introduced into the wild type- and further developed strains, based thereon. Thereby the first genotypic characterization of the developed strains, including the latest production strain, has been accomplished, accounting for the major part of the invention. Furthermore, on the basis of the determined DNA-sequences, potential genes were identified and account, combined with their functional annotation, for another part of the invention. In particular, the gene- and DNA-sequences, as well as protein-sequences derived there out which were affected by mutagenic modifications throughout the strain development process, potentially contributing to the increased production yield, contribute to the invention.

Material and Methods

As briefly described above, a series of mutagenesis experiments has been performed on the *Actinoplanes utahensis* wild type strain SE50-100, originally isolated from a soil sample. These experiments were aimed at the identification of mutants with an improved production of acarbose as well as other parameters, relevant for industrial production by fermentation such as high growth rate, optimized nutrient needs and consumption as well as low formation of cumbersome byproducts. Initially based on the wild type strain, further mutagenesis experiments were continuously performed on the mutant strains selected from the previous experiments. During the course of the strain development, several mutants with outstanding attributes were selected as new production strains and transferred into large scale production. Of these, seven strains were selected, including the latest production strain as well as the wild type strain, to be sequenced by Bielefeld University's Center for Biotechnology (CeBiTec) Universitätsstrasse 27, 33615 Bielefeld, Germany. Table 1 lists all seven strains that have been used during this project in the chronological order of their development.

Table 1 list all *A. utahensis* strains used in this study in their chronological order.

| Strain Symbol | Development Order | Remark |
| --- | --- | --- |
| SE50-100 | (1) | wild type strain |
| SN223-29-47 | 2 | |
| C445-P47 | 3 | |
| SN12755-48 | 4 | |
| SC3687-18-43 | 5 | |
| SC7177-40-17 | 6 | |
| SN19910-37-21 | 7 | latest production strain |

Strain Cultivation

Cultivation of strains in order to check their acarbose productivity was done as described previously (Schmidt et al., Naturwissenschaften, 1977, 64:535-536). In order to isolate DNA, the *Actinoplanes* strains were cultivated in a two-step shake flask system. Beside inorganic salts the medium contained starch hydrolysate as carbon source and yeast extract as nitrogen source. Preculture and main culture were run for 3 days and 4 days, respectively, on a rotary shaker at 28° C. Then the biomass was collected by centrifugation.

Strain Mutagenesis

The strain development of the Acarbose producer was performed by the method of stepwise selection of higher producing strains. This method uses the process of random mutation by chemical or physical means. Chemicals used to induce mutations were either alkylating agents or intercalating dyes that serve as frameshift mutagens. Physical treatment of cells to induce mutagenesis was done with UV light of 365 nm. Fragments of the mycelium were used for mutagenesis treatment in appropriate buffer systems. After the treatment the biological material was grown for a short period in liquid medium to allow phenotypic expression of the induced alterations and then plated on agar plates. A random selection of clones that survived the mutagenesis treatment was checked for their acarbose productivity in small scale shake flask experiments. The best mutant clones obtained during a mutation cycle of this kind were chosen for the next mutation step. Several such steps of mutation and selection resulted in a gradual increase of productivity.

Preparation of Genomic DNA

The preparation of genomic DNA of *A. utahensis* strain SE50-110 was performed by a modification of the general described procedure (Maniatis T., Fritsch E. F., Sambrook J., Molecular Cloning—A Laboratory Manual, Cold Spring Harbor Press, 1982). The mycel of 50 mL of freshly grown culture was harvested by centrifugation (10 min., 4.000 rpm, 4° C.) in a Christ centrifuge. The pellet was washed 4 times in a buffer containing 15% sucrose (Merck KGaA, Darmstadt, Germany, cat. 7651), 25 mM TrisHCl pH 7.2 (Merck KGaA, Darmstadt, Germany, cat. 1.08382.1000), and 25 mM EDTA (Merck KGaA, Darmstadt, Germany, cat. 8418) under the same conditions. Finally the pellet was resuspended in 4.5 mL of the same buffer and lysozyme (Merck KGaA, Darmstadt, Germany, cat. 1.05281.0010) and RNAse (Qiagen, Hilden, Germany, cat. 19101) were added to final concentrations of 5 mg/mL and 50 µg/mL respectively and the mixture was incubated at 37° C. for 45 minutes. After the addition of SDS (Serva, Heidelberg, Germany, cat. 20767) and proteinase K (Qiagen, Hilden, Germany, cat. 19133) to 0.5% and 2 μg/mL final concentrations respectively, the incubation was continued at 50° C. for 5 minutes. NaCl (Merck KGaA, Darmstadt, Germany, cat. 1.06404.1000) was added to a final concentration of 300 mM and the volume adjusted with WFI to 8 mL. The lysate was subjected to three successive phenol/SEVAG extractions (SEVAG is a mixture of 24 parts chloroform [Merck KGaA, Darmstadt, Germany, cat. 1.02445.1000] and 1 part isoamylalcohol [Merck KGaA, Darmstadt, Germany, cat. 1.979.1000]) and the phenol was removed by washing the DNA solution with 10 mL SEVAG. The DNA was precipitated by the addition of 0.1 volume of 3 M sodium acetate (pH 4.8) (Merck KGaA, Darmstadt, Germany, cat. 6268) and 1 volume of cold isopropanol (Merck KGaA, Darmstadt, Germany, cat. 1.09634.1011). The DNA was pelleted by centrifugation (25 minutes, 4.000 rpm, 4° C.; Christ centrifuge) and the DNA pellet was washed thoroughly (5×) with 70% ethanol (Merck KGaA, Darmstadt, Germany, cat. 1.00983.1011) (10 minutes, 4000 rpm, 4° C.; Christ centrifuge) and air-dried. Finally the pellet was resuspended in 200 μL Tris pH 8.5 over night at 4° C. and the DNA concentration was determined by measuring the optical density at 260 nm and 280 nm. The size of the prepared DNA was analysed by subjecting an aliquot (10 μL) of the DNA solution to electrophoresis through a 1% agarose gel as quality check.

Fosmid-Library Construction

Fosmids are commonly used for preparing genomic libraries when a smaller insert size is desired. The inserts have an average size of 40 kb and are produced by random shearing, yielding a more uniform coverage of the genome than other library types. Fosmids are excellent candidates for closing gaps in a whole genome sequencing projects due to their uniform coverage. The fosmid-library construction for *Actinoplanes utahensis* wild type has been carried out on genomic DNA by IIT Biotech GmbH, Universitätsstr. 25, 33615 Bielefeld, Germany. For construction in *E. coli* EPI300 cells, the CopyControl™ Cloning System (EPICENTRE Biotechnologies, 726 Post Road, Madison, Wis. 53713, USA) has been used. The kit was obtained from Biozym Scientific GmbH, Steinbrinksweg 27, 31840 Hessisch Oldendorf, Germany.

Fosmid-Library Sequencing

Fosmid-library sequencing for *Actinoplanes utahensis* wild type has been carried out on a 3730xl DNA-Analyzer (Applied Biosystems, 850 Lincoln Centre Drive, Foster City, Calif. 94404, USA) by IIT Biotech GmbH, Universitätsstr. 25, 33615 Bielefeld, Germany. The device performs parallel Sanger-sequencing in 96 capillaries (Sanger et al., J. Mol. Biol., 1975, 94 (3):441-448). The resulting flowgram files were base called and stored in FASTA format. Both files were later used for gap-closure and quality assessment.

High-Throughput Genome Sequencing

Genome Sequencer FLX

The Genome Sequencer FLX (GS FLX) system (454 Life Sciences, 15 Commercial Street, Branford, Conn. 06405, USA) has been used for pyrosequencing of the *A. utahensis* wild type strain SE50-100 as well as the latest production strain SN19910-37-21. Two different protocols and reagent series were used on the GS FLX platform:

1. Standard series with long paired end (PE) protocol. The genome-DNA fragment size for the PE-library construction was 2.5-3.0 kb. The protocol yields an average read length of 2×100 bases and a total number of sequenced bases of about 100 Mb.
2. Titanium series with whole genome shotgun (WGS) protocol. The genome-DNA fragment size for the WGS-library construction was 500-800 bp. The protocol yields a read length of 400-500 bases and a total number of sequenced bases ranging from 400-600 Mb.

Details on the protocols are provided in the manufacturers manuals, namely the *GS FLX Sequencing Method Manual* (December 2007), *GS FLX Paired End DNA Library Preparation Method Manual* (December 2007), *GS FLX Titanium Sequencing Method Manual* (October 2008) and the *GS FLX Titanium General Library Preparation Method Manual* (October 2008)

Genome Analyzer IIx

The Genome Analyzer IIx (GA IIx) system (Illumina, Inc., 9885 Towne Centre Drive, San Diego, Calif. 92121, USA) including Cluster-Station and Paired-End-Module has been used for sequencing-by-synthesis of the five former productions strains SN223-29-47, C445-P47, SN12755-48, SC3687-18-43 and SC7177-40-17. For all five strains, the paired end protocol with a genome-DNA fragment size of approximately 330 bp and a read length of 2×36 bases was used. Library preparation, cluster generation and sequencing were performed according to the manufacturers manuals *Paired-End sequencing Sample Preparation Guide* (Part #1005063 Rev. B September 2009), *Using the Paired-End Cluster Generation Kit v2 on the Cluster Station and Paired-End Module* (Part #1005629 Rev. C February 2009) and *Using SBS Sequencing Kit v3 on the Genome Analyzer* (Part #1005637 Rev. A November 2008).

Wild Type Draft Genome Assembly

The automated assembly of all *Actinoplanes utahensis* wild type reads generated by the GS FLX platform was performed with the Newbler assembler software (gsAssembler version 2.0.00.22, 454 Life Science). For detailed information on the assembly algorithm see the *Genome Sequencer FLX System Software Manual Part C*, version 2.3 (October 2009).

Wild Type Genome Finishing

In order to close remaining gaps between contiguouse sequences (contigs) still present after the automated de novo assembly by the Newbler program, the visual assembly software package Consed (Gordon et al., Genome Research, 1998, 8:195-202) was utilized. Within the graphical user interface, primer pairs at the ends of contiguous contigs were selected. These primer pairs were then used to amplify desired sequences from clones originating from the previously constructed fosmid-library in order to bridge the gaps between contiguous contigs.

After the DNA sequence of these fosmid-reads had been determined, manual assembly of all applicable reads was performed with the aid of different program features. In detail, a fosmid-read is first aligned to the 5' end of a contig, extending it by its 5' remainder. Afterwards, the 3' end of the neighboring contig is aligned to this extension, spanning the previously existing gap and joining the two contigs.

In cases were the length or quality of one fosmid-read was not sufficient to span the gap, multiple rounds of primer selection, sequencing and manual assembly were performed.

Wild Type Genome Annotation

Identification of Coding Sequences (CDS)

The potential genes and partial gene sequences on the wild type genome (see Appendix) were identified by a series of computational analysis. All utilized programs are part of the GenDB annotation-pipeline (Meyer et al., Nucleic Acids Research, 2003, 31(8):2187-95). For the identification of CDSs intrinsic, extrinsic and combined methods were applied in order to achieve optimal results.

The program responsible for the intrinsic prediction of CDSs is Glimmer (Delcher et al., Nucleic Acid Research, 1999, 27:4636-41). It first constructs a training set from CDSs with optimal characteristics taken from the genome to be analyzed. Based upon this set, an interpolated Markov Model is calculated, which is used in the actual search-run to identify all CDSs of the genomic sequence. Glimmer tends to calculate more CDSs as are actually there.

The extrinsic CDS-prediction has been carried out by CRITICA (Badger et al., Mol. Biol. Evol., 1999, 16:512-24). CRITICA first makes use of the BLASTN algorithm (Altschul et al., J. Mol. Biol., 1990, 215(3):403-10) in order to determine a list of genomic sequences which show at least slight similarity to sequences from public DNA-databases. If the translated amino acid sequence possesses a higher similarity than it would be expected based on the DNA-similarities, this is interpreted as evidence for being a conserved coding sequence. CRITICA combines these results with intrinsic analysis based on the distribution of hexa nucleotides to improve the prediction of previously unknown sequences. Despite this, CRITICA still tends to predict fewer CDS in cases where no homolog sequence is already stored in a public database.

The Reganor software (McHardy et al., Bioinformatics, 2004, 20(10):1622-31) has been used to optimize the results calculated by Glimmer and CRITICA. It combines the results of both programs and thus minimizes their respective shortcomings. Moreover, the CDS predicted by CRITICA form the basis of the combined results, complemented by the intrinsic predictions calculated by Glimmer.

Annotation and Functional Prediction

The identified open reading frames were analyzed through a variety of different software packages in order to draw conclusions from their RNA- and/or amino acid-sequences regarding their potential function. Besides their functional prediction, further characteristics and structural features have also been calculated.

Homology-based searches were applied to identify conserved sequences by means of comparison to public and/or proprietary nucleotide- and protein-databases. If a significant sequence similarity was found throughout the major section of a gene, it was concluded that the gene should have a similar function in *A. utahensis*. The homology-based method, which was used to annotate the gene list of *Actinoplanes utahensis*, is termed BLASTX (Coulson, Trends in Biotechnology, 1994, 12:76-80). BLASTX translates a given nucleotide sequence into three forward and three reverse complementary reading frames before it compares them against protein databases (e.g. the public, non-redundant protein database (nr-aa) at the National Center for Biotechnology Information (NCBI)).

Enzymatic classification has been performed on the basis of enzyme commission (EC) numbers (Webb, Edwin C., San Diego: Published for the International Union of Biochemistry and Molecular Biology by Academic Press, 1992, ISBN 0-12-227164-5. For further functional gene prediction, the cluster of orthologous groups of proteins (COG) classification system has been applied (*Tatusov* et al., Science, 1997, 278(5338):631-7 and Tatusov et al., *Nucleic Acids Res.* 2001, 29(1):22-8).

To identify potential transmembrane proteins, the software TMHMM (Krogh et al., J. Mol. Biol., 2001, 305(3): 567-80 and Sonnhammer et al., Proc. Int. Conf. Intell. Syst. Mol. Biol., 1998, 6:175-82) has been utilized. It makes use of Hidden Markov Models to predict transmembrane helices and other characteristics of transmembrane proteins. With information gained thereof, membrane associated functional predictions obtain significantly stronger conclusiveness.

The software SignalP (Bendtsen et al., J. Mol. Biol., 2004, 340:783-95 and Nielsen et al., protein Engineering, 2997, 10:1-6) was used to predict the secretion capability of the identified CDSs. This is done by means of Hidden Markov Models and neural networks, searching for the appearance and position of potential signal peptide cleavage sites within the amino acid sequence. The resulting score can be interpreted as a probability measure for the secretion of the translated protein. SignalP retrieves only those proteins which are secreted by the classical signal-peptide-bound mechanisms.

In order to identify further proteins from *Actinoplanes utahensis* which are not secreted via the classical way, the software SecretomeP has been applied (Bendtsen et al., BMC Microbiology, 2005, 5:58). The underlying neural network has been trained with secreted proteins, known to lack signal peptides despite their occurrence in the exoproteome. The final secretion capability of the translated genes was been derived by the combined results of SignalP and SecretomeP predictions.

To reveal polycistronic transcriptional units, proprietary software has been developed which predicts jointly transcribed genes by their orientation and proximity to neighboring genes (adopted from Salgado et al., Proc. Natl. Acad. Sci. USA, 2000, 97(12):6652-7). In light of these predictions, operon structures can be determined and based upon them further sequence regions can be derived with high probability of contained promoter and operator elements.

Secondary structures of single-stranded DNA-respective RNA-molecules were calculated by the RNAshapes software (Steffen et al., Bioinformatics, 2006, 22(4):500-503). The results were used for the intrinsic prediction of transcriptional terminators which indicate operon and gene ends, respectively.

Production Strain Reference Assembly

The assembly of reads obtained for all six production strains has been achieved by mapping them onto the wild type reference genome. For this task, two different software programs were utilized, taking the two read types into account which originated from the Genome Sequencer FLX (read-length 400-500 bases WGS) and Genome Analyzer IIx (read length 2×36 bases PE) system, respectively.

The gsMapper software (version 2.3, 454 Life Science) was used to align the reads from the Genome Sequencer FLX platform against the wild type reference genome. The program implements a heuristic to find the best alignment position for each read within the reference sequence. After all reads have been aligned, multiple alignments for the reads that align contiguously to the reference are performed in order to form contigs. From the contigs' multiple alignments, consensus basecall sequences are produced using the flow-signals of the reads in the multiple alignments, resulting in quality and confidence values for each base. For detailed information on the mapping algorithm see the *Genome Sequencer FLX System Software Manual Part C*, version 2.3 (October 2009).

As part of the CLC Genomics Workbench (CLC bio, Finlandsgade 10-12, Katrinebjerg, 8200 Aarhus N, Denmark), the short read assembly algorithm with PE information has been used to align reads from the Genome Analyzer IIx platform against the reference genome. For detailed information on the mapping algorithm see the *CLC Genomics Workbench User Manual* 3.7.1.

Identification of Mutations in the Production Strains

Genetic variations between the wild type strain SE50-100 and the latest production strain SN19910-37-2 have been automatically determined during the reference assembly process by means of the gsAssembler software (version 2.3, 454 Life Science). The details of the algorithm, determining single nucleotide polymorphisms (SNPs) as well as structural variations, can be found in the *Genome Sequencer FLX System Software Manual Part C*, version 2.3 (October 2009).

Mutations between the wild type strain and the five former productions strains have been determined using the CLC Genomics Workbench (CLC bio, Finlandsgade 10-12 Katrinebjerg, 8200 Aarhus N, Denmark). Specialized algorithms for high-throughput data analysis of SNPs and deletion/insertion polymorphisms (DIPs) have used, described in detail in *CLC Genomics Workbench User Manual* 3.7.1.

Sequencing, Assembly and Annotation of the *Actinoplanes utahensis* Wild Type Strain The draft genome sequence of the *Actinoplanes utahensis* wild type strain SE50-100 has been determined by a combination of sequencing information from three high-throughput runs. These were carried out on a Genome Sequencer FLX system, using two paired-end (PE) and one whole genome shotgun (WGS) approaches. The sequencings resulted in the successful nucleotide sequence determination of about 2 million reads, accounting for approximately 407 million sequenced bases in total (see table 2 for detailed information on the outcomes of each run).

Table 2 shows the results of the three high-throughput sequencing runs for the *A. utahensis* wild type strain SE50-100. Two paired-end (PE) and one whole genome shotgun (WGS) run were performed.

| Run | 454 Technology | Reads | Paired Reads | Bases |
|---|---|---|---|---|
| 1 | Standard, PE | 742,169 | 259,260 | 103,840,588 |
| 2 | Standard, PE | 751,570 | 265,457 | 105,329,378 |
| 3 | Titanium, WGS | 481,602 | — | 197,732,895 |
| | Total | 1,975,341 | 524,717 | 406,902,861 |

The sequenced reads were then successfully (99.65%) assembled into 476 contiguous sequences (contigs) exceeding 500 bases in length. Considering the resulting draft genome size of 9,122,632 bases, a genome coverage of 43.88-fold has been accomplished. Due to 480,030 (91.48%) successfully mapped paired-end reads, these contigs could already be ordered and oriented into eleven scaffolds (multiple contigs whose order and orientation are known from paired-end information). Table 3 gives further inside into the success- and error-rates of the assembly process leading to the preliminary draft genome sequence of the *Actinoplanes utahensis* wild type strain SE50-100.

Table 3 displays the results of successfully assembled reads, bases and the inferred read error. The inferred read error is calculated from mismatches between the reads and the consensus sequence of the final assembled contigs and measures the frequency of incorrectly called bases.

| Run | 454 Technology | Assembled Reads | Assembled Bases | Inferred Read Error |
|---|---|---|---|---|
| 1 | Standard, PE | 99.58% (739,079) | 98.08% (101,847,643) | 0.36% (370,520) |
| 2 | Standard, PE | 99.59% (748,526) | 98.18% (103,411,267) | 0.35% (364,397) |
| 3 | Titanium, WGS | 99.85% (480,863) | 99.33% (196,416,109) | 0.52% (1,018,256) |
| | Total | 99.65% (1,968,468) | 98.72% (401,675,019) | 0.44% (1,753,173) |

Interestingly, the genome sequence of the previously published acarbose cluster (Wehmeier, Biocat. Biotrans., 2003, 21:279-285 and Wehmeier and Piepersberg, Appl. Microbiol. Biotechnol., 2004, 63:613-625) was not identical to the sequencing results described above. In total, 37 single nucleotide polymorphisms (SNPs) and 24 deletion/insertion polymorphisms (DIPs) were found to be artificially introduced into the wild type sequence by the former sequencing attempt (see FIG. 1). The correction of these flawed sequencings lead to a minor elongation (42 bases) of the acbC gene as well as to the correction of several temporary frameshifts within the acbE gene. This however, had no consequence on overall annotation of the gene and the whole acarbose cluster.

FIG. 1 shows former false sequencings of the acarbose cluster which were corrected by the performed high-throughput sequencing described here.

Finishing of the Draft Genome Sequence by Fosmid Library Sequencing

Figure 2:
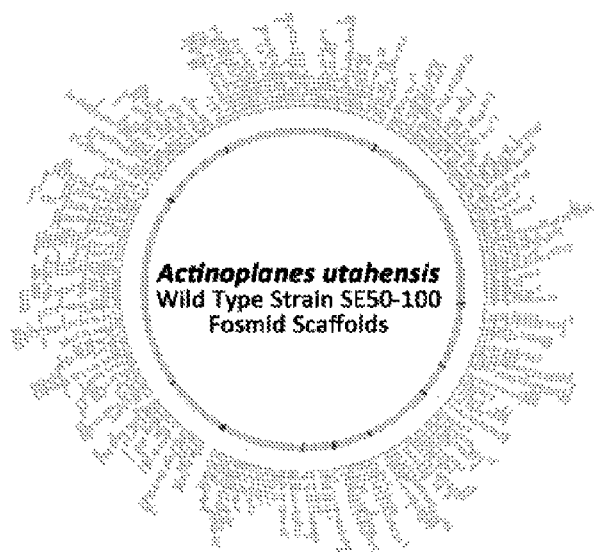

In order to obtain a whole genome scaffold of the wild type strain SE50-100, terminal insert sequences of 999 randomly selected fosmid clones have been determined (FIG. 2). No inconsistencies between the eleven paired-end-based scaffolds and the fosmid-library-based whole genome scaffold were found, corroborating the quality of the sequencing runs as well as the accuracy of the assembly process. In total 600 Sanger reads were derived from selected clones covering most of the remaining gaps of the draft genome. By manual assembly of these reads, 411 gaps between contigs could be bridged and closed respectively. The remaining 64 contigs form a single, circular scaffold and could not be bridged with this method due to long repetitive DNA-sequences and/or uncovered regions within the fosmid library. The resulting improved genome sequence of the *A. utahensis* wild type strain SE50-100 and is deposited in the appendix of this document.

FIG. 2 depicts the circular mapping of the fosmid clones (grey) used to build the genomic scaffold. The eleven scaffolds, which were based on the paired-end information, are marked in black.

Based on the improved genome sequence, a guanine-cytosine (G+C) content of 71.29% has been calculated which is typical for actinobacteria closely related to the *Actinoplanes* genus (Ventura et al., Microbiol. Mol. Biol. Rev., 2007, 71(3): 495-548).

Annotation of the *Actinoplanes utahensis* Wild Type Genome

On the foundation of the improved genome sequence, a full genome annotation has been performed, resulting in the determination of 8,027 putative coding sequences (CDS) with an average gene length of 985 nucleotides. Based thereon, *Actinoplanes utahensis* exhibits a coding density of 86.35% with notable G+C content difference of about 3% between coding (71.68%) and non-coding (68.70%) DNA regions. By examining the structural gene composition, 1,793 putative polycistronic transcriptional units were predicted, hosting 5,980 genes (74.50%) with an average number of 3.34 genes per operon. All nucleotide sequences as well as their amino acid translations are deposited in the appendix of this document. Table 4 summarizes the outcomes of the gene prediction process.

Table 4 shows the results of the gene prediction software for the A. utahensis wild type strain.

| Gene Prediction Parameter | Value |
| --- | --- |
| Coding sequences | 8,027 |
| Coding bases | 7,904,275 (86.35%) |
| Average gene length (bp) | 985 |
| Coding G + C content (%) | 71.68 |
| Non-coding G + C content (%) | 68.70 |
| Putative monocistronic transcriptional units | 2,047 |
| Putative polycistronic transcriptional units (PTU) | 1,793 |
| Average number of genes per PTU | 3.34 |

A variety of different programs were used to perform the functional annotation of the identified open reading frames. Due to extrinsic protein database comparisons 2,839 CDSs (35.67%) could be enzymatically characterized with an enzyme commission (EC) number. In addition 701 CDSs (8.73%), possessing typical transmembrane spanning regions, have been identified and classified as membrane-associated proteins. For a total number of 600 proteins signal peptides, and thus a high probability of being secreted into the extracellular medium, have been predicted. For additional 657 proteins, other secretion mechanisms were proposed. However, these predictions would result in an unusual high number of secreted proteins. Furthermore, the cluster of orthologous groups of proteins (COG) classification system has been applied and revealed an assignment of 3,983 (49.62%) CDSs to one or multiple COG-categories. Appendix table 9 offers a more comprehensive outline of the COG-categories and its subdivisions whereas the results of the general annotation are summarized in table 5. After full annotation, 2,684 genes (33.44%) had still no associated function. However, distant similarities to other sequences were found in public databases. For 434 (5.41%) orphan genes, not even distant related sequences were found in the databases.

Table 5 lists the results of the functional gene annotation for the A. utahensis wild type strain.

| Functional Annotation Parameter | Value |
| --- | --- |
| CDSs with annotated function | 4,909 (61.16%) |
| CDSs with EC-number | 2,839 (35.67%) |
| CDSs with COG-category | 3,983 (49.62%) |
| CDSs with unknown function | 2,684 (33.44%) |
| Orphan CDSs | 434 (5.41%) |
| Membrane associated proteins | 701 (8.73%) |
| Signal peptide predicted (75% confidence) | 600 (7.47%) |
| Other secretion mechanism predicted (95% conf.) | 657 (8.18%) |

Figure 3:
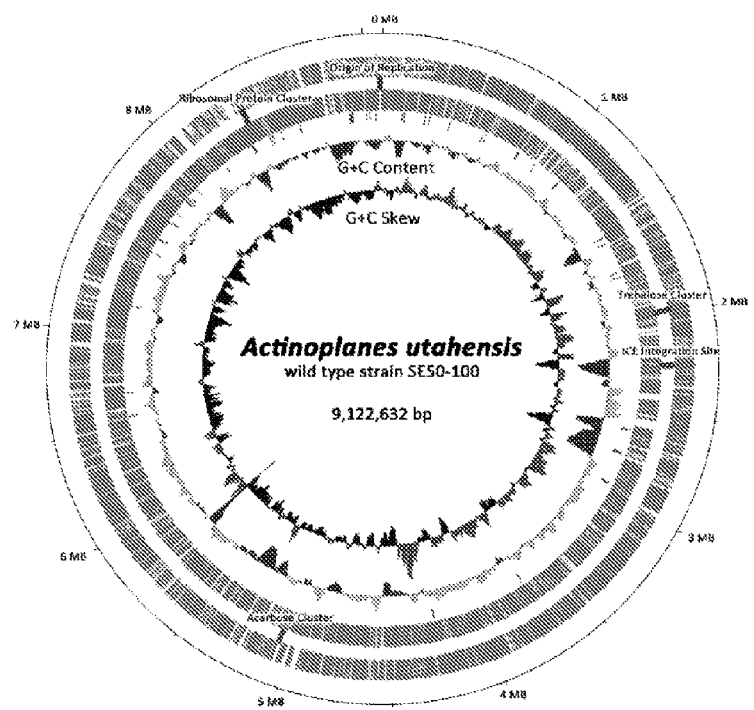

The annotated wild type genome is shown as a circular plot in FIG. 3. In addition to the depicted genes on the forward (outmost circle) and reverse strand (second circle), the G+C content (third circle) as well as the G+C skew (forth circle) is drawn in. Furthermore, several sites of high importance are marked, including the origin of replication, the previously described trehalose (Lee et al., Appl. Microbiol. Biotechnol., 2008, 80:767-778) and acarbose clusters, an interesting protein cluster consisting of about 25 contiguous ribosomal proteins as well as the location of an integrative and conjugative element (ICE). Table 6 lists the general features of the Actinoplanes utahensis wild type genome.

FIG. 3 shows a circular genome plot of the Actinoplanes utahensis SE50-100 wild type chromosome. On the outmost circle, genes in forward orientation are depicted. The second circle hosts genes on the reverse strand. The G+C content and the G+C skew are shown on the third and fourth circle, respectively.

Table 6 lists the general features of the A. utahensis SE50-100 genome.

| Feature | Genome |
| --- | --- |
| Total size (bp) | 9,122,632 |
| G + C content (%) | 71.29 |
| No. of CDS | 8,027 |
| No. of orphans | 434 |
| Coding density (%) | 86.35 |
| Average gene length (bp) | 985 |
| No. of rRNAs | 4 × 16S-23S-5S |
| No. of transposease genes | 39 |

By means of further extrinsic database searches, the most homologous gene and the organism it originates from have been assigned to each open reading frame. Together with the detailed annotations described above, this information is listed for each CDS in appendix table 10.

For many genes, an even more detailed manual annotation has been added to the (semi-) automated information described above. These genes include, but are not limited to all elements of the acarbose cluster (Wehmeier and Piepersberg, Appl. Microbiol. Biotechnol., 2004, 63: 613-625), the trehalose cluster (Lee et al., Appl. Microbiol. Biotechnol., 2008, 80:767-778) as well as certain classes of proteins such as starch degrading- and synthesizing-enzymes, sugar epimerases, genes involved in the uptake, transport and metabolism of maltose, secreted proteins, cellulases and genes involved in nitrogen metabolism and sporulation associated genes and their protein translations.

Metabolic Potential of the A. utahensis Wild Type Strain

Through the use of annotated EC numbers, it was possible to analyze the metabolic capabilities of Actinoplanes utahensis. Mapping of the EC numbers onto canonical pathways of the Kyoto Encyclopedia of Genes and Genomes (KEGG) revealed the availability of all major pathways regarding the central metabolism such as the glycolysis, the TCA cycle and the penthose-phosphate-pathway. For the utilization of the Entner-Dudoroff-pathway however, the key enzyme phosphogluconate dehydratase is missing for the catalysis of 6-Phospho-D-gluconate to 2-Dehydro-3-deoxy-D-gluconate-6P.

Genome Sequencing of the A. utahensis Production Strains

In addition to the wild type strain SE50-100, the latest production strain SN19910-37-21 as well as five former strains were sequenced in order to reveal genetic differences responsible for the increased acarbose production in these strains. The latest strain has been sequenced on the Genome Sequencer FLX (GS FLX) system, whereas the former strains were sequenced using the Genome Analyzer IIx (GA IIx) platform solely based on paired-end data. The results are summarized in table 7. In total, 5.6 billion bases were sequenced.

Table 7 lists all sequenced *A. utahensis* production strains in the order of their acarbose production.

| Strain Symbol | Platform | Protocol | Reads | Bases | Coverage |
|---|---|---|---|---|---|
| SN223-29-47 | GA IIx | PE | 34,571,040 | 1,209,986,400 | 132.64 |
| C445-P47 | GA IIx | PE | 30,360,960 | 1,062,633,600 | 116.48 |
| SN12755-48 | GA IIx | PE | 29,292,960 | 1,025,253,600 | 112.39 |
| SC3687-18-43 | GA IIx | PE | 28,105,200 | 983,682,000 | 107.83 |
| SC7177-40-17 | GA IIx | PE | 27,332,400 | 956,634,000 | 104.86 |
| SN19910-37-21 | GS FLX | Titanium, WGS | 776,085 | 297,036,826 | 32.56 |

Identification of Genetic Variations Between the Mutated Strains and the Wild Type Consequent reference mapping against the previously finished wild type genome lead to the assembly of all six production strains. In addition, all genetic variations between the production strains and the wild type strain could be determined. Interestingly, no major deletion mutations had taken place, as the wild type genome is generally completely covered by the reads originating from the production strains. However, 1,826 single nucleotide polymorphisms (SNPs) and 128 deletion/insertion polymorphisms (DIPs) were discovered between the wild type genome and the latest production strain. The number of SNPs introduced into each genome, as listed in table 8, rises with the chronological development of the strain. All mutations and their exact transitions are listed in appendix table 11 together with the production strains, showing their first occurrence.

Table 8 lists the number of single nucleotide polymorphisms (SNPs) and deletion/insertion polymorphisms (DIPs) that were detected between the corresponding production strain and the *A. utahensis* wild type genome.

| Strain Symbol | SNPs | DIPs |
|---|---|---|
| SN223-29-47 | 428 | 7 |
| C445-P47 | 1,040 | 6 |
| SN12755-48 | 1,204 | 6 |
| SC3687-18-43 | 1,331 | 5 |
| SC7177-40-17 | 1,533 | 7 |
| SN19910-37-21 | 1,826 | 128 |

Figure 4:
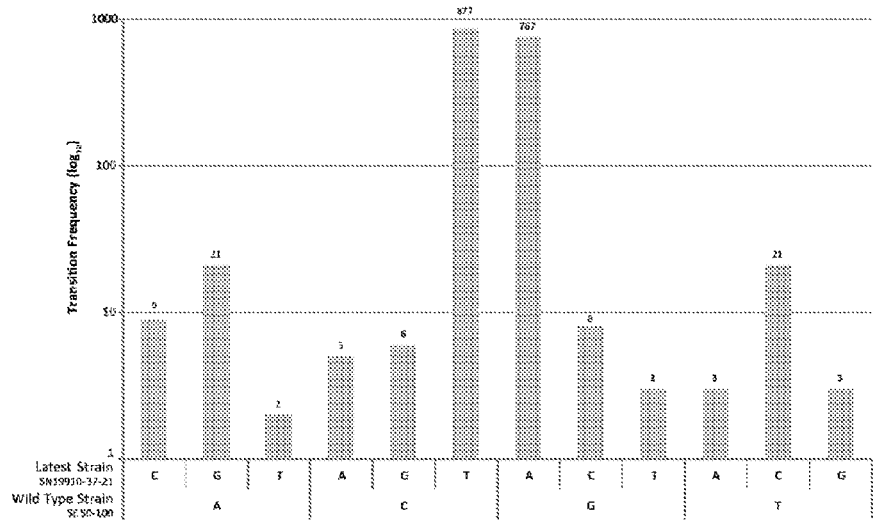

The SNP based nucleotide transitions were not gaussian distributed but show a more than 100-fold preference for the two transition G→A and C→T. FIG. 4 depicts these findings.

FIG. 4 shows the transition frequency of SNP mutations between the wild type and the latest production strain.

Figure 5:
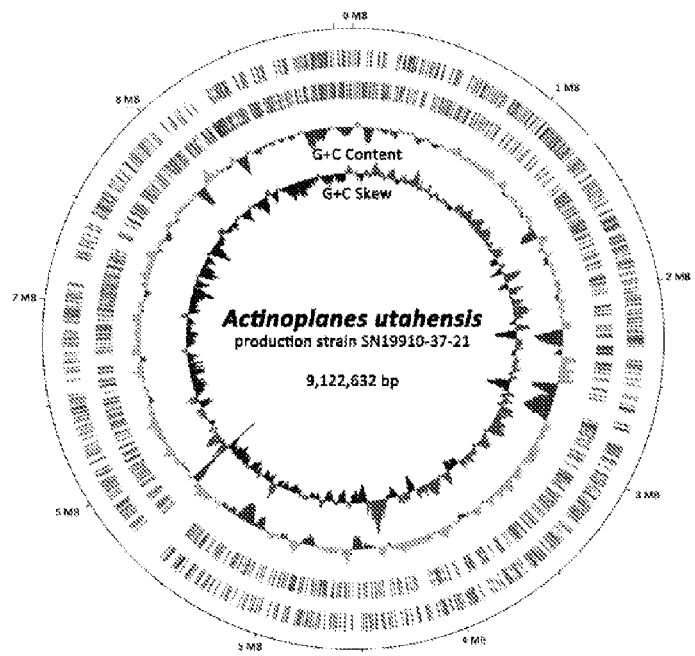

By comparison of annotated gene loci against positions were SNPs and DIPs were introduced, it was found that 1,896 genes (23.62%) were affected by these mutations on the nucleotide level as can be seen in FIG. 5. Of these, 376 genes were still coding for the identical protein sequence, holding only silent mutations. On the other side, the protein sequence of 816 genes changed on individual positions, leaving the amino acid sequence unchanged for the most part. However, the 704 residuary genes were hit by mutations changing their length and/or reading frame. In detail, 429 genes were predicted to have an increased length compared to the wild type whereas 275 genes were shortened.

FIG. 5 visualizes only the 1,896 genes which were hit by a mutation event. On the outmost circle, forward oriented genes are listed. On the second circle, backward genes are depicted.

The third and forth circles represent the G+C content and the G+C skew, respectively.

Modifications of the Central Metabolism

The enzyme encoding genes which were affected by mutagenesis events are likely to have an impact on the overall metabolism as well as special pathways like the one encoding for the formation of acarbose. For this reason, these genes were mapped according to their EC numbers onto canonical pathways of the KEGG database to identify loss of functionality introduced by the mutagenesis experiments. While several enzymes of the central metabolism were affected by SNPs, only few genes were hit by mutations leading to a probable loss of function. In addition, for each of these severely changed genes at least one other gene, annotated with the same EC number, was still available, probably assisting for the knocked out version.

Modifications of the Acarbose Cluster and the Use of Former Production Strains

Figure 6:
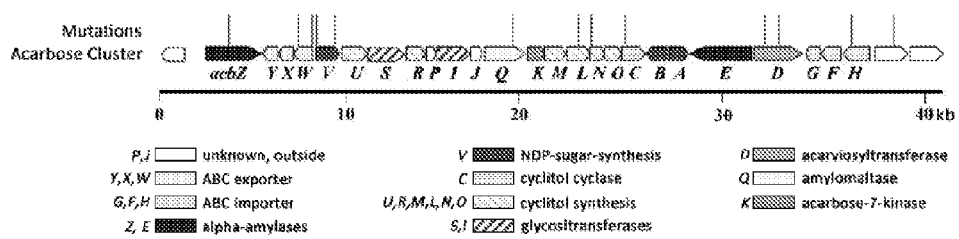

By sequencing of the former production strains, it was possible to trace mutations back through time to the strain they were first introduced into. This analysis was especially enlightening on the sequence of the acarbose cluster as depicted in FIG. 6. The 13 SNPs which hit the cluster were sequentially introduced as mutation experiments were executed. Two SNPs were introduced into the intragenic region between genes acbW and acbV. Furthermore, two SNPs were introduced to the acbD gene. The acbD encoding protein, an acarviosyltransferase is believed to load acarbose with maltodextrins in the extracellular space prior to reimport through the acarbose importer complex. Another mutation is located in the acbH gene which encodes the subject binding protein of the acarbose importer complex.

FIG. 6 shows the acarbose cluster in conjunction with the mutations which were introduced therein during the development of the depicted former production strains.

LIST OF ALL MUTATIONS

Table 9 lists all mutations introduced into the *Actinoplanes utahensis* wild type strain SE50-100 by the corresponding production strains.

| Position in reference wild type strain SE50-100 | Base in Reference strain | SN223-29-47 | C445-P47 | SN12755-48 | SC3687-18-43 | SC7177-40-17 | SN19910-27-21 | Affected Gene ID |
|---|---|---|---|---|---|---|---|---|
| 7102 | G | | A | A | A | A | A | cds_wt_4 |
| 11919 | G | A | A | A | A | A | A | cds_wt_7 |
| 12285 | G | A | A | A | A | A | A | cds_wt_7 |
| 12651 | G | A | A | A | A | A | A | cds_wt_7 |
| 13511 | G | A | A | A | A | A | A | cds_wt_7 |
| 46974 | C | T | T | T | T | T | T | cds_wt_41 |
| 62542 | C | | T | T | T | T | T | cds_wt_52 |
| 64957 | C | T | T | T | T | T | T | cds_wt_54 |
| 65055 | C | T | T | T | T | T | T | cds_wt_54 |
| 65455 | C | C/T | | | | | T/C | — |
| 65460 | C | C/T | | | | | T | — |
| 65882 | G | A | A | A | A | A | A | cds_wt_55 |
| 72685 | A | | | | | | A/G | — |
| 72693 | A | | | | | | A/G | — |
| 72701 | A | | | | | | A/G | — |
| 73373 | C | | T | T | T | T | T | cds_wt_61 |
| 73467 | C | | T | T | T | T | T | cds_wt_61 |
| 76845 | C | T | T | T | T | T | T | cds_wt_64 |
| 78965 | C | T | T | T | T | T | T | cds_wt_66 |
| 80653 | G | | A | A | A | A | A | cds_wt_67 |
| 85503 | G | | A | A | A | A | A | cds_wt_70 |
| 88269 | G | | A | A | A | A | A | cds_wt_72 |
| 88369 | G | | A | A | A | A | A | cds_wt_72 |
| 89368 | C | T | T | T | T | T | T | cds_wt_72 |
| 89901 | C | | T | T | T | T | T | cds_wt_72 |
| 90029 | C | | T | T | T | T | T | cds_wt_72 |
| 91949 | C | T | T | T | T | T | T | cds_wt_74 |
| 93427 | C | T | T | T | T | T | T | — |
| 101351 | G | | A | A | A | A | A | cds_wt_82 |
| 103967 | C | | | | | | T | cds_wt_84 |
| 104063 | C | T | | T | T | T | T | cds_wt_84 |
| 110857 | C | | T | T | T | T | T | cds_wt_88 |
| 112637 | G | | A | A | A | A | A | cds_wt_90 |
| 114499 | G | | A | A | A | A | A | cds_wt_90 |
| 115250 | G | | A | A | A | A | A | cds_wt_92 |
| 115873 | C | | T | T | T | T | T | cds_wt_92 |
| 115983 | C | | T | | | | T | cds_wt_93 |
| 117494 | C | | T | T | T | T | T | cds_wt_93 |
| 119344 | G | | A | A | A | A | A | cds_wt_94 |
| 134489 | C | T | T | T | T | T | T | cds_wt_106 |
| 139515 | C | | T | T | T | T | T | — |
| 146767 | C | T | T | T | T | T | T | cds_wt_119 |
| 161035 | G | | A | A | A | A | A | cds_wt_133 |
| 172303 | G | | A | A | A | A | A | cds_wt_143 |
| 176176 | G | | | | | A | A | cds_wt_146 |
| 178880 | G | | | | | | G/A | cds_wt_148 |
| 180754 | C | | | T | T | | T | cds_wt_150 |
| 180925 | C | | | T | | | T | cds_wt_150 |
| 184674 | G | | | A | A | A | A | cds_wt_154 |
| 190568 | C | | T | T | T | T | T | cds_wt_159 |
| 190644 | C | | T | T | T | T | T | cds_wt_159 |
| 191971 | C | | T | T | T | T | T | cds_wt_161 |
| 193584 | G | | A | A | A | A | A | cds_wt_162 |
| 196028 | C | | T | T | T | T | T | cds_wt_164 |
| 196338 | C | | T | T | T | T | T | — |
| 214992 | G | | A | A | A | A | A | — |
| 222841 | G | | | | | A | A | cds_wt_187 |
| 222924 | C | | | | | T | T | cds_wt_187 |
| 228543 | C | | | | T | T | T | cds_wt_193 |
| 247200 | C | | | | | T | T | cds_wt_205 |
| 248952 | C | T | T | T | T | T | T | cds_wt_206 |
| 253299 | G | | | | | | A | cds_wt_209 |
| 254551 | G | | | | | | A | cds_wt_210 |
| 259829 | C | | | T | T | | T | — |
| 268705 | C | | T | T | T | T | T | cds_wt_224 |
| 270822 | G | A | A | A | A | A | A | cds_wt_227 |
| 273723 | G | A | | A | A | | A | cds_wt_229 |
| 276430 | C | | T | T | T | T | T | cds_wt_232 |
| 276561 | C | | | T | T | T | T | cds_wt_232 |
| 283007 | G | A | A | A | A | A | A | — |
| 283062 | G | A | A | A | A | A | A | — |
| 287132 | C | | | | T | T | T | cds_wt_247 |
| 294767 | G | | | | | A | A | cds_wt_253 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 295356 | C | T | T | T | T | T | T | cds_wt_254 |
| 300028 | C | | | | | | T | cds_wt_256 |
| 303810 | G | | | | | A | A | cds_wt_259 |
| 313837 | C | | | | | T | T | cds_wt_271 |
| 316698 | G | | | | | A | A | cds_wt_273 |
| 316929 | G | | A | A | A | A | A | cds_wt_273 |
| 325503 | C | T | T | T | T | T | T | cds_wt_283 |
| 331088 | G | | | A | A | | A | — |
| 340040 | G | | A | A | | | A | cds_wt_297 |
| 342987 | G | | A | A | A | A | A | cds_wt_299 |
| 343915 | G | A | A | A | A | A | A | cds_wt_300 |
| 352688 | C | T | T | T | T | T | T | cds_wt_308 |
| 353668 | G | | A | A | A | A | A | cds_wt_308 |
| 361019 | G | | A | A | A | A | A | cds_wt_314 |
| 362742 | G | | A | A | A | A | A | cds_wt_315 |
| 375835 | C | T | T | T | T | T | T | cds_wt_329 |
| 381358 | G | | A | A | | | A | cds_wt_335 |
| 382029 | G | | A | A | A | A | A | cds_wt_335 |
| 391677 | C | T | | T | T | T | T | cds_wt_345 |
| 400166 | C | | T | T | T | T | T | cds_wt_350 |
| 406413 | G | | | A | A | | A | cds_wt_355 |
| 409544 | G | | A | A | A | A | A | cds_wt_358 |
| 416199 | G | | | | | | A | cds_wt_364 |
| 419938 | C | T | T | T | T | T | T | cds_wt_369 |
| 425067 | G | | | | | A | A | cds_wt_374 |
| 425419 | G | | | | | A | A | cds_wt_374 |
| 426464 | G | | A | A | A | A | A | cds_wt_376 |
| 438324 | C | | T | T | T | T | T | cds_wt_385 |
| 446368 | G | | A | A | A | A | A | cds_wt_390 |
| 446984 | G | | A | A | A | A | A | cds_wt_392 |
| 447392 | G | | A | A | A | A | A | — |
| 450492 | G | | | | | | A | cds_wt_395 |
| 458678 | C | | T | T | T | T | T | cds_wt_403 |
| 459753 | C | | | | | | T | — |
| 459833 | A | G | | G | | G | G | cds_wt_405 |
| 466505 | G | | A | A | A | A | A | cds_wt_416 |
| 474923 | G | | | | | | A | cds_wt_423 |
| 482599 | G | | | A | A | A | A | cds_wt_430 |
| 494993 | G | | A | A | A | A | A | cds_wt_445 |
| 500358 | C | T | T | T | T | T | T | cds_wt_449 |
| 510408 | C | | | T | T | T | T | cds_wt_459 |
| 511515 | G | | A | A | A | A | A | cds_wt_460 |
| 512816 | G | | | | | | A | cds_wt_463 |
| 513902 | C | T | T | T | T | T | T | cds_wt_464 |
| 515197 | G | | | | | | A | cds_wt_465 |
| 518156 | G | | A | A | A | A | A | cds_wt_468 |
| 533618 | G | A | A | A | A | A | A | cds_wt_485 |
| 536327 | C | T | | T | T | | T | cds_wt_488 |
| 542891 | G | | A | A | A | A | A | cds_wt_493 |
| 548989 | C | | T | T | T | T | T | cds_wt_496 |
| 553081 | G | | A | A | A | A | A | cds_wt_500 |
| 553332 | G | | A | A | A | A | A | cds_wt_500 |
| 557884 | G | | | | | | A | cds_wt_502 |
| 557907 | G | | | | | | A | cds_wt_502 |
| 567026 | C | T | T | T | T | T | T | — |
| 587166 | A | G | G | G | G | G | G | cds_wt_528 |
| 590721 | G | | | | | | A | cds_wt_530 |
| 602225 | C | T | T | T | T | T | T | cds_wt_543 |
| 604184 | C | | | | | | T | cds_wt_544 |
| 605918 | C | T | T | T | T | T | T | cds_wt_546 |
| 621774 | C | | | | | T | T | — |
| 624361 | C | T | T | T | T | T | T | — |
| 625600 | C | T | T | T | T | T | T | — |
| 626283 | G | | A | A | A | A | A | — |
| 629283 | G | | A | A | A | A | A | cds_wt_565 |
| 636108 | C | | | | | T | T | — |
| 648981 | G | | A | A | A | A | A | cds_wt_582 |
| 684062 | G | | A | A | A | A | A | cds_wt_613 |
| 702171 | C | | | | | T | T | cds_wt_627 |
| 702650 | C | | | | | T | T | cds_wt_627 |
| 703452 | C | | T | T | T | T | T | cds_wt_628 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 706109 | C | | | | | | T | cds_wt_631 |
| 711168 | G | | A | A | A | | A | — |
| 712462 | A | | | | | | A/G | cds_wt_637 |
| 714678 | G | | | A | A | A | A | cds_wt_639 |
| 714785 | G | | A | A | A | A | A | cds_wt_639 |
| 717602 | G | | | A | A | A | A | cds_wt_641 |
| 719600 | G | | | A | A | A | A | cds_wt_643 |
| 724097 | G | | | A | A | A | A | cds_wt_646 |
| 738525 | C | | | | | T | T | cds_wt_655 |
| 744594 | G | | | | | | A | cds_wt_662 |
| 746362 | G | | | A | A | A | A | cds_wt_664 |
| 750285 | C | | T | T | T | T | T | cds_wt_667 |
| 752663 | G | | A | A | A | A | A | cds_wt_670 |
| 763762 | C | | | | | | C/G | — |
| 763785 | G | | | | | | G/C | — |
| 763792 | C | | | | | | C/G | — |
| 763951 | C | | | | | | C/G | — |
| 765635 | G | A | A | A | A | A | A | cds_wt_682 |
| 766073 | G | | A | A | A | A | A | cds_wt_682 |
| 769289 | G | | A | A | A | A | A | cds_wt_686 |
| 776043 | C | | | T | T | T | T | cds_wt_692 |
| 780677 | C | | | | | T | T | — |
| 781916 | C | | | T | T | T | T | cds_wt_698 |
| 783900 | C | | | T | T | T | T | cds_wt_699 |
| 786653 | G | A | A | A | A | A | A | cds_wt_702 |
| 795572 | C | T | T | T | T | T | T | cds_wt_709 |
| 796824 | G | | | A | A | A | A | cds_wt_710 |
| 798663 | G | | | A | A | A | A | cds_wt_712 |
| 810530 | G | | | | | | A | cds_wt_724 |
| 810533 | C | | | | | | G | — |
| 810556 | T | | | | | | T/C | cds_wt_725 |
| 810557 | G | | | | | | G/C | cds_wt_725 |
| 810563 | C | | | | | | C/T | cds_wt_725 |
| 810576 | A | | | | | | A/G | cds_wt_725 |
| 819250 | G | | A | A | A | A | A | cds_wt_730 |
| 829153 | C | T | T | T | T | T | T | cds_wt_739 |
| 830171 | C | | | | | | T | cds_wt_740 |
| 831404 | G | | A | A | A | A | A | cds_wt_741 |
| 838352 | G | | | | | | A | cds_wt_748 |
| 842068 | G | | A | A | A | A | A | cds_wt_750 |
| 847887 | G | | | | | A | A | cds_wt_753 |
| 861775 | C | T | T | T | T | T | T | cds_wt_768 |
| 870304 | G | | A | A | A | A | A | cds_wt_776 |
| 880820 | C | T | T | T | T | T | T | cds_wt_785 |
| 897424 | C | T | T | T | T | T | T | cds_wt_794 |
| 907842 | G | A | A | A | A | A | A | cds_wt_799 |
| 908987 | C | T | T | T | T | T | T | — |
| 921289 | G | | A | A | A | A | A | cds_wt_813 |
| 941088 | G | A | A | A | A | A | A | cds_wt_829 |
| 945666 | G | | | | A | A | A | cds_wt_834 |
| 959932 | C | | | | | | T | cds_wt_847 |
| 964504 | G | | A | A | A | A | A | cds_wt_850 |
| 964558 | C | | | | | T | T | cds_wt_850 |
| 970334 | C | T | T | T | T | T | T | cds_wt_857 |
| 972781 | C | | T | T | T | | T | cds_wt_860 |
| 995285 | G | | A | A | A | A | A | cds_wt_879 |
| 1004653 | C | | | | | | T | — |
| 1006503 | C | T | T | T | T | T | T | cds_wt_889 |
| 1008680 | G | | | | | | A | cds_wt_890 |
| 1009674 | G | A | A | A | A | A | A | cds_wt_893 |
| 1009813 | G | | | | | | A | cds_wt_893 |
| 1023301 | C | | T | T | T | T | T | cds_wt_902 |
| 1028963 | G | | A | A | A | A | A | cds_wt_908 |
| 1030345 | C | T | T | T | T | T | T | cds_wt_910 |
| 1030822 | G | | A | A | A | A | A | cds_wt_911 |
| 1037262 | G | | A | A | A | A | A | cds_wt_917 |
| 1041811 | C | | T | T | T | T | T | cds_wt_919 |
| 1054013 | C | | T | T | T | T | T | — |
| 1055406 | C | T | T | T | T | T | T | — |
| 1082623 | G | | A | A | | | A | cds_wt_952 |
| 1085482 | C | | | | | T | T | cds_wt_953 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 1085499 | C | | T | T | T | T | T | cds_wt_953 |
| 1088995 | C | T | T | T | T | T | T | cds_wt_956 |
| 1097530 | C | | | T | T | T | T | cds_wt_967 |
| 1107807 | T | | | | | | A | — |
| 1117905 | C | | | | | T | T | — |
| 1119169 | G | | | | | A | A | cds_wt_987 |
| 1120103 | G | A | | | | | A | cds_wt_989 |
| 1120852 | G | A | A | A | A | A | A | cds_wt_990 |
| 1122832 | C | | | | | T | T | cds_wt_990 |
| 1123080 | C | | T | T | T | T | T | cds_wt_990 |
| 1128153 | G | | A | A | A | A | A | cds_wt_993 |
| 1130585 | G | | A | A | A | A | A | cds_wt_999 |
| 1145784 | C | | | | | T | T | cds_wt_1014 |
| 1146897 | G | | A | A | A | A | A | cds_wt_1015 |
| 1153166 | C | | | | | | T | cds_wt_1021 |
| 1163219 | C | | | | | T | T | cds_wt_1027 |
| 1163309 | G | | A | A | A | A | A | cds_wt_1027 |
| 1163538 | G | | | A | A | | A | cds_wt_1027 |
| 1169629 | C | | | | T | T | T | cds_wt_1032 |
| 1169882 | C | | | | | T | T | cds_wt_1032 |
| 1170591 | C | | | | T | T | T | cds_wt_1032 |
| 1172808 | C | | | | | T | T | cds_wt_1035 |
| 1172940 | C | | T | T | T | T | T | cds_wt_1035 |
| 1173551 | C | | T | T | T | T | T | cds_wt_1035 |
| 1179238 | C | | T | T | T | T | T | — |
| 1192548 | C | | | | | T | T | cds_wt_1050 |
| 1194346 | C | | T | T | T | T | T | cds_wt_1051 |
| 1194637 | G | A | A | A | A | A | A | cds_wt_1051 |
| 1196403 | C | T | T | T | T | T | T | cds_wt_1053 |
| 1208932 | C | | | | | | T | cds_wt_1065 |
| 1221399 | C | | | | | T | T | cds_wt_1081 |
| 1222202 | C | | T | T | T | T | T | cds_wt_1083 |
| 1225212 | C | | | | | T | T | cds_wt_1086 |
| 1242677 | G | | A | A | A | A | A | cds_wt_1101 |
| 1249095 | C | | | | | T | T | cds_wt_1105 |
| 1250477 | G | | | | | | A | — |
| 1255855 | C | T | T | T | T | T | T | — |
| 1260719 | C | T | | T | T | | T | cds_wt_1114 |
| 1261347 | C | | | | | | T | cds_wt_1114 |
| 1261926 | C | T | T | T | T | T | T | cds_wt_1115 |
| 1262307 | G | | A | A | A | A | A | cds_wt_1115 |
| 1262367 | G | | A | A | A | A | A | cds_wt_1115 |
| 1267545 | C | | | | | T | T | cds_wt_1120 |
| 1270664 | C | | | | | T | T | cds_wt_1122 |
| 1272928 | C | | | | | T | T | cds_wt_1123 |
| 1273797 | C | | | | | T | T | cds_wt_1124 |
| 1277491 | G | A | | A | A | | A | cds_wt_1127 |
| 1282245 | G | | | | | | A | cds_wt_1131 |
| 1284346 | C | | | | | T | T | cds_wt_1134 |
| 1285883 | C | T | T | T | T | T | T | cds_wt_1136 |
| 1291340 | C | | | | | T | T | cds_wt_1144 |
| 1300654 | G | | A | A | A | A | A | cds_wt_1155 |
| 1306705 | C | | | | | T | T | — |
| 1307526 | C | T | T | T | T | T | T | — |
| 1308200 | C | T | T | T | T | T | T | cds_wt_1161 |
| 1315876 | C | | | | | T | T | cds_wt_1170 |
| 1317961 | G | A | A | A | A | A | A | cds_wt_1172 |
| 1321981 | C | | | | T | T | T | cds_wt_1176 |
| 1322304 | C | | | | | T | T | cds_wt_1176 |
| 1325473 | C | | | | | T | T | cds_wt_1179 |
| 1325983 | G | A | A | A | A | A | A | cds_wt_1180 |
| 1327837 | C | | | | | T | T | cds_wt_1183 |
| 1329364 | C | | | | T | T | T | cds_wt_1185 |
| 1330802 | G | | A | A | A | A | A | cds_wt_1186 |
| 1335338 | C | | T | T | T | | T | cds_wt_1189 |
| 1342390 | C | | | | | T | T | cds_wt_1195 |
| 1343472 | A | | | | C | C | C | cds_wt_1196 |
| 1344261 | C | | | | | T | T | cds_wt_1196 |
| 1346995 | C | | | | | T | T | — |
| 1348395 | G | | | | | A | A | cds_wt_1202 |
| 1351344 | C | | | | | T | T | cds_wt_1204 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 1352745 | C | | | | T | T | T | cds_wt_1206 |
| 1356389 | C | | | | T | T | T | — |
| 1359105 | G | | A | A | A | A | A | cds_wt_1210 |
| 1359182 | C | | | | | T | T | cds_wt_1210 |
| 1362032 | C | | | | | T | T | cds_wt_1212 |
| 1370065 | G | | A | A | A | A | A | cds_wt_1221 |
| 1370088 | C | T | T | T | T | T | T | cds_wt_1221 |
| 1379821 | C | | | | | | T | cds_wt_1228 |
| 1382638 | G | | A | A | A | A | A | cds_wt_1232 |
| 1388800 | C | | T | T | T | T | T | cds_wt_1238 |
| 1404278 | C | T | | | | | T | cds_wt_1248 |
| 1409508 | G | | | | | A | A | cds_wt_1254 |
| 1410045 | G | | | | | A | A | — |
| 1413757 | G | | | | | A | A | cds_wt_1259 |
| 1415711 | G | | | | | A | A | cds_wt_1262 |
| 1415773 | G | | | | | A | A | cds_wt_1262 |
| 1418132 | C | | | | | T | T | cds_wt_1264 |
| 1419671 | G | | | | | A | A | cds_wt_1265 |
| 1420016 | C | | | | | T | T | cds_wt_1265 |
| 1428228 | C | | T | T | T | T | T | cds_wt_1270 |
| 1428233 | C | T | T | T | T | T | T | cds_wt_1270 |
| 1435884 | C | | | | | T | T | cds_wt_1279 |
| 1438355 | C | | | | | T | T | cds_wt_1282 |
| 1440872 | G | | | | A | A | A | cds_wt_1282 |
| 1443149 | C | | | | | | T | cds_wt_1285 |
| 1450678 | G | | A | A | A | A | A | cds_wt_1294 |
| 1453590 | G | | A | A | A | A | A | cds_wt_1296 |
| 1454075 | C | | | | | | T | cds_wt_1297 |
| 1455191 | G | | A | A | A | A | A | cds_wt_1298 |
| 1463521 | C | | | T | T | T | T | cds_wt_1303 |
| 1473239 | C | | T | T | T | T | T | cds_wt_1311 |
| 1474775 | G | | | | | A | A | cds_wt_1312 |
| 1482297 | C | | | | T | T | T | cds_wt_1318 |
| 1494980 | G | | | | | A | A | cds_wt_1326 |
| 1502729 | G | A | A | A | A | A | A | cds_wt_1332 |
| 1514463 | C | T | | | | | T | — |
| 1525258 | G | | | | | | A | cds_wt_1357 |
| 1533361 | C | | | | | | T | cds_wt_1364 |
| 1545597 | T | | | | | | T/C | — |
| 1563822 | C | | T | T | T | T | T | cds_wt_1394 |
| 1563854 | C | T | T | T | T | T | T | cds_wt_1394 |
| 1565818 | C | | | | | | T | cds_wt_1396 |
| 1566866 | C | | | | | T | T | cds_wt_1397 |
| 1570236 | G | | | | | A | A | cds_wt_1398 |
| 1570636 | C | T | T | T | T | T | T | cds_wt_1399 |
| 1581033 | T | | C | C | C | C | C | cds_wt_1411 |
| 1594972 | G | A | A | A | A | A | A | cds_wt_1426 |
| 1614616 | C | | T | T | T | T | T | cds_wt_1441 |
| 1615586 | C | | T | T | T | T | T | cds_wt_1441 |
| 1616152 | C | | T | T | T | T | T | cds_wt_1442 |
| 1616981 | C | | | T | T | T | T | cds_wt_1443 |
| 1617561 | C | | | T | | T | T | cds_wt_1443 |
| 1617928 | C | T | T | T | T | T | T | cds_wt_1444 |
| 1622589 | G | A | A | A | A | A | A | cds_wt_1447 |
| 1641656 | C | T | | | | | T | cds_wt_1457 |
| 1641711 | C | | | | | | T | cds_wt_1457 |
| 1641953 | C | | T | | | T | T | cds_wt_1458 |
| 1648653 | G | | A | A | A | A | A | cds_wt_1466 |
| 1648676 | G | | A | A | A | A | A | cds_wt_1466 |
| 1649444 | C | | | | | T | T | — |
| 1650400 | G | A | A | A | A | A | A | — |
| 1658589 | G | | | | | A | A | cds_wt_1467 |
| 1661376 | G | | | | | | A | cds_wt_1469 |
| 1664324 | C | | | | | T | T | cds_wt_1474 |
| 1680524 | C | T | T | T | T | T | T | cds_wt_1485 |
| 1682349 | G | | A | A | A | A | A | cds_wt_1485 |
| 1682842 | C | | | | | T | T | cds_wt_1486 |
| 1686608 | C | | | | T | T | T | cds_wt_1490 |
| 1695571 | C | | T | T | T | T | T | cds_wt_1495 |
| 1699167 | G | | A | A | A | A | A | cds_wt_1499 |
| 1700705 | G | | | | | | A | cds_wt_1501 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 1715788 | T | | | | | | C | cds_wt_1517 |
| 1727072 | G | | A | A | A | A | A | cds_wt_1526 |
| 1747963 | C | T | T | T | T | T | T | cds_wt_1546 |
| 1748448 | C | | | | | T | T | cds_wt_1547 |
| 1778278 | C | | | | | T | T | cds_wt_1569 |
| 1779396 | C | | T | T | T | T | T | cds_wt_1570 |
| 1779723 | C | | T | T | T | T | T | cds_wt_1570 |
| 1792608 | G | | A | A | A | A | A | cds_wt_1583 |
| 1793069 | C | | | | | T | T | cds_wt_1584 |
| 1795610 | C | | | | | T | T | cds_wt_1588 |
| 1803172 | C | | T | T | T | T | T | — |
| 1805902 | C | T | T | T | T | T | T | cds_wt_1595 |
| 1815104 | C | T | T | T | T | T | T | cds_wt_1601 |
| 1848170 | G | | | | | | A | cds_wt_1640 |
| 1858054 | C | | | | T | T | T | cds_wt_1649 |
| 1874864 | G | | A | A | A | A | A | cds_wt_1664 |
| 1878368 | C | | T | T | T | T | T | cds_wt_1669 |
| 1878456 | C | | T | T | T | T | T | cds_wt_1669 |
| 1881797 | G | | A | A | A | A | A | cds_wt_1671 |
| 1881821 | G | | A | A | A | A | A | cds_wt_1671 |
| 1883780 | G | | A | A | A | A | A | cds_wt_1673 |
| 1886024 | G | A | A | A | A | A | A | cds_wt_1677 |
| 1886177 | G | | A | A | A | A | A | cds_wt_1677 |
| 1886499 | G | A | A | A | A | A | A | cds_wt_1677 |
| 1888003 | G | | | | | | A | cds_wt_1678 |
| 1888277 | G | | A | A | A | A | A | — |
| 1891012 | G | | A | A | A | A | A | cds_wt_1680 |
| 1891205 | C | T | T | T | T | T | T | cds_wt_1681 |
| 1891493 | G | | A | A | A | A | A | cds_wt_1682 |
| 1891608 | G | | A | A | A | A | A | cds_wt_1682 |
| 1895230 | C | | | | | | T | cds_wt_1683 |
| 1896121 | G | | A | A | A | A | A | cds_wt_1684 |
| 1898465 | G | | A | A | A | A | A | cds_wt_1686 |
| 1904126 | G | | A | A | A | A | A | cds_wt_1689 |
| 1904415 | G | | A | A | A | A | A | cds_wt_1689 |
| 1918600 | G | | | | | A | A | cds_wt_1702 |
| 1926767 | G | | | | | A | A | cds_wt_1710 |
| 1930239 | G | A | A | A | A | A | A | — |
| 1933689 | G | | A | A | A | A | A | cds_wt_1718 |
| 1935111 | G | | | A | A | A | A | cds_wt_1721 |
| 1938524 | G | | A | A | A | A | A | cds_wt_1725 |
| 1941158 | G | | A | A | A | A | A | cds_wt_1729 |
| 1950155 | C | | | | T | | T | cds_wt_1737 |
| 1961896 | C | | | | T | T | T | cds_wt_1749 |
| 1964247 | C | | | | | | T | — |
| 1971635 | A | | | | | C | C | cds_wt_1755 |
| 1973884 | G | | A | A | A | A | A | cds_wt_1756 |
| 1985968 | G | A | A | A | A | A | A | cds_wt_1769 |
| 1986215 | C | | | | | | T | cds_wt_1769 |
| 1987891 | C | | | | | T | T | cds_wt_1770 |
| 1987907 | C | | | | | T | T | cds_wt_1770 |
| 1993612 | G | | A | A | A | A | A | cds_wt_1778 |
| 1997079 | C | | T | T | T | T | T | cds_wt_1783 |
| 2043866 | G | | | | | A | A | cds_wt_1830 |
| 2043889 | G | | | | | A | A | cds_wt_1830 |
| 2048938 | C | | | | | | T | cds_wt_1835 |
| 2058063 | G | | A | A | A | A | A | cds_wt_1841 |
| 2058998 | G | A | A | A | A | A | A | cds_wt_1841 |
| 2060664 | G | | A | A | A | A | A | cds_wt_1843 |
| 2060796 | G | | A | A | A | A | A | cds_wt_1843 |
| 2067415 | G | | | | | | A | — |
| 2067911 | G | A | A | A | A | A | A | cds_wt_1851 |
| 2071535 | G | | | | | | A | cds_wt_1854 |
| 2077305 | A | | | | | | G/A | — |
| 2077309 | T | | | | | | C/T | — |
| 2077321 | A | | | | | | G/A | — |
| 2077324 | G | | | | | | A/G | — |
| 2077336 | A | | | | | | G/A | — |
| 2077351 | C | | | | | | T/C | — |
| 2077353 | A | | | | | | G/A | — |
| 2077369 | C | | | | | | T/C | — |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 2077383 | G | G/A | G/A | G/A | G/A | G/A | A/G | — |
| 2077384 | C | C/G | C/G | C/G | C/G | C/G | G/C | — |
| 2077398 | G | G/C | G/C | G/C | G/C | G/C | G/C | — |
| 2077432 | T | | | | | | C/T | — |
| 2077603 | A | | | | | | G/A | cds_wt_1862 |
| 2077615 | C | | | | | | A/C | cds_wt_1862 |
| 2077618 | G | | | | | | A/G | cds_wt_1862 |
| 2077636 | T | | | | | | C/T | cds_wt_1862 |
| 2077645 | G | | | | | | C/G | cds_wt_1862 |
| 2077651 | G | | | | | | C/G | cds_wt_1862 |
| 2077652 | A | | | | | | G/A | cds_wt_1862 |
| 2077654 | A | | | | | | G/A | cds_wt_1862 |
| 2077663 | C | | | | | | A/C | cds_wt_1862 |
| 2077669 | G | | | | | | C/G | cds_wt_1862 |
| 2077671 | T | | | | | | C/T | cds_wt_1862 |
| 2077682 | C | | | | | | G/C | cds_wt_1862 |
| 2077688 | G | | | | | | A/G | cds_wt_1862 |
| 2077691 | C | | | | | | G/C | cds_wt_1862 |
| 2077694 | A | | | | | | C/A | cds_wt_1862 |
| 2077697 | G | | | | | | C/G | cds_wt_1862 |
| 2077703 | T | | | | | | G/T | cds_wt_1862 |
| 2077715 | G | | | | | | A/G | cds_wt_1862 |
| 2077724 | A | | | | | | G/A | cds_wt_1862 |
| 2077726 | C | | | | | | T/C | cds_wt_1862 |
| 2077730 | G | | | | | | C/G | cds_wt_1862 |
| 2077733 | G | | | | | | A/G | cds_wt_1862 |
| 2077736 | C | | | | | | C/T | cds_wt_1862 |
| 2077742 | G | | | | | | C/G | cds_wt_1862 |
| 2077745 | A | | | | | | G/A | cds_wt_1862 |
| 2077751 | G | | | | | | A/G | cds_wt_1862 |
| 2077762 | T | | | | | | C/T | cds_wt_1862 |
| 2077769 | T | | | | | | C/T | cds_wt_1862 |
| 2077772 | A | | | | | | G/A | cds_wt_1862 |
| 2077775 | G | | | | | | A/G | cds_wt_1862 |
| 2077793 | G | | | | | | C/G | cds_wt_1862 |
| 2077794 | A | | | | | | G/A | cds_wt_1862 |
| 2077795 | C | | | | | | T/C | cds_wt_1862 |
| 2077805 | C | | | | | | T/C | cds_wt_1862 |
| 2080486 | C | | | | | | T | cds_wt_1864 |
| 2086608 | G | | A | A | A | A | A | cds_wt_1866 |
| 2096915 | G | | A | A | A | A | A | cds_wt_1878 |
| 2098836 | C | T | T | T | T | T | T | cds_wt_1880 |
| 2099830 | G | | | | | | A | cds_wt_1880 |
| 2126265 | C | | T | T | T | T | T | — |
| 2131730 | G | | A | A | A | A | A | cds_wt_1909 |
| 2135109 | C | | | | | | T | cds_wt_1912 |
| 2136848 | C | | T | T | T | T | T | — |
| 2144528 | G | A | A | A | A | A | A | cds_wt_1918 |
| 2147486 | G | | A | A | A | A | A | cds_wt_1921 |
| 2154132 | C | T | T | T | T | T | T | cds_wt_1927 |
| 2154136 | C | T | T | T | T | T | T | cds_wt_1927 |
| 2188490 | C | | | | T | T | T | cds_wt_1959 |
| 2191494 | C | T | T | T | T | T | T | cds_wt_1960 |
| 2199567 | G | | A | A | A | A | A | cds_wt_1969 |
| 2208975 | G | A | A | A | A | A | A | cds_wt_1977 |
| 2212324 | G | | | | A | A | A | cds_wt_1979 |
| 2212659 | G | | A | A | A | A | A | cds_wt_1980 |
| 2230643 | G | | A | A | A | A | A | cds_wt_1996 |
| 2235434 | G | | A | A | A | A | A | cds_wt_2000 |
| 2250499 | C | T | T | T | T | T | T | cds_wt_2012 |
| 2259118 | C | | | T | T | | T | cds_wt_2019 |
| 2260582 | G | | | | | | A | cds_wt_2019 |
| 2266821 | C | T | T | | T | T | T | cds_wt_2023 |
| 2271223 | G | A | A | A | A | A | A | cds_wt_2027 |
| 2273696 | C | T | T | T | T | T | T | — |
| 2277990 | C | T | | | | | T | cds_wt_2031 |
| 2291798 | C | | T | T | T | T | T | cds_wt_2032 |
| 2293101 | C | | | | | | C/T | cds_wt_2033 |
| 2293102 | G | | | | | | G/T | cds_wt_2033 |
| 2293121 | G | C/G | C/G | C/G | C/G | C/G | G/C | cds_wt_2033 |
| 2293139 | A | C/A | C/A | C/A | C/A | C/A | A/C | cds_wt_2033 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 2293157 | G | G/A | G/A | G/A | G/A | G/A | G/A | cds_wt_2033 |
| 2293169 | G | | | | | | G/C | cds_wt_2033 |
| 2293175 | G | | | | | | G/A | cds_wt_2033 |
| 2293176 | A | | | | | | A/T | cds_wt_2033 |
| 2293184 | C | | | | | | C/G | cds_wt_2033 |
| 2293185 | G | | | | | | G/A | cds_wt_2033 |
| 2293187 | A | | | | | | A/G | cds_wt_2033 |
| 2293196 | G | | | | | | A/G | cds_wt_2033 |
| 2293202 | G | | | | | | G/C | cds_wt_2033 |
| 2293205 | G | | | | | | C/G | cds_wt_2033 |
| 2293214 | G | | | | | | G/C | cds_wt_2033 |
| 2293219 | A | | | | | | A/T | cds_wt_2033 |
| 2293220 | G | | | | | | G/C | cds_wt_2033 |
| 2293226 | G | | | | | | C/G | cds_wt_2033 |
| 2293228 | G | | | | | | G/A | cds_wt_2033 |
| 2293234 | A | | | | | | A/T | cds_wt_2033 |
| 2293235 | G | | | | | | G/C | cds_wt_2033 |
| 2293238 | G | | | | | | G/C | cds_wt_2033 |
| 2293244 | G | | | | | | G/C | cds_wt_2033 |
| 2293247 | G | | | | | | A/G | cds_wt_2033 |
| 2293253 | G | G/A | A | G/A | G/A | A/G | A/G | cds_wt_2033 |
| 2293268 | G | G/C | C | C | C | C | C/G | cds_wt_2033 |
| 2293310 | G | | | | | | G/A | cds_wt_2033 |
| 2293313 | G | | | | | | G/C | cds_wt_2033 |
| 2293316 | G | | | | | | G/A | cds_wt_2033 |
| 2293319 | G | | | | | | G/A | cds_wt_2033 |
| 2293328 | G | | | | | | G/C | cds_wt_2033 |
| 2293337 | G | | | | | | G/C | cds_wt_2033 |
| 2293346 | G | | | | | | G/C | cds_wt_2033 |
| 2293352 | C | | | | | | C/G | cds_wt_2033 |
| 2293367 | G | G/C | C/G | G/C | | | G/C | cds_wt_2033 |
| 2293376 | C | G/C | G/C | C/G | C/G | C/G | C/G | cds_wt_2033 |
| 2293403 | C | | | | | | C/G | cds_wt_2033 |
| 2293463 | C | | | | | | C/G | cds_wt_2033 |
| 2302130 | G | | | | | | A | cds_wt_2039 |
| 2312744 | C | | | | | T | T | cds_wt_2051 |
| 2313183 | G | | | A | A | | A | cds_wt_2051 |
| 2315988 | C | T | T | T | T | T | T | cds_wt_2052 |
| 2323085 | C | T | T | T | T | T | T | cds_wt_2057 |
| 2329242 | C | T | T | T | T | T | T | cds_wt_2063 |
| 2332081 | G | | A | A | A | A | A | cds_wt_2066 |
| 2341627 | C | | | | T | | T | cds_wt_2073 |
| 2347673 | C | T | T | T | T | T | T | cds_wt_2076 |
| 2348681 | G | A | A | A | A | A | A | cds_wt_2077 |
| 2359598 | G | | A | A | A | A | A | cds_wt_2088 |
| 2362060 | A | | | | | | G | cds_wt_2091 |
| 2368326 | G | | | | | A | A | cds_wt_2097 |
| 2376154 | G | A | A | A | A | A | A | cds_wt_2107 |
| 2380176 | C | | T | T | T | T | T | cds_wt_2113 |
| 2382542 | C | | T | T | T | T | T | cds_wt_2115 |
| 2382567 | C | | T | T | T | T | T | cds_wt_2115 |
| 2382748 | C | T | T | T | T | T | T | — |
| 2389975 | C | | | | T | T | T | — |
| 2392147 | C | | | | T | T | T | cds_wt_2122 |
| 2396255 | G | | | | | A | A | cds_wt_2123 |
| 2415101 | G | | A | A | A | | A | cds_wt_2140 |
| 2422620 | C | | | | T | T | T | cds_wt_2147 |
| 2437185 | G | | A | A | A | A | A | cds_wt_2158 |
| 2448470 | G | | A | A | A | A | A | cds_wt_2169 |
| 2452760 | G | | A | A | A | A | A | cds_wt_2173 |
| 2456608 | C | | | | T | T | T | cds_wt_2175 |
| 2459347 | C | | | | T | T | T | cds_wt_2177 |
| 2459641 | G | | | | | A | A | cds_wt_2178 |
| 2460824 | C | | | | T | T | T | cds_wt_2180 |
| 2463427 | C | | | | | | T | cds_wt_2182 |
| 2482048 | C | T | T | T | T | T | T | cds_wt_2197 |
| 2482381 | G | A | A | A | A | A | A | cds_wt_2197 |
| 2483453 | C | | T | T | T | T | T | cds_wt_2199 |
| 2487377 | G | A | A | A | A | A | A | cds_wt_2203 |
| 2489641 | G | | A | A | A | A | A | cds_wt_2206 |
| 2492054 | G | | | | | A | A | — |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 2502775 | G | | | | | A | A | — |
| 2515457 | G | | | | | A | A | cds_wt_2228 |
| 2518872 | G | | | A | A | A | A | cds_wt_2232 |
| 2530466 | G | | A | A | A | A | A | cds_wt_2252 |
| 2532233 | G | | A | A | A | A | A | cds_wt_2256 |
| 2533237 | G | | A | A | A | A | A | cds_wt_2259 |
| 2536306 | G | | A | A | A | A | A | — |
| 2538874 | G | | A | A | A | A | A | cds_wt_2265 |
| 2542087 | G | | A | A | A | A | A | cds_wt_2270 |
| 2544720 | C | | | | | T | T | cds_wt_2270 |
| 2553277 | G | | | | | | A | cds_wt_2277 |
| 2556662 | C | | | | | T | T | cds_wt_2283 |
| 2559280 | G | A | A | A | A | A | A | — |
| 2562212 | G | | | | | A | A | cds_wt_2288 |
| 2564253 | G | | | | | A | A | — |
| 2564620 | G | | | | | A | A | — |
| 2566353 | G | | | | | A | A | cds_wt_2290 |
| 2572994 | G | | A | A | A | A | A | cds_wt_2297 |
| 2573153 | C | | T | T | T | T | T | cds_wt_2297 |
| 2575327 | G | | | | A | | A | cds_wt_2299 |
| 2599645 | G | | | | | A | A | cds_wt_2323 |
| 2599894 | G | | | | | A | A | cds_wt_2324 |
| 2601319 | G | | | | | A | A | cds_wt_2324 |
| 2606340 | G | | | | | A | A | cds_wt_2330 |
| 2608948 | G | | | | | A | A | cds_wt_2334 |
| 2610422 | C | | | | | T | T | — |
| 2614778 | G | | | | | | A | cds_wt_2339 |
| 2617082 | G | | | | | A | A | cds_wt_2340 |
| 2618776 | C | | T | T | T | T | T | cds_wt_2342 |
| 2618805 | C | | T | T | T | T | T | cds_wt_2342 |
| 2620558 | G | | | | | A | A | cds_wt_2344 |
| 2626414 | A | | | G | G | G | G | cds_wt_2350 |
| 2636037 | C | | | | | T | T | cds_wt_2357 |
| 2639682 | G | | | | | A | A | cds_wt_2361 |
| 2642753 | G | | A | A | A | A | A | cds_wt_2364 |
| 2644984 | C | | | | | T | T | cds_wt_2364 |
| 2651718 | C | | T | T | T | T | T | cds_wt_2367 |
| 2652733 | C | | | | | T | T | cds_wt_2368 |
| 2653074 | C | | | | | T | T | cds_wt_2368 |
| 2653159 | C | T | T | T | T | T | T | cds_wt_2368 |
| 2653337 | G | | A | A | A | A | A | cds_wt_2369 |
| 2655271 | C | | | | | | T | cds_wt_2371 |
| 2655308 | C | | | | | | T | cds_wt_2371 |
| 2657059 | C | | | | | T | T | cds_wt_2371 |
| 2658261 | G | | | | | A | A | cds_wt_2372 |
| 2659295 | C | | | | | T | T | cds_wt_2373 |
| 2663775 | C | | | | | T | T | cds_wt_2376 |
| 2670944 | C | | | | | T | T | cds_wt_2378 |
| 2671043 | C | | | | | T | T | cds_wt_2378 |
| 2672551 | C | | | | | T | T | cds_wt_2380 |
| 2676880 | C | T | T | T | T | T | T | cds_wt_2382 |
| 2677056 | G | | A | A | A | A | A | cds_wt_2382 |
| 2677196 | C | T | T | T | T | T | T | cds_wt_2382 |
| 2678066 | G | | A | A | A | A | A | cds_wt_2382 |
| 2679900 | C | | | | | T | T | cds_wt_2383 |
| 2686364 | C | | | | | T | T | cds_wt_2390 |
| 2687028 | C | | | | | T | T | cds_wt_2391 |
| 2688632 | C | | | | | T | T | cds_wt_2392 |
| 2694405 | G | | | | | | A | cds_wt_2396 |
| 2701281 | G | | | | | A | A | cds_wt_2403 |
| 2712327 | G | | | | | A | A | — |
| 2720850 | C | T | T | T | T | T | T | cds_wt_2418 |
| 2728435 | G | | | | | A | A | cds_wt_2425 |
| 2731397 | G | | A | A | A | A | A | cds_wt_2428 |
| 2735550 | G | G/A | G/A | G/A | G/A | G/A | G/A | — |
| 2735576 | G | | | | | | G/C | — |
| 2738768 | C | | | T | T | T | T | cds_wt_2433 |
| 2744600 | C | T | T | T | T | T | T | cds_wt_2438 |
| 2748694 | C | T | T | T | T | T | T | cds_wt_2442 |
| 2756873 | C | | T | T | T | T | T | cds_wt_2449 |
| 2760595 | G | | | | | A | A | — |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 2762887 | G | | | A | A | A | A | cds_wt_2453 |
| 2763137 | G | | A | A | A | A | A | cds_wt_2453 |
| 2764279 | C | | T | T | T | T | T | cds_wt_2454 |
| 2766645 | C | | | T | T | T | T | cds_wt_2456 |
| 2770562 | C | | | | | T | T | — |
| 2773173 | C | T | T | T | T | T | T | cds_wt_2462 |
| 2774095 | G | | A | A | A | A | A | cds_wt_2464 |
| 2774734 | G | | A | A | A | A | A | cds_wt_2465 |
| 2774874 | G | | A | A | A | A | A | cds_wt_2465 |
| 2776314 | C | | | | | T | T | cds_wt_2466 |
| 2776919 | C | | T | T | T | T | T | cds_wt_2467 |
| 2778598 | G | | | | | A | A | cds_wt_2468 |
| 2779539 | G | | | | | A | A | — |
| 2782696 | C | | | | | T | T | cds_wt_2473 |
| 2783578 | C | | | | | T | T | — |
| 2783738 | C | | | | | T | T | cds_wt_2474 |
| 2785372 | C | | | | | T | T | cds_wt_2475 |
| 2785531 | C | | | | | T | T | cds_wt_2475 |
| 2787379 | G | | A | A | A | A | A | cds_wt_2476 |
| 2788015 | C | | | | | T | T | cds_wt_2477 |
| 2788247 | C | | | | | T | T | cds_wt_2477 |
| 2789216 | C | | T | T | T | T | T | cds_wt_2478 |
| 2790626 | C | | T | T | T | T | T | cds_wt_2479 |
| 2791577 | C | | | | | T | T | cds_wt_2480 |
| 2792510 | C | | | | | T | T | cds_wt_2481 |
| 2792715 | G | A | A | A | A | A | A | cds_wt_2481 |
| 2797814 | C | T | T | T | T | T | T | cds_wt_2487 |
| 2799953 | C | | T | T | T | T | T | cds_wt_2489 |
| 2800033 | C | | | | | T | T | cds_wt_2489 |
| 2802765 | C | | | | | T | T | — |
| 2803789 | C | | T | T | T | T | T | cds_wt_2493 |
| 2804694 | C | | T | T | T | T | T | cds_wt_2494 |
| 2806670 | C | | T | T | T | T | T | cds_wt_2496 |
| 2814611 | G | | | | | | A | — |
| 2815199 | C | | | | | | C/T | cds_wt_2502 |
| 2816239 | G | | | | | | A | cds_wt_2503 |
| 2821693 | G | | | | A | A | A | cds_wt_2509 |
| 2838356 | C | | | | | T | T | — |
| 2841171 | T | | | | | | T/A | cds_wt_2526 |
| 2841177 | C | | | | | | C/G | cds_wt_2526 |
| 2841183 | C | | | | | | C/G | cds_wt_2526 |
| 2841213 | T | | | | | | T/C | cds_wt_2526 |
| 2841228 | C | | | | | | C/G | cds_wt_2526 |
| 2841237 | G | | | | | | G/C | cds_wt_2526 |
| 2841251 | G | | | | | | G/T | cds_wt_2526 |
| 2841255 | C | | | | | | C/G | cds_wt_2526 |
| 2841258 | G | | | | | | G/T | cds_wt_2526 |
| 2841276 | C | G/C | | G | G | G | C/G | cds_wt_2526 |
| 2841293 | C | | | | | | C/G | cds_wt_2526 |
| 2841297 | C | | | | | | C/A | cds_wt_2526 |
| 2841303 | C | | | | | | C/T | cds_wt_2526 |
| 2841306 | G | | | | | | G/A | cds_wt_2526 |
| 2841312 | T | | | | | | C/T | cds_wt_2526 |
| 2841315 | C | | | | | | G/C | cds_wt_2526 |
| 2841322 | A | | | | | | A/T | cds_wt_2526 |
| 2841323 | G | | | | | | G/T | cds_wt_2526 |
| 2841327 | C | | | | | | G/C | cds_wt_2526 |
| 2841335 | G | | | | | | C/G | cds_wt_2526 |
| 2841357 | G | | | | | | C/G | cds_wt_2526 |
| 2841360 | G | | | | | | C/G | cds_wt_2526 |
| 2841369 | G | | | | | | C/G | cds_wt_2526 |
| 2841376 | T | | | | | | T/C | cds_wt_2526 |
| 2841377 | G | | | | | | T/G | cds_wt_2526 |
| 2841384 | G | | | | | | C/G | cds_wt_2526 |
| 2841389 | T | | | | | | T/C | cds_wt_2526 |
| 2841397 | G | | | | | | G/T | cds_wt_2526 |
| 2841398 | A | | | | | | C/A | cds_wt_2526 |
| 2841402 | G | | | | | | A/G | cds_wt_2526 |
| 2841403 | G | | | | | | C/G | cds_wt_2526 |
| 2841409 | T | | | | | | A/T | cds_wt_2526 |
| 2841413 | G | | | | | | T/G | cds_wt_2526 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 2841423 | C | | | | | | G/C | cds_wt_2526 |
| 2841444 | G | | | | | | C/G | cds_wt_2526 |
| 2841451 | C | | | | | | T/C | cds_wt_2526 |
| 2841477 | C | | | | | | G/C | cds_wt_2526 |
| 2841514 | G | | | | | | T/G | cds_wt_2526 |
| 2841531 | A | | | | | | G/A | cds_wt_2526 |
| 2841534 | G | | | | | | C/G | cds_wt_2526 |
| 2841536 | T | | | | | | A/T | cds_wt_2526 |
| 2841540 | C | | | | | | C/G | cds_wt_2526 |
| 2841546 | G | | | | | | C/G | cds_wt_2526 |
| 2841552 | G | | | | | | C | cds_wt_2526 |
| 2841554 | T | | | | | | C/T | cds_wt_2526 |
| 2841555 | C | | | | | | T/C | cds_wt_2526 |
| 2841562 | C | | | | | | T/C | cds_wt_2526 |
| 2841563 | A | | | | | | C/A | cds_wt_2526 |
| 2841569 | A | | | | | | C/A/T | cds_wt_2526 |
| 2841575 | C | | | | | | T/C | cds_wt_2526 |
| 2841585 | C | | | | | | C/G | cds_wt_2526 |
| 2841588 | G | | | | | | C/G | cds_wt_2526 |
| 2841594 | G | | | | | | A/G | cds_wt_2526 |
| 2841605 | C | | | | | | C/A | cds_wt_2526 |
| 2841609 | C | | | | | | C/G | cds_wt_2526 |
| 2841617 | T | | | | | | G/T | cds_wt_2526 |
| 2841636 | G | C | | C | C | | C/G | cds_wt_2526 |
| 2841656 | A | | | | | | C/A | cds_wt_2526 |
| 2841660 | G | | | | | | C/G | cds_wt_2526 |
| 2841668 | C | | | | | | T/C | cds_wt_2526 |
| 2841690 | G | | | | | | C/G | — |
| 2841700 | G | | | | | | T | — |
| 2841701 | C | | | | | | T | — |
| 2841708 | G | | | | | | A/G | — |
| 2841734 | T | | | | | | C | — |
| 2841735 | C | | | | | | T | — |
| 2841738 | G | | | | | | C | — |
| 2841744 | C | | | | | | G/C | — |
| 2841747 | G | | | | | | A | — |
| 2841756 | C | | | | | | G | — |
| 2841759 | G | | | | | | C | — |
| 2841762 | C | | | | | | G | — |
| 2841776 | G | | | | | | T | — |
| 2841778 | T | | | | | | G | — |
| 2841783 | G | | | | | | C | — |
| 2841786 | A | | | | | | T | — |
| 2841789 | C | | | | | | T | — |
| 2845157 | G | | A | A | A | A | A | cds_wt_2528 |
| 2850318 | G | | | A | A | A | A | cds_wt_2533 |
| 2851372 | G | | | | | | A | cds_wt_2534 |
| 2853353 | C | | T | T | T | T | T | cds_wt_2535 |
| 2853817 | G | | | | | | A | cds_wt_2535 |
| 2868405 | C | T | T | T | T | T | T | cds_wt_2548 |
| 2874011 | C | | T | T | T | T | T | cds_wt_2551 |
| 2875055 | G | | A | A | A | A | A | — |
| 2875488 | G | | | | A | A | A | — |
| 2876911 | G | A | | | | | A | cds_wt_2553 |
| 2882407 | C | | T | T | T | T | T | cds_wt_2558 |
| 2888545 | C | | T | T | T | T | T | cds_wt_2562 |
| 2890510 | C | T | T | T | T | T | T | cds_wt_2565 |
| 2892791 | G | | | | | | A | cds_wt_2566 |
| 2896239 | G | A | | | | | A | cds_wt_2568 |
| 2896828 | G | A | A | A | A | A | A | cds_wt_2568 |
| 2896833 | G | A | A | A | A | A | A | cds_wt_2568 |
| 2899845 | C | T | T | T | T | T | T | — |
| 2899865 | C | T | T | T | T | T | T | — |
| 2901123 | C | | T | T | T | T | T | cds_wt_2572 |
| 2905469 | C | | T | T | T | T | T | cds_wt_2574 |
| 2912026 | G | A | A | A | A | A | A | cds_wt_2580 |
| 2921100 | C | | | | | T | T | cds_wt_2587 |
| 2934976 | G | A | A | A | A | A | A | — |
| 2935134 | G | | | | | | A | — |
| 2935223 | G | | | | A | A | A | — |
| 2945715 | G | | A | A | A | A | A | cds_wt_2611 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 2953167 | C | T | T | T | T | T | T | cds_wt_2616 |
| 2956464 | C | T | T | T | T | T | T | cds_wt_2620 |
| 2965167 | G | | | | | | A | cds_wt_2630 |
| 2971031 | C | T | T | T | T | T | T | cds_wt_2633 |
| 2971761 | C | T | T | T | T | T | T | cds_wt_2633 |
| 2973653 | C | T | T | T | T | T | T | cds_wt_2634 |
| 2976296 | C | T | | | | | T | cds_wt_2637 |
| 2978371 | C | T | T | T | T | T | T | cds_wt_2638 |
| 2983351 | G | | A | A | A | A | A | cds_wt_2644 |
| 2986416 | C | T | T | T | T | T | T | cds_wt_2649 |
| 2987675 | C | T | T | T | T | T | T | cds_wt_2650 |
| 2988967 | C | T | T | T | T | T | T | cds_wt_2650 |
| 2992035 | C | | | | | T | T | cds_wt_2651 |
| 2993614 | A | | | | | | G | cds_wt_2652 |
| 2994097 | G | A | A | A | A | A | A | cds_wt_2652 |
| 3000921 | G | A | A | A | A | A | A | cds_wt_2658 |
| 3002748 | G | | | | A | A | A | cds_wt_2659 |
| 3003382 | G | | | | A | A | A | — |
| 3005352 | G | | | | A | A | A | cds_wt_2662 |
| 3006201 | C | | | | T | | T | cds_wt_2662 |
| 3021497 | G | | A | A | A | A | A | cds_wt_2674 |
| 3026718 | C | | | | | T | T | — |
| 3027132 | G | | | | A | A | A | — |
| 3031683 | C | | T | T | T | T | T | — |
| 3032969 | C | | T | T | T | T | T | — |
| 3044082 | G | | | | | | A | cds_wt_2679 |
| 3045579 | G | A | A | A | A | A | A | cds_wt_2679 |
| 3049857 | G | | | | | | A | cds_wt_2681 |
| 3066905 | C | | | | | T | T | cds_wt_2697 |
| 3079916 | T | | | | | | A/T | — |
| 3079923 | C | | | | | | C/T | — |
| 3079936 | G | | | | | | A/G | — |
| 3079950 | A | T/A | | | | | T/A | — |
| 3080004 | C | | | | | | C/T | — |
| 3080006 | A | | | | | | T/A | — |
| 3080035 | C | C/T | | | | | C/T | cds_wt_2713 |
| 3080043 | A | C/A | C/A | C/A | C/A | C/A | C/A | cds_wt_2713 |
| 3080063 | G | C/G | C/G | C/G | C/G | C/G | C/G | cds_wt_2713 |
| 3080084 | C | C/T | C/T | C/T | C/T | C/T | C/T | cds_wt_2713 |
| 3080087 | G | G/C/T | G/C/T | C/G/T | G/C/T | G/T/C | C/T/G | cds_wt_2713 |
| 3080098 | C | | | | | C/A | C/A | cds_wt_2713 |
| 3080128 | C | | | | | T/C | T/C | cds_wt_2713 |
| 3080136 | A | | | | | G/A | G/A | cds_wt_2713 |
| 3080160 | C | | | | | | G/C | cds_wt_2713 |
| 3080161 | T | | | | | | C/T | cds_wt_2713 |
| 3080163 | T | | | | | | C/T | cds_wt_2713 |
| 3080183 | T | T/C | T/C | T/C | T/C | T/C | C/T | cds_wt_2713 |
| 3080192 | G | C/G | C/G | C/G | C/G | C/G | C/G | cds_wt_2713 |
| 3080204 | G | C/G | C/G | C/G | C/G | C/G | C/G | cds_wt_2713 |
| 3080237 | G | | | | | | C/G | cds_wt_2713 |
| 3080288 | G | | | | | | C/G | cds_wt_2713 |
| 3080294 | G | | | | | | T/G | cds_wt_2713 |
| 3080316 | C | | | | | | C/T | — |
| 3080321 | T | T/C | T/C | T/C | T/C | T/C | — |  |
| 3080325 | G | G/T | G/T | G/T | G/T | G/T | T/G | — |
| 3080326 | C | C/T | C/T | C/T | C/T | C/T | T/C | — |
| 3080355 | A | A/T | A/T | A/T | A/T | A/T | T/A | — |
| 3080356 | A | | | | | | A/G | — |
| 3080357 | A | A/G | A/G | A/G | A/G | A/G | A/G | — |
| 3080359 | A | | | | | | A/G | — |
| 3080372 | A | A/G | A/G | A/G | A/G | A/G | A/G | — |
| 3080375 | A | | | | | | A/C | — |
| 3080382 | G | | | | | | G/A | — |
| 3080391 | A | | | | | | A/G | — |
| 3080393 | C | | | | | | C/T | — |
| 3080394 | G | | | | | | G/A | — |
| 3080402 | A | | | | | | A/G | — |
| 3080406 | A | | | | | | A/G | — |
| 3080418 | A | | | | | | A/G | — |
| 3080447 | C | | | | | | C/T | — |
| 3080465 | T | | | | | | T/C | — |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 3080472 | C | | | | | | C/T | — |
| 3080482 | A | | | | | | A/G | — |
| 3080485 | C | | | | | | C/T | — |
| 3080496 | T | | | | | | T/C | — |
| 3082062 | G | | | | | | A | — |
| 3084014 | G | A | A | A | A | A | A | cds_wt_2717 |
| 3087970 | C | | T | T | T | T | T | cds_wt_2721 |
| 3089578 | G | | A | A | A | A | | — |
| 3090231 | G | | | | | | G/C | cds_wt_2723 |
| 3101153 | G | | A | A | A | A | A | cds_wt_2729 |
| 3120006 | C | | | T | T | T | T | — |
| 3121040 | C | | T | T | T | T | T | — |
| 3125035 | C | | T | T | T | T | T | cds_wt_2746 |
| 3125407 | C | | | | | | T | cds_wt_2746 |
| 3128098 | C | | T | T | T | T | T | cds_wt_2749 |
| 3131738 | C | | T | T | T | T | T | cds_wt_2753 |
| 3133651 | C | | T | T | T | T | T | cds_wt_2755 |
| 3133766 | G | A | A | A | A | A | A | cds_wt_2755 |
| 3137673 | C | | | | | | T | cds_wt_2759 |
| 3138173 | G | A | A | A | A | A | A | cds_wt_2760 |
| 3147694 | C | | | T | T | T | T | cds_wt_2765 |
| 3148142 | C | | T | T | T | T | T | cds_wt_2766 |
| 3148342 | C | | T | T | T | T | T | cds_wt_2766 |
| 3148452 | C | | T | T | T | T | T | cds_wt_2766 |
| 3148777 | C | | T | T | T | T | T | cds_wt_2766 |
| 3148960 | C | | T | T | T | T | T | cds_wt_2766 |
| 3149335 | C | | T | T | T | T | T | cds_wt_2766 |
| 3151547 | C | | | | | | T | — |
| 3152279 | C | | T | T | T | T | T | — |
| 3153365 | G | A | A | A | A | A | A | — |
| 3156844 | C | | | | T | T | T | cds_wt_2777 |
| 3175067 | G | A | A | A | A | A | A | cds_wt_2796 |
| 3176311 | C | | T | | | T | T | cds_wt_2797 |
| 3180510 | C | | | T | T | T | T | cds_wt_2801 |
| 3181134 | C | | T | T | T | T | T | cds_wt_2803 |
| 3196810 | C | | | | | | T | cds_wt_2815 |
| 3198674 | G | A | A | A | A | A | A | cds_wt_2817 |
| 3203788 | G | | | | | | A | cds_wt_2823 |
| 3204764 | G | | | | | | A | cds_wt_2823 |
| 3208464 | G | | | A | A | A | A | cds_wt_2826 |
| 3213080 | C | | T | T | T | T | T | cds_wt_2831 |
| 3214059 | C | | | | | T | T | cds_wt_2832 |
| 3216019 | C | | | T | T | | T | cds_wt_2834 |
| 3216133 | C | | | | | | T | cds_wt_2834 |
| 3218109 | C | | | T | T | T | T | cds_wt_2834 |
| 3226281 | C | | | | | T | T | cds_wt_2841 |
| 3229241 | G | | | | A | A | A | cds_wt_2845 |
| 3230387 | G | | | | A | A | A | cds_wt_2847 |
| 3235932 | C | | T | T | T | T | T | cds_wt_2851 |
| 3237109 | C | T | T | T | T | T | T | cds_wt_2851 |
| 3238700 | C | | T | T | T | T | T | cds_wt_2854 |
| 3241279 | C | | T | T | T | T | T | cds_wt_2857 |
| 3241643 | G | | | | A | A | A | cds_wt_2857 |
| 3245145 | C | | | | T | T | T | cds_wt_2860 |
| 3247705 | G | | A | A | A | A | A | cds_wt_2861 |
| 3248186 | G | | A | A | A | A | A | cds_wt_2862 |
| 3249319 | C | | T | T | T | T | T | cds_wt_2862 |
| 3251559 | G | | A | A | A | A | A | — |
| 3253347 | C | | T | T | T | T | T | — |
| 3253453 | C | | T | T | T | T | T | cds_wt_2867 |
| 3253884 | G | | | | A | A | A | — |
| 3254464 | G | | | | A | A | A | — |
| 3258028 | G | | A | A | A | A | A | cds_wt_2872 |
| 3258094 | G | | A | A | | A | A | — |
| 3258637 | C | | T | T | T | T | T | — |
| 3259667 | C | | | T | T | | T | cds_wt_2874 |
| 3261792 | G | | | A | A | A | A | cds_wt_2876 |
| 3262978 | C | T | T | T | T | T | T | cds_wt_2876 |
| 3266668 | G | | A | A | A | A | A | cds_wt_2879 |
| 3266806 | C | T | T | T | T | T | T | cds_wt_2879 |
| 3267341 | G | | | A | A | A | A | cds_wt_2880 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 3267927 | C | | T | T | T | T | T | cds_wt_2880 |
| 3268140 | T | | C | C | C | C | C | cds_wt_2880 |
| 3269676 | G | | A | A | A | A | A | cds_wt_2882 |
| 3270548 | G | | | A | A | A | A | cds_wt_2882 |
| 3275254 | A | | G | G | G | G | G | cds_wt_2885 |
| 3276870 | C | | T | T | T | T | T | cds_wt_2888 |
| 3277187 | C | T | T | T | T | T | T | — |
| 3279932 | C | | T | T | T | T | T | — |
| 3285105 | C | | T | T | T | T | T | cds_wt_2902 |
| 3289175 | C | | | | | | T | cds_wt_2903 |
| 3289533 | C | | | T | T | T | T | cds_wt_2903 |
| 3290417 | G | | | A | | | A | cds_wt_2904 |
| 3290880 | C | | | T | T | T | T | — |
| 3291408 | C | T | T | T | T | T | T | cds_wt_2906 |
| 3294618 | C | | T | T | T | T | T | cds_wt_2909 |
| 3295292 | C | | T | T | T | T | T | — |
| 3296150 | C | | T | T | T | T | T | — |
| 3296689 | C | | T | T | T | T | T | cds_wt_2910 |
| 3297254 | C | | T | T | T | T | T | cds_wt_2910 |
| 3297593 | G | | | | | | A | cds_wt_2910 |
| 3297802 | C | | T | T | T | T | T | cds_wt_2910 |
| 3297816 | G | | | | | | A | cds_wt_2910 |
| 3299219 | C | | T | T | T | T | T | — |
| 3300457 | C | | T | T | T | T | T | cds_wt_2914 |
| 3300838 | C | T | | T | T | T | T | cds_wt_2914 |
| 3300849 | C | T | T | T | T | T | T | cds_wt_2914 |
| 3307410 | G | | A | A | A | A | A | — |
| 3307738 | G | | A | A | A | A | A | — |
| 3309205 | C | | T | T | T | T | T | cds_wt_2919 |
| 3309441 | G | | | | | | A | cds_wt_2919 |
| 3313410 | C | | T | T | T | T | T | cds_wt_2923 |
| 3314734 | C | | T | T | T | T | T | cds_wt_2925 |
| 3315483 | C | | T | T | T | T | T | cds_wt_2925 |
| 3316995 | C | | | | | | T | cds_wt_2926 |
| 3318906 | C | | T | T | T | T | T | cds_wt_2927 |
| 3319964 | C | | | T | T | T | T | cds_wt_2928 |
| 3321895 | G | | A | A | A | A | A | cds_wt_2929 |
| 3326784 | G | | A | A | A | A | A | cds_wt_2933 |
| 3327191 | G | | A | A | A | A | A | cds_wt_2934 |
| 3328753 | C | | T | T | T | T | T | cds_wt_2934 |
| 3336319 | C | | T | T | T | T | T | cds_wt_2941 |
| 3337206 | G | | | | | A | A | cds_wt_2941 |
| 3338688 | C | | T | T | T | T | T | cds_wt_2943 |
| 3345311 | C | | T | T | T | T | T | cds_wt_2947 |
| 3346757 | G | | | | | A | A | cds_wt_2947 |
| 3347355 | C | | | | T | T | T | cds_wt_2947 |
| 3347540 | C | | | | T | T | T | cds_wt_2947 |
| 3347560 | C | | | | T | T | T | cds_wt_2947 |
| 3348860 | C | | T | T | T | T | T | — |
| 3349015 | C | | | | T | T | T | cds_wt_2949 |
| 3349651 | C | | | | T | T | T | cds_wt_2949 |
| 3350820 | C | | T | T | T | T | T | cds_wt_2951 |
| 3351613 | C | | T | T | T | T | T | cds_wt_2953 |
| 3353030 | C | | | T | T | T | T | cds_wt_2954 |
| 3354271 | C | | | | T | T | T | cds_wt_2954 |
| 3354637 | C | | | | T | T | T | cds_wt_2955 |
| 3358411 | G | | | | | | G/A | — |
| 3358883 | G | | | | | A | A | — |
| 3361525 | G | A | A | A | A | A | A | cds_wt_2960 |
| 3363657 | C | | T | T | T | T | T | — |
| 3368167 | C | | T | T | T | T | T | — |
| 3368381 | C | | | | | | C/T | cds_wt_2966 |
| 3375301 | C | | T | T | T | T | T | cds_wt_2971 |
| 3381507 | C | | | | | | T | cds_wt_2978 |
| 3383846 | C | | T | T | T | T | T | cds_wt_2982 |
| 3386322 | C | | | T | T | T | T | cds_wt_2985 |
| 3386914 | G | | A | A | A | A | A | cds_wt_2986 |
| 3388650 | C | | T | T | T | T | T | cds_wt_2988 |
| 3388663 | C | | | T | T | T | T | cds_wt_2988 |
| 3388840 | G | A | A | A | A | A | A | cds_wt_2988 |
| 3390202 | G | | | A | A | A | A | cds_wt_2990 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 3391187 | C | | T | T | T | T | T | cds_wt_2991 |
| 3394129 | C | | T | T | T | T | T | cds_wt_2995 |
| 3395838 | C | | T | T | T | T | T | cds_wt_2996 |
| 3396692 | C | | | | | | T | cds_wt_2997 |
| 3397717 | C | | T | T | T | T | T | cds_wt_2998 |
| 3400152 | C | | T | T | T | T | T | cds_wt_3000 |
| 3402866 | G | | A | A | A | A | A | cds_wt_3004 |
| 3403044 | C | | | | | T | T | cds_wt_3004 |
| 3403253 | C | | T | T | T | T | T | cds_wt_3004 |
| 3404959 | C | | T | T | T | T | T | cds_wt_3006 |
| 3405078 | C | T | T | T | T | T | T | — |
| 3409620 | G | | | | A | | A | cds_wt_3009 |
| 3412544 | G | | A | A | A | A | A | cds_wt_3012 |
| 3415574 | A | G | G | G | G | G | G | cds_wt_3016 |
| 3418558 | C | | | T | T | T | T | — |
| 3418906 | G | | A | A | A | A | A | — |
| 3420004 | C | | T | T | T | | T | cds_wt_3019 |
| 3420345 | C | | | | | T | T | cds_wt_3019 |
| 3429994 | C | | | | | T | T | cds_wt_3030 |
| 3430020 | G | A | A | A | A | A | A | cds_wt_3030 |
| 3431269 | C | | T | T | T | T | T | cds_wt_3032 |
| 3432683 | G | | | | A | A | A | — |
| 3433788 | G | | | | A | A | A | — |
| 3434662 | C | | T | T | T | T | T | cds_wt_3034 |
| 3435439 | G | | | | A | A | A | cds_wt_3035 |
| 3435661 | G | | | | A | A | A | cds_wt_3035 |
| 3440357 | G | | | | A | A | A | cds_wt_3039 |
| 3441404 | C | | | | | T | T | — |
| 3453288 | C | | | | | T | T | cds_wt_3048 |
| 3454769 | G | | | | A | A | A | cds_wt_3048 |
| 3456480 | C | | T | T | T | T | T | — |
| 3457161 | C | | | | T | T | T | cds_wt_3050 |
| 3461043 | C | T | T | T | T | T | T | cds_wt_3053 |
| 3461116 | G | | A | A | A | A | A | cds_wt_3053 |
| 3464902 | C | T | T | T | T | T | T | cds_wt_3057 |
| 3469479 | C | | T | T | T | T | T | — |
| 3473066 | G | A | | A | A | | A | cds_wt_3065 |
| 3474749 | C | | T | T | T | T | T | — |
| 3484337 | G | | A | A | A | A | A | cds_wt_3076 |
| 3484696 | C | | T | T | T | T | T | cds_wt_3077 |
| 3490633 | G | A | A | A | A | A | A | cds_wt_3080 |
| 3511395 | C | | T | T | T | T | T | — |
| 3517523 | G | A | A | A | A | A | A | — |
| 3518338 | C | | T | T | T | T | T | cds_wt_3100 |
| 3519210 | C | T | T | T | T | T | T | cds_wt_3102 |
| 3519280 | C | T | T | T | T | T | T | cds_wt_3102 |
| 3526212 | G | A | A | A | A | A | A | cds_wt_3108 |
| 3526229 | G | A | A | | | | A | cds_wt_3108 |
| 3532172 | C | | | | | T | T | cds_wt_3117 |
| 3532281 | C | | | T | T | T | T | cds_wt_3117 |
| 3539856 | C | | T | T | T | T | T | cds_wt_3124 |
| 3540438 | C | | | | T | T | T | cds_wt_3124 |
| 3540952 | C | | | T | T | T | T | cds_wt_3125 |
| 3553678 | G | | | | | A | A | cds_wt_3135 |
| 3558780 | G | | A | A | A | A | A | cds_wt_3138 |
| 3559503 | G | A | A | A | A | A | A | cds_wt_3139 |
| 3560298 | T | | C | C | C | C | C | cds_wt_3140 |
| 3572036 | C | | T | T | T | T | T | cds_wt_3152 |
| 3587529 | C | | T | T | T | T | T | — |
| 3590513 | C | | T | T | T | T | T | cds_wt_3168 |
| 3590937 | C | | T | T | T | T | T | cds_wt_3168 |
| 3596971 | C | | | | | | T | cds_wt_3175 |
| 3601304 | C | | T | T | T | T | T | — |
| 3610733 | G | | A | A | A | | A | — |
| 3613460 | C | | | | | | T | cds_wt_3186 |
| 3617806 | G | | A | A | A | A | A | cds_wt_3189 |
| 3618063 | C | T | T | T | T | T | T | cds_wt_3189 |
| 3618082 | G | | | | | | A | cds_wt_3189 |
| 3621113 | G | | A | A | A | A | A | cds_wt_3191 |
| 3625554 | C | | T | T | T | T | T | cds_wt_3196 |
| 3626449 | C | | | T | T | T | T | cds_wt_3198 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 3626548 | C | | | | T | T | T | cds_wt_3198 |
| 3627377 | C | T | T | T | T | T | T | cds_wt_3199 |
| 3627686 | C | | | | T | T | T | cds_wt_3199 |
| 3628977 | C | | T | T | T | T | T | cds_wt_3199 |
| 3632788 | C | | | | | T | T | cds_wt_3200 |
| 3647003 | C | | | T | T | T | T | cds_wt_3215 |
| 3650159 | G | | | | | | A | cds_wt_3219 |
| 3658514 | C | | | | | T | T | cds_wt_3227 |
| 3659174 | C | T | T | T | T | T | T | cds_wt_3228 |
| 3672218 | G | A | A | A | A | A | A | cds_wt_3242 |
| 3695232 | G | A | A | A | A | A | A | cds_wt_3263 |
| 3702963 | C | | T | T | T | T | T | cds_wt_3268 |
| 3704185 | C | | T | T | T | T | T | cds_wt_3269 |
| 3704278 | G | | | | | | G/C | cds_wt_3269 |
| 3704281 | T | | | | | | T/G | cds_wt_3269 |
| 3704282 | C | | | | | | C/T | cds_wt_3269 |
| 3704293 | T | | | | | | T/G | cds_wt_3269 |
| 3704327 | G | | | | | | A/G | cds_wt_3269 |
| 3704335 | C | | | | | | T/C | cds_wt_3269 |
| 3704338 | C | | | | | | G/C | cds_wt_3269 |
| 3704340 | A | | | | | | C/A | cds_wt_3269 |
| 3704371 | G | | | | | | C/G | cds_wt_3269 |
| 3704386 | T | | | | | | C/T | cds_wt_3269 |
| 3704389 | C | | | | | | G/C | cds_wt_3269 |
| 3704395 | G | | | | | | C/G | cds_wt_3269 |
| 3704404 | G | | | | | | C/G | cds_wt_3269 |
| 3704415 | C | | | | | | T/C | cds_wt_3269 |
| 3704427 | G | G/A | G/A | G/A | G/A | G/A | A/G | cds_wt_3269 |
| 3704428 | C | C/T | T/C | C/T | C/T | C/T | T/C | cds_wt_3269 |
| 3704464 | C | C/T | C/T | C/T | C/T | C/T | T/C | cds_wt_3269 |
| 3704484 | A | | | | | | C/A | cds_wt_3269 |
| 3704485 | C | | | | | | G/C | cds_wt_3269 |
| 3704491 | G | | | | | | C/G | cds_wt_3269 |
| 3704512 | G | | | | | | C/G | cds_wt_3269 |
| 3704519 | A | | | | | | G/A | cds_wt_3269 |
| 3704531 | A | | | | | | G/A | cds_wt_3269 |
| 3704534 | G | | | | | | C/G | cds_wt_3269 |
| 3704536 | C | | | | | | G/C | cds_wt_3269 |
| 3704543 | C | | | | | | G/C | cds_wt_3269 |
| 3704544 | T | | | | | | C/T | cds_wt_3269 |
| 3704554 | T | | | | | | T/G | cds_wt_3269 |
| 3704563 | C | | | | | | G/C | cds_wt_3269 |
| 3704573 | A | | | | | | G/A | cds_wt_3269 |
| 3704574 | A | | | | | | G/A | cds_wt_3269 |
| 3704577 | G | | | | | | C/G | cds_wt_3269 |
| 3704584 | C | | | | | | G/C | cds_wt_3269 |
| 3704587 | G | | | | | | A/G | cds_wt_3269 |
| 3704590 | G | | | | | | C/G | cds_wt_3269 |
| 3704605 | T | | | | | | C/T | cds_wt_3269 |
| 3704608 | C | | | | | | G/C | cds_wt_3269 |
| 3704617 | T | | | | | | G/T | cds_wt_3269 |
| 3704619 | A | | | | | | C/A | cds_wt_3269 |
| 3704620 | C | | | | | | A/C | cds_wt_3269 |
| 3704629 | C | | | | | | G/C | cds_wt_3269 |
| 3704638 | C | | | | | | G/C | cds_wt_3269 |
| 3704641 | G | | | | | | C/G | cds_wt_3269 |
| 3704647 | C | | | | | | G/C | cds_wt_3269 |
| 3704650 | G | | | | | | C/G | cds_wt_3269 |
| 3704660 | C | | | | | | A/C | cds_wt_3269 |
| 3704662 | G | | | | | | A/G | cds_wt_3269 |
| 3704668 | T | | | | | | C/T | cds_wt_3269 |
| 3704669 | G | | | | | | A/G | cds_wt_3269 |
| 3704670 | T | | | | | | C/T | cds_wt_3269 |
| 3704680 | C | | | | | | G/C | cds_wt_3269 |
| 3704684 | C | | | | | | G/C | cds_wt_3269 |
| 3704686 | G | | | | | | C/G | cds_wt_3269 |
| 3704746 | G | G/C | G/C | G/C | G/C | G/C | C/G | cds_wt_3269 |
| 3704755 | C | C/G | C/G | C/G | C/G | C/G | C/G | cds_wt_3269 |
| 3704767 | A | A/G | A/G | A/G | A/G | A/G | A/G | cds_wt_3269 |
| 3704782 | T | | | | | | T/C | cds_wt_3269 |
| 3704789 | A | | | | | | A/G | cds_wt_3269 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 3704791 | C | | | | | | C/G | cds_wt_3269 |
| 3704806 | C | | | | | | C/T | cds_wt_3269 |
| 3704815 | T | | | | | | T/C | cds_wt_3269 |
| 3704822 | C | | | | | | C/G | cds_wt_3269 |
| 3704844 | C | | | | | | C/A | cds_wt_3269 |
| 3704851 | A | | | | | | A/G | cds_wt_3269 |
| 3704852 | C | | | | | | C/A | cds_wt_3269 |
| 3704866 | T | | | | | | T/C | cds_wt_3269 |
| 3704869 | C | | | | | | C/G | cds_wt_3269 |
| 3704875 | C | | | | | | C/G | cds_wt_3269 |
| 3704906 | G | | | | | A | A | cds_wt_3269 |
| 3706589 | C | | | | | | C/G | cds_wt_3270 |
| 3706625 | G | | | | | | G/C | cds_wt_3270 |
| 3706641 | G | | | | | | G/T | cds_wt_3270 |
| 3706652 | G | | | | | | G/A | cds_wt_3270 |
| 3706655 | C | | | | | | C/G | cds_wt_3270 |
| 3706679 | T | | | | | | T/C | cds_wt_3270 |
| 3706715 | C | | | | | | C/G | cds_wt_3270 |
| 3706735 | C | | | | | | C/G | cds_wt_3270 |
| 3706737 | A | | | | | | A/G | cds_wt_3270 |
| 3706739 | G | | | | | | G/C | cds_wt_3270 |
| 3706784 | C | | | | | | C/T | cds_wt_3270 |
| 3706790 | T | | | | | | T/C | cds_wt_3270 |
| 3706794 | A | | | | | | A/G | cds_wt_3270 |
| 3706805 | G | | | | | | G/C | cds_wt_3270 |
| 3706822 | A | | | | | | A/G | cds_wt_3270 |
| 3706862 | C | C/G | C/G | C/G | C/G | C/G | C/G | cds_wt_3270 |
| 3706926 | G | | | | | | G/T | cds_wt_3270 |
| 3706932 | A | | | | | | A/C | cds_wt_3270 |
| 3706940 | G | | | | | | G/A | cds_wt_3270 |
| 3706945 | G | | | | | | G/C | cds_wt_3270 |
| 3706950 | T | | | | | | T/A | cds_wt_3270 |
| 3706951 | C | | | | | | C/G | cds_wt_3270 |
| 3706958 | T | | | | | | T/C | cds_wt_3270 |
| 3706960 | A | | | | | | A/G | cds_wt_3270 |
| 3706967 | C | | | | | | C/G | cds_wt_3270 |
| 3706983 | C | | | | | | C/G | cds_wt_3270 |
| 3706985 | G | | | | | | G/C | cds_wt_3270 |
| 3706994 | G | | | | | | G/C | cds_wt_3270 |
| 3706996 | A | | | | | | A/C | cds_wt_3270 |
| 3707006 | G | | | | | | G/C | cds_wt_3270 |
| 3707012 | C | | | | | | C/A | cds_wt_3270 |
| 3707013 | A | | | | | | A/G | cds_wt_3270 |
| 3707036 | C | | | | | | C/G | cds_wt_3270 |
| 3711369 | G | | | | | A | A | cds_wt_3273 |
| 3713575 | C | | | | | | T | cds_wt_3274 |
| 3724878 | G | | A | A | A | A | A | cds_wt_3284 |
| 3724955 | G | | A | A | A | A | A | cds_wt_3285 |
| 3727102 | G | | | | | | A | cds_wt_3287 |
| 3727130 | G | | | | | | A | cds_wt_3287 |
| 3727909 | C | | T | T | T | T | T | cds_wt_3288 |
| 3732046 | C | | | | | T | T | cds_wt_3292 |
| 3733052 | G | A | A | A | A | A | A | cds_wt_3293 |
| 3740023 | G | | | | | A | A | cds_wt_3297 |
| 3741710 | G | | | | | A | A | cds_wt_3299 |
| 3744813 | G | | | | | A | A | cds_wt_3301 |
| 3750360 | G | | | | | A | A | cds_wt_3306 |
| 3756113 | C | T | T | T | T | T | T | cds_wt_3312 |
| 3762328 | G | | | | | | A | cds_wt_3318 |
| 3763755 | G | | | | | A | A | cds_wt_3319 |
| 3764788 | G | | A | A | A | A | A | cds_wt_3320 |
| 3771690 | C | T | T | T | T | T | T | cds_wt_3327 |
| 3775098 | G | | | | | | A | cds_wt_3331 |
| 3775718 | G | | | | | A | A | cds_wt_3332 |
| 3776484 | G | | | | | A | A | cds_wt_3333 |
| 3783703 | T | | C | C | C | C | C | cds_wt_3342 |
| 3786947 | G | | | | | A | A | cds_wt_3346 |
| 3788243 | C | | | | | T | T | — |
| 3798429 | G | | | | | A | A | cds_wt_3363 |
| 3799202 | G | | A | A | A | A | A | cds_wt_3364 |
| 3799222 | G | | A | A | A | A | A | cds_wt_3364 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 3802171 | C | T | T | T | T | T | T | cds_wt_3368 |
| 3806580 | C | | | | | T | T | cds_wt_3371 |
| 3825163 | C | | | | | T | T | cds_wt_3394 |
| 3828141 | G | | | | | A | A | — |
| 3831054 | G | | | | | A | A | cds_wt_3401 |
| 3831114 | G | | A | A | A | A | A | cds_wt_3401 |
| 3831589 | C | | | | | T | T | — |
| 3831701 | G | | | | | A | A | — |
| 3837175 | G | | | | | A | A | cds_wt_3406 |
| 3841387 | G | | | | | A | A | cds_wt_3410 |
| 3843222 | C | T | T | T | T | T | T | cds_wt_3413 |
| 3843509 | G | | | | | A | A | cds_wt_3414 |
| 3843815 | G | A | A | A | A | A | A | cds_wt_3414 |
| 3844238 | G | | | | | A | A | cds_wt_3414 |
| 3846121 | G | | | | | | A | cds_wt_3417 |
| 3846452 | G | | | | | A | A | cds_wt_3417 |
| 3852914 | T | | C | C | C | C | C | cds_wt_3423 |
| 3873931 | G | | | | | | A | cds_wt_3442 |
| 3879758 | G | | | | | A | A | cds_wt_3449 |
| 3883035 | C | T | T | T | T | T | T | cds_wt_3453 |
| 3905636 | C | | | | | T | T | cds_wt_3478 |
| 3919216 | C | | T | T | T | T | T | cds_wt_3488 |
| 3920191 | G | | | | | A | A | cds_wt_3489 |
| 3928659 | C | | T | T | T | T | T | cds_wt_3496 |
| 3935704 | C | | | | | | C/T | cds_wt_3503 |
| 3941486 | G | | | | A | A | A | cds_wt_3508 |
| 3964297 | G | | | | | A | A | cds_wt_3529 |
| 3965972 | G | | | A | A | A | A | cds_wt_3530 |
| 3968608 | C | | T | T | T | T | T | cds_wt_3533 |
| 3983198 | C | | T | T | T | T | T | cds_wt_3545 |
| 3993744 | G | | | | | | G/A | cds_wt_3554 |
| 4002370 | G | | A | A | A | A | A | cds_wt_3560 |
| 4004770 | C | | T | T | T | T | T | cds_wt_3562 |
| 4006580 | C | T | T | T | T | T | T | cds_wt_3562 |
| 4006932 | G | | A | A | A | A | A | cds_wt_3562 |
| 4013932 | G | A | A | A | A | A | A | cds_wt_3571 |
| 4014337 | T | | | | C | C | C | cds_wt_3572 |
| 4017638 | C | | | | T | T | T | cds_wt_3574 |
| 4019106 | G | | A | A | A | A | A | cds_wt_3576 |
| 4020770 | C | | T | T | T | T | T | cds_wt_3577 |
| 4025302 | C | T | T | T | T | T | T | cds_wt_3582 |
| 4027304 | G | | | | A | A | A | cds_wt_3584 |
| 4034139 | G | | | | | | G/T | cds_wt_3588 |
| 4043320 | A | | | | | G | G | cds_wt_3599 |
| 4063459 | G | | A | A | A | A | A | cds_wt_3621 |
| 4072648 | C | | T | T | T | T | T | cds_wt_3630 |
| 4073198 | C | | | | | | T | cds_wt_3630 |
| 4073446 | G | | | | | | A | cds_wt_3630 |
| 4074524 | C | | T | T | T | T | T | cds_wt_3631 |
| 4081747 | C | | | | T | T | T | cds_wt_3639 |
| 4086210 | A | G | G | G | G | G | G | cds_wt_3643 |
| 4089001 | C | | | T | T | | T | cds_wt_3647 |
| 4102977 | C | | | | | T | T | cds_wt_3657 |
| 4104004 | C | | | | | T | T | cds_wt_3658 |
| 4114649 | G | | A | A | A | A | A | cds_wt_3670 |
| 4117981 | G | | A | A | A | A | A | cds_wt_3673 |
| 4118234 | C | | T | T | T | T | T | — |
| 4121337 | G | | A | A | A | A | A | — |
| 4124406 | G | | A | A | A | A | A | cds_wt_3680 |
| 4130087 | C | | T | T | T | T | T | cds_wt_3683 |
| 4148633 | C | | | | | T | T | cds_wt_3698 |
| 4150599 | C | | | | | T | T | cds_wt_3700 |
| 4152842 | C | | T | T | T | T | T | cds_wt_3703 |
| 4156366 | G | A | A | A | A | | A | cds_wt_3707 |
| 4156524 | G | | | | | A | A | cds_wt_3707 |
| 4157742 | G | A | A | A | A | A | A | cds_wt_3708 |
| 4157795 | G | A | A | A | A | A | A | cds_wt_3708 |
| 4158022 | G | A | A | A | A | A | A | cds_wt_3708 |
| 4160265 | G | A | | A | A | | A | — |
| 4170648 | C | | T | T | T | T | T | cds_wt_3719 |
| 4186914 | C | | | | T | | T | cds_wt_3734 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 4187188 | G | | | | A | | A | cds_wt_3735 |
| 4192330 | C | | T | T | T | T | T | cds_wt_3740 |
| 4192395 | C | T | T | T | T | T | T | cds_wt_3740 |
| 4194086 | C | T | | T | T | | T | cds_wt_3741 |
| 4196729 | C | T | T | T | T | T | T | cds_wt_3743 |
| 4205330 | C | | | | | | T | cds_wt_3752 |
| 4218066 | G | A | A | A | A | A | A | cds_wt_3764 |
| 4220842 | G | | A | A | A | A | A | cds_wt_3768 |
| 4231722 | C | | T | T | T | T | T | cds_wt_3782 |
| 4251577 | C | | T | T | | | | — |
| 4253562 | G | | | | A | A | A | — |
| 4255089 | G | | A | A | A | A | A | cds_wt_3798 |
| 4268915 | C | T | T | T | T | T | T | cds_wt_3809 |
| 4284264 | C | T | T | T | T | T | T | cds_wt_3820 |
| 4285070 | G | | | | | | A | cds_wt_3821 |
| 4286615 | G | | | | | | A | cds_wt_3823 |
| 4299670 | C | | T | T | T | T | T | — |
| 4302785 | G | | A | A | A | A | A | cds_wt_3840 |
| 4302812 | C | | | | | | T | cds_wt_3840 |
| 4312528 | G | | A | A | A | A | A | cds_wt_3851 |
| 4312875 | C | | | | | T | T | cds_wt_3851 |
| 4314885 | G | | A | A | A | A | A | cds_wt_3852 |
| 4314896 | C | T | T | T | T | T | T | cds_wt_3852 |
| 4314899 | G | | A | A | A | A | A | cds_wt_3852 |
| 4316350 | C | T | T | T | T | T | T | cds_wt_3853 |
| 4318874 | C | | T | T | T | T | T | — |
| 4319625 | C | | | | T | T | T | — |
| 4324089 | G | | | A | A | A | A | cds_wt_3859 |
| 4325174 | G | | A | A | A | A | A | cds_wt_3860 |
| 4325955 | G | | A | A | A | A | A | cds_wt_3860 |
| 4327176 | C | | T | T | T | T | T | cds_wt_3861 |
| 4328372 | C | | T | T | T | T | T | cds_wt_3861 |
| 4329685 | C | | T | T | T | T | T | cds_wt_3862 |
| 4329867 | C | | T | T | T | T | T | cds_wt_3862 |
| 4331851 | C | | T | T | T | T | T | cds_wt_3862 |
| 4331916 | C | | T | T | T | T | T | cds_wt_3862 |
| 4334253 | C | | | | | | T | — |
| 4335755 | C | | | | T | T | T | — |
| 4340706 | C | | | | | T | T | — |
| 4343282 | T | | | | | | C | cds_wt_3868 |
| 4347901 | C | | | | T | T | T | cds_wt_3875 |
| 4352755 | G | A | A | A | A | A | A | cds_wt_3879 |
| 4360959 | G | A | A | A | A | A | A | cds_wt_3884 |
| 4361293 | C | | | | T | T | T | cds_wt_3884 |
| 4362371 | C | | T | T | T | T | T | cds_wt_3885 |
| 4365880 | G | | | | | A | A | cds_wt_3888 |
| 4376161 | C | | | T | T | T | T | cds_wt_3893 |
| 4376238 | C | | T | T | T | T | T | cds_wt_3893 |
| 4378853 | G | | A | A | A | A | A | — |
| 4395837 | G | | | | | A | A | cds_wt_3904 |
| 4396016 | C | | T | T | T | T | T | cds_wt_3904 |
| 4402736 | C | | T | T | T | T | T | cds_wt_3911 |
| 4406151 | G | | | | | A | A | cds_wt_3914 |
| 4414580 | G | A | A | A | A | A | A | — |
| 4414632 | C | | T | T | T | T | T | — |
| 4420655 | C | | | | | T | T | cds_wt_3928 |
| 4433146 | G | | | | | | A | cds_wt_3940 |
| 4438071 | G | | A | A | A | A | A | — |
| 4440571 | T | | C | C | C | C | C | cds_wt_3948 |
| 4440772 | G | | | | | A | A | cds_wt_3949 |
| 4443633 | G | | | | | A | A | cds_wt_3952 |
| 4444731 | C | | | | | | T | cds_wt_3953 |
| 4446487 | T | | C | C | C | C | C | cds_wt_3954 |
| 4463567 | C | T | | | T | | T | cds_wt_3967 |
| 4463766 | G | | A | | | | A | cds_wt_3967 |
| 4467838 | G | | | | | | A | cds_wt_3969 |
| 4474494 | G | | A | A | A | A | A | cds_wt_3976 |
| 4481185 | G | | | A | A | A | A | cds_wt_3981 |
| 4486135 | C | | T | T | T | T | T | cds_wt_3985 |
| 4487769 | G | | | | | | A | cds_wt_3986 |
| 4490385 | G | | A | A | A | A | A | cds_wt_3989 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 4496083 | G | | A | A | A | A | A | cds_wt_3998 |
| 4499876 | C | | T | T | T | T | T | cds_wt_4002 |
| 4503563 | C | T | T | T | T | T | T | cds_wt_4006 |
| 4504062 | C | T | T | T | T | T | T | cds_wt_4006 |
| 4517204 | G | A | A | A | A | A | A | cds_wt_4018 |
| 4524639 | G | | | | A | | A | cds_wt_4025 |
| 4524706 | G | | | | | | A | cds_wt_4025 |
| 4529241 | G | | A | A | A | A | A | cds_wt_4028 |
| 4529778 | G | | A | A | A | A | A | cds_wt_4029 |
| 4531772 | G | A | A | A | A | A | A | cds_wt_4032 |
| 4532547 | G | A | A | A | A | A | A | cds_wt_4032 |
| 4532943 | G | A | A | A | A | A | A | cds_wt_4033 |
| 4533824 | G | A | A | A | A | A | A | cds_wt_4034 |
| 4535251 | G | | A | A | A | A | A | cds_wt_4035 |
| 4537480 | G | | A | A | A | A | A | cds_wt_4036 |
| 4537859 | G | A | A | A | A | A | A | — |
| 4543587 | G | A | A | A | A | A | A | cds_wt_4041 |
| 4547764 | C | | | | | T | T | cds_wt_4046 |
| 4558815 | C | | T | T | T | T | T | — |
| 4558914 | C | | T | T | T | T | T | cds_wt_4060 |
| 4564648 | G | A | A | A | A | A | A | cds_wt_4064 |
| 4564991 | G | A | A | A | A | A | A | cds_wt_4064 |
| 4573497 | C | | T | T | T | T | T | cds_wt_4073 |
| 4573536 | C | | T | T | T | T | T | cds_wt_4073 |
| 4575408 | C | | | | | T | T | cds_wt_4075 |
| 4577334 | C | T | T | T | T | T | T | cds_wt_4076 |
| 4580403 | G | | | | | | A | cds_wt_4079 |
| 4582642 | T | | | | C | C | C | — |
| 4588387 | C | A | A | A | A | A | A | cds_wt_4086 |
| 4588663 | G | | A | A | A | A | A | cds_wt_4087 |
| 4597434 | C | | | | | T | T | — |
| 4598262 | C | | T | T | T | T | T | cds_wt_4091 |
| 4601247 | G | | | | | | G/C | cds_wt_4093 |
| 4601248 | T | | | | | | T/C | cds_wt_4093 |
| 4603166 | C | | | | | T | T | cds_wt_4094 |
| 4611131 | C | | T | T | T | T | T | cds_wt_4099 |
| 4614475 | C | | T | T | T | T | T | cds_wt_4103 |
| 4616665 | G | | A | A | A | A | A | cds_wt_4104 |
| 4617801 | G | | | | | | A | cds_wt_4106 |
| 4619989 | C | | T | T | | | T | cds_wt_4108 |
| 4621439 | G | A | A | A | A | A | A | cds_wt_4109 |
| 4626601 | G | A | | A | A | A | A | cds_wt_4114 |
| 4630752 | C | | T | T | T | T | T | cds_wt_4116 |
| 4649811 | A | | | | | | A/G | cds_wt_4135 |
| 4650590 | C | | | | T | T | T | cds_wt_4136 |
| 4669551 | C | | T | T | T | T | T | cds_wt_4157 |
| 4670815 | G | | | | | | A | cds_wt_4158 |
| 4674426 | G | | | A | A | A | A | cds_wt_4162 |
| 4677968 | C | | T | T | T | T | T | cds_wt_4168 |
| 4688341 | C | | | | | | T | cds_wt_4174 |
| 4697092 | C | | T | T | T | T | T | cds_wt_4179 |
| 4700003 | G | A | A | A | A | A | A | cds_wt_4181 |
| 4702254 | C | T | T | T | T | T | T | cds_wt_4183 |
| 4704691 | C | T | T | T | T | T | T | cds_wt_4185 |
| 4704704 | C | T | T | T | T | T | T | cds_wt_4185 |
| 4713174 | C | | T | T | T | T | T | — |
| 4727776 | G | A | A | A | A | A | A | cds_wt_4209 |
| 4736024 | C | | | | | | T | cds_wt_4219 |
| 4766839 | C | T | T | T | T | T | T | cds_wt_4240 |
| 4769655 | C | T | | T | T | T | T | cds_wt_4243 |
| 4776927 | G | | A | A | A | A | A | cds_wt_4247 |
| 4788381 | C | | | | | T | T | cds_wt_4255 |
| 4794373 | C | T | T | T | T | T | T | cds_wt_4264 |
| 4799012 | G | A | A | A | A | A | A | cds_wt_4268 |
| 4812357 | C | | | | | | T | cds_wt_4277 |
| 4813704 | G | | | | | | G/T | — |
| 4813710 | G | | | | | | G/T | — |
| 4813711 | A | | | | | | A/C | — |
| 4814060 | C | | | | T/C | | C/T | — |
| 4814078 | C | | | | | | C/T | — |
| 4814081 | C | | | | | | C/T | — |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 4814082 | G | | | | | | G/C | — |
| 4814087 | T | | | | | | T/C | — |
| 4818340 | G | | | | A | | A | — |
| 4820651 | C | | | | T | | T | cds_wt_4283 |
| 4821863 | G | A | A | A | A | A | A | — |
| 4852073 | T | | | | | | T/C | — |
| 4852080 | T | | | | | | C/T | cds_wt_4318 |
| 4852093 | T | | | | | | C/T | cds_wt_4318 |
| 4852131 | G | | | | | | A/G | cds_wt_4318 |
| 4852238 | T | | | | C/T | C/T | C/T | cds_wt_4318 |
| 4852271 | T | | | | | | T/C | cds_wt_4318 |
| 4852348 | G | | G/A | G/A | G/A | G/A | G/A | cds_wt_4318 |
| 4852373 | T | | | | | | T/C | cds_wt_4318 |
| 4858842 | C | T | T | T | T | T | T | cds_wt_4320 |
| 4859921 | G | A | A | A | A | A | A | cds_wt_4321 |
| 4860949 | G | | A | A | A | A | A | cds_wt_4321 |
| 4872907 | G | | | | A | A | A | cds_wt_4325 |
| 4879205 | C | | | | T | | T | cds_wt_4332 |
| 4886810 | C | | | | T | | T | cds_wt_4337 |
| 4889101 | G | A | A | A | A | A | A | cds_wt_4340 |
| 4891956 | C | | | | T | | T | cds_wt_4341 |
| 4896797 | C | | T | T | T | T | T | cds_wt_4345 |
| 4903124 | G | | | | | | A | cds_wt_4350 |
| 4904325 | A | | | | | | A/G | — |
| 4904344 | C | | | | | | C/G | — |
| 4904345 | C | | | | | | C/T | — |
| 4904355 | A | | | | | | G | — |
| 4904359 | G | | | | | | G/C | — |
| 4904360 | T | | | | | | T/C | — |
| 4908341 | C | | T | T | T | T | T | — |
| 4908687 | C | | | | | | T | — |
| 4911304 | C | | | | | | T | cds_wt_4356 |
| 4916472 | C | | T | T | T | T | T | cds_wt_4359 |
| 4920831 | C | | | | | | T | cds_wt_4362 |
| 4924034 | C | | T | T | T | T | T | cds_wt_4363 |
| 4924484 | C | | T | T | T | T | T | cds_wt_4363 |
| 4927068 | C | | T | T | T | T | T | cds_wt_4367 |
| 4927798 | C | | T | T | T | T | T | cds_wt_4367 |
| 4929941 | C | | T | T | T | T | T | cds_wt_4370 |
| 4930693 | C | | | T | T | T | T | cds_wt_4370 |
| 4932671 | C | | | | | | T | cds_wt_4373 |
| 4933447 | T | | | | | | T/C | cds_wt_4374 |
| 4948234 | G | | | | | A | A | cds_wt_4390 |
| 4950870 | C | T | T | T | T | T | T | cds_wt_4393 |
| 4951932 | C | T | T | T | T | T | T | cds_wt_4394 |
| 4953821 | C | T | | | T | | T | — |
| 4978515 | G | A | | | | | A | cds_wt_4414 |
| 4981742 | C | | | | | | T | cds_wt_4416 |
| 4984320 | A | | G | G | G | G | G | cds_wt_4417 |
| 4987021 | G | A | A | A | A | A | A | cds_wt_4421 |
| 4987606 | G | | A | A | A | A | A | cds_wt_4421 |
| 4991441 | G | | A | A | A | A | A | cds_wt_4424 |
| 4992870 | G | A | A | A | A | A | A | cds_wt_4425 |
| 5014441 | C | T | T | T | T | T | T | cds_wt_4442 |
| 5016187 | C | T | T | T | T | T | T | cds_wt_4443 |
| 5016773 | C | T | T | T | T | T | T | cds_wt_4443 |
| 5025119 | G | | | | | | A | cds_wt_4454 |
| 5030757 | C | | | | | | T | cds_wt_4459 |
| 5053257 | C | | T | T | T | T | T | cds_wt_4482 |
| 5056010 | C | | T | T | T | T | T | — |
| 5056241 | C | | T | T | T | T | T | cds_wt_4487 |
| 5058845 | C | | | | | T | T | — |
| 5058850 | C | | | | | T | T | — |
| 5060436 | C | | T | T | T | T | T | cds_wt_4489 |
| 5061245 | C | | T | T | T | T | T | cds_wt_4489 |
| 5062621 | C | | T | T | T | T | T | cds_wt_4490 |
| 5063656 | C | | T | T | T | T | T | cds_wt_4492 |
| 5063753 | A | | | | | | A/G | cds_wt_4492 |
| 5063759 | T | | | | | | T/G | cds_wt_4492 |
| 5063766 | C | | | | | | C/T | cds_wt_4492 |
| 5063772 | A | | | | | | A/G | cds_wt_4492 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 5063775 | T | | | | | | T/C | cds_wt_4492 |
| 5063777 | A | | | | | | A/G | cds_wt_4492 |
| 5063883 | T | | | | | | T/C | cds_wt_4492 |
| 5063900 | G | G/A | G/A | G/A | G/A | G/A | G/A | cds_wt_4492 |
| 5063967 | T | | | | | | C/T | cds_wt_4492 |
| 5063994 | C | | | | | | C/G | cds_wt_4492 |
| 5063997 | T | | | | | | C/T | cds_wt_4492 |
| 5064000 | G | | | | | | C/G | cds_wt_4492 |
| 5064054 | C | C/G | C/G | | C/G | | C/G | cds_wt_4492 |
| 5064140 | T | T/A | T/A | T/A | | T/A | A/T | cds_wt_4492 |
| 5064188 | G | G/C | G/C | G/C | G/C | G/C | G/C | — |
| 5064199 | G | G/A | G/A | G/A | G/A | G/A | A/G | — |
| 5064223 | T | T/C | T/C | T/C | T/C | T/C | C/T | — |
| 5064318 | G | G/A | | G/A | G/A | G/A | G/A | — |
| 5064363 | G | | | | | | G/A | — |
| 5064364 | C | | | | | | C/G | — |
| 5064368 | T | T/C | T/C | T/C | T/C | C/T | C/T | — |
| 5066806 | C | | T | T | T | T | T | cds_wt_4496 |
| 5079654 | C | | | | | | T | cds_wt_4505 |
| 5080712 | C | | T | T | T | T | T | cds_wt_4505 |
| 5080760 | G | | A | A | A | A | A | — |
| 5083716 | C | | T | T | T | T | T | cds_wt_4508 |
| 5085149 | C | | T | T | T | T | T | cds_wt_4509 |
| 5087053 | C | | T | T | T | T | T | cds_wt_4509 |
| 5089288 | G | | A | A | A | A | A | cds_wt_4511 |
| 5095356 | C | | T | T | T | T | T | cds_wt_4517 |
| 5096131 | C | | T | T | T | T | T | cds_wt_4517 |
| 5099106 | C | | | | | T | T | cds_wt_4520 |
| 5099331 | C | | | | | T | T | cds_wt_4521 |
| 5099501 | C | | | | | | T | cds_wt_4521 |
| 5104316 | C | | T | T | T | T | T | cds_wt_4525 |
| 5104896 | C | | T | T | T | T | T | cds_wt_4525 |
| 5105840 | C | | T | T | T | T | T | cds_wt_4526 |
| 5107273 | C | | T | T | T | T | T | cds_wt_4528 |
| 5107438 | G | | | | | | A | cds_wt_4528 |
| 5110964 | G | | | | | | A | cds_wt_4534 |
| 5111341 | G | | | A | | | A | cds_wt_4534 |
| 5111525 | G | A | | A | | | A | cds_wt_4534 |
| 5113971 | C | | T | T | T | T | T | cds_wt_4535 |
| 5114926 | C | | | | | | T/C | — |
| 5114933 | C | | | | | | T/C | — |
| 5116995 | G | | | | A | A | A | cds_wt_4538 |
| 5117622 | G | | | | A | A | A | cds_wt_4538 |
| 5126463 | G | | | | A | A | A | — |
| 5128522 | G | | | | A | A | A | cds_wt_4545 |
| 5131328 | G | | A | A | A | A | A | cds_wt_4547 |
| 5132598 | C | | T | T | T | T | T | cds_wt_4548 |
| 5133033 | C | | T | T | T | T | T | cds_wt_4548 |
| 5134996 | G | | A | A | A | A | A | cds_wt_4551 |
| 5136119 | C | | T | T | T | T | T | cds_wt_4552 |
| 5139533 | C | T | T | T | T | T | T | cds_wt_4555 |
| 5141709 | G | | A | A | A | A | A | cds_wt_4556 |
| 5147647 | C | | T | T | T | T | T | cds_wt_4560 |
| 5158997 | C | | T | T | T | T | T | cds_wt_4571 |
| 5171223 | G | A | A | A | A | A | A | — |
| 5189948 | C | | T | T | T | T | T | cds_wt_4598 |
| 5196838 | C | | T | T | T | T | T | cds_wt_4603 |
| 5203530 | G | | | | | | A | cds_wt_4610 |
| 5204859 | C | | T | T | T | T | T | cds_wt_4612 |
| 5213315 | G | | | | | | A | cds_wt_4621 |
| 5216015 | G | | A | A | A | A | A | cds_wt_4624 |
| 5221083 | C | | T | T | T | T | T | cds_wt_4628 |
| 5229965 | G | | A | A | A | A | A | cds_wt_4633 |
| 5233924 | G | | | | | | A | cds_wt_4635 |
| 5246591 | G | | | | A | A | A | cds_wt_4645 |
| 5247914 | C | T | T | T | T | T | T | cds_wt_4646 |
| 5253451 | C | T | | | | | T | cds_wt_4650 |
| 5255901 | C | | T | T | T | T | T | cds_wt_4652 |
| 5259871 | G | | A | A | A | A | A | cds_wt_4654 |
| 5270798 | G | A | A | A | A | A | A | cds_wt_4667 |
| 5277822 | G | A | | A | A | | A | cds_wt_4674 |

-continued

| Position in reference wild type strain SE50-100 | Base in Reference strain | SN223-29-47 | C445-P47 | SN12755-48 | SC3687-18-43 | SC7177-40-17 | SN19910-27-21 | Affected Gene ID |
|---|---|---|---|---|---|---|---|---|
| 5280936 | C | | T | T | T | T | T | cds_wt_4680 |
| 5283902 | G | | | | | A | A | cds_wt_4682 |
| 5292603 | C | T | T | T | T | T | T | cds_wt_4692 |
| 5309793 | G | | A | A | A | A | A | cds_wt_4713 |
| 5317263 | G | | | | A | A | A | cds_wt_4720 |
| 5323245 | G | | | | | A | A | cds_wt_4725 |
| 5323289 | C | | | | | T | T | cds_wt_4725 |
| 5323708 | G | | | | | A | A | cds_wt_4726 |
| 5326705 | G | | | | | A | A | cds_wt_4730 |
| 5339380 | G | A | | | | | A | cds_wt_4742 |
| 5349635 | C | T | T | T | T | | T | cds_wt_4752 |
| 5350111 | G | | A | A | A | A | A | cds_wt_4752 |
| 5356868 | C | | T | T | T | T | T | cds_wt_4756 |
| 5363828 | C | | | | | T | T | cds_wt_4763 |
| 5385564 | C | T | T | T | T | T | T | cds_wt_4780 |
| 5391456 | G | | A | A | A | A | A | cds_wt_4787 |
| 5404805 | G | | | | | A | A | cds_wt_4798 |
| 5415953 | G | A | A | A | A | A | A | cds_wt_4808 |
| 5416207 | C | T | T | T | T | T | T | cds_wt_4808 |
| 5419045 | C | | T | T | T | T | T | cds_wt_4811 |
| 5438747 | G | A | A | A | A | A | A | cds_wt_4833 |
| 5457995 | G | | A | A | A | A | A | cds_wt_4849 |
| 5465469 | C | | | | | T | T | cds_wt_4855 |
| 5481386 | G | | | | | A | A | cds_wt_4866 |
| 5485106 | C | | T | T | T | T | T | cds_wt_4869 |
| 5500846 | G | | A | A | A | A | A | cds_wt_4887 |
| 5514802 | C | | T | T | T | T | T | cds_wt_4901 |
| 5516464 | C | | | | | | T | cds_wt_4902 |
| 5530664 | C | | T | T | T | T | T | cds_wt_4914 |
| 5537010 | G | A | A | A | A | A | A | cds_wt_4920 |
| 5540526 | G | A | | | | | A | — |
| 5541233 | C | | T | T | T | T | T | cds_wt_4926 |
| 5543634 | C | | T | T | T | T | T | cds_wt_4929 |
| 5545010 | C | | | | | | T | cds_wt_4929 |
| 5545574 | G | | | | | A | A | cds_wt_4929 |
| 5548499 | C | | | T | T | T | T | cds_wt_4933 |
| 5557711 | G | A | | A | A | | A | cds_wt_4941 |
| 5574966 | C | T | T | T | T | T | T | cds_wt_4961 |
| 5576016 | C | | T | T | T | T | T | — |
| 5579654 | C | | | | T | T | T | cds_wt_4970 |
| 5582215 | C | | | | | | C/T | cds_wt_4972 |
| 5590781 | T | | | | | | T/A | — |
| 5590796 | C | | | | | | C/T | — |
| 5590809 | T | | | | | | T/C | — |
| 5590810 | G | | | | | | G/A | — |
| 5590823 | G | G/A | G/A | G/A | G/A | G/A | G/A | — |
| 5590828 | A | | | | | | A/G | — |
| 5590847 | G | G/T | G/T | G/T | G/T | G/T | G/T | — |
| 5590861 | G | G/C | G/C | G/C | G/C | G/C | G/C | — |
| 5590867 | A | A/C | A/C | A/C | A/C | A/C | A/C | — |
| 5590868 | A | | | | | | A/G | — |
| 5590886 | G | G/A | G/A | G/A | G/A | G/A | A/G | cds_wt_4977 |
| 5590889 | T | T/C | T/C | T/C | | T/C | C/T | cds_wt_4977 |
| 5590903 | A | | | | | | G/A | cds_wt_4977 |
| 5590909 | G | | | | | | T/G | cds_wt_4977 |
| 5590910 | C | | | | | | G/C | cds_wt_4977 |
| 5590912 | G | | | | | | T/G | cds_wt_4977 |
| 5590918 | G | | | | | | A/G | cds_wt_4977 |
| 5590923 | A | | | | | | G/A | cds_wt_4977 |
| 5590927 | T | | | | | | G/T | cds_wt_4977 |
| 5590933 | G | | | | | | A/G | cds_wt_4977 |
| 5590945 | C | | | | | | G/C | cds_wt_4977 |
| 5590960 | T | | | | | | C/T | cds_wt_4977 |
| 5590961 | C | | | | | | T/C | cds_wt_4977 |
| 5590972 | T | | | | | | C/T | cds_wt_4977 |
| 5590978 | T | | | | | | C/T | cds_wt_4977 |
| 5590981 | G | | | | | | C/G | cds_wt_4977 |
| 5590987 | T | | | | | | C/T | cds_wt_4977 |
| 5590993 | C | C/G | | | | | G/C | cds_wt_4977 |
| 5591002 | G | | | | | | G/A | cds_wt_4977 |
| 5591008 | T | C/T | T/C | T/C | C/T | T/C | C/T | cds_wt_4977 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 5591026 | C | | | | | | G/C | cds_wt_4977 |
| 5591035 | C | | | | | | G/C | cds_wt_4977 |
| 5591054 | C | A/C | C/A | C/A | C/A | C/A | A/C | cds_wt_4977 |
| 5591063 | T | | | | | | C/T | cds_wt_4977 |
| 5591065 | C | | | | | | G/C | cds_wt_4977 |
| 5591069 | A | | | | | | A/G | cds_wt_4977 |
| 5591074 | A | | | | | | G/A | cds_wt_4977 |
| 5591077 | C | | | | | | A/C | cds_wt_4977 |
| 5591092 | A | | | | | | G/A | cds_wt_4977 |
| 5591095 | G | | | | | | C/G | cds_wt_4977 |
| 5591098 | T | | | | | | C/T | cds_wt_4977 |
| 5591115 | G | | | | | | A/G | cds_wt_4977 |
| 5591158 | G | T/G | T/G | T/G | T/G | T/G | T/G | cds_wt_4977 |
| 5591179 | G | | | | | | T/G | cds_wt_4977 |
| 5591220 | C | | G/C | G/C | G/C | | G/C | cds_wt_4977 |
| 5591226 | A | | | G/A | G/A | | G/A | cds_wt_4977 |
| 5591268 | T | | | | | | C/T | cds_wt_4977 |
| 5591361 | C | | | | | | G/C | cds_wt_4977 |
| 5591442 | G | | | | | | A/G | cds_wt_4977 |
| 5591445 | C | | | | | | T/C | cds_wt_4977 |
| 5591457 | G | | | | | | C/G | cds_wt_4977 |
| 5591458 | A | | | | | | C/A | cds_wt_4977 |
| 5591466 | G | | | | | | C/G | cds_wt_4977 |
| 5591469 | G | | | | | | A/G | cds_wt_4977 |
| 5591472 | C | | | | | | G/C | cds_wt_4977 |
| 5591476 | A | | | | | | A/G | cds_wt_4977 |
| 5591496 | G | | | | | | C/G | cds_wt_4977 |
| 5591499 | A | | | | | | C/A | cds_wt_4977 |
| 5591505 | G | | | | | | C/G | cds_wt_4977 |
| 5591508 | T | | | | | | G/T | cds_wt_4977 |
| 5591520 | A | | | | | | G/A | cds_wt_4977 |
| 5591532 | C | | | | | | T/C | cds_wt_4977 |
| 5591541 | C | | | | | | T/C | cds_wt_4977 |
| 5591553 | G | | | | | | A/G | cds_wt_4977 |
| 5591562 | G | | | | | | T/G | cds_wt_4977 |
| 5591565 | G | | | | | | C/G | cds_wt_4977 |
| 5591571 | A | | | | | | G/A | cds_wt_4977 |
| 5591577 | A | | | | | | C/A | cds_wt_4977 |
| 5591596 | C | | | | | | T/C | cds_wt_4977 |
| 5591598 | G | | | | | | C/G | cds_wt_4977 |
| 5591607 | C | C/T | C/T | C/T | C/T | C/T | T/C | cds_wt_4977 |
| 5591613 | T | T/C | T/C | T/C | T/C | T/C | C/T | cds_wt_4977 |
| 5591632 | C | | | | | | A/C | cds_wt_4977 |
| 5591635 | G | | | | | | G/T | cds_wt_4977 |
| 5591640 | T | | | | | | T/C | cds_wt_4977 |
| 5591643 | C | | | | | | C/T | cds_wt_4977 |
| 5591654 | A | | | | | | A/C | cds_wt_4977 |
| 5591656 | A | | | | | | A/G | — |
| 5604643 | G | | A | A | A | A | A | cds_wt_4993 |
| 5612009 | C | | | T | T | T | T | cds_wt_5000 |
| 5626626 | C | T | T | T | T | T | T | — |
| 5629121 | C | | T | T | T | T | T | cds_wt_5011 |
| 5631426 | C | | | | | T | T | cds_wt_5015 |
| 5636810 | G | | A | A | A | A | A | cds_wt_5021 |
| 5657449 | C | T | T | T | T | T | T | cds_wt_5035 |
| 5659036 | G | | A | A | A | A | A | cds_wt_5036 |
| 5692125 | C | | | T | T | T | T | cds_wt_5065 |
| 5694507 | C | | | T | T | T | T | cds_wt_5069 |
| 5696833 | C | | | | | T | T | cds_wt_5070 |
| 5698190 | C | | T | T | T | T | T | — |
| 5705110 | C | | | T | T | T | T | cds_wt_5076 |
| 5708625 | C | | | T | T | T | T | cds_wt_5079 |
| 5709728 | C | | T | T | T | T | T | cds_wt_5079 |
| 5724677 | C | | | T | T | | T | cds_wt_5088 |
| 5727195 | C | | | | | | T | cds_wt_5090 |
| 5728510 | C | | | | | T | T | cds_wt_5091 |
| 5732980 | C | | | T | T | | T | cds_wt_5094 |
| 5738712 | G | | | | | | A | cds_wt_5097 |
| 5738846 | C | | | | | | T | cds_wt_5097 |
| 5745077 | C | | | | | | T | cds_wt_5099 |
| 5751489 | C | | | T | T | T | T | cds_wt_5101 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 5751716 | C | | | | | | T | cds_wt_5101 |
| 5753910 | C | | | T | T | T | T | cds_wt_5103 |
| 5755351 | C | | | T | T | T | T | cds_wt_5105 |
| 5756752 | C | | | | | | T | cds_wt_5107 |
| 5756803 | C | | | | | | T | cds_wt_5107 |
| 5760058 | C | | | | | | G | cds_wt_5110 |
| 5760301 | C | | | | | | T | cds_wt_5110 |
| 5763377 | C | | T | T | T | T | T | cds_wt_5111 |
| 5764363 | C | | | T | T | T | T | cds_wt_5111 |
| 5765100 | C | | | T | T | T | T | cds_wt_5111 |
| 5765446 | C | | | T | T | T | T | cds_wt_5111 |
| 5767623 | C | T | T | T | T | T | T | cds_wt_5113 |
| 5779664 | C | | | | | T | T | cds_wt_5122 |
| 5780052 | C | | | | | T | T | cds_wt_5122 |
| 5781808 | C | | | T | T | T | T | cds_wt_5123 |
| 5783477 | G | | A | A | A | A | A | — |
| 5788208 | C | | | T | T | T | T | cds_wt_5131 |
| 5790337 | C | | | T | T | T | T | cds_wt_5133 |
| 5791404 | C | | | T | T | T | T | cds_wt_5133 |
| 5793414 | G | A | A | A | A | A | A | cds_wt_5134 |
| 5795059 | C | | | T | T | T | T | — |
| 5795465 | G | | A | A | A | A | A | cds_wt_5136 |
| 5799803 | G | | | | | | A | cds_wt_5140 |
| 5803395 | C | | | T | T | T | T | cds_wt_5141 |
| 5803716 | G | | A | A | A | A | A | cds_wt_5141 |
| 5805398 | G | | A | A | A | A | A | cds_wt_5143 |
| 5805735 | G | | A | A | A | A | A | cds_wt_5143 |
| 5807160 | C | T | T | T | T | T | T | cds_wt_5145 |
| 5809295 | G | | | | | | A | cds_wt_5147 |
| 5810587 | G | | | | | A | A | — |
| 5811908 | C | | | | | | T | cds_wt_5148 |
| 5813504 | C | | | T | | | T | cds_wt_5149 |
| 5813556 | C | | T | T | T | T | T | cds_wt_5149 |
| 5834083 | C | | | | | | T | cds_wt_5170 |
| 5842153 | G | | | | | | C | cds_wt_5173 |
| 5843698 | T | | | | | | T/C | cds_wt_5173 |
| 5843724 | C | | | | | | C/A | cds_wt_5173 |
| 5843727 | C | | | | | | C/T | cds_wt_5173 |
| 5843751 | G | | | | | | G/A | cds_wt_5173 |
| 5843752 | G | | | | | | G/C | cds_wt_5173 |
| 5843766 | A | | | | | | A/G | cds_wt_5173 |
| 5843783 | A | | | | | | A/G | cds_wt_5173 |
| 5843786 | G | | | | | | G/C | cds_wt_5173 |
| 5843787 | C | | | | | | C/G | cds_wt_5173 |
| 5843795 | G | | | | | | G/C | cds_wt_5173 |
| 5843796 | T | | | | | | T/A | cds_wt_5173 |
| 5843797 | G | | | | | | G/T | cds_wt_5173 |
| 5843804 | C | | | | | | C/G | cds_wt_5173 |
| 5843810 | C | | | | | | C/T | cds_wt_5173 |
| 5843818 | T | | | | | | T/C | cds_wt_5173 |
| 5843819 | T | | | | | | T/G | cds_wt_5173 |
| 5843831 | C | | | | | | C/T | cds_wt_5173 |
| 5843863 | G | | | | | | G/T | cds_wt_5173 |
| 5843878 | C | | | | | | C/T | cds_wt_5173 |
| 5843881 | G | | | | | | G/T | cds_wt_5173 |
| 5843888 | G | | | | | | G/A | cds_wt_5173 |
| 5843890 | G | | | | | | G/C | cds_wt_5173 |
| 5843897 | C | | | | | | C/G | cds_wt_5173 |
| 5843899 | G | | | | | | G/T | cds_wt_5173 |
| 5843902 | C | | | | | | C/T | cds_wt_5173 |
| 5843942 | C | | | | | | C/T | cds_wt_5173 |
| 5843965 | G | | | | | | G/C | cds_wt_5173 |
| 5843980 | C | | | | | | C/G | cds_wt_5173 |
| 5843981 | C | | | | | | C/T | cds_wt_5173 |
| 5843987 | C | | | | | | C/G | cds_wt_5173 |
| 5843988 | C | | | | | | C/T | cds_wt_5173 |
| 5843992 | C | | | | | | C/T | cds_wt_5173 |
| 5857131 | C | | T | T | T | T | T | cds_wt_5188 |
| 5858663 | C | | | T | T | T | T | cds_wt_5190 |
| 5879695 | G | | A | A | A | A | A | cds_wt_5201 |
| 5880188 | T | | | | | | T/C | cds_wt_5201 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 5880203 | G | | | | | | G/C | cds_wt_5201 |
| 5880223 | C | | | | | | C/T | cds_wt_5201 |
| 5880241 | A | | | | | | A/C | cds_wt_5201 |
| 5880306 | C | | | | | | C/T | cds_wt_5201 |
| 5880307 | T | | | | | | T/C | cds_wt_5201 |
| 5880349 | A | | | | | | A/T | cds_wt_5201 |
| 5880412 | G | | | | | | G/A | cds_wt_5201 |
| 5880421 | C | | | | | | C/T | cds_wt_5201 |
| 5880430 | A | | | | | | A/G | cds_wt_5201 |
| 5880517 | T | T/C | T/C | T/C | T/C | T/C | T/C | cds_wt_5201 |
| 5882826 | G | | A | A | A | A | A | cds_wt_5202 |
| 5887657 | G | | | | | | C/G | cds_wt_5205 |
| 5887660 | G | | | | | | C/G | cds_wt_5205 |
| 5887684 | T | | | | | | C/T | cds_wt_5205 |
| 5887693 | T | | | | | | C/T | cds_wt_5205 |
| 5887696 | G | | | | | | C/G | cds_wt_5205 |
| 5887718 | G | | | | | | G/A | cds_wt_5205 |
| 5887732 | G | | | | | | G/C | cds_wt_5205 |
| 5887734 | G | | | | | | G/A | cds_wt_5205 |
| 5887765 | A | G/A | G/A | G/A | G/A | G/A | A/G/C | cds_wt_5205 |
| 5887771 | G | | | | | | G/C | cds_wt_5205 |
| 5887774 | G | | | | | | G/A | cds_wt_5205 |
| 5887775 | C | T/C | T/C | T/C | T/C | T/C | C/T | cds_wt_5205 |
| 5887784 | T | | | | T/C | | T/C | cds_wt_5205 |
| 5887792 | T | T/C | T/C | | T/C | | T/C | cds_wt_5205 |
| 5887810 | G | | | | | | G/C | cds_wt_5205 |
| 5887813 | G | | | | | | G/C | cds_wt_5205 |
| 5887816 | G | | | | | | G/C | cds_wt_5205 |
| 5887820 | G | G/C | G/C | G/C | G/C | G/C | G/C | cds_wt_5205 |
| 5887824 | C | C/G | C/G | C/G | C/G | C/G | C/G | cds_wt_5205 |
| 5887831 | G | | | | | | G/C | cds_wt_5205 |
| 5887837 | C | | | | | | C/T | cds_wt_5205 |
| 5887843 | C | | | | | | C/G | cds_wt_5205 |
| 5887892 | G | | A/G | A/G | A/G | A/G | A/G | cds_wt_5205 |
| 5887931 | G | G/A/C | A/G | G/A | G/A | G/A | G/A/C | cds_wt_5205 |
| 5887937 | G | | | | | | G/C | cds_wt_5205 |
| 5887938 | C | | | | | | C/G | cds_wt_5205 |
| 5887942 | C | | | | | | C/G | cds_wt_5205 |
| 5887945 | G | | | | | | G/C | cds_wt_5205 |
| 5887951 | G | | | | | | C/G | cds_wt_5205 |
| 5887960 | G | | | | | | G/C | cds_wt_5205 |
| 5887969 | G | | | | | | G/C | cds_wt_5205 |
| 5887970 | C | | | | | | C/G | cds_wt_5205 |
| 5887971 | A | | | | | | A/G | cds_wt_5205 |
| 5887974 | G | | | | | | G/T | cds_wt_5205 |
| 5887975 | C | | | | | | C/T | cds_wt_5205 |
| 5887977 | T | | | | | | T/A | cds_wt_5205 |
| 5887982 | C | | | | | | C/A/T | cds_wt_5205 |
| 5887988 | G | | | | | | G/T | cds_wt_5205 |
| 5887990 | C | | | | | | C/G | cds_wt_5205 |
| 5888003 | A | | | | | | A/C | cds_wt_5205 |
| 5888004 | A | | | | | | A/G | cds_wt_5205 |
| 5888005 | A | | | | | | A/G | cds_wt_5205 |
| 5888026 | C | | | | | | C/T | cds_wt_5205 |
| 5888050 | G | | | | | | G/C | cds_wt_5205 |
| 5888053 | G | | | | | | G/C | cds_wt_5205 |
| 5888056 | G | | | | | | G/C | cds_wt_5205 |
| 5888083 | G | | | | | | G/C | cds_wt_5205 |
| 5888092 | C | | | | | | C/G | cds_wt_5205 |
| 5888095 | C | | | | | | C/G | cds_wt_5205 |
| 5888102 | G | | | | | | G/A | cds_wt_5205 |
| 5888103 | T | | | | | | T/C | cds_wt_5205 |
| 5888122 | C | | | | | | C/T | cds_wt_5205 |
| 5888143 | G | | | | | | G/C | cds_wt_5205 |
| 5890782 | G | | | | | | G/C | cds_wt_5206 |
| 5890839 | T | T/C | T/C | T/C | T/C | T/C | C/T | cds_wt_5206 |
| 5890849 | T | | | | | | A/T | cds_wt_5206 |
| 5890851 | C | | | | | | G/C | cds_wt_5206 |
| 5890863 | C | | | | | | G/C | cds_wt_5206 |
| 5890864 | G | | | | | | A/G | cds_wt_5206 |
| 5890869 | G | | | | | | T/G | cds_wt_5206 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 5890872 | C | | | | | | T/C | cds_wt_5206 |
| 5890893 | C | | | | | | T/C | cds_wt_5206 |
| 5890899 | C | | | | | | T/C | cds_wt_5206 |
| 5890906 | G | | | | | | A/G | cds_wt_5206 |
| 5890908 | G | | | | | | G/A | cds_wt_5206 |
| 5890914 | C | | | | | | T/C | cds_wt_5206 |
| 5890920 | C | | | | | | G/C | cds_wt_5206 |
| 5890923 | C | | | | | | T/C | cds_wt_5206 |
| 5890926 | C | | | | | | G/C | cds_wt_5206 |
| 5890971 | C | | C/T | C/T | C/T | C/T | C/T | cds_wt_5206 |
| 5890992 | C | T/C | T/C | T/C | T/C | T/C | C/T | cds_wt_5206 |
| 5891058 | G | | | | | | C/G | cds_wt_5206 |
| 5891061 | G | | | | | | C/G | cds_wt_5206 |
| 5891070 | C | | | | | | T/C | cds_wt_5206 |
| 5891094 | T | | | | | | C/T | cds_wt_5206 |
| 5891097 | C | | | | | | C/G | cds_wt_5206 |
| 5891100 | C | | | | | | C/T | cds_wt_5206 |
| 5891121 | C | | | | | | T/C | cds_wt_5206 |
| 5891142 | G | | | | | | G/C | cds_wt_5206 |
| 5891145 | C | | | | | | C/G | cds_wt_5206 |
| 5891148 | G | | | | | | C/G | cds_wt_5206 |
| 5891187 | G | | G/C | G/C | G/C | G/C | G/C | cds_wt_5206 |
| 5891220 | G | | | | | | G/C | cds_wt_5206 |
| 5891247 | T | | | | | | T/C | cds_wt_5206 |
| 5891250 | C | | | | | | C/T | cds_wt_5206 |
| 5891263 | T | | | | | | T/C | cds_wt_5206 |
| 5892300 | C | | | | | | C/T | cds_wt_5206 |
| 5892304 | A | | | | | | A/C | cds_wt_5206 |
| 5892312 | C | | | | | | C/G | cds_wt_5206 |
| 5892330 | C | | | | | | C/T | cds_wt_5206 |
| 5892370 | A | | | | | | A/G | cds_wt_5206 |
| 5892413 | C | | | | | | C/T | cds_wt_5206 |
| 5892414 | T | | | | | | T/C | cds_wt_5206 |
| 5892456 | A | | | | | | A/T | cds_wt_5206 |
| 5892519 | G | G/A | G/A | G/A | G/A | G/A | G/A | cds_wt_5206 |
| 5894264 | G | | | | | | A | cds_wt_5207 |
| 5894322 | G | | | | | | A | cds_wt_5207 |
| 5894986 | A | | | | | | A/G | cds_wt_5207 |
| 5894989 | T | | | | | | T/C | cds_wt_5207 |
| 5895041 | G | | | | | | G/A | cds_wt_5207 |
| 5895043 | C | | | | | | C/G | cds_wt_5207 |
| 5895049 | C | | | | | | C/G | cds_wt_5207 |
| 5895054 | T | | | | | | T/C | cds_wt_5207 |
| 5895058 | G | | | | | | G/C | cds_wt_5207 |
| 5895073 | C | C/G | C/G | C/G | C/G | C/G | C/G | cds_wt_5207 |
| 5895100 | G | G/C | G/C | G/C | | | G/C | cds_wt_5207 |
| 5895106 | C | | | | | | G/C | cds_wt_5207 |
| 5895108 | T | | | | | | C/T | cds_wt_5207 |
| 5895115 | C | | | | | | G/C | cds_wt_5207 |
| 5895118 | A | | | | | | C/A | cds_wt_5207 |
| 5895127 | C | | | | | | G/C | cds_wt_5207 |
| 5895130 | C | | | | | | G/C | cds_wt_5207 |
| 5895137 | A | | | | | | T/A | cds_wt_5207 |
| 5895142 | T | | | | | | C/T | cds_wt_5207 |
| 5895147 | G | | | | | | C/G | cds_wt_5207 |
| 5895181 | C | C/T | C/T | C/T | C/T | C/T | T/C | cds_wt_5207 |
| 5895254 | A | | | | | | G/A | cds_wt_5207 |
| 5895280 | T | T/C | C/T | T/C | T/C | T/C | C/T | cds_wt_5207 |
| 5895283 | G | G/C | G/C | G/C | G/C | G/C | C/G | cds_wt_5207 |
| 5895298 | C | C/G | C/G | C/G | C/G | C/G | G/C | cds_wt_5207 |
| 5895299 | G | G/A | G/A | G/A | G/A | G/A | A/G | cds_wt_5207 |
| 5895319 | C | | | | | | G/C | cds_wt_5207 |
| 5895328 | C | | | | | | T/C | cds_wt_5207 |
| 5895334 | C | | | | | | T/C | cds_wt_5207 |
| 5895340 | G | | | | | | C/G | cds_wt_5207 |
| 5895346 | G | | | | | | G/C | cds_wt_5207 |
| 5895349 | C | | | | | | T/C | cds_wt_5207 |
| 5895358 | C | | | | | | T/C | cds_wt_5207 |
| 5895361 | C | | | | | | G/C | cds_wt_5207 |
| 5895370 | C | | | | | | C/T | cds_wt_5207 |
| 5895391 | C | | | | | | T/C | cds_wt_5207 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 5895436 | G | | | | | | C/G | cds_wt_5207 |
| 5895437 | A | | | | | | G/A | cds_wt_5207 |
| 5895439 | C | | | | | | G/C | cds_wt_5207 |
| 5895493 | G | | G/C | G/C | G/C | G/C | C/G | cds_wt_5207 |
| 5895496 | G | | G/C | G/C | G/C | G/C | C/G | cds_wt_5207 |
| 5895505 | C | | | | | | T/C | cds_wt_5207 |
| 5895529 | T | T/C | C/T | T/C | T/C | T/C | C/T | cds_wt_5207 |
| 5895532 | C | C/G | G/C | C/G | C/G | C/G | G/C | cds_wt_5207 |
| 5895577 | G | | | | | | C/G | cds_wt_5207 |
| 5895580 | C | | | | | | G/C | cds_wt_5207 |
| 5895628 | T | | | | | | C/T/G | cds_wt_5208 |
| 5895629 | T | | | | | | C/T | cds_wt_5208 |
| 5895661 | C | | | | | | C/G | cds_wt_5208 |
| 5895847 | C | C/G | C/G | C/G | C/G | C/G | C/G | cds_wt_5208 |
| 5895878 | G | G/A | | G/A | G/A | G/A | G/A | cds_wt_5208 |
| 5895898 | C | | C/T | C/T | C/T | C/T | C/T | cds_wt_5208 |
| 5895899 | A | | A/C | A/C | | A/C | A/C | cds_wt_5208 |
| 5895915 | A | A/G | A/G | A/G | A/G | A/G | G/A | cds_wt_5208 |
| 5895949 | C | | | | | | T/C | cds_wt_5208 |
| 5896081 | C | C/G | C/G | C/G | C/G | C/G | G/C | cds_wt_5208 |
| 5896085 | C | C/T | C/T | C/T | C/T | | T/C | cds_wt_5208 |
| 5896090 | C | C/T | C/T | C/T | C/T | | T/C | cds_wt_5208 |
| 5896115 | C | | | | | | C/T | cds_wt_5208 |
| 5896120 | A | | | | | | A/G | cds_wt_5208 |
| 5896123 | G | | | | | | G/C | cds_wt_5208 |
| 5896126 | T | | | | | | T/C | cds_wt_5208 |
| 5896147 | T | | | | | | T/G | cds_wt_5208 |
| 5896148 | T | | | | | | T/C | cds_wt_5208 |
| 5896154 | T | | | | | | T/C | cds_wt_5208 |
| 5896156 | G | | | | | | G/C | cds_wt_5208 |
| 5896159 | G | | | | | | G/C | cds_wt_5208 |
| 5896246 | T | | | | | | T/C | cds_wt_5208 |
| 5896279 | C | | | | | | T/C | cds_wt_5208 |
| 5896312 | A | | | | | | A/G | cds_wt_5208 |
| 5896324 | A | | | | | | A/G | cds_wt_5208 |
| 5896333 | G | | | | | | G/A | cds_wt_5208 |
| 5896381 | G | | | | | | G/C | cds_wt_5208 |
| 5900925 | C | | | | | | C/G | cds_wt_5209 |
| 5900943 | G | | | | | | G/T | cds_wt_5209 |
| 5900949 | C | | | | | | C/G | cds_wt_5209 |
| 5900955 | C | | | | | | C/T | cds_wt_5209 |
| 5900958 | C | | | | | | C/G | cds_wt_5209 |
| 5900965 | T | | | | | | T/C | cds_wt_5209 |
| 5900971 | G | | | | | | G/C | cds_wt_5209 |
| 5900972 | C | | | | | | C/G | cds_wt_5209 |
| 5900997 | C | | | | | | C/T | cds_wt_5209 |
| 5901000 | C | | | | | | C/T | cds_wt_5209 |
| 5901015 | A | | | | | | A/C | cds_wt_5209 |
| 5901034 | C | | | | | | C/A | cds_wt_5209 |
| 5901048 | C | | | | | | C/T | cds_wt_5209 |
| 5901050 | G | | | | | | G/A | cds_wt_5209 |
| 5901057 | C | | | | | | C/T | cds_wt_5209 |
| 5901068 | G | | | | | | G/A | cds_wt_5209 |
| 5901071 | A | | | | | | A/G | cds_wt_5209 |
| 5901078 | G | G/T | G/T | | | G/T | G/T | cds_wt_5209 |
| 5901099 | C | C/T | C/T | C/T | C/T | C/T | C/T | cds_wt_5209 |
| 5901123 | T | | | | | | T/A | cds_wt_5209 |
| 5901135 | G | | | | | | C/G | cds_wt_5209 |
| 5901172 | G | | | | | | A/G | cds_wt_5209 |
| 5901186 | G | | | | | | G/A | cds_wt_5209 |
| 5901195 | T | | | | | | T/C | cds_wt_5209 |
| 5901204 | G | | | | | | G/A | cds_wt_5209 |
| 5901219 | C | | | | | | A/C | cds_wt_5209 |
| 5901342 | T | T/C | T/C | T/C | T/C | T/C | C/T | cds_wt_5209 |
| 5901345 | T | | | | | | T/G | cds_wt_5209 |
| 5901346 | T | | | | | | T/C | cds_wt_5209 |
| 5901354 | C | | | | | | C/G | cds_wt_5209 |
| 5901615 | C | T/C | T/C | T/C | T/C | T/C | T/C | cds_wt_5209 |
| 5901617 | G | C/G | C/G | C/G | C/G | C/G | C/G | cds_wt_5209 |
| 5901660 | C | | | | | | C/G | cds_wt_5209 |
| 5901664 | T | T/G | T/G | T/G | T/G | T/G | T/G | cds_wt_5209 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 5901669 | C | C/A | C/A | | C/A | C/A | A/C | cds_wt_5209 |
| 5901673 | T | | | | | | A/T | cds_wt_5209 |
| 5901675 | C | | | | | | G/C | cds_wt_5209 |
| 5901679 | C | | | | | | C/T | cds_wt_5209 |
| 5901688 | C | | | | | | T/C | cds_wt_5209 |
| 5901689 | T | | | | | | A/T | cds_wt_5209 |
| 5901690 | G | | | | | | C/G | cds_wt_5209 |
| 5901698 | C | | | | | | A/C | cds_wt_5209 |
| 5901712 | G | | | | | | A/G | cds_wt_5209 |
| 5901713 | T | | | | | | A/T | cds_wt_5209 |
| 5901714 | T | | | | | | T/C | cds_wt_5209 |
| 5901719 | G | | | | | | G/C | cds_wt_5209 |
| 5901726 | G | | | | | | G/C | cds_wt_5209 |
| 5901729 | C | | | | | | C/G | cds_wt_5209 |
| 5901732 | C | | | | | | C/T | cds_wt_5209 |
| 5901733 | G | | | | | | G/A | cds_wt_5209 |
| 5901738 | C | | | | | | C/G | cds_wt_5209 |
| 5901752 | C | | | | | | C/T | cds_wt_5209 |
| 5901757 | G | | | | | | G/A | cds_wt_5209 |
| 5901764 | T | | | | | | C/T | cds_wt_5209 |
| 5901767 | C | | | | | | G/C | cds_wt_5209 |
| 5901771 | G | | | | | | C/G | cds_wt_5209 |
| 5901790 | C | | | | | | G/C | cds_wt_5209 |
| 5901791 | G | | | | | | C/G | cds_wt_5209 |
| 5901793 | G | | | | | | A/G | cds_wt_5209 |
| 5901807 | G | | | | | | C/G | cds_wt_5209 |
| 5901824 | G | | | | | | A/G | cds_wt_5209 |
| 5901826 | G | | | | | | G/A | cds_wt_5209 |
| 5901830 | T | | | | | | T/G | cds_wt_5209 |
| 5901840 | A | | | | | | A/C | cds_wt_5209 |
| 5902914 | C | T | T | T | T | T | T | cds_wt_5209 |
| 5905708 | G | | A | A | A | A | A | cds_wt_5211 |
| 5925008 | C | T | T | T | T | T | T | — |
| 5925517 | G | | A | A | A | A | A | cds_wt_5227 |
| 5926357 | G | | | | | | A | cds_wt_5228 |
| 5928875 | C | | | | | T | T | cds_wt_5231 |
| 5930205 | C | T | T | T | T | T | T | cds_wt_5232 |
| 5933164 | G | A | A | A | A | A | A | — |
| 5947433 | C | T | T | T | T | T | T | cds_wt_5246 |
| 5957471 | G | | | A | A | A | A | — |
| 5960825 | C | | T | T | T | T | T | cds_wt_5274 |
| 5961809 | T | G/T | | | G/T | G/T | G/T | cds_wt_5275 |
| 5961866 | T | | | | | | T/A | — |
| 5970914 | C | | T | T | T | T | T | cds_wt_5279 |
| 5975910 | A | A/G | A/G | A/G | A/G | A/G | G/A | cds_wt_5283 |
| 5975911 | A | A/G | A/G | A/G | A/G | A/G | G/A | — |
| 5975926 | A | A/G | A/G | A/G | A/G | A/G | G/A | — |
| 5978267 | C | T | T | T | T | T | T | cds_wt_5286 |
| 6005749 | C | | T | T | T | T | T | cds_wt_5311 |
| 6009383 | G | A | A | A | A | A | A | cds_wt_5315 |
| 6010024 | C | | | T | T | T | T | cds_wt_5316 |
| 6026234 | C | | T | T | T | T | T | — |
| 6033950 | C | T | T | T | T | T | T | cds_wt_5324 |
| 6042035 | C | | | | | | T | — |
| 6050103 | C | | | | | C/T | C/T | cds_wt_5343 |
| 6050112 | A | | | | | | C/A | cds_wt_5343 |
| 6050115 | G | | | | | | G/C | cds_wt_5343 |
| 6050116 | C | | | | | | C/G | cds_wt_5343 |
| 6050118 | G | | | | | | G/A | cds_wt_5343 |
| 6050509 | G | G/A | A/G | A/G | A/G | A/G | A/G | cds_wt_5343 |
| 6050536 | G | | | | | | G/C | cds_wt_5343 |
| 6050556 | G | | | | | | C/G | cds_wt_5343 |
| 6050557 | C | | | | | | A/C | cds_wt_5343 |
| 6050584 | T | | | | | | T/A | cds_wt_5343 |
| 6050694 | T | | | | | | T/C | cds_wt_5343 |
| 6050727 | A | | | G/A | G/A | G/A | G/A | cds_wt_5343 |
| 6050730 | G | | C/G | C/G | C/G | C/G | C/G | cds_wt_5343 |
| 6050769 | G | | | | | | G/A | cds_wt_5343 |
| 6050820 | A | | | | | | A/C | cds_wt_5343 |
| 6050822 | T | | | | | | T/C | cds_wt_5343 |
| 6050824 | C | | | | | | C/T | cds_wt_5343 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 6050947 | T | | | | | | C/T | cds_wt_5343 |
| 6050949 | A | | | | | | G/A | cds_wt_5343 |
| 6050952 | T | | | | | | T/C | cds_wt_5343 |
| 6050958 | G | | | | | | A/G | cds_wt_5343 |
| 6050965 | A | | | | | | C/A | cds_wt_5343 |
| 6050971 | T | | | | | | C/T | cds_wt_5343 |
| 6051079 | A | G/A | G/A | G/A | G/A | G/A | A/G | cds_wt_5343 |
| 6051571 | G | A | A | A | A | A | A | — |
| 6072579 | C | | | | T | T | T | — |
| 6074412 | G | A | A | A | A | A | A | — |
| 6075058 | G | A | A | A | A | A | A | — |
| 6083188 | C | | | | | T | T | — |
| 6085177 | C | | | | | T | T | cds_wt_5373 |
| 6090298 | C | | T | T | T | T | T | cds_wt_5376 |
| 6094419 | C | T | T | T | T | T | T | cds_wt_5383 |
| 6095825 | C | T | T | T | T | T | T | cds_wt_5386 |
| 6098808 | C | T | T | T | T | T | T | cds_wt_5388 |
| 6099142 | C | T | T | T | T | T | T | cds_wt_5388 |
| 6099801 | C | T | T | T | T | T | T | — |
| 6100131 | C | T | T | T | T | T | T | cds_wt_5389 |
| 6100928 | C | T | T | T | T | T | T | cds_wt_5389 |
| 6114598 | C | | T | T | T | T | T | cds_wt_5399 |
| 6129757 | G | A | A | A | A | A | A | — |
| 6151020 | G | A | A | A | A | A | A | cds_wt_5451 |
| 6157309 | C | | T | T | T | T | T | cds_wt_5456 |
| 6157376 | C | | T | T | T | T | T | cds_wt_5456 |
| 6178150 | G | | A | A | A | A | A | cds_wt_5472 |
| 6188180 | C | | T | T | T | T | T | cds_wt_5481 |
| 6191683 | G | A | | | A | | A | cds_wt_5487 |
| 6207945 | G | A | A | A | A | A | A | cds_wt_5501 |
| 6216366 | C | | T | T | | T | T | cds_wt_5511 |
| 6230439 | A | | G | G | G | | G | cds_wt_5526 |
| 6251389 | G | | A | A | A | A | A | cds_wt_5542 |
| 6251652 | G | | A | A | A | A | A | cds_wt_5542 |
| 6255100 | G | | A | A | A | A | A | cds_wt_5546 |
| 6264179 | G | | | A | A | A | A | cds_wt_5554 |
| 6265855 | G | | A | A | A | A | A | — |
| 6267856 | G | | | A | A | A | A | cds_wt_5556 |
| 6278700 | G | A | A | A | A | A | A | — |
| 6281103 | C | | | | | T | T | cds_wt_5566 |
| 6282875 | C | | T | T | T | T | T | cds_wt_5567 |
| 6286620 | C | | | | | T | T | cds_wt_5571 |
| 6288364 | C | | T | T | T | T | T | cds_wt_5571 |
| 6291716 | C | | T | T | T | T | T | cds_wt_5574 |
| 6297821 | C | | T | T | T | T | T | cds_wt_5578 |
| 6303632 | G | | | | | A | A | cds_wt_5583 |
| 6306219 | C | | T | T | T | T | T | cds_wt_5586 |
| 6309112 | G | | | | | A | A | cds_wt_5588 |
| 6322894 | G | | | | | | A | — |
| 6328731 | C | T | T | T | T | T | T | cds_wt_5605 |
| 6331035 | G | A | A | A | A | A | A | cds_wt_5607 |
| 6338677 | G | A | A | A | A | A | A | cds_wt_5615 |
| 6339429 | C | | | | | T | T | — |
| 6344180 | C | | | | T | T | T | cds_wt_5619 |
| 6346415 | C | | | | T | | T | cds_wt_5622 |
| 6361477 | C | | T | T | T | T | T | cds_wt_5639 |
| 6362282 | G | | | A | A | A | A | cds_wt_5639 |
| 6366940 | C | T | | | T | | T | cds_wt_5641 |
| 6368217 | G | | | | | A | A | cds_wt_5643 |
| 6369699 | G | | | | | A | A | cds_wt_5644 |
| 6375315 | G | A | A | A | A | A | A | cds_wt_5648 |
| 6381431 | C | | T | T | T | T | T | cds_wt_5654 |
| 6401947 | G | A | A | | | A | A | — |
| 6403645 | C | | | | T | T | T | cds_wt_5675 |
| 6437676 | C | T | T | T | T | T | T | cds_wt_5697 |
| 6439389 | G | | | | | A | A | cds_wt_5698 |
| 6450624 | C | | T | T | T | T | T | — |
| 6454248 | C | | T | T | T | T | T | cds_wt_5708 |
| 6454843 | C | | | | | T | T | — |
| 6456678 | C | | | | | T | T | cds_wt_5711 |
| 6456912 | C | | T | T | T | T | T | cds_wt_5712 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 6459047 | G | | | | | | A | cds_wt_5715 |
| 6460584 | T | | C | C | C | C | C | — |
| 6471884 | G | | | | | A | A | cds_wt_5729 |
| 6485358 | C | | T | T | T | T | T | cds_wt_5741 |
| 6499172 | G | | | A | A | A | A | cds_wt_5757 |
| 6500551 | G | | | | | | A | cds_wt_5760 |
| 6507389 | C | T | T | T | T | T | T | cds_wt_5765 |
| 6517707 | C | | | T | T | | T | — |
| 6525706 | G | | | | | A | A | cds_wt_5775 |
| 6538378 | C | | | | | T | T | cds_wt_5786 |
| 6542765 | C | | T | T | T | T | T | cds_wt_5790 |
| 6543445 | C | | T | T | T | T | T | cds_wt_5791 |
| 6543579 | C | | T | T | T | T | T | cds_wt_5791 |
| 6545779 | C | | T | T | T | T | T | cds_wt_5792 |
| 6550507 | C | | | | | T | T | cds_wt_5797 |
| 6553219 | G | | A | A | A | A | A | cds_wt_5800 |
| 6553546 | G | | A | | | | A | cds_wt_5800 |
| 6553589 | G | | A | A | A | A | A | cds_wt_5800 |
| 6555594 | G | | A | A | A | A | A | cds_wt_5804 |
| 6556192 | C | | | | | | T | cds_wt_5804 |
| 6560301 | C | | T | T | T | T | T | — |
| 6561416 | G | | A | A | A | A | A | cds_wt_5810 |
| 6563658 | C | | T | T | | | T | cds_wt_5812 |
| 6564054 | C | | T | T | T | T | T | cds_wt_5812 |
| 6564511 | C | | | T | T | T | T | cds_wt_5813 |
| 6564827 | C | | T | T | T | T | T | cds_wt_5813 |
| 6567102 | C | | T | T | T | T | T | cds_wt_5815 |
| 6567313 | C | | | | | T | T | cds_wt_5816 |
| 6568360 | C | | | | T | | T | cds_wt_5817 |
| 6569524 | C | | T | T | T | T | T | cds_wt_5819 |
| 6569696 | G | | A | A | A | A | A | cds_wt_5819 |
| 6570943 | C | | T | T | T | T | T | cds_wt_5820 |
| 6572188 | C | | | T | T | | T | cds_wt_5821 |
| 6572441 | C | | | T | T | | T | cds_wt_5821 |
| 6580904 | G | | A | A | A | A | A | cds_wt_5830 |
| 6581219 | G | | | | | | G/A | cds_wt_5830 |
| 6589934 | C | | T | T | T | T | T | cds_wt_5837 |
| 6595494 | C | T | | T | T | | T | — |
| 6604343 | C | | | | | | T | cds_wt_5851 |
| 6615272 | C | | | | | | T | cds_wt_5859 |
| 6617190 | G | A | A | A | A | A | A | cds_wt_5861 |
| 6619058 | C | | | | | | T | cds_wt_5862 |
| 6622561 | G | A | A | A | A | A | A | cds_wt_5864 |
| 6629950 | C | | | | T | T | T | cds_wt_5870 |
| 6632292 | C | T | T | T | T | T | T | cds_wt_5872 |
| 6656015 | C | T | | | | T | T | cds_wt_5891 |
| 6669477 | G | | | | | A | A | cds_wt_5901 |
| 6690831 | C | | T | T | T | T | T | cds_wt_5923 |
| 6690855 | G | | | | | A | A | cds_wt_5923 |
| 6696960 | G | | | | | A | A | — |
| 6705369 | G | | A | A | A | A | A | cds_wt_5935 |
| 6716231 | G | | A | A | A | A | A | — |
| 6729998 | G | | A | A | A | A | A | cds_wt_5955 |
| 6734341 | C | | | | T | T | T | cds_wt_5960 |
| 6758247 | G | | | | | A | A | cds_wt_5984 |
| 6759384 | C | | | | | | T | cds_wt_5985 |
| 6767085 | G | | | | | A | A | cds_wt_5990 |
| 6769984 | C | | | | T | T | T | cds_wt_5994 |
| 6780798 | A | | | G | G | G | G | cds_wt_6005 |
| 6801699 | G | A | A | A | A | A | A | cds_wt_6025 |
| 6805336 | G | A | A | A | A | A | A | cds_wt_6026 |
| 6805990 | G | A | A | A | A | A | A | cds_wt_6026 |
| 6808471 | C | | T | T | T | T | T | — |
| 6818998 | G | | A | A | A | A | A | cds_wt_6038 |
| 6830990 | G | | | | | A | A | cds_wt_6049 |
| 6843179 | C | | | | | | T | cds_wt_6061 |
| 6847192 | G | | | | | | A | cds_wt_6063 |
| 6854404 | C | | | | | | T | cds_wt_6068 |
| 6858684 | G | | A | A | A | A | A | cds_wt_6073 |
| 6883984 | C | | T | T | T | T | T | cds_wt_6092 |
| 6884717 | G | | | | | A | A | cds_wt_6092 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 6890659 | G | | A | A | A | A | A | cds_wt_6098 |
| 6892977 | G | | A | A | A | A | A | cds_wt_6100 |
| 6898871 | C | | T | T | T | T | T | cds_wt_6107 |
| 6902839 | A | T | T | T | T | T | T | cds_wt_6112 |
| 6911746 | G | | A | A | A | A | A | cds_wt_6117 |
| 6916561 | G | A | A | A | A | A | A | cds_wt_6122 |
| 6916943 | C | | T | T | T | T | T | cds_wt_6122 |
| 6927456 | G | A | | A | A | | A | cds_wt_6133 |
| 6960103 | G | | A | A | A | A | A | cds_wt_6158 |
| 6961070 | C | | | | | T | T | cds_wt_6159 |
| 6968534 | C | T | T | T | T | T | T | — |
| 6973392 | G | | A | A | A | A | A | — |
| 6987945 | G | | A | A | A | A | A | cds_wt_6176 |
| 6993597 | G | | | | A | A | A | cds_wt_6181 |
| 6995391 | C | | T | T | T | T | T | cds_wt_6182 |
| 6996621 | C | | | | | | T | cds_wt_6183 |
| 6999127 | C | | T | T | T | T | T | cds_wt_6187 |
| 6999520 | C | | | | | T | T | cds_wt_6187 |
| 6999817 | C | | T | T | T | T | T | cds_wt_6188 |
| 7000264 | C | | T | T | T | T | T | cds_wt_6188 |
| 7002458 | G | | A | A | A | A | A | cds_wt_6190 |
| 7003486 | G | | | | | A | A | cds_wt_6192 |
| 7003496 | G | | | | | A | A | cds_wt_6192 |
| 7004068 | C | T | T | T | T | T | T | cds_wt_6193 |
| 7009952 | C | | | | | T | T | — |
| 7010119 | C | | | | | T | T | cds_wt_6198 |
| 7010712 | C | | | | | T | T | cds_wt_6199 |
| 7015917 | G | | A | A | A | A | A | cds_wt_6203 |
| 7019067 | C | | T | T | T | T | T | — |
| 7019437 | C | | T | T | T | T | T | cds_wt_6206 |
| 7020227 | C | | T | T | T | T | T | cds_wt_6207 |
| 7021026 | C | | T | T | T | T | T | cds_wt_6209 |
| 7023202 | C | | T | T | T | T | T | cds_wt_6212 |
| 7024113 | C | | | | | T | T | cds_wt_6213 |
| 7026584 | C | | T | T | T | T | T | cds_wt_6217 |
| 7028273 | C | | T | T | T | T | T | cds_wt_6218 |
| 7028622 | C | | | | | T | T | cds_wt_6218 |
| 7029812 | C | | | | | | T | cds_wt_6219 |
| 7031076 | C | | | | | | T | cds_wt_6219 |
| 7040546 | C | T | T | T | T | T | T | cds_wt_6233 |
| 7053643 | C | | T | T | T | T | T | cds_wt_6243 |
| 7065316 | C | | T | T | T | T | T | cds_wt_6252 |
| 7075215 | C | | T | T | T | T | T | cds_wt_6264 |
| 7098642 | C | | T | T | T | T | T | cds_wt_6283 |
| 7099792 | C | | T | T | T | T | T | cds_wt_6284 |
| 7100617 | C | | | T | T | T | T | cds_wt_6285 |
| 7101023 | C | | T | T | T | T | T | cds_wt_6285 |
| 7103392 | C | | T | T | T | T | T | — |
| 7104098 | C | | T | T | T | T | T | cds_wt_6288 |
| 7109594 | C | | T | T | T | T | T | cds_wt_6291 |
| 7110600 | C | | T | T | T | T | T | cds_wt_6293 |
| 7110641 | C | | T | T | T | T | T | cds_wt_6293 |
| 7112833 | C | | T | T | T | T | T | cds_wt_6295 |
| 7116801 | C | T | T | T | T | T | T | cds_wt_6297 |
| 7135624 | G | A | A | A | A | A | A | cds_wt_6314 |
| 7135635 | G | A | | | | | A | cds_wt_6314 |
| 7146220 | G | | A | A | A | A | A | — |
| 7160415 | C | | T | T | T | | T | — |
| 7161529 | G | | A | A | A | A | A | cds_wt_6338 |
| 7162249 | G | | A | A | A | A | A | cds_wt_6338 |
| 7165660 | C | | | | T | T | T | — |
| 7176091 | G | A | A | A | A | | A | cds_wt_6348 |
| 7177869 | G | A | A | A | A | A | A | cds_wt_6350 |
| 7185280 | G | | | | | | A | cds_wt_6354 |
| 7186525 | C | | T | T | T | T | T | cds_wt_6355 |
| 7211965 | G | | | | | | G/C | cds_wt_6378 |
| 7211966 | A | | | | | | A/T | cds_wt_6378 |
| 7211975 | C | | | | | | C/T | cds_wt_6378 |
| 7211983 | G | | | | | | G/T | cds_wt_6378 |
| 7211992 | G | | | | | | G/T | cds_wt_6378 |
| 7211994 | G | | | | | | G/A | cds_wt_6378 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 7212006 | T | | | | | | T/C | cds_wt_6378 |
| 7212047 | C | | | | | | C/G | cds_wt_6378 |
| 7212067 | T | | | | | | T/A | cds_wt_6378 |
| 7212068 | G | | | | | | G/C | cds_wt_6378 |
| 7212075 | G | | | | | | G/C | cds_wt_6378 |
| 7212088 | A | | | | | | A/T | cds_wt_6378 |
| 7212097 | T | | | | | | T/C | cds_wt_6378 |
| 7212113 | T | | | | | | T/C | cds_wt_6378 |
| 7212121 | G | | | | | | G/T | cds_wt_6378 |
| 7212122 | T | | | | | | T/C | cds_wt_6378 |
| 7212142 | T | | | | | | T/C | cds_wt_6378 |
| 7212144 | C | | | | | | C/G | cds_wt_6378 |
| 7212151 | T | | | | | | T/G | cds_wt_6378 |
| 7212156 | G | | | | | | G/C | cds_wt_6378 |
| 7212180 | C | | | | | | C/G | cds_wt_6378 |
| 7212182 | G | | | | | | G/C | cds_wt_6378 |
| 7212183 | T | | | | | | T/C | cds_wt_6378 |
| 7212206 | T | | | | | | T/C | cds_wt_6378 |
| 7216330 | G | A | A | A | A | A | A | cds_wt_6380 |
| 7218939 | G | A | A | A | A | A | A | — |
| 7219494 | G | | | | | A | A | — |
| 7224067 | G | | | | | | A | cds_wt_6388 |
| 7228023 | G | | | | | | A | — |
| 7240925 | G | A | | A | A | | A | cds_wt_6398 |
| 7241497 | C | | | T | T | | T | cds_wt_6399 |
| 7264121 | G | | A | A | A | A | A | cds_wt_6416 |
| 7266647 | G | A | A | A | A | A | A | cds_wt_6419 |
| 7283171 | C | T | T | T | T | T | T | cds_wt_6434 |
| 7294161 | A | | G | G | G | G | G | — |
| 7303836 | C | T | T | T | T | T | T | cds_wt_6454 |
| 7310019 | G | | A | A | A | A | A | cds_wt_6461 |
| 7314132 | C | | T | T | T | T | T | cds_wt_6463 |
| 7314146 | C | | T | T | T | T | T | cds_wt_6463 |
| 7319151 | G | A | A | A | A | A | A | cds_wt_6467 |
| 7319658 | G | | A | A | A | A | A | cds_wt_6467 |
| 7321495 | G | | | | | | A | cds_wt_6470 |
| 7329181 | G | | A | A | A | A | A | cds_wt_6478 |
| 7330808 | G | | A | A | A | A | A | cds_wt_6480 |
| 7362245 | C | | | | | T | T | cds_wt_6510 |
| 7369374 | C | | | | | T | T | cds_wt_6518 |
| 7371536 | C | | | | | T | T | cds_wt_6520 |
| 7377855 | C | | T | T | T | T | T | cds_wt_6527 |
| 7384932 | G | A | A | A | A | A | A | cds_wt_6533 |
| 7385124 | C | | T | T | T | T | T | cds_wt_6533 |
| 7386113 | G | | A | A | A | A | A | cds_wt_6533 |
| 7389303 | C | | T | T | T | T | T | cds_wt_6535 |
| 7394213 | C | | T | T | T | T | T | cds_wt_6540 |
| 7394997 | C | | | | | T | T | cds_wt_6540 |
| 7400636 | C | | | | | T | T | — |
| 7401592 | C | | T | T | T | T | T | cds_wt_6544 |
| 7422484 | G | | A | A | A | A | A | cds_wt_6563 |
| 7446288 | G | | | | | | A | — |
| 7451085 | C | | T | T | T | T | T | — |
| 7452627 | C | | T | T | T | T | T | cds_wt_6589 |
| 7453489 | C | T | T | T | T | T | T | cds_wt_6590 |
| 7453910 | C | | T | T | T | T | T | cds_wt_6591 |
| 7460642 | C | | T | T | T | T | T | cds_wt_6600 |
| 7462223 | G | A | A | A | A | A | A | cds_wt_6601 |
| 7484067 | C | T | T | T | T | T | T | — |
| 7490770 | G | | | | | A | A | cds_wt_6634 |
| 7492384 | G | | | | | | A | cds_wt_6634 |
| 7498836 | G | | A | A | A | A | A | cds_wt_6639 |
| 7511194 | G | | | | | | A | cds_wt_6648 |
| 7517188 | G | | A | A | A | A | A | cds_wt_6653 |
| 7518982 | C | T | T | T | T | T | T | cds_wt_6654 |
| 7524203 | G | | A | A | A | A | A | cds_wt_6659 |
| 7525798 | C | | T | T | T | T | T | cds_wt_6660 |
| 7546077 | C | | T | T | T | T | T | — |
| 7583090 | G | | A | A | A | A | A | — |
| 7588792 | C | | T | T | T | T | T | cds_wt_6730 |
| 7598819 | G | | A | A | A | A | A | — |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 7600514 | G | | | | | A | A | cds_wt_6738 |
| 7604996 | G | | | | | | A | cds_wt_6743 |
| 7607903 | G | | A | A | A | A | A | cds_wt_6746 |
| 7622689 | G | | A | A | A | A | A | cds_wt_6763 |
| 7627683 | G | | | | | | G/T | cds_wt_6770 |
| 7630530 | G | A | A | A | A | A | A | cds_wt_6772 |
| 7639840 | G | | | | | A | A | cds_wt_6784 |
| 7641043 | G | | | | | | A | cds_wt_6785 |
| 7646004 | G | A | A | A | A | A | A | cds_wt_6788 |
| 7648704 | G | A | A | A | A | A | A | cds_wt_6791 |
| 7652691 | G | A | A | A | A | A | A | cds_wt_6794 |
| 7654254 | G | A | A | A | A | A | A | — |
| 7655513 | G | A | A | A | A | A | A | — |
| 7662521 | G | | A | | A | | A | — |
| 7671626 | C | | | T | T | T | T | cds_wt_6808 |
| 7672126 | G | | | | | | A | cds_wt_6808 |
| 7687061 | G | | | | | | A | cds_wt_6826 |
| 7689723 | G | | A | A | A | A | A | cds_wt_6829 |
| 7714246 | C | | T | T | T | T | T | cds_wt_6856 |
| 7718521 | G | | A | A | A | A | A | cds_wt_6860 |
| 7719226 | G | | A | A | A | A | A | cds_wt_6861 |
| 7719430 | G | | A | A | A | A | A | cds_wt_6861 |
| 7720998 | G | | A | A | A | A | A | cds_wt_6862 |
| 7731353 | G | | A | A | A | A | A | cds_wt_6874 |
| 7733376 | G | | | | | A | A | cds_wt_6876 |
| 7736672 | C | | | | | | C/T | cds_wt_6879 |
| 7740086 | C | T | T | T | T | T | T | cds_wt_6883 |
| 7740896 | G | | | | A | A | A | cds_wt_6884 |
| 7765137 | G | | A | A | A | A | A | cds_wt_6902 |
| 7772239 | G | | A | A | A | A | A | cds_wt_6912 |
| 7789263 | G | A | A | A | A | A | A | cds_wt_6933 |
| 7790304 | G | | | | | | A | cds_wt_6933 |
| 7801751 | G | | A | A | A | A | A | cds_wt_6947 |
| 7802623 | T | | | | | | T/C | — |
| 7802638 | T | | | | | | T/C | — |
| 7802639 | C | | | | | | C/T | — |
| 7802682 | A | | T | T | T | T | T | — |
| 7809752 | G | | | | | A | A | cds_wt_6953 |
| 7809834 | G | | | | | A | A | cds_wt_6953 |
| 7823754 | C | T | T | T | T | T | T | cds_wt_6968 |
| 7825882 | G | | | | A | A | A | cds_wt_6969 |
| 7832540 | G | A | A | A | A | A | A | cds_wt_6976 |
| 7838339 | C | | T | T | T | T | T | cds_wt_6980 |
| 7841392 | C | | T | T | T | T | T | cds_wt_6983 |
| 7841997 | C | | T | T | T | T | T | cds_wt_6983 |
| 7842274 | C | | T | T | T | T | T | cds_wt_6984 |
| 7844241 | G | | A | A | A | A | A | cds_wt_6985 |
| 7855301 | C | | T | T | T | T | T | cds_wt_6993 |
| 7864327 | G | A | A | A | A | A | A | — |
| 7874843 | C | | | | | | T | cds_wt_7008 |
| 7883195 | A | | | | | | G | cds_wt_7018 |
| 7889441 | G | | A | A | A | A | A | cds_wt_7022 |
| 7909245 | G | A | A | A | A | A | A | cds_wt_7036 |
| 7912017 | A | | | | | | G | cds_wt_7038 |
| 7917279 | G | | A | A | A | A | A | cds_wt_7040 |
| 7926998 | G | A | A | A | A | A | A | cds_wt_7045 |
| 7931764 | G | | A | A | A | A | A | cds_wt_7049 |
| 7934819 | G | | A | A | A | A | A | cds_wt_7051 |
| 7948630 | C | T | T | T | T | T | T | cds_wt_7068 |
| 7963950 | G | | A | A | A | A | A | cds_wt_7082 |
| 7967045 | G | | | A | A | A | A | cds_wt_7086 |
| 7969374 | G | A | A | A | A | A | A | cds_wt_7089 |
| 7984213 | G | | A | A | A | A | A | cds_wt_7101 |
| 7984254 | G | | A | A | A | A | A | cds_wt_7101 |
| 7985275 | G | A | | A | | | A | cds_wt_7103 |
| 8009877 | C | T | T | T | T | T | T | cds_wt_7127 |
| 8026754 | C | T | | | | | T | cds_wt_7145 |
| 8036245 | C | | T | T | T | T | T | cds_wt_7152 |
| 8042744 | G | | | A | A | A | A | cds_wt_7156 |
| 8051051 | G | A | A | A | A | A | A | cds_wt_7165 |
| 8053700 | C | | | | | | T | cds_wt_7169 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 8062905 | A | | | | | | T | — |
| 8062911 | C | | | | | | T | — |
| 8075410 | C | T | T | T | T | T | T | cds_wt_7189 |
| 8077440 | G | | A | A | A | A | A | cds_wt_7191 |
| 8087405 | G | A | A | A | A | A | A | cds_wt_7205 |
| 8094018 | G | | A | A | A | A | A | cds_wt_7211 |
| 8095401 | G | A | | | | | A | cds_wt_7213 |
| 8096270 | C | T | | | | | T | cds_wt_7214 |
| 8122172 | G | | | | | | A | cds_wt_7240 |
| 8123295 | G | | A | A | A | A | A | cds_wt_7241 |
| 8123721 | G | | A | A | A | A | A | cds_wt_7241 |
| 8136640 | C | | T | T | T | T | T | cds_wt_7254 |
| 8161493 | C | | T | T | T | T | T | cds_wt_7274 |
| 8165695 | A | | | | | | A/T | cds_wt_7279 |
| 8165703 | A | | | | | | A/G | cds_wt_7279 |
| 8165704 | C | | | | | | C/G | cds_wt_7279 |
| 8167086 | G | | A | A | A | A | A | cds_wt_7280 |
| 8171741 | G | A | A | A | A | A | A | cds_wt_7283 |
| 8179169 | G | | | | A | A | A | cds_wt_7288 |
| 8181933 | G | A | A | A | A | A | A | cds_wt_7290 |
| 8186618 | C | T | T | T | T | T | T | cds_wt_7297 |
| 8193241 | C | | | T | T | T | T | cds_wt_7306 |
| 8195170 | C | | T | T | T | T | T | cds_wt_7307 |
| 8195310 | C | | T | T | T | T | T | cds_wt_7307 |
| 8199221 | G | A | A | A | A | A | A | cds_wt_7312 |
| 8202704 | C | | | | | | C/T | cds_wt_7315 |
| 8205853 | G | A | A | A | A | A | A | cds_wt_7319 |
| 8212158 | C | T | T | T | T | T | T | cds_wt_7324 |
| 8212583 | G | | | | | A | A | cds_wt_7324 |
| 8214951 | C | | T | T | T | T | T | cds_wt_7328 |
| 8221459 | G | A | A | A | A | A | A | cds_wt_7335 |
| 8227017 | G | | | | | | A | cds_wt_7340 |
| 8233448 | C | | | | | T | T | cds_wt_7347 |
| 8237580 | G | | | | | | A | cds_wt_7349 |
| 8239310 | G | | | | | | A | cds_wt_7349 |
| 8240439 | G | | | | | A | A | cds_wt_7350 |
| 8241289 | G | | A | A | A | A | A | cds_wt_7350 |
| 8243590 | G | A | A | A | A | A | A | — |
| 8247542 | G | | A | A | A | A | A | cds_wt_7357 |
| 8248207 | C | | | | | | T | cds_wt_7357 |
| 8256006 | G | | A | A | A | A | A | cds_wt_7367 |
| 8263792 | G | | A | A | A | A | A | cds_wt_7373 |
| 8267543 | G | | A | A | A | A | A | cds_wt_7377 |
| 8272330 | G | | | | | | A | cds_wt_7379 |
| 8273351 | C | | T | T | T | T | T | cds_wt_7380 |
| 8278809 | G | | | | | A | A | cds_wt_7384 |
| 8282707 | G | | | | | | A | cds_wt_7387 |
| 8298405 | T | T/A | T/A | | T/A | | T/A | cds_wt_7401 |
| 8298413 | C | C/G | | C/G | C/G | C/G | C/G | cds_wt_7401 |
| 8302281 | G | A | A | A | A | A | A | cds_wt_7405 |
| 8311927 | T | | C | C | C | C | C | cds_wt_7413 |
| 8323622 | C | | T | T | T | T | T | cds_wt_7423 |
| 8325049 | G | | | | | | G/C | cds_wt_7424 |
| 8325050 | A | | | | | | G/A | cds_wt_7424 |
| 8325073 | C | C/G | C/G | C/G | C/G | C/G | C/G | cds_wt_7424 |
| 8325095 | G | | | | | | G/C | cds_wt_7424 |
| 8325096 | G | | | | | | G/T | cds_wt_7424 |
| 8325102 | C | | | | | | C/G | cds_wt_7424 |
| 8325109 | T | | | | | | C/T | cds_wt_7424 |
| 8325115 | C | | | | | | G/C | cds_wt_7424 |
| 8325118 | C | | | | | | C/G | cds_wt_7424 |
| 8325121 | G | | | | | | G/C | cds_wt_7424 |
| 8325127 | G | | | | | | G/C | cds_wt_7424 |
| 8325133 | C | | | | | | G/C | cds_wt_7424 |
| 8325203 | T | | | | | T/C | T/C | cds_wt_7424 |
| 8325210 | A | A/G | A/G | A/G | A/G | A/G | G/A | cds_wt_7424 |
| 8325277 | C | | | | | | C/G | cds_wt_7424 |
| 8325286 | C | | | | | | C/G | cds_wt_7424 |
| 8349257 | G | | | | A | A | A | cds_wt_7444 |
| 8351616 | G | | | | A | A | A | cds_wt_7445 |
| 8355565 | C | | | | | T | T | cds_wt_7448 |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 8355924 | C | | T | T | T | T | T | cds_wt_7448 |
| 8363036 | G | A | A | A | A | A | A | cds_wt_7452a |
| 8364757 | C | T | T | T | T | T | T | cds_wt_7454 |
| 8365293 | G | A | A | A | A | A | A | cds_wt_7454 |
| 8368404 | G | | | A | A | A | A | cds_wt_7457 |
| 8378911 | G | | A | A | A | A | A | cds_wt_7464 |
| 8379977 | G | | | A | A | A | A | — |
| 8380006 | C | | | | | | T | — |
| 8381094 | G | | A | A | A | A | A | cds_wt_7465 |
| 8384806 | G | | | | A | A | A | cds_wt_7468 |
| 8389000 | C | | | | | T | T | cds_wt_7470 |
| 8389283 | A | G | G | G | G | G | G | cds_wt_7470 |
| 8393915 | G | | A | A | A | A | A | cds_wt_7472 |
| 8396831 | G | | | | | | A | cds_wt_7476 |
| 8397563 | G | | | | A | A | A | cds_wt_7476 |
| 8402662 | G | | A | A | A | A | A | — |
| 8411820 | C | | | T | T | T | T | cds_wt_7490 |
| 8413318 | C | T | T | T | T | T | T | cds_wt_7491 |
| 8414872 | C | | T | T | T | T | T | cds_wt_7491 |
| 8431655 | T | A/T | A/T | A/T | A/T | A/T | T/A | — |
| 8441210 | C | T | | | T | T | T | cds_wt_7510 |
| 8449495 | G | | | | | | G/A | cds_wt_7513 |
| 8453858 | G | | | | A | | A | cds_wt_7514 |
| 8463714 | G | | | | | A | A | cds_wt_7525 |
| 8466767 | G | | A | A | A | A | A | cds_wt_7529 |
| 8491536 | G | A | A | A | A | A | A | — |
| 8497636 | C | | | | | | T | cds_wt_7552 |
| 8506267 | G | | | A | A | A | A | cds_wt_7561 |
| 8509227 | G | | | | | | A | cds_wt_7562 |
| 8515828 | G | | A | A | A | A | A | cds_wt_7566 |
| 8529144 | G | | A | A | A | A | A | cds_wt_7572 |
| 8544731 | G | | A | A | A | A | A | — |
| 8546526 | C | T | T | T | T | T | T | cds_wt_7591 |
| 8556565 | G | | A | | | | A | — |
| 8559522 | G | A | A | A | A | A | A | cds_wt_7602 |
| 8560241 | C | | | | | | T | cds_wt_7603 |
| 8567608 | C | | T | T | T | T | T | cds_wt_7607 |
| 8572238 | C | | | | | T | T | — |
| 8576774 | G | A | | A | A | A | A | — |
| 8582623 | C | | | | | T | T | cds_wt_7615 |
| 8589455 | C | | | | | T | T | cds_wt_7621 |
| 8589459 | C | | | | | T | T | cds_wt_7621 |
| 8595339 | C | T | T | T | T | T | T | cds_wt_7627 |
| 8610015 | C | | T | T | T | T | T | cds_wt_7640 |
| 8622039 | C | T | T | T | T | T | T | cds_wt_7652 |
| 8631175 | G | A | A | A | A | A | A | cds_wt_7660 |
| 8640526 | C | | T | T | T | T | T | cds_wt_7667 |
| 8646416 | G | | A | A | A | A | A | cds_wt_7674 |
| 8647802 | G | | A | A | A | A | A | cds_wt_7675 |
| 8648408 | G | | | | A | A | A | cds_wt_7676 |
| 8655581 | C | T | T | T | T | T | T | cds_wt_7683 |
| 8658688 | G | | A | A | A | A | A | cds_wt_7685 |
| 8668191 | C | | T | T | T | T | T | cds_wt_7693 |
| 8668196 | G | | A | A | A | A | A | cds_wt_7693 |
| 8669919 | G | A | A | A | A | A | A | — |
| 8674137 | C | T | T | T | T | T | T | cds_wt_7700 |
| 8678961 | G | | A | A | A | A | A | cds_wt_7704 |
| 8682722 | G | A | A | A | A | A | A | — |
| 8690364 | C | T | T | T | T | T | T | cds_wt_7711 |
| 8691972 | C | | | | | | T | cds_wt_7712 |
| 8699652 | G | | A | A | A | A | A | cds_wt_7716 |
| 8699708 | G | | A | A | A | A | A | cds_wt_7716 |
| 8709561 | C | | T | T | T | T | T | — |
| 8720459 | G | A | A | A | A | A | A | cds_wt_7731 |
| 8731485 | G | | | | | A | A | cds_wt_7745 |
| 8737851 | G | A | A | A | A | A | A | cds_wt_7749 |
| 8737859 | G | A | A | A | A | A | A | cds_wt_7749 |
| 8742265 | C | | T | | T | T | T | cds_wt_7750 |
| 8743148 | C | | | T | T | | T | cds_wt_7751 |
| 8754468 | G | | A | A | A | A | A | — |
| 8754501 | G | | A | A | A | A | A | — |

-continued

| Position in reference wild type strain SE50-100 | Base in Reference strain | Occurrence in Strain | | | | | | Affected Gene ID |
|---|---|---|---|---|---|---|---|---|
| | | SN223-29-47 | C445-P47 | SN12755-48 | SC3687-18-43 | SC7177-40-17 | SN19910-27-21 | |
| 8759529 | G | | | | | | A | cds_wt_7757 |
| 8761290 | C | | T | T | T | T | T | cds_wt_7757 |
| 8769464 | T | | | | | C | C | — |
| 8792629 | G | | A | A | A | A | A | cds_wt_7788 |
| 8793001 | C | T | T | T | T | T | T | cds_wt_7788 |
| 8809351 | C | | T | T | T | T | T | cds_wt_7801 |
| 8813761 | C | | T | T | T | T | T | cds_wt_7803 |
| 8813866 | C | | T | T | T | T | T | cds_wt_7803 |
| 8816396 | G | A | A | A | A | A | A | cds_wt_7805 |
| 8821923 | G | | A | A | A | A | A | cds_wt_7810 |
| 8825490 | G | | A | A | A | A | A | cds_wt_7813 |
| 8828064 | C | | T | T | T | T | T | cds_wt_7815 |
| 8841828 | G | A | A | A | A | A | A | cds_wt_7827 |
| 8842797 | G | | | | | A | A | cds_wt_7828 |
| 8843541 | G | | | | | | A | cds_wt_7828 |
| 8845199 | T | | C | C | C | C | C | cds_wt_7829 |
| 8848419 | G | A | A | A | A | A | A | cds_wt_7832 |
| 8849052 | G | A | A | A | A | A | A | cds_wt_7833 |
| 8854017 | C | | | T | T | T | T | cds_wt_7839 |
| 8854256 | G | | A | A | A | A | A | cds_wt_7839 |
| 8858030 | G | | A | A | A | A | A | cds_wt_7843 |
| 8859328 | G | | | | | | A | cds_wt_7844 |
| 8860995 | G | | | A | | | A | cds_wt_7846 |
| 8861382 | G | | A | A | A | A | A | — |
| 8871894 | C | T | T | T | T | T | T | — |
| 8872344 | C | | | | | | C/T | cds_wt_7854 |
| 8875526 | G | | A | A | A | A | A | cds_wt_7858 |
| 8881555 | G | | | | A | A | A | cds_wt_7864 |
| 8889242 | G | | | | | | A | cds_wt_7871 |
| 8893686 | G | A | A | A | A | A | A | cds_wt_7877 |
| 8894581 | G | A | A | A | A | A | A | — |
| 8896018 | G | A | A | A | A | A | A | cds_wt_7879 |
| 8901982 | G | A | A | A | A | A | A | cds_wt_7883 |
| 8902511 | G | | A | A | A | A | A | cds_wt_7883 |
| 8902844 | G | | A | A | A | A | A | cds_wt_7884 |
| 8902903 | G | | A | A | A | A | A | cds_wt_7884 |
| 8907784 | G | A | A | A | A | A | A | — |
| 8927137 | G | | | | | | A | — |
| 8929703 | G | A | A | A | A | A | A | cds_wt_7911 |
| 8931762 | C | T | T | T | T | T | T | cds_wt_7914 |
| 8934108 | G | | | | | A | A | cds_wt_7916 |
| 8937518 | C | | | | | | T | cds_wt_7919 |
| 8943513 | C | | | | | | T | cds_wt_7925 |
| 8943676 | C | | | | | | T | cds_wt_7925 |
| 8944024 | C | | | | | | T | — |
| 8945415 | C | | | T | T | T | T | — |
| 8946251 | C | | | T | T | T | T | cds_wt_7927 |
| 8948806 | G | | A | A | A | A | A | cds_wt_7930 |
| 8950622 | C | T | T | T | T | T | T | cds_wt_7931 |
| 8951908 | C | | T | T | T | T | T | cds_wt_7932 |
| 8953417 | G | A | | A | A | | A | cds_wt_7935 |
| 8955117 | G | | | | | A | A | cds_wt_7936 |
| 8956021 | C | | | | | | T | cds_wt_7937 |
| 8956608 | C | | | | | | T | cds_wt_7937 |
| 8958843 | C | T | | | T | T | T | cds_wt_7939 |
| 8959688 | G | | | A | A | A | A | cds_wt_7940 |
| 8974326 | G | | A | A | A | A | A | cds_wt_7953 |
| 8979884 | C | | | T | T | T | T | cds_wt_7957 |
| 8982938 | G | G/C | G/C | | | | G/C | cds_wt_7963 |
| 8982956 | G | G/C | G/C | G/C | G/C | G/C | G/C | cds_wt_7963 |
| 8982975 | G | | | | | | G/C | cds_wt_7963 |
| 8983002 | G | G/A | G/A | G/A | G/A | G/A | G/A | — |
| 8983053 | C | C/T | C/T | C/T | C/T | C/T | C/T | cds_wt_7964 |
| 8983087 | G | | | | | | A/G | cds_wt_7964 |
| 8983088 | G | | | | | | G/C | cds_wt_7964 |
| 8983102 | A | A/G | A/G | A/G | A/G | A/G | G/A | cds_wt_7964 |
| 8983134 | G | G/C | G/C | G/C | G/C | G/C | G/C | cds_wt_7964 |
| 9008254 | C | | | | | | T | cds_wt_7977 |
| 9028349 | G | A | A | A | A | A | A | cds_wt_7991 |
| 9029056 | C | | | | | T | T | cds_wt_7991 |
| 9045846 | G | | A | A | A | A | A | cds_wt_7996 |

-continued

| Position in reference wild type strain SE50-100 | Base in Reference strain | SN223-29-47 | C445-P47 | SN12755-48 | SC3687-18-43 | SC7177-40-17 | SN19910-27-21 | Affected Gene ID |
|---|---|---|---|---|---|---|---|---|
| 9049564 | C | | | | | | T | cds_wt_7998 |
| 9052240 | C | T | T | T | T | T | T | cds_wt_8000 |
| 9052265 | G | | | A | A | A | A | cds_wt_8000 |
| 9053107 | G | A | A | A | A | A | A | — |
| 9058239 | G | A | A | A | A | A | A | cds_wt_8006 |
| 9060181 | C | | T | T | T | T | T | cds_wt_8008 |
| 9064090 | C | T | T | T | T | T | T | cds_wt_8011 |
| 9072129 | C | | | | | | C/T | cds_wt_8017 |

Summary of Identified COG Categories

Table 10 shows details on COG-classified genes of the *A. utahensis* wild type strain SE50-100. For each COG category and its subcategories, the number of annotated genes and the absolute percentage is listed.

| COG-Categories | Population | |
|---|---|---|
| CDS with COG-category | 3,983 | (49.62%) |
| Information storage and processing | 1240 | (15.45%) |
| Translation. ribosomal structure and biogenesis | 200 | (2.49%) |
| RNA processing and modification | 2 | (0.02%) |
| Transcription | 771 | (9.61%) |
| Replication. recombination and repair | 266 | (3.31%) |
| Chromatin structure and dynamics | 1 | (0.01%) |
| Cellular processes and signaling | 1398 | (17.42%) |
| Cell cycle control. cell division. chromosome partitioning | 49 | (0.61%) |
| Nuclear structure | 0 | (0.00%) |
| Defense mechanisms | 84 | (1.05%) |
| Signal transduction mechanisms | 592 | (7.38%) |
| Cell wall/membrane/envelope biogenesis | 302 | (3.76%) |
| Cell motility | 104 | (1.30%) |
| Cytoskeleton | 8 | (0.10%) |
| Extracellular structures | 0 | (0.00%) |
| Intracellular trafficking. secretion. and vesicular transport | 89 | (1.11%) |
| Posttranslational modification. protein turnover. chaperones | 170 | (2.12%) |
| Metabolism | 2409 | (30.01%) |
| Energy production and conversion | 308 | (3.84%) |
| Carbohydrate transport and metabolism | 575 | (7.16%) |
| Amino acid transport and metabolism | 521 | (6.49%) |
| Nucleotide transport and metabolism | 82 | (1.02%) |
| Coenzyme transport and metabolism | 187 | (2.33%) |
| Lipid transport and metabolism | 234 | (2.92%) |
| Inorganic ion transport and metabolism | 257 | (3.20%) |
| Secondary metabolites biosynthesis. transport and catabolism | 245 | (3.05%) |

All Genes with Annotation

Table 11 lists all annotated genes of the *Actinoplanes utahensis* wild type strain SE50-100.

Lengthy table referenced here

US09719064-20170801-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US09719064B2). An electronic copy of the table will also be available from the USPTO upon request and payment of the fee set forth in 37 CFR 1.19(b)(3).

SEQUENCE LISTING (16053 sequences)

SEQ ID NO: 1 - DNA, 1164 bp, Actinoplanes utahensis
atgcgcaaggcactgatcgcacttgccgccgccggtctgttgacgtcggtcacccttacggcctgtgacggcggctcgaacgacggtgacgccagcggcagcgacgcgggtctccactcgaatgccacctcgtccggcgagggcaggggcggcgtcggcatcgtgctgcccgacacccagagctccacccgctggagcaacgacgacccgaaatacctcaaggccgcgttcaagtcggccaacgtgccgtacgagatccagaacgccgagggcaacgcggacgcgttcaagggcatcgccaaggcgatgctggacagcggcatcaaggtcctgatgatcgcgaacctggactcggtcagcgccaagtgggtgatcgacctggcccactccaagaagatcccggtcatcgactacgaccggctgaccctcaacggcggcgccgactactacgtcagcttcgacaacgagaaggtcggccagttccaggcgaccggcctgatccagtgcctgaaggacaagggcgtcagcaagccggtcatcgccgagctgaacggctcgcccaccgacaacaacgccaccctgttcaaggccgggtacgacgcggtcctgcaggagaagtacgacggcggcgacttcgtgaaggggcccgaccagttcgtcccgcagtgggacaacaacgagggcaaggcgatcttcacgcagatgttgaagcagtggccgacgatcaacggggtgctcgccgccaacgacggcctgggcaacgcggcgatcgaggtgctgaagaagaacggcaagaccggcatcccggtcaccggtcaggacgccaccgtgcagggcctgcagaacatcctcgccggcgaccagtgcatgaccgtgtacaaggccaccaagcaggaggcccagaaggcggccgacctggcgatcgccctggtcaagagcggcaaggcgaccgcccgggacaaggtgaaggacccggagaccggcgcctacgtgccgtccgagctgctcaccccgacgctggtgaccgcccagaacatggtggagacggtgatcaaggaccagttcgtcacttccaaggaactctgcaccgcgaagttcctgcaggcctgccagcagtacggcctggcggccaagccgggcgcgtccagcggcaccggcagctga

SEQ ID NO: 2 - DNA, 480 bp, Actinoplanes utahensis
gtggccaaggagaacgggaccaagctgatcgcctcgaacaagaaggcgcggcacgactacgccatcatccggacgtacgaggccggtctggtgctggccggcaccgaggtgaagacgttacgcctgggccgcgcgtcgctggtcgacgcgttcgcccaggagcacgagggcgagctgatgctgtacaacctgcacatcgcggagtacggcttcggtagctggacgaaccacgccccgcggcgcacccggaaactcctgctgcacaaggccgagatcatcaagatcctgaatacgctgaacgacggcagcgggctgaccctggtgccgctctcgctctacttcaaggacggctgggtcaaggtcgagctggcgatcgcgcgcggcctcaagtcgtacgacaagcgccaggtcctggccgagcgggacgccaagaaggagatcgccaaggagatgggccgccggctgaagggccgccggtaa

SEQ ID NO: 3 - DNA, 357 bp, Actinoplanes utahensis
atggtgtacgacccggggcttacgtcgcgcggtgtccagtacggacggcgaggtatccgcgggacgggcataatcaatcgggtgaccaattgggagtatgcgcggctggagtatcgcgcggccggcacgctgggcaccgaccggttcatggactggaccgccacgttccatcacccgggcggggtgctgcgctggggcaccgacgagcgcttcgatgatttgcgccatctgaaccgggcgggtgcggcgggctggcaggcgtacaaccgcgcggtgatccacgtgaaggacgagccgcaccggttgagcagcgtgacgtattcgatgcgccgcccgatcccggtcgacggcccgtag

SEQ ID NO: 4 - DNA, 2109 bp, Actinoplanes utahensis
atgacgacaggtacggtggcccggctggtctgcggccggcgcagcaaatggatcgtgctggcactgtggatcgtggtgctggtcttcgccggcgggctggccggcaagctcggcggcgtcgaaaagaacgacaacgcctcctggctgcccggctcggccgaggccacccaggtcgccgacctgcagaaacaattccagccggacgacatcgtgccggccatcctggtctacgagcgggccggcggcaccaccccggccgacctgcagaaagcggccgccgacgcccgggcgatcgccacggtccccggagtcaccggccaggtgatcggtccggtcccggcgcccgaccgggcggcgctgcaggtcatcgcgccgatcagggtcgacgccggcggctgggacaagatcaccgaggcggtggaccggatcaagacgatctccggtacgggggacggaggcctcggcgtctacctgaccggaccggcgggggtggcggccgactcggccagcgcgttccagggcatcgacggcaccctgctctacaccacgctgatcgtggtcgcgatcatcctgctcgtcacctatcgcagcccggtgctctggctgctcccgatcatcaccgcgggcgtggcactgaccagcgcccaggcggtgatctacctgctcgccaagcacgccgggctggtggtcaacgggcagagcgccggcatcctgaccgtgctggtcttcggcgccggcaccgactacgccctgctgctggtcgcccgctaccgggaggagctgcgccggcacgaggaccggcacgaggcgatgatgttcgccctgcaccgcgccggcccggcgatcatcgcgagcgccgcgaccgtggcgatcggcatgtcctgcctgatgctcgccgaggtgaacgcgaccagcggcctcggcccggtcgccgcactcggcatcgtggtcggcctgctcgccatgatgaccctgctcccggccctgctggtgatctgcggccggtggctgttctggccggtccgcccccgcttcggcaccccggagccgaccgcgaccgggctgtgggcccggatgggcggccggatcgcccgccgcccccgccaggtgtggctggccaccgcgctcgccctcggcgcgatggcgctcggcctgctgcagctcaacgcgaacgggctcagccagcaggactcgttcaccagcacacagccgtcggtgaccggcctcgaagtgctgagccggcacttcccggccggccagggcgacccggtcgtggtgatcaccgacccggcccaccaggacgcggtgcgcgccgcgttcgccggcaccgccgggatcagccaggtcggcgagccggccgtgaagaacaacctggtcaggttcgagggcacgctgacgtcggcgccggacgggcaggccgccgaggacaccgtccgcgcggtccgcaccgccctggccggcaccggtgccaaggtcggcggcaccaccgccctgaaactcgacatcaaccaggcgaacaagcacgacaaccggctgatcctgccgctggtgctgctcgtcgtgctggccatcctggccatcctgctgcgcgccctgatcgccccgatcctgctgatggccaccgtggtcctgtccttcgccgccgccctcggggtcagcgccctgatcttccggcacgtgttccacttcgccggcgaggacaccgcgttcccgctgttcgtcttcgtcttcctggttgctctcggcatcgactacaacatcttcctgatgacccgggtccgcgaggaggcccgcgatcacggcacccgccgaggcgccctgatcggcctcggcgccaccggcggcgtgatcacctcggccggcatcgtcctggccggtaccttcgccgccctcggcagcctgccgctggtcgccttcgccgaaatcggcttcgcggtcgccttcggcgtcctgctggacaccctgatcgtgcggtccgtgctggtcaccgcattgagcctggatctgggccgctggatgtggtggccgagcgcgctgttccgccatgacccgtcggtggacgccccggtgtcaccggcgccggccatcctcacccaccagaccgactga

SEQ ID NO: 5 - DNA, 1377 bp, Actinoplanes utahensis
atggcggacgtggacgctacccacggcaccggggcggtgccgcccgacgcgctgcgcgcggccgagaccgggagcagcggtggggccttcgacgagctgcacccgccgcgcgccgacctcgtgtccgactgtgtgcactgcggcttctgcctgaccacctgccccacctacgtgctctggggcgaggagatggactcgccgcgcgggcggatccacctgatcgcccagggcctggagggtgagccgctcagcgagtcgatggtcggccacttcgacagttgtctgggctgcatggcctgcgtgaccgcgtgcccgtccggggttcgctacgaccggctgatcgaggacacccgggcccaggtcgagcggcggcacccgcgcccggcacgggatcgggcgttgcgcgcggcgatcttcgcggtgttcccctatccacggcggctgcgactgttgcgggggccgttgtgggcgtaccggacatcgggccttcagcgtctcgtcacccgtagcggcctgctggaccgcttcgcaccgaccctggccacgctggaatcgctggcgccgggcgttcgccgggtgccgcggccgccgcgccgggtggcggcgcgcgggcagcgccgggcggtggtcgggatgctgaccggttgtgtccagtcggcattcttcccggaggtgaactccgcgaccgtccggatcctcgcggccgagggctgcgacgtgctgatcccggccgcgcagggctgttgcggggcgctgagcgtgcacaacgggcggcgggcggaggcggaggggttcgcccggcggctgatcgacacgttcgagcggtgcgggatggacttcttcgtggtgaacgccgcggggtgcgggtcatcgctgaaggagtacggcgagttgctggccgaggatccggcgtacgcggctcgggccgcggcgttcgcggccaaggtgcgggatcttgccgagctgctcgccgagctggggccggtcgctccgcgacatccgttgccgctgacggtggcctatcacgacgcctgccatctcgggcacgcgcagggcgtccgggcgcagccgcgggccctgctgcgcggcattccgggtctggagctgcgagagatcgccgacccggagatctgctgcggctcggccggcgtctggaacgtgctgaacccggagccggccgccgaactgggcgaccgcaaggccgccgcggtcctcgacaccggcgcggcgctgctggtcaccgcgaacccgggctgcctgatgcaggtcgcggccgcggtccgccggcgcggcggcaggatcgcgctggcgcacaccgcccaggtcctcgacgcctctctgcgaaatctgggagccgccgccctgaccgaccactga

SEQ ID NO: 6 - DNA, 807 bp, Actinoplanes utahensis
gtgccggcccggctcgtcgccgcgccccgggacaccgcggaggcggccgcgctgatcaccgcggcccgcggcctgagcgtggtgatccgcggcggcggcacgaaactcgactggggtccgccgccccgcgagctggacctcatcatcgacacgcggcggctggccggggtggtcgagcacgctgccggggatctgatcaccgtggtccgcgccggcacgccgatgggcgatctgcaccggctgcccgggcagcagctggcgctcgacgcgccgcccgcggcgacggccggcggcacggtcgcggcgaacgcctccgggccgcggcggctgcgctacggcaccgcccgcgacctgctgatcgggatcaccgcggtgcgtccggacgggaccgtcaccagggccggcggccgggtggtcaagaatgtcgcgggttacgacctgggcaagctctacaccggcgccttcggcaccctcgggctgatcaccgagtgcgtcttccggttgcatccggtgccgggttcacatgctttcgtacgggtgagcgctccccccgggcacgccgccaaggtcctggccggccagttcgcggccagcgcctgcgaggtgaacgccgcccccggcgccgaacccgaactcgccgtgctgctcgaaggcaccgccgccggggttcgggagcgcgccgccgcggtcgcggccctgctcggcgggaaggtgtccgccgaggcaccggagtggtgggacgtgccgccctggccgcccggcggcgtcgggctcaagctgaccggcgcgctgtcccaggctagctag

SEQ ID NO: 7 - DNA, 1461 bp, Actinoplanes utahensis
atgaccgacatcgatgcattggcggctcggctgcgcgctgagctgggcgccgaccgggtcctgaccgaccggcaggagctgcggacctacgagtgcgacgggctggcgcactacaaggtcatcccggctctggtggcgctgccgcggaccgcggcgcaggtggccgcggtggtccgggcatgtgccgacaccgggacaccgttcgtggcccgcgggtcgggcaccgggctgtccgggggtgcgctcccacacgccgacggggtgctgatcgtgacctcccaactgcgccggatcgtcgaggtccggccggaggacgagcgggcggtggtcgagcccggggtgatcaacctgcaggtgaccagggcagccgccccacacggctactactacgcgcccgacccgtccagccagcagatctgctcgatcggcggcaacgtcgcggagaattccggtggcgcccactgcctgaaatacggcttcaccaccaaccacgtcaccgggctggaggtcgtcaccccggacggcgagcgggtccggctgggcggcccggcgcccgacacaccgggctacgacctgctcggcgcgttcgtcgggtcggagggcacgctcggggtggcgaccgaggtcaccgtgcggctgacccggctgcccgagacggtccgcaccctgctggccggattcggctccaccgaccaggccggggccgccacctcggcgatcatcgcggccggcgtgctccccgcggcgatcgagatgatggacgagttggccatcgcggccgccgaggcggccgtgcagtgctcctatccggccggcgcgggcgcggtgctgatcgtcgagctggacgggccggcggccgaggtcgcagcgcagttcgacgaggtgagcgcgctctgcgagagcaacggcgcgttcgagaccaggatcgcggcggacgaccaggagcgggcgctgatctggcgcgggcgcaagtcggcgttcgccgcggtcggccggatcagccccgactacatcgtgcaggacggggtgatcccgcggatgtcgctgccggtggtgctgcggcgcatcggcgaggtcgcggccgagcacggggtgcgggtggcgaacgtgttccacgccggcgacgggaacctgcatccgctggtgctgttcgacgcgcagataccggggcaggccgagcgcgccgagacggtgtccggggcgatcctcgacctgtgcatcgagcacggcggctcgatcaccggggagcacggggtcggggtggacaaggcacggtacatgccgcgcatgttcagcgacgccgacctggagaccatgcagctgctgcggtgcgcattcgacccggacgggatcgccaatccgggcaaggtcttccccaccccgcggctgtgcggggaacgccccggccgccggtcgggcgcccacccgctgcacaccgccggcgtcgcggagatcttctga

SEQ ID NO: 8 - DNA, 2721 bp, Actinoplanes utahensis
atggcgtgcagccgaggattcttaggcggaggtggctgcggcatgaagttcgtctacgacttccacgagggcaacaaggacctcaaagacctgctgggtggcaagggcgccaatctcgcggagatgacgaacctcggcctcccggtcccgcccggattcaccatcaccaccgaggcgtgtcaggaatacctgcgcgccggtacgcatgtcgacgggctggccggggagatcgacacgcacctggcgacgctggagcaggcgatgggccgccggctcggcgacccggccgatccgctgctggtctcggtccggtccggcgccaagttctcgatgcccgggatgatggagaccgtcctcaacgtcggtctcaacgatgagtcggtggccgggctgtcccggcaggccggtggcaacgaccggttcgcctgggactcgtaccgccgcctgatccagatgttcggcaagacggtgtgcgacgtgcccggggcggagttcgaggacgctctgcaccaggcgaaggtggccaagggtgtcaaggacgacgtgcagctcgacgccgaggatctgcgggcgctggtcacggcgtacaagaaagtgttcgtgaaacacaccgggcacgagttcccgcaggatccgcgcgagcagctcgacctggctgtcgaggcggtcttccggtcgtggaacgccgaccgcgcggtgctctaccggcgacaggagcggatcccggccgacctgggcaccgcggtcaacgtggtggcgatggtcttcggcaacctgggcgacgactccggcaccggcgtcgcgttcacccgcaacccggccagcggcgagcagggcatctacggcgactacctggccaacgcgcagggcgaggacgtggtcgccggaatccgcaacacgctgccgctcgccgagctggagaacctcgacaagcgcagctacgacgaactgttgcggatcatggccatcctcgagggccactaccgcgacctctgcgacatcgagttcaccatcgaacgcggcaaactgtggatgctgcagacccgggtcggcaaacggaccgcggccgccgcgttcaccatcgccgcacaactcgtcgacgagggcgtgatcgacctcgacgaggcgctcacccgcgtcaccggcagccagctcggccagctgatgttcccgcgcttcgacctttccggatcgccggaatcggtcacccgcggcgtcggcgcatccccgggcgcggccgccggcgaggtggttttcacctccgcgcacgcggtcgccgccgccgccgaaggaaaatcagtcattttggtacgtcgtgagacgaacccggacgacctgccgggcatgatcgcggccaagggcatcctcaccagtcggggcggcaaaacctcgcacgccgccgtggtcgcccgcggcatgggcaagacctgtgtctgcggtgccgacgagatcgaggtcggacgcgacaccgtcaccatcggcgcgcacaccatccgcgaaggcgacgtcgtctcgatcgacggcacgaccggccgcgtctacctcggcgaggtgccggtgcgcccgagcgaggtcgtgcagtacttcgagggcgacctggacccgacgcaggccaacgacccgctggtcgccgccgtgcaccggatcatcacgcatgccgatcagaaacggcggttgtccgtgcggaccaacgccgacacgggcaccgacgcggcccgggcccgccggttcggagcccaggggatcggcctgtgccggaccgagcacatgttcctcggcgaccgccgggagctcgtcgaacgcctcatcctcgcccgcaccgacaccgaccggaccgacgcgctggccgccctgcagccgctgcagcgagccgacttcctgcagatcctgcgcgagatgaacgggctgccggtgaccatccggctgatcgacccgccgctgcacgagttcctgccgtccctggaggagctcgcggtcaaggtggcggtcgcgcacgagcagggccagcggctcgaacacgacgaaaagatgctggccgcggtccgcaaaatgcacgagcagaacccgatgctcgggctccgcggcgtacgactgggcctggtcattcccggtcttttcgcgatgcaggtgcgggccatcgcggaagccgcggtggcgctcgcggccgagggcggcaacccgcgcccggagatcatggtgccgctggtcggcgcggtacaggaactggaaacggtccgcgccgaagccgagaagatcatcgccgaggtgatcggcgactccggcgtcacggtgctgatcggcacgatgatcgaggtgccgcgggcggcgctgaccgccgggcagatcgccgaagcggccgaattcttctccttcggtaccaacgacctgacccagatgggctggggcttctcccgcgacgacgtggaaggggcgttcttctggcgctacctggaactcggcatcttcgggatcagccccttcgagtcgatcgacaccgagggcgtggggcggctcgtgcggatcgccgcggaagaggggcgggccgcccggccgggactcaagctcggcgtgtgcggggagcatggcggggacccggattcggtgcacttcttccatgaggtcgggctcgactatgtgtcgtgctcgccgttccgggtgccgatcgcgcggcttgaagccgggcgggcggcggtcgagtccgaaggatccgaccaccggtag

SEQ ID NO: 9 - DNA, 405 bp, Actinoplanes utahensis
atggcgtcccggctcaacccgtatctgaccttcgacggcaacgcccgcgaggccatggagacgtatcagcggatcttcggtggcgatctgaaggtcaccacgttcggggagttcggcgtccccgacgagtcgatcaaggacaaggtgatgcacgcgatgctggacacgccgcagggttacaccctgatggcctccgacaccgcgcccggcatgccgttcaccccgggcaacgccaactcggtcagcatcagcggcgacgcctccgacaacctgcgcgccttctgggacaagctcgccgacggcgccaccatcagcctgcccctggagaaacagatgtggggcgacgagttcggccagcttgtcgacagatacggcgtcccctggatggtcaacatcaccgcctga

SEQ ID NO: 10 - DNA, 1281 bp, Actinoplanes utahensis
atgaccatcgctgacttcgctgtcgtggcggcctcggcggtgctggtgctcgcccgatggctgccgacggccgcacggcgccgcactgctctcagcgccgccgccgtgacgatcgtcggcgcggccttcaccgtgccgggcacccgttggccggtccttctggtgctgggcacggacctgcttgtggtcgcggcaaccgttgcggtgtggctccggaagcgtcgcatcgccctgtccgccagcgatggccgcagtgctgaagtccggcgcgctacgaaggcgcgtagcggcggggctctgcgcgcttcgggcgggggaagcgcggaggtatcggacgcttcggaccggaggagtgcggctcggcgcgccgctgaggcggggagcggggaaagtccgcggggttcgggtggccgaggcggggaggtgtcgggcgcttcgggcggcgggagcggtgcggctctgcaggctgccgatgtggggagccgggaggctttgcgagcctcggacgggcggagtgagggggctgccgggggtggggaggaggatcggcgggttcggcggtcgatggcgttgcccggttcggtggtggccctggggctggtgatcggggccggggcggccgcctgggcgttgccggtgccggtgtttccggcgctgtccggggcgtccgcggtggggacgacagtgctgcagtggacggatccggcgcggggggaggcggccacgccggacgccggcgatcggcgcgcggtggtggtgcagctgtggtatccggcgcagcgggtggcgccggatgcggttcgggcgcagtacctggggcggaatcgtcgcgaagctgaaatcgtcgctgatggggtggctgactatctcggggtgccggggtttctgctcgacgggcctacccgggcacggacccacgcggtggtcggggcgcaaccggcaaccggtcgcttcccggtggtgctgttctcgcccgggctcggcggggtacgcacgcagaacacggcgtgggctgaggaactggccagccgaggctacgtcgtggccggggtggaccacccgtatgactcggccgcggtcgtactcgccgacgggagtaccgtccggacgcgcatcgcggccagcggggaccggaccgaggacaaccgtcggcgaatctcctggacgtcggtgcgggccgcggacctcagcttcgtcctgacccaactcggccgcctggacaagggcgatcctgctggccgtggcgaggagggcgatgctgccggccgtggcgaggactag

SEQ ID NO: 11 - DNA, 660 bp, Actinoplanes utahensis
atgggcgatcctgccggccgtggcgggatgggcgagcctgccggccgtggcgggatgggcgagcctgctggccgcggcgggaaggcagcattcgaccaccgtgcaccggcagacggcggcgagcccggccgtgcgggtggcggtgtcggcggcggtgaggagggcgtcgccggggagttggctggccggctggatgtcggtcgggcggcggtcaccgggcattcgctgggtggggcggcggctgtgcgggctgctcaaggggatccgcggttcaaggcggtcatcgatctggacggtgggctcgacaccgatcagaaggcggtacggcagcccgttctggtggttacccatgagattcgggatcgggcggatgccgactatgtcgcgcgggtgatgacagtgctcgaaggcggcggggcgggcgggtatcggctcaccgtgccggggagtgcgcatctcacgttcaccgatgcgcccctttatctgccgccggtcccgtcgctggtgggttcgctcggggggaacggcagcgtgcggatgacagtggagaccagcgccgcgttcctggacgccaccctgggcgggcggaccgtcgacctgtcggcggcgctggcgaaatacggcgaactgtcagtccggcagcccgcggcggtccggtaa

SEQ ID NO: 12 - DNA, 2328 bp, Actinoplanes utahensis
gtgacttcggctcccgctatccccgtctccagtgccaccgacgcgctcaaccgcatcttcggttatccggatttccgcggccggcagcgcgagatcgtcgagcacgtgatcgacggtggtgacgccctggtcctgatgcccaccggcggcggcaagtcgctgtgctaccagatccccgccctggtccgccccggcaccggtgtggtgatctccccgctgatcgccctgatgcaggaccaggtcgacgccctgcgcacgctcggcgtccgggccggcttcctgaattcgacgcaggacctcgacgagcgccgcctggtcgaggccgagttcgtcgccggcgagctcgacctgctctacgtcgcgcccgagggcctgggcaccgcgggcgtccagcggctgctcgaccgcgggcagatctcgctgttcgcgatcgacgaggcgcactgcgtctcccagtggggccacgacttccgccccgactacctgtcgctgtcgatgctgcacgagcgctggcccgacgtgccgcggatcgcgctgaccgccaccgccaccaccgccacccgcgacgagatcgcccgccggctgcagctgaccgacgcgcggcacttcaccgccagcttcgaccggcccaacatccagtatcggatcgtcccgaaaaatgatccgaagcgccagctgctcgacctgctgcgcaccgagcacccgggcgaggccggcatcgtctactgcctgtcccgcgcctccgtcgagaaacacgcggaatacctgtccgccaacggcgtccccgcgctgccctaccacgccggtctcgacgcccgcacccgcgccgagcaccagtcccgcttcctgcgcgaggacggcctcgtcatggtcgccacgatcgccttcgggatgggcatcgacaagccggacgtccgcttcgtcgcccatctcgacctgccgaaatccgtcgagggctactaccaggagaccggccgcgccggccgcgacggcctgccgtccaccgcctggctcgcctacggcctgcaggacgtcgtccagctccgcaagatgatcgacggctcggagggcgacgccaacttccgccgcaacgccaaccggcacctcgacgcgatgctcgcgctgtgcgagacggtgtcctgccgccgcgtccagctcctggcctacttcgaccaggaggccgcatcgtcgtcgtgcggcaactgcgacacctgcctcaccccgcccgagtcgtgggacggcaccgtccccgcccagaaactgctgtccaccgtgctgcgcctgcaccgcgagcgcaaccagaagttcggcgccggccagtcgatcgacatcctgctcggtaggaagacggacaaggtcgcccagttccgccacgaccagctcaaggtcttcggcatcggcgccgacctgcgcgaggccgagtggcgcggcgtcgtccgccaactgctggccggcggctacctggcggtcgagggcgaatacggcacgctggtcctcaccgaccgcagcgccgccgtcctgcgcggcgaggtcaccctgatgatgcgccgcgagctggcccgtccccgatccgcgtccagcgcccgctcatcgtcgggttcgggctcgtccagctcccgctcggccgcacccgctcccgccgacttcccggccgaagccgagcccctcttcgaaaggctccgcgcctggcgggccggcatcgcccgcgatcaggccatcccgccttacgtcatcttccacgacaagacgttgcgcgccatcgccgtcctcgcccccgccacgctcgaccagctcgccaccgtcagcggcgtcggccagagcaagctcaccaagttcggcgacgacgtcctcgccgtgatccgtggcgagaccccgtcccccaccccgccgcccggcgactcgcccgtccccggcacgctccccgtcaccaccaccgggcctgcccacggtgggcttcccggcacggccactgcggctgcccgtggcgcgcttcacgcagccgagccggcccctgacacacttcccgtctccgagccggcccgcggcacgctccccgcagccggcgcacgtcccgtccctgagccggcccgcggcacgcttcccgcagccgacgcgcgtcccgtccccgagccggcccgcggcacgcttcacccagccgacgcacgtcccgtccccgagccggcccgcggcacgcttcacccagccgacgcacgtcccgtctccgagccggcccgcggcacgcttccttccgccggaccgaccgcctccttcgaggatgacttcccccggtatgagtacaccgacgaggacgagcccttcttcgactga

SEQ ID NO: 13 - DNA, 1902 bp, Actinoplanes utahensis
gtggacattccggcgggcggcgatcttcgggcgatgctgtccgcggtggatcagctgccgttcatcgtggccgttttcgagggaccggagctgctcctggtcggcgcgaacgcggcgaccagggcggtgctgcccgggcgggacatcatcggccggccctgccgggaggtgctcagcgacctggccgggcagcagttcgtcgacgcgtactaccaggtgtaccggaccggtgagccgatcgccggccagcagtggcgggcccacctggacatgccggacggctcggtgcacgagatgttcgcgaccttcaccatcgtgccgtggcgcgacccggacgggacactgcgcggggtgatcggcgccgcgttcgacgtcaccgagatcgcccgcacccggcaggccgccgaggccgaggccgcccggctgcggcagcgctacgagcagggccgggacgtgatcaccgagctgcagcgggaactgctgccaccagggctgccggtgctgcccggcctgcaggtggccgcgagctacctgctcgccgacgcggacaccgcggccggcggcgactggttcgacgcggtggcccggccggacgggcgggtggccctggtcgtcggcgacgtggtcgggcacggcatcaccgcgtccggcgccatggggcagctgcgggcggtgctgcgggaacgcctcgactccggcgcgccgatcgaggaggcgctggcggccgccgaccggttcgccgggcggatgcaggcggcgcacgcggccaccgtgtgcctggtgctgctcgacccggccggcggtgcgctggactactgcacggccggacacccgccgccgctggtcagcggacccgacgggaccacccgctacctcgccgccagcggcgggtcgccgctcggcaccggcggggtcttcccgatccggcacgaccggctggcgaccggggacctgctgctgctctacaccgacgggatcgtggaacggccccaggccggcgggccgcagcccgcggagctcgccaaggtggtcgcggacgcgacggccgggcgggcgctgcgcgagccgggcagcaccgcggccgaccgggtctgcgggcaggccatcgaactgctggtgcgggccggcgggcatgccgacgacatcaccctgctcgcggcgcagcgggttccggtcgtacccgagctggccctcgatcttccggcgaagccgaccgagttgcgcggggtgcgggcccggctggggcggtggctggccgagctcggcgcgtccgcgcaggacgtgttcgtgctccagcacgcgctcggcgagctgaccaccaacgcgatcgagcacggcggcgggcggaccgtcacggtccgggcggtgctgaccgcggccgggcgggtcgaggcggtcgtcaccgaccacggcgggtggcgggcgccctcccggcagccgatccgcggccgtggcctggccctcaccgcccagctggtggagagcctgcacgtcgagcccggcccgcacggcacggtggccaccgtccggcacccgctgagccgcccggcccggctgctcacccgtttcgacgacgctccgcgccgggccgagccgcccgccgcgatgaccgtcaccgagctgcccggcggcgacgaggcacgggtccgggtcgacgggccggtggacagcacctccgcggtcgcgctgcggcaggagctgctgcgccgtagccggggcgggaacgtgccgatgaccgtcgacctgaccggggtcgaccacctggccagcgccggggtgtccgcgctctacctgatcgccgagcagcaccacgaccgcaaagccccgctgaccctgatcgcggccccggacagcccctcgcggcacatcctcgacctggtcgggctgccggtaaccccatag

SEQ ID NO: 14 - DNA, 642 bp, Actinoplanes utahensis
atggtgaaggccagcatccgacgacaggtgaccgtgccgctgcggttttccgacggatacgccaccaccgcccaggtgatgaccttcgacgggctggcggacggccgcgagcacctggcgctgggcctcggcgactggcggcgggcgctgaccaagtcggcggccggcggccgggcgccgctggtccgcccgcacagcgagtgcctgaccggcgacgtgttcggcagccagcgctgcgactgcgggccgcagctgcgcgaggccgccgagcggatcaccgagcagggcggcttcctgctctacctgcggcaggaggggcggggcatcgggctgtacgccaagctggacgcgtacgcgctgcaggacgacgggctggacacctatgaggcgaacctggcgctggggcgcggcgaggacgaacgcgactacacggcggcggcgcagatgctgcaggcggtcggcgtcgaccggatccggctgctcagcaacaaccccgacaaggccctgcagctggaaggcctcggcgtcgcggtgacccagcggatcccgaccggggtgcacgtctccgcggccaacgtccggtacctgcgggccaaggcgtcgcacacctcgcacaccatcgaactgcccctggccgagtga

SEQ ID NO: 15 - DNA, 687 bp, Actinoplanes utahensis
atggatgagcgtccttacattttgctgagctgcgggatgtcgatcgacggctatctcgacgacacgtccgcggaccgcctgctcctgtcgaacgacgcggatttcgaccgggtcgacgaggtccgcgccggctgtgacgcgatcctggtcggtgcctcgacgatccgccaggacaatccgcgtctgctgatccgctcggcgcagcgccgggcgcggcggctggtccgggggaaaccggcgaatccggtgaaggtgaccgtgaccggtcgcggtgacctcgacccggaggcggcgttcttcaccgcgggcgagtcggcgaaactggtctactgcgccaccggcgcgctggcggcgacccgggaccggctgggcgcggcggccaccgtggtggacggcggcgacccggtcgacgtccgccgggtcagcgccgacctggcccggcgcggcgtgcgccggctgatggtcgagggtggcggcaccatgcacacccagttcctcaccggcgacctcgccgacgagttgcagctggtgatcgcgccgttcttcgtcggggactcccgcgcgccgcggttcgtgcacgacggcgacttcccggccgggccgaagaatcgcgcgcggctcgccgaggtccgccagatcggcgacgtggtgctgctccgctacgcgctctccgaccgcttcagctga

SEQ ID NO: 16 - DNA, 1086 bp, Actinoplanes utahensis
gtgacgacgcgatcgttctgggcatgggtgcgcctgctcggcggtgccgggatcatcgtgctggtgctgtggcgactcggcaccggcgccttcctggacgggctgcgggtgctcgacgccggcacgctcgcgctggccttcgggatcggcgtggtgaccacggtgctcagcgcgtggcggtggtgcctggtggcccgcgggctgggcctgaagctgtcgctgcgggacgccaccgccgactactaccaggcgctgttcctgaacgcggcacttcccggcggggtgctcggcgacgtcggccgggccgtctcgcacggccgcgaggagggcgacgtggggcgcggcgtgcgcgcggtcgtcctggaacgcaccgccgggcagctggtgctgctggtggtcggcggggcggtgctgttcaccgtgccgtcgccggtgctgaccgtcctcggcgagcacggggagacggtcgccgtggtcgccggcacggtcgcggtcgtcgcgctgctgaccgtcggggtgctccggcgggcccggcggggcagcgtgaaactggccggcgccacccgcaccggggccgccgagatccgctccggcctgctggcccgccgcaactggccgggcgtgctgttcgcctcggccatggtcctcgccgggcacctggcgaccttcctggtcgcggcccgggtcgccgggaacggcgcgtcgctgctgcggctcgccccgatgctgctgctggcgctgctggcgatgggcatcccgctgaacgtcggcggctgggggccccgcgagggcgtgctggcctgggccttcggcgcggccgggctgagtgccgaacagggcgtgacgatcgcggtcgcctacggcatctgtgccttcgtcgcggcggcgccgggcgcgatcgtggtcgcggtccgtgccgcgcggaaactgcggcggccggttgcggcccgacccgattcgcgcgtacggtcgaccacccccgccgcgcccctggtcaccgccgagcccctgccggcagggccggtgcgggtgcgtcgcgcgaccacggtgcggcaaccggcgtacagcagcggggtcggggtttga

SEQ ID NO: 17 - DNA, 753 bp, Actinoplanes utahensis
atgaccggagaattcagcgccgactggctggccctgcgcgagcccgccgacgccgacgcccgcgcggccgacctggccggcctgctgccgcatccggtcaaggtgatccgcgacctgggctgcggcaccgggtcgatgggccggtggctggcgccccggctgccgatgccgcagttctggatcctcaccgaccgcgaccacgacctgctggagatcgccgccgaccggatgccggacggggtgaacgtggcgatcgacgagcgcgacgtgaccgcgctgacccgcgacgacctgaccggggccgacctggtcacctgttcggcgctgctggacgtgctgaccgccgccgaggtggaccggctggtcgaggtgtgcgcgcaggcccgggcgaacgtgctgttcaccctctcggtgaccggggtggtgcggttgacgccccccgatccgcgcgacgacgacgtacgacaggctttcaacgaccatcagcgtcgtgacgcgcgtctcggaccggaggccggggactacgccgcggccgccttcgcgaaggccggtgcgcgcatcctcacccgggagagcccctggcggctcggcgcggcgcggcccgaactgaccgccgaatggttgcgcggctgggtcggtgcggccgccgagcagcgtcctgatctgcgcttcgatgactatctggcggagcgtgcggcggcccttccggagatctcggtgggccacaaggatgttttagcgatcttcgactga

SEQ ID NO: 18 - DNA, 1080 bp, Actinoplanes utahensis
gtgaacaccccgctccacgtggtgctgccgggcggcatcgacgacccggcggcaccgagcggcggcaaccgctacgaccgccgggtcctgcgggagatcaccgcgaaccgggcgcgcggcacgcagcgcgagccggctgcggctccgctcgatcatccggcggtacgcgagaccgctctgcccggctcctggccacgccccgccgcggacgcccgccggcgcctgtcccggaccatggcggcgatccccgacgggcacaccgtgctgctcgacggcctggtcgcgtgcggcgtcccggaactcctcgccccgcacgcccgtcggctgcgtctggtgatcctggtccacctgccgctcagcgacgagaccggcctctccccaaccgcggccgccgaactgaaggccctggagggccgcgccctgcacctggccgccggggtgatcgccaccagcgaccaggccgccgcgcacgtcgccggcatgcacggcatcgcccgggtgcacgtcgcggctcccggcgtcgatcccgccccgccgtcgaccggctcccccagcggccgccacctgctctgtgtggcgtcgctcacccaccgcaagggccaggacgtcctgctgcgtgctctggggaccctcaccgacctggactgggagtgcaccttcgccggcgcgggcccgatccccgcccattccgggaacgtccggttcaccgggccgctcgccggggcggacctcgaggccgcctacgcgaacgccgacctcttcgttctgccgtcgcgcgcggaaacctacggcatggtgatcaccgaggcgctcgcgcacgccctcccggtggtggccacccacgtcggcggcgtcccgcaggcgctcggcggcaccccggacggcgtacccggcaagctcctggccccggacgacccggacgggctcgcggacgtcctgcgcgcctggctcaccgacagcgacctgcgggcgcgctggcggcgccgggccgtcgcccgccgcgcgaccctgaccggctgggacgagacggcccgccggctcaccacgatcctgagaatcatcgaggaaggaactccatga

SEQ ID NO: 19 - DNA, 402 bp, Actinoplanes utahensis
ttgttcagcgtcaccgtccgcgaccacatcatgatcgcgcacagcttctccggggaggtcttcggacctgcgcagcggctgcacggcgccaccttcgtggtcgacgccaccttccgccgcccggagctggacgaggacaacatcgtcgtcgacatcggcctggccagtgagaagctgcacaccatctgctccggcctgagctaccgcaacctggacgaggacccggagttcaccggcgtcaacacgtccaccgagttcctggccaaggtgatcgccgaccggctggccgtccggatctccgcgggcgaactcggcccgggcgccaccggtctcaccggcctccaggtcaccctgcacgagtcgcacatcgcctgggcgagctacgagcgaaccctgcggtga

SEQ ID NO: 20 - DNA, 975 bp, Actinoplanes utahensis
gtgttcgacgcgagggccttttggttggcttgccccggatcgggggagatacgcacggaatcggtgcgggatccgggtccgggtgaggtgctggtgcgcacgctgcactccggcgtgagccgcggtacggagacgctggtgttccagggccgggtgccggagaaccagtggtcggcgatgcgggcgccgttccaggagggcgacttcccggcgccggtcaaatacggctacctcaacgtcggcacggtagaggaaggtccagcttccctgaagaatcggacagtcttctgcctgttcccgcatcagacccgatacgtggtggggcaccgggagataaccgtcgtgcccgacggcgtccccccggagcgggcggtcctggccggcacggtggaaaccgccgtcaacgccgtctgggacgccaacccccagctcggcgaccgcatcacgatcgtcggcggcggcatggtcggctcctcggtggccgccatcctcgccgcctaccccgccgccgagatccagctcgtcgacgccgaccccggccgcaggaccgtcgccgacgccctgggcgtggacttcgccctccccgacgacgccgcggacggccgcgacctggtgatccatgccagcgccaacccggccggcctggcccgcagcctggagctcgccgccccggagaagaccgtcgtcgagctcagctggtacggcgaccgcgaggtccccctgcgcctgggcgagttcttccactcccgccgcctcaccatccgcggcagtcaggtcggcggcatcctcccgcagcggggccgcacgtacgcgcaacgcctggacctagccttgaatctcttgcgggacgaccgtttcgacgccctcctgaccggccggtccgcgttcgacgagctgcccgaggtgatgccgaggctggccgacggcagcctgccggcgctgtgtcacgtgatcgactaccccaccgggaattga

SEQ ID NO: 21 - DNA, 747 bp, Actinoplanes utahensis
gtgaccatcactaccgccacgacgaccccgtcccgggcgcctttcgccgggttcgccgcccagctcgcgctgatcgcgctgctggccgcgacgacgggactcacgctggccggtgggctcgccggaatcgcctacggcgccgtcctctgcggtctgctcggcatggccctggaccgggccgggctcagcttcctcggctgggccaacctggtcaccttcggccgggccatcctcaccggcggggtggccgccatggtcaccggcaccgtcctcggccacccggcgccggtctggccgctggtcacgatcgccgccgtcgcgctcgccatggacggcgtcgacggacaggtcgcccgccgcaccggcacgtcgtcgtcgctcggcgcgcgcttcgacatggaggtcgacgcgttcctgatcctggtgctcagcgggtacgccgcggtcagccacggctggtgggcgctggccatcggcggattccggtacgccttcgtcgccgcctcctgggcgtacccgtggctgaacggcgcgctgccggcgcgcttctcccgcaaggtggtcgccgcccagcagggcgtgctgctcgcggtcgtggcgaccgggctgctgccggagtgggccgcggtgggcacgctggccttcgccctggcgtcgctgacctggtccttcggccgggacatcaggtggctgcaccgggagtccgcggtccagcgtcagttcgacctgatcactggacgcgtctga

SEQ ID NO: 22 - DNA, 1248 bp, Actinoplanes utahensis
gtggcgcggcgggcgcagcggcagatagccgcgccgggccgcttccgcgagttgtcccggggtacccatcctggacagcaccggtccggggtcggccccgggttcctgccgtgcggccaggtagtcggtgacggtccgcatgagttcgtcgcgcgggccgggtggcagatcctcgctcgcggtccacaactcggtcaggtattcgagcacgagcgtgtcggcgtgggccagcggtgctgtcgtcatctcgggtctccttctcgaagctgctgtccagcatcgatcggggcgagcgccgggcacatcggaccggggtggtattccgcgaccccggagtccgactttcggcctatggtcacaggtatgcgtctggtttccctgctgccctcggccaccgagatcgtctatgcgctggggttgggtgacaatctggtcggggtcactttcgagtgtgacgagccggccgaggcccgctcgtcgaagacggtggtggtcggcgggcgggacacgcacggcatgtcgccggtcgagatcgacgattatgtgcgtacgcagatggccgccggcggtgatctgtacaccctgcacgcggacgccctcgccggcctctcccccgatctgatcctcacccaggacctctgtcgggtctgcgcgctcccgtccggccatgtggacgacgcgctgacgcatctgggctgccgcgccgaggtgctcagtctcgacccgtattcgctgcccgacgtgctggcctcgttcgtcgaggtggccactgccgccggcgtacccgatcggggccgggaactcagagcgggcctggagcggcggctggacgcggtggcggccgcggtggccggccggccgcggccccgggtggcgatcgtggagtgggtggatccgccgttcaccggcgggcactgggtgccggatctgatcgtcgcggcgggtggtgagccggtggcggcgcgggcggggaagcggtcggtgcaggtgtcgtgggccgagctgaccgccgcgcaaccggagatcgtgctggtcacaccgtgcggctatcacctggacggcgcggtccggcaggcggagtcggtgctgccgcacttcccggacgcgcaggtgtgggcgatcgacggcgacggcctggtggtccggccgggtccgcggctggtcgacggggtggaggcgatcgccacgatcctgcatccggacgcggtgccggcggcacgccagggagcggtcagacgcgtccagtga

SEQ ID NO: 23 - DNA, 858 bp, Actinoplanes utahensis
atgatgccggtcaacggcatccaggtgtgcctggaaaccttcggtgaacgcaccgatccgcctctcctgctgctcgccggggaggccagttcgatggactggtgggatgacgagttctgccgccgcctggccgccggcggtcgcttcgtcatccgctacgaccatcgcgacacgggccgctccaccgcgttcccacccggcgccgcctattccggcaccgacctgatgcacgacgcgctcggtgtcctcgacgcgctcggcgcccccgccgcgcacctggtcggcctctccctgggcggcgcactcgcccagcgcatcgccgtcgaacacccgcgccgcgccctcaccctcacgttgatcgccaccagcgccggcctccccccggacgccatcccggtcctggccggcgcccccactctcccgctccgcacctcggccggcacctcggtcgccgtccgcaccgcccccgacgacgtcaactggtccaaccgccgcgccgcggtagccggcctgatcgccgaggcccttgcccggggcggcccgttcacccccgacgagcagcagttgcgccgcctggccgaacgagtcttcgaccgctcctgcgacctcggcaccgcccgccgcaaccaccagcgagccggctacggccccccgatccacgaccggctccccaccatcaccacccccaccctgatcctgcacggcaccctcgaccagcgcgtccccgcccaccacccccgggagctggcccgcctcatcccccaggcccgcctgatctggctggacggcgtaggccacgaacccccaccccgagccctatggccccagatcctccccgaaatcctccgcacgccttga

SEQ ID NO: 24 - DNA, 333 bp, Actinoplanes utahensis
atgtcggaattcgagctgcaccgtacggaagagcaggcctcgctggacgggcagcgggtgccggggctgcgggccgagttcttccgccgggccgacggggaccgggtcgccagcgtggggcggtattcgctgggcgggcgcgagttgctgctcgcgtgggggtacgtcgacgaggagcattgccggcacaacgccgtacgcgcgaaatccggaagttggtttccggcggaagccgggtgtcccgacgtgcggctcataaaggacggccaggccgtgatcggcctggccgttcgcgcctccacgggcgaatggatgcgcgaggagtgcggctga

SEQ ID NO: 25 - DNA, 372 bp, Actinoplanes utahensis
atgcgtcgtgccgctgtcgttctcgccctcgtcgtcgccggtctgtggatcgcctcgccggcccaggcgttcgcccacaacaacgtccacaacgtgtacttccacgccgtgctcgacgcgctgaccctgctggtcgtggcgtccccggtgtggaccgcgatgctgtggagcggccgccgcaggtggctgatggccgcactgatcgcggtggtgcagatcccggtcgcggtgatcggtttcgtcccgatcatcaacccgtacctgcacctggccctgttcctgctggccatcggcctcaccgcaacctcactgcgcatcgtccgcaaccggtcccgcgccgccgccggcgtcccggccccgaaaccccgctag

SEQ ID NO: 26 - DNA, 171 bp, Actinoplanes utahensis
gtggtggccgacagggcgacctgccgcaccgtggagtcggcgatcgtcgcgtacatcgcggtgcacgacgccgacccgacgtcgatcaggcaattgacgccgtacgtcgacggcgacatcgcgaagtaccgcatcgtcaggggccgcgcggcggggccgggctgccgctga

SEQ ID NO: 27 - DNA, 1845 bp, Actinoplanes utahensis
gtgacgatggagacgttggagttccaggccgaggcgcgtcagctgctgcagttgatggtccactcgatctattcgaacaaggacatcttcctgcgtgagctgatctccaacgcgtccgacgcgctggacaagttgcgcctggccaaactgcaggacgggctggaggcggacacgtccgacctgcacatcgagatcgaggcggacgccgaggcgcgcacgctgacggtccgcgacaacgggatcggcatgacccgcgaggaggtcgtggcgctgatcggcacgatcgccaagtccggcaccgccgacctgctggccaagctgaaggaggcgtccgagtccaagggtgacgccgagctgatcggccagttcggggtgggcttctactcgacgttcatggtggccgacaaggtgtcgctggtgacccgcaaggccggcaccgaggggcacggcacccgctgggagtcggccggcgagggcacctacacgatcgaggacgcgccggacgcgccgaccggcaccacggtcacgctgcaactgcgacccaaggacgaggaggacgccctcttcgactacgccgacgagtggcggatcaagcagatcgtcaagcggtactcggacttcatctcgttcccgatccggatgggcgacgagacgctgaactcgatgaaggcgctctgggcgcgcccgcgcagcgaggtctccgacgacgagtaccaccagttctaccggcacatcagccacgactggtcggacccgctcgagatcatcaacatgaaggccgagggcaccttcgagtacgaggcgctgctgttcatcccgtcccgcgccccgcacgacctgttccagcgtgacgcccgccgtggcctgcagctctacgtcaagcgcgtcttcatcatggacgacagcaaggagctgatcccggactacctgcgcttcgtcaagggcgtggtggacgccgccgacctgtcgctgaacatctcgcgcgagatcctgcagcaggaccggcacatccagatgatccgccgccggctggtcaagaaggtcctgtccacgatcaaggacctgatggccaacgagccggagaagtacgcgacgttctggcgcgagttcggccgggcggtcaaggagggcctgctcagcgagccggacaaccacaagccgatcctggacatcgcctcgttcgccaccaccgcgggcgccgagccgaccacgctcgccgcctacgtggagcggatgaaggaggaccaggaggagatctactacctgaccggcgagagccggtcccaggtggagaactcgccgcacatggaggcgttccgcgagcagggttacgaggtgctgatcctcaccgacccggtcgacgagatctgggtcgacgcggtccccgacttcgagggcaggaagctgcgctcgatcgcccgcggctcggtcgacctcaagaaggacgagccggagaaggagcccgagggtgacttcgggccgctgctcggcttcctcaaggacaggctggacgagcaggtcaaggaggtgcggctgtcgcaccggctgaccacctcggcggcctgcctggtcagcgacgccgacgacatcaccccggcgctggagaagatgtaccgcgcgatgggtcaggacggcccgcgggtgaagcggatcctggagctcaacccccaccatccgctggtcgccggtctgcggtcggcgcacgagcgcggcgcggaggatccggctctgccggagaccgccgaattgctgtacgggacggccctgctcgccgagggcggcgacctggaggatccggcccgcttcgcgaaactgctcgccgatcggctggcccggacggtctga

SEQ ID NO: 28 - DNA, 939 bp, Actinoplanes utahensis
atgaggtgccaggcctgcgggttggacaacgatccggcactcgactattgcgacagctgcgagcatccactgcgcgattccaccgccgttgtttcggtgccgccgccgccgattccccggccccggccggcgccggccgtggagttcgacgacgcggggacggcggccgatccggggttccgggacacgctggtcgagccgcgcccgccggcccggccggtgctggtgggggtggccgtgctcgcgctggccggggcggtcggcggctacctgctcgcgcaggatagaggcgataaatccggcaagccggatagcggagcggtgaccagtgcggccgcccggccggtcgggggtgggacggacgccgcgcggggcggcgcgaccggcgcggacgacggcgatggcggcccgggcagcggggatggcggcccgggcagcggggatggcggcccgagcagcgggaacggcggacccagcagtgccgcggccgacccgcaggcccagggtgccgcactcgataagctgctcgatcggagcagggccagccgggacaagctcaaccaggcgatcaagtcggtcgacgggtgctccggcgtgtacgccgcgatcggccggatgcgcgaggccggcgacgagcgtgccgccgagcgggacacgctcgccaccctggacctgtccgcgttcccgaacggggagagcctgcgaagcgcgctgacatcggcgttcgagcattcgctggccgccgaccagaattatgtgaaatgggctcaggaaaagcaggcgaacgattgccggaatacgccggcgacccgcgcctacgacgccgacggagaccgcgagtcggactccgcgggccgcgcgaaagagcaattcctgggcctgtggaatccgatcgccgggcagctcggcctgcagacgcgggaccggcagggcatctga

SEQ ID NO: 29 - DNA, 333 bp, Actinoplanes utahensis
gtgcctgactcgaacaccttcaacatcggcggcgtgaacggcggccagaacaacttcggcggcgatcacaacaccttcaaccagcaggtgtacggcgtggacgcggccgccgtggcgcagcttctcggccgggtgcgcgagcatctggccgacttcccggacccggtggcggccggccacgcggtgagcgagctgcaggcggcgccggcggccgagttggcccacccgggccggctccgaagcctgctggaagacctgcaccggtacgccccggacgggacggcggcgctggccgcggtcgccgccctggtcgccgcggtgcacggcggctga

SEQ ID NO: 30 - DNA, 1749 bp, Actinoplanes utahensis
atgacaacgctgcccagcccgccgctcgccgcgccgctcaccatgccgcggtacgcccggaccagtgaccgcctcagcaacaccacccggtatctgtgcaccgccgccttcctggtgcgcggcttcgccgaccaggtggtcgacgaactgatcggcgagatgcgccggtccgtgccgccctcgcacggctacgacctcgacccgatcgtccggcagtgcttccgggtccgccgccgacacctctaccagcagctctgcgccaccgtgctctacctggccgcgctcctgctcagcccaccgctcacgctcaccgtgaccgggctcggcctgatcgtccggctggcccgctcggtgcggctgcgggcgttcctggcccgccaccgcctcggcttcctgcgctggtgggtcgcctggttcctggccggcatgctggtcgggctgccgctgacgctgctgttctccctccagaacctcttccggcagtacctcgacgagaacaccgacaccaccggctccgccgccgcggcagccgccaccggtggtggcgggagctccctgctcgccctgttgtgcctgctggccatcgtgggggtcacctacgcgttccgccgcgacgcgtaccgggtcgtcaccaccgagttcgcccccgacgtcgcccacgcccgcacccggctgcgcgacaccctggtcgaggaccggctcgcgatgatcgccgcagcccagcggggcaacgtggtggtccaccacgacgacccgttcctcggctgcggcgcggtcgagcagggctggtcgttcagcatgacgctgcggccgcgggacccgtccgggatccgccccgaggagccggtgccgatcgacccggtggcgctgaaccggcggctcaaacgggccatcgagacgatgcgcgccgactggctcgacgagggacagcgggtcaccggcctgtcggtccggccgtacgtggtggccgacggcattcgcgacgagcacgatccggtgatcgacccggagaccggcatgccgtacacgatggccgacgaccccaccgtcgacgcgatcgtggccagcccgcagggcgggctccggcagtacctgcgggtggtgatcccggtgcgcggcaaggcgatccgggacgagcacggccaggtgatcctcggcgcgcaggcgctgggcatctcggtcagcgcgttcgtgcacgtcgcggtcgagggcgggatgctgtacgccgagtttctcggcaccgtgctgccaccgctgcgcgccgagtgccaggtcgccgacacgctgcgcccggagaaggtcggctcgtacgcggtgggcggggtgctgcgcggggcgatcgtcgacgtggcagccgggccgtaccgcctggcccgggcgctcggccgggtggcccggctgcgctggcggatgcacacctcgatccgccgctcgcaggagttccgcacccacgactacggcgcgcggatcagcgtccgtgacctggcctcggccccggaggcggaaagctacctgcagagactcgacggcatcaagtacgtgaagctggtcgaccggatcgtcggcgaggcgatcatcgaccacctgatcgagaacggcgtcgacccgctcgaattccgccaggcggtcaaccagatcacgctgcagaacagcagcctggtccaggtgggcacgatccagggcgggcagaacaacttcggcggcgacggcaacgtgttcaccacgacggtaggagcggcgcgtgcctga

SEQ ID NO: 31 - DNA, 159 bp, Actinoplanes utahensis
atgaagaagatccttggctgggtgctgttgttcctgctcgtcttctggatcggcacgaacccggggccggccgccgacgtcgcccggagcatcggcgacggggtcgccacgatcttcaccaacatcggcacgttcttcgtcaacctggcgaaaggctga

SEQ ID NO: 32 - DNA, 1422 bp, Actinoplanes utahensis
gtgctcagcgtcgcgctgcccacgctcgcccacgacctgcacgccaccaccggtgacctgcaatggttcaccacctcctacctgctggtgctggccgccgcgctgctgccggccggcatgctcggcgaccgcttcggccgcaaacggttcctgctcggcgcgctggcactcttcggcgtcgcctccgcctggtgcgcgtgggccggcagcaccgggcagctgatcgccgcccgctcggtgctcggcctggccgccgcggtgatcatgccgctgatcggcgcggtgctcaccgtcgtcttcgacgagcagacccggccccgggcgctgagcatctgggtcaccgccaacgcgctgggcatcccgctcggcccgctgctcggcggctggctgctcgaccacttctggtggggctcggtcttcctgatcaacctgccgatcgtcgcgttcgggctgctcgccgtcgtggcctgggtgcccgggtcgcacggggaccggacccgccgggtcgacctcccgggagtggcgctctccgcgatcgggctggtcggcgtgacgtacggcatcatcgaagccggggagcgcggcttcggtgacccgcgctcgctgctgaccgtcgccgccggcctcgcgtccctgatcgccctggcgatctggcagcggcgtgccggcagcccgctggtcgacctcgacctgttcgcctcgcgcggtttcaccggcggcgcggtcctcgccacagtcgccagcttcgccttcttcggcctgctcttcgcgctgccccagctgttccaggcggtcggcggacaggacgcgttcggcaccggcatccggctgctcccggtgatcggcggcctgctcgtcggcgcccggctcgccgaccgcctggtcgcccggctgggcccgcggatcgtggtcgccaccgggctgaccctgatggcgctcgccctgctgaccggcgcccgcaccggcgtgaccacgggatacggctacgtggccgcctgggtcgcggtcgccggtctcgggctcggcttcgtgatgccgccatcgatgaacgccgccctgggcgccctcaccccgcagcgcagcggcgtcggctccgggctgctgcaggcgatgcgacaggtcggcagcgcgatcggcgtcgcggtgctgggcaccgtgctgaacaccggctatcgcgacgggatcgacgcggccgggctgcccgccgcggcccgggacagcgccgccgccggggtcgccgtggcccggcgcgccggcgacccgggcatgctggacaccatccggcgcgccttcacccacggcatggacaccgcgctggtcgccaccggggtggtcgccgccctcggcgtcctgctcgtggtgatcctgccccgccacgccccggccgccgacccggcgctgctggcagaatcaggagtatga

SEQ ID NO: 33 - DNA, 597 bp, Actinoplanes utahensis
atgacggcgagcctgcgcgagcgtaagaaggcgaggacgcgggcgacgatccgcgagcaggcgatgcggctgttcgaggagcaggggtacgcggcgaccacggtggaccagatcgccgaggcggccgaggtgtcgccgagcaccttcttccggtacttcccggccaaggaggacgtcatcctggtcgacgactacgacccgctggtggtggcggcggtccgcgcccagccgccggaggtgccgccgatcgaggcgatccggcgggcgctgcgggacgtgttcggccgtgtcagccccgaactgtgggagctggaacgccgccgccagaaactcttcgccgaggtgcccgagctgcgggcccgcgcgctgcaccagatgaccgaggcgatcgagctgatcgccgaggtgatcggtgagcgcgccggcctgccgcccgacgacctgcgggtgcgggcgatgggcggcgcgatcgccggggtggtcctggcggtgctgccgccgggccggatgatcgggcagaccgctctcgacccggccgatttcgagcggctcagcgacgccctcgacctgctccagcagggtttaccgctcggttag

SEQ ID NO: 34 - DNA, 1014 bp, Actinoplanes utahensis
atgctccatggagaggtacgtacggatgaagtccgccggccggctcggtgcgcccagtcgcgcggcctgctcggcgaaagcgtacgcgatcgcctcggtgaccagtgcgtccttcgacgtgaactgtttgtagaagccgccgtgggtgagcccggcggccgcgctgacgtcggccacgctgaccccggcgatgccccggtcccggaagagggcggcggccgtggcgacgatccgctcccggttctcccgggcctgtgcctgcgatacccgtcccatgcgcccagtatagatgacgtgtgtcatctattaccttgcggacttttagatgacgcccgtaatctaagtcgcatggaacttcacaacgccgtcgccctcgtcaccggagccaaccgcggattcggccggcacctcgccgcccagctgctcgaacgcggcgccaaggtgtacgccgccgcccgtcgcccggagagtgtcgacctgcccgggtccatcccgctgcgcctcgacgtcaccgacccgacctcgatcgccgccgccgtcgcggccgctcccgacgtcaccctgctgatcaacaacgccggcgcggccagcggtcagccgctgctcggtggcgacctggacctggtccgggccgagatggagaccaactacttcgggccgctggcggtgacccgggcggtcgcgccggtgatcgaggcgaacggcgggggagcggtgctcaacgtcctgtccgtgctgtcctggctgcacccggcggggctcggctcctacgcggcgaccaaggcggcggcctgggcgctgaccaacgccacccgcgagcagctggccccggccgggatcacggtgaccggactgcacgtcggctacatggacaccgacatggccgccggcgtcccggccgagcagaaggccgatccggccggggtggcgaaactggcgctggacgcggtcgccgccggggccccggaggtcctcggcgacgacctgacccgcaccgtgaaagcgtccctctaa

SEQ ID NO: 35 - DNA, 618 bp, Actinoplanes utahensis
gtgaagctgctgcacatcgccgcctccccgcgcggcgggaagtccgaatccctggccctggcggccaccttcctgaccgcggccgccgaggcccaccccggcctgcagatcgaggagtggaacctgtgggacgggaccctgcccgagttcgggccggacgcggcggccgccaagatggctgtcttcgccggcgagcagccgcagagcccggcgtgggacgccgcggtcgccgcgttccaccggttcgacgcggccgaccgctacctgttcagcgtgccgatgtggaacgccggcgtgccgtacatcctcaagcagttcatcgacgtggtcagccagcccggcctggtgttcggcttcgacccggccgcgggctacaccggcctgctgcgcggcaagaaggccgcggtggtctacaccagcgcggtgtacgggccggaccgaccgcccgccttcggcagcgacttccagtcccggtatttcgccgactggctgcactgggccggcgtcaccgaccagaccgagatccacttccggcccaacctggtgaccgccgacgccggaaccgctcgcaaggctgcccacgccgaggcccgggagcagggcaggctgttcctttag

SEQ ID NO: 36 - DNA, 435 bp, Actinoplanes utahensis
atgagcgacaccgaaaccgccgcctgggccgcgctgttgcgggtgcacgcggccgtggtgccggtcctcgaccgcaccctgcagagcgcctgtgggctgccattgacgtggtacgacgtgctgctggagctgcgtcacgcgccggacggccggctcagcatgggtgagctgggggagcgggcggtggtcagccgcacccgggtcagccgcgtggtcgaccagctcgtcgcggccggcctggcgacccgggagaccaatccggacgatcggcgctcggcgcacgcggcgatcaccgacgccggccggcagcggctgcgcgaggcggcaccgatctatctggacgggatccggcggcacttcaccgggctgatgtccaccgacgaggcgcgcgtggtggcccgggccctggacggggtgctgcggaaacaggcgtga

SEQ ID NO: 37 - DNA, 1380 bp, Actinoplanes utahensis
atgtcgaccatcaccgatgccggcaccggccagctgatcgtcgccgcggtgctcggcatcgcggcggtcgtcctgctcatcgccggggccaagtggcatccgttcctcgccctgatcgtcggaaccggcgtgctcggcctggtggccggcgccgacccggccaagatcgtcacctcgttcaccaccgggctgggcagcacggtgggcagcgtgggcgtgctgatcgcgctcggctcgatgatcggggcgctgctgaccgagtcgggtggcgccgacgggatcgtgcaccggctcgtcaccggggtctccgggaccgtcctgccctgggcgatggccggggtggcggcgctcgtcgggctgccgctgttcttcgagatcggtgtcgtgctgctggtgccgatcgtgctgctggtggcccggcggaccgacgtggggctgctgcggatcgggattccggcgctggccgggctctccgtgctgcacggactggtgccgccgcatcccgggccgctggtggcgatcgacagcctgcacgccgacctggggctgaccctgatcttcgggctgatctgcgcgattcccacggtgatcgtcgccggcccgctcttcggcaacctcatcgcggcgcgcgtgcccgtcgacgtaccgcgccgtcctgacgttgatcttgatgctgacggtgccgcggagcgggaaccggaagccgtgcggcgcaaccccggattctggccggcggtgctgaccgtactgttgccggtggtgctgatgctcgcgcgggcggtcgcggaactcaccctgcccgacgacaacagcgtccggaaggtcctcgacgtgctggggacaccgatcgtggcgctgctcttcggggtgctgctggcgatgtggagcctcggtcaccgggccggcttcgaccgccgggagacctccgggatcgtcggcggcgcgctgcccccgatcgccggcatcctgctgatcgtggccgccggcggcggcttcaagcaggtgctggtcgacagcggcgtgggccgggtgatcgccgacgcggccaaggacgcgagcatcaacgcgctgctgctcggcttcctcgtcgcggtcgggatccgggtcgcgaccggctcggcgaccgtcgccacgatcaccgcggccgggatcgtcacgccgctggcggccaccctggaccggccgacgctgtcgctgctggtgctcgcgatcggctgcggctcgctgttcttctcgcacgtcaacgacgccggcttctggctggtcaaagaatacttcgggatgaccgtcgggcagaccgtcaagacctggtcggtgatggagacgatcatctcggtggtcggcttcggctgcgtgatgctgctcagcctggtggtctag

SEQ ID NO: 38 - DNA, 426 bp, Actinoplanes utahensis
gtgcggatcgccgtacccgtcgccctgatcgccacgctggccctggccgccgggtgcgaggtgaaggtcaatcccgcctcgatgccggcgccgttcagcgtcgcgccggtcccgtccgcgtcggccggccagccgaagtatgtctgcaccgcggtctacaagatcctcaccgacggcgcggtcaagctggccggattcgccgccggcagcgacgacaccgccaccgagggcctgcagaagaccttcggcgacatggccacccaggtgcacgcggccggggcgaagtcggacgacgccgcccagcgcgccgcggtggacgaggtggccgcggcgctgaccagggggagccggtcggacgacccgaaggcgttcctgaacggcgagttcagcaccgtcggccagaagatcgacggcacctgcggttag

SEQ ID NO: 39 - DNA, 1842 bp, Actinoplanes utahensis
atgcgccgcgacaccttttgcgcggtagggaagttagctacgaacgtggcgaaattcccgaaaaatgccttcatagtcggtacgacggtggtagtactggctgccggtggcaccgcgttcgccgacctcgtctcgcccagcccggtcacctccccgtcgttcaacggctcggtctacgccgtcgcctaccgcggcagcacggtatacgtcggcggcaacttcacccgcgccatcgtcggcggccgcaccgtgccgcgcacccggctggccgccttcgactcccggaccggggcgctgctcgactggaaacccggcgccgacgccaccgtgcgcgccctcgccgtggacagcgacacggtctacgccgccggcgacttcgaccagatcaacggcgtgaagcgggacgcgatcgccggactcggcgccaccgacggcgcgctcaccccgatgcggcacaccgtcctcggccagcccgccgcgctcgccgccggacacggcaaggtctacctcggcggccggatcaccgcggtcgacggagttccgcgggccaacctggccgccttcgacaccggcaccggggccctcgacccctgggcgccgaccaccgacgacaccgtgcgcgcgatcgcggccgccgccgaccgcatctacctcggcggcagcttccaccggaccgacggcgcccgatacaccctgcggctcagcgcggtcgacccggtcaccggagtcctcgacccgaccttcctgcccaagccggtctcccaggtgttcgcgctcgccgcggccgccgacggggtgtacgcggcactcggcgggcagggcgggcgggcggtgtcgtacacccggaccggggccacccggtggacccgggtcttcgacggcgacgcccaggcgatcaccgtgctcggcggcaccgtctacgtcggcggccacttcgacaaggcctgcaccaccaccaacaacggggccaagggcagctgcaccgacggctcggtgccgcgcggcaaactcgccgccgtcgacccgcagggcaacctgctcgactgggcgccgcaggccaacggcgtcgccggcacccggtcgatggccgccaacccggagatcagctcggtcagcgcggtcggcgacttcaccaccgtgggcgggctgccccgtaagcggtacgccgagttcggggcgatcgggccgcgactcgaggacgcgccggccaccgcggactacgtggcgtcgtacaacttcgactcgaccgtcgccgacggcacctacgacgacgggtccggccacggccacctgctgcgcgccgtcacccgccacggcggcacgacgaccgccgtgccgcacggcaacggccaggcgctgcgcttcccggcccgatgcaccggacccacctgcccgcgcctcgtcctggaaaccgcctccggacccgacctcaacccgggaacccggcccatccgctacggcgccggcgtgcaactcgccccggccgagacctccagcggcgagaacatcctgcagaagggctactccaccggcggcggccagtacaagctgcaggtcgacggcatctccggcaaacccagctgcggcctcggcgaccaggtcgtctacctcgcccgcagccgggtctcgatcgccgacggcggctggcacagcctggagtgccggcgcaccggccccaccctgtccctgctcgtcgacgacgtgctgcaggccagcgtcgccgtcccgcccaccgtcgcggtcgacaccacctccccgctcaccgtcggcggcaaaggcgccggcccgaacaacgaccagttcaacggaacactggatgacgtctgggtgcacatcgggtag

SEQ ID NO: 40 - DNA, 630 bp, Actinoplanes utahensis
atgtctgatctcgaccgactcctcgaggccggttcccgccacgttcaggacgacgtgacctacgtcgtcgagccgcacccggccggcagcctggtcctgccgaccgggcagctggccgccttcgacccgggcgtcaccgacgaggacgaggagccgttcacggtccccgtcacccccgggacccacccggtcaccgcctgggtcgcgatcctggagaaagagggccgcgagtggcagcggcgggtggcggcgctgcaggtcaccgtgcgaccgggcgtggtcatgtcgtgggagctggctctggtcgccagcgacgagccggcggatctcgcgcccggcgagttcttcggctacggcgtcgagaccggggccggcggcttcgccgacctcagcgtctcgcggatcctggccgggtgggacaccgaggagttcgaggagaccttcgaccccgacgagttcccggaggagccgatcccgggccacttcgaccacgtgatcgacccggacaccggagccaacctgatcatggcggagtcggggtggggagacgggttctatccgacctacgtcgggcggaccgcggacggcgaggtggcctgcttcgtgaccgacttcctggtggtgccctga

SEQ ID NO: 41 - DNA, 510 bp, Actinoplanes utahensis
gtgacgctgcgcgctgtcgctcacccggcccgactgcacatcctgtcgctgctcaccggtgcaccgatgacggccgccgaggtggcccgcgagctggggatgaacagcgccaatgccgcctatcacctgcgcacgctgtacaccgccggggtcatcgagctggccggtgcggagcgcattcgcggtggcctggccaagcggtaccggtacgacgccacccttcatgcggcccgcgcgtctgccggcggtggcgcgccggagccggaccgggccgtctacgccgcgatctccggcgagctgggacgccgtgcgcagcatgccgagcccggtggtgtcaacgccctcgccgacgccgagctgtgggtcgatccgcgggtgtggcgtgccgctcgggaccggatcaatgaggtcgtccgcggcctccatgaggcggcgcagaaaccccgcactccgggagcgctacgcacgagcaccacggtcgcgctgttcaccatgaaggcgacggcgtga

SEQ ID NO: 42 - DNA, 1293 bp, Actinoplanes utahensis
gtgagagtccacggccctcttgcacacgcaccgttccgattcctgctgtccggccggttggtcagctccctcggtaacgccatggctcccatcgcgttggcgttcgccgtcctcgacctgaccgattcccccggcgcgctcggcttggtgatcgggtcccgcaccatcgccaacgtcgtcttcctgcttttcggcggagtgctcgccgaccgcctgccgcggcacctggtgatggtcggcaccagcgtcgccgcgggggtcacccaggcggcgatcgccgcgacgctctcgaccggcaccgccaccctgaccgtcctgacgacactcagtgcgttgaacggcgtgttcagcgcgctcgcgatgccggcatcggcagcgctgctaccgcaaaccgtgcccgccgaggaacgtcagcaggcgaatgcctggagccggttgttcctcaacggcgtggccatcgtcggggcggcggccggtggggtgttggtggccgcggtcgggcccagctggggtatcgcctgcgacgccgccaccttcttcctcgcggctctgctgttcgtgttcgtcaggacgatgccgaccgaaccgatcggcgctcaccccctaccggacccgccggaaaccggcgtcgtcccacctgacgaggctcccggtggcggaggcatcgtcaccgatctgcggaccgggtgggcggaattcagctcgcgaacctggctgtgggtcgtggtggccggattcgcgctgatcaacgcctgtatcggcggactcaccacgctggggcccgtcgtcgcgaacaccaccttcggccgcgcgacctggggtttcgtgctggccgcggagaccgtcgggatgattgtcggtggcctcgtcgccctgcgactgcgggtcagccgccttctgctgttcggcgtcgtctgcgcggccttccaactactcccgctgttgaccctcggcctcgcgccgcggccgggcttcctgctcggcgccgcattcatcgccggtgtgggggtggagcagttcggcatcgcctgggagaccaccatgcaggaacacgtacccgccgagagactggcgcgtgtctattcctacgacatgctcggctcgttcatcgccattccgatcggccagctgctcgcggggccgatcgcccaagccgtcggtgtccggcgcacgctggtcggtgcggccctgctcatcgccgtcgccgtggtcggcatgctctgcagccgggacgtccgacacctgcgccaccgcctcggatcaccggcggacgcccagccgatcgaggcctga

SEQ ID NO: 43 - DNA, 552 bp, Actinoplanes utahensis
gtgtctcggatccgtctcaccgccgcggaacgccaggagcagatcgtcgccgccgccctgcaggccttcgcccagggcggatatgtcggcacgtccaccgacgaggtggcccgcctgtcgggcgtgtcacagccgtacgtgatccgcatcttcggctcgaagcaggagctgttcctggccacggtccgctacgccggccagcgcatcgaggcgacatggcgggcggccgccgaccgggagccgactctggccagcctgggcagcgcctacaccgacctgctcgccgagcgcgaactcctcgccgtcctcctgcacggcttcgccgccagcgccgacccggtcgtcggcgacgccgtccgagcctgttacggcaacatgtaccaaaccgtccgcgacctcaccggcgccaccccggaggaggcccgcgacttcttcgccatgggcatgctgatcaccgtgctcggcacgatgcgcatcctgggccccggcgccgtccccccacaaccgtggatgacctcgctgctcagcaccttccccgaccacaccgcctga

SEQ ID NO: 44 - DNA, 1389 bp, Actinoplanes utahensis
gtgaccaccctcgcttcccgagcacccgccaagacccggccgttggcggccgtgctcgccgccgtcggcatcccgaccttcatggtctccctggacaacctcgtggtcagcacggcgctgccggtgatccgcaccgaactgcacgcctcgatcaccgacctgcagtggttcgtcaacgcgtacacgctgccgttcgccgcgttcctgctcaccgccgccgcgctcggcgatcggctcgggcggcgccggatgttcctcggcggcatcgtcgtcttcaccctcgcctcggcggccgccgcgctgtccaccgaagcgtggcagctcaccgcctcccgcgcggtgcagggactgggcggggccgcgatcaccccgctggcgctgaccctgctcgcccgggcggtcccggcacacctgcgcaacgcggcggtcgggatctggggcggcatcaccgggctcggcgtcgccgtcggcccggtcgtcggcggcgcggtcgtcgacggcctgcactggtcctggatcttctggctgaacgtgccggtcggcgtcgtcgccgtcgtgctcgccgcgaccacgctcgacgaatcccgcggcgacggccgccggctcgacccgatcggcctgatcctgtccgccggcggcatgctgctgctgatctggggcgtcgtcgacggccccgaccggggctggaccagcggccgggtcccggtcatgctcggcgcggcggtcgtgatgctcaccggcttccttttctggcaggcgcgcaaccggaccccgatgctgcccctccgcctgttccgcagccgcggcttcagcctggtcaacgcggtgaccctgaccttctccgccggtgcgttcggctcggtgttcctgctctcccagttcttccaggtggtgcagggcgccagcccgctgcagtccggcctgcgcaccctgccctggacggcggccccgatgatcgtcgcgccgctggccggcatgctggccggccggatcggccagcggatcctgatcgtcgccggtcaggtgttcctcgcggccggtctgctgtggatggccctcggactgtcggtgaccgcgtcctacacctcgctgatcggggcgttcgtgctcgccggcatcgggatggggctgaccttcgccccggtcagcacgatggtgctggccagcgtggacgtgaacgagcagggcgtggcgtccggcaccaacaacacgatccgcgaattcggggtggcggccggggtggcggctctctcgtcgatcttcagttcgctgggcggtttcagcagcttcgatgccttcatcgacggtacgcggccggcggtgctgaccggcgcggcggtgatcgcggtgggggcggtggtggggctctggctgccccgcaaggcctga

SEQ ID NO: 45 - DNA, 1029 bp, Actinoplanes utahensis
atggcgaacaggccgtcggtcacgctgagcagggcgacgacgagcaccgcgaacatgatcttcataccgactctgcggtcggacagcagcctcaccgaatcacactctcacaggtcacggtgtccgggccgtcggttgccgcgctgtgtagggtcgccggttgtgagtgacctcagcagcatccgggtgatcggcggccggacgtacgacttcagccgccaggccgtcgtgatggcgatcgtgaaccggacgccggactcgttccacgacaaaggccgcaccttcgccctggagaaggccaccgaggcggtccgtcacgcggccgccgagggggccgactggatcgacatcggcggcgtcccgttcgctcccggccccgaggtcaccgccgccgaggagctcgaccgagtcctgcccgtcgtcgaggcggcccgcgacctggccgtcgtctcggtcgacacgttccgccccgaggtggccgccgaggtgatccggcacggcgccgccgtcgtcaacgacacgtccgggctgcgcgatcccgcgatggccgacgcggtcgccggcacggacgcgcaactggtcatctgccacagcctcgccgcgccgcgcaccctctaccccagtccgcgatatcgggatgtgaccgccgaggtcggcgacttcctccggcagaaggtcgcgctggccctctcccgcggcgtgcgcccggatcagatcatcatcgacccgggccatgacctgaacaagaacacccttcactcgctggagatcacccgccgcctcgacgagatcgccgccatcggctacccgatgctcgcggccctgagcaacaaggacttcatcggcgaaaccctcgaccgcccgcagcaggaacgactcgccggaacgctggccacggtcgtcttcagcctgctgcgcggcgcacggatcatgcgggtgcacgacgtccgggcggcctccgacgcgatccgaatgaccgaggcgatactggggtggcgggaacccgcctacctcaaacacaacatctga

SEQ ID NO: 46 - DNA, 1587 bp, Actinoplanes utahensis
gtgaggctgctgtccgaccgcagagtcggtatgaagatcatgttcgcggtgctcgtcgtcgccctgctcagcgtgaccgacggcctgttcgccatggacagtctcggcaccaccaacaacatggtgaaagccggctaccagaacagtctcgaactggagacgatcggcaacctgcgcagtgccgtcaaccggacctggctggcggcctccgacgacctgctcgccagcgacgccacggcccggcaggccgccaccggcgccccgaccgacgcgcagaaccaggtcgaccagtatgcgcagggatatcagggctatccgaccggcagcgacgagggcgccgcgttgcaggcgttccggatggcctgggcgtcgtacgccgacgtgctgagcggcacgctgctgccgctcgccgccgccggcgaccgggcgaagatcgacgccgtgcggacccggcagatcgtcccgttgatgaccgaggtgcgggggcagctcgccaggctgtccgacctgacggtggccgagaccgccgcgcaggagaccgccgccgagagccgctaccagggcaccaggtggcgggtgctgctgatgctgaccttcagcgccgggatcggggtggtcctcgccctcggggcgagccggatgatcgtacggccgctgtcgcggtgcgtgaccgtgctggaccggatccggaccggtgacctcaccgcccgcgccgaggtcaccggccgcgacgaggtcggccggatggccgacgccctcaaccacaccgcccaggcgatgagcgacatggtcggccgggtgcggaccagcgccgatgtcctcgcctccgccgccgaggagctgtccaccgtctccagcgagctgtccgtgtcggcggaggagacttccgcccaggtcggcacggtgtccgcatcggccggccgggtgtccgaaggggtgcaggcggtctccgccggggccgaggagatgggcgtgtcgatccgggagatcgcgaacagcgccaacgaggccgccggggtcgccgccgaggccgcccgtaccgccgagcacaccaacaccagcgtgtcccggctcggcgaggcgtccgcgcagatcagcacggtcgtcgcgctgatcacctcgatcgccgaacagaccaacctgctggccctcaacgcgaccatcgaggcggcccgggccggcgagatgggcaaggggttcgcggtggtcgccgccgaggtgaaggacctcgcccaggagaccgcccgggccacccaggagatcaccgcgcaggtcgccgcgatccagaccgaatccgacggggcggtacacgccatccggcagatcgccgcggtcatcgcgacgatcaacgactacgcgacgacgatcgcggcggccgtcgaggagcagaccgcgaccaccgccgagatcgcccgcagcgtcggtcaggccgcggaaggctcgtcggcgatcgccgggacgatcgccggtgtggcgcaggccgcccagcaggtcacctccggcgcgaccgagacccagcagaccgccgccgaactcgcccggaccgcggccgaactccaggccacggccgcgacctaccggacctga

SEQ ID NO: 47 - DNA, 591 bp, Actinoplanes utahensis
atgtcggtttggaccgatcagtccgctaatctggggactatggcacgtacgccggttccgggcacccgcgacacgattctgaccgcggccgccgggctgttctaccggtacggcgtccgcgcggtcggcatggcccaggtcgtcgaggtcgccggctgcggcaagaacctgctgtaccggcattttcccagcaaggcgcagctggccgcggcctatctgcgactgtcccgccgggagcgcgagcaggccgccgccgaggcgctccgctgggcgcacggcccggccggacagctgatcgccctggtcgccgagatcgccgagtcgacccgccggccgggctggcggggctgcgccttccgcaattatctgaccgagttcccgggcgccaccgacgagccggcccagctggcccgcgcctacctcgccgacagccgcgccgtggtcgaccgcctggtcaccgagctgggcggtgacgccctgctggccgaccgcatctggctgatcgtcgacgccctgcactccagccccccggaccaggcccgggtcgccgtcgactgggtcaccgaactgatccgcgacaccaccgcctga

SEQ ID NO: 48 - DNA, 498 bp, Actinoplanes utahensis
gtgctcggcggcctgctgcgaccgcggtccggcgaggtgcgcgtcggcggccgggccgtcctcgtcagcgatgagaccggacatgtgttcgcttccgacgtacgggaaaatctgcgtctcgccgcaccggccgcgagtgacggagaggttgtcgccgcgctgcggcgggtcggtctcggcccgtggctggacggtttggcggccgggctggacacctggctggggaccgggggcagcacgatgtcgggcgggcagcggcgccggctggccaccgcgcgggcgttgctggccgatccggcgctgctgatcctggatgagccgaccgaggggatcgatgaggcgggcgcccgggagctgatggcggatctgctggacgcggcgtccgggcggacggtgctggtgttcgcgcaccgcgcggagggtctcgatttggtagaccagatttacgaactgtccaatggacggctgaatgtcggtttggaccgatcagtccgctaa

SEQ ID NO: 49 - DNA, 3903 bp, Actinoplanes utahensis
gtggctggtcgccgcgatcggcgtcaccttcgccgccttcccgtcctggtacgcggtcctgctctcggccctctacctgccgatggtcggcatcctgctgctgctcgcggtccgcggcgtcgcgctggaattccgcggcaagcacgactcccccgcctggcgccaccgctgcgacctgctcctggcgggttcgtcggcgggcgtcgtcctgctctggggcgcccagctcggcatcttcgtgcgcggcctggccctcggcccggacggcgcggtcaccgggcacggcctgagccgcagcctggccccgctgttctcggtgccggccggcctcggcgccctcgccgccctgctcggcacgatcctgctcggcgccaccttcctggcgctgcgcaccaccggcccggtccgccgccgcgccgtcgcgctgtcccggcacggcggcaacgccggcaccgtcctgctgctgctcgccggcctcgccaccggttcccggctcaccctggtcgccgcggtcctctgcttcatcaccggtatgctcgcccgccagggccgcgaagcgctcgccttcaccaccaccgcgctcacggtcaccggcgcgatcgtcgccgtcttcaccgcccacggcgcggtcgtgctgcgcagcaccctgtcgccgctgtggtcgctcacccgcgaatccgccgccgccggcccgtcggcgctgcgactgatcaccgtcgccggcgtgctcatcctgcccggcgtcgtcgcctaccaggcgtggtcctactgggtgttccgccgccgcatcgccagcgagcggatcccgtcatgaccgcggcccgctcctcggtcgcggtcgctgccggttccggccgctccaccccgattgacggtacgtcgtcagcaccgtccgcctcgccccacccgcccaccgcgggccgcccgccgcggggcccgatcgacccgaggctgctgcgccacgcccgcaccgcgcgcgccggcatcgccctgcagtccctgatcggcatcggtcaggccgccgcgacgctggccatcgccgtggccctcacccggctcatcgccccgtcccggccacactcgctgctgttcggcggctcccgcggcaccgccgtcgccctgctcgccgccgccttcaccacccgtgccctgctcgcctgggccgaacaggtcaccgcccgccgcaccgccgccaaggtcaccgacgagctccgccgccgcctgctcggcaccgtcgtgcggcgcggcccggcctgggtcgcctcgttcggcgccggtcgcctcaccaccatcctgggcaccgggctcgactccctgcgcccctggttcgccggctacctgccgtccctgatcctcggcgtgacgctgcccccggtcgtgctcaccgtgatgttcctggccgacccggcctccgcggtgatcgccctgctcaccctcccgctggtcccgatcctcggcgccctgatcggctgggccacccaggcccgcgccgagcagcgctgggccgccgacgcccggctggccggccacttcctcgacgtcgtccagggtctcggcaccctccgcatgtacggccgggccgaccgccagaccaccgtcatcgccgacctcaccgaccggcaccgccgcgccaccctgcgggtcctgcgggtcgcgttcctctcctccaccgccctggacctggtcggcaccctctcggtcggcctgatcgccgtccaggccggcatccgggtcgccggcggctccatgccactggccccggccctgctcgccatcctgctggcccccgaggcctaccgcccgctgcgggagatggccgcccgctaccacgccgccaccgacgccaccgcggtcatcaccgacgtcaccgacatcctcaccccacccgcggcgccgctcgccgcatctcgcaccggctctctgccggacaccgccctcagccaggaatggctggccctgacccaccgcatccgctcctgccccgttccctcgccctctccgctcagcgatctcgccgccccgccacccgcgttccctgccgccaccgcgggcctttcacccgcgctcccggccgctgccaccccgacacccgcactccccgccgccaccgcgggccttccacccgcgctcccggccgctgccaccccgacacccgcactccccgccgccaccgcacccggaccgtcggccgcggcgaccccgcggtggggtgtgctcgcgtccggcgtgcgagcctcctatcccggctcccgcggcgaagcgctctccctgcccgaactggccgtccaggccggcgagttcgtcgccctccgcggcccgtccggcgccggcaagagcaccctcctgcgggtcctggccggcctgcaccccgccgacaggggcgccctcgcggtgggccgcaccttccacctgtcccagcgcccggccctgccgcacgcccggacgatcggcgaggcgttcccggccggagccaccgacgacgagatccgctccgccctgcacctggtaggcctggacaccgaggtcactccgcagaccccgctcggcgagcacggccgcggcatctccgccggtcaacgtcagcgcctggccctggccgccctcctgcaccgggccacccacctgcgccgcggcgaacccgccgcgagccggcaccccggcccggtggtcaccctgctgctcgacgaacccaccgcccacctcgaccccgccgccgaacgcctggtcatcacccacctccaggacttcgcccgacgaggctgcgccgtcctggtggtcgcccaccgccccgccctcctcgccgccgcggaccgcatcgtcgacctgaccgccccgcccggcatcacgacgaccccggccgacagccccgcctgcgacgctcccggggaagcctctcgagagcaccccgcgtccgcaccccggcctgccgagatcgccgcggagggcagttggtggcggcggccctgggtcgcggtcgcgctgggtgcggccgcggtcctcggcgggctgaccctgaccggctccgccgcctggctgctggtgcgggccgccaccctgcctccggtgctgaccctgtccgcggcggtggtcctggtccgcggcagcgcggtggcccgccccctgctccgctacctggagcgtctggtcgcccatgacgtggcgttcgcccggctgggtcggcggcgggccgcggtctacgccgagctgatcccccgggtccccggccctcggttgcaccgccgcggtgatctcctcacccgcctggtcgacgacgtggacgcccgggtcgacggtctgctccgcggctggttcccgatcctcaccgccgcggtgacggtggcggtcgccggggccgccgcgctcaccatcgccatgtcgggggatgccgccgccaccatcgcggtgtccggcgacgccgcatcgaccggcctcgcggcgcgggcggccggggtggcgcccgccgtgctcgccacccggatcgccggcgtgctcgccctcggcatcgtgatcaccggcgtggtggccccgttgctcgcctggtggcaggcggaccgccaggaggccgcgaccggctccgctcgggccgccctgcgggacgcgatggtcgagacggtcgacggcgtcgaggaactcggcaccggcgccgcccgttccggcgtgccggagaaccgtagccgcaccctggccgtactggaggcccgggcggcccgcaccgccggcctggccgccgccgtcgcccacctggggtgggcggtcgccgccgccggaacggccatcgtcctgggccgggccggcctttccgcggagtggtccgcggtcctgctgctgggcgtcatcgccctgggcgagccgctggtcgccctgccggaagccgccatcgcccgccgccacgccactagctag

SEQ ID NO: 50 - DNA, 1404 bp, Actinoplanes utahensis
atggacgtgctcgacctgacccggctgcagttcgcggtggtgacgatctaccactacctgttcgtgccgctgtcgatctgcctgtcggcgaccgcggcgggactgcacctgacctggctgcggacgcggaccgagaagtaccggaacctgacgaagttcgtcggcaagctcctgatcgtcaccttcgcggtgggggtggtcaccggactcgtgcaggagttccagttcgggctcggctggagcgcgttcgccaagttctacggtgacgtcttcgggccgaccctggcggtcgaggggatgctcgcgttcttcctggaggcgacgttcctggccctgtggtatttcggatgggaacggctcccccggcggatccacgccgccacgatcgtggtcgtcgcgatcgggacgctgctctcggcgtacatcatcctcgccggtaattccttcatgcagaacccggtggcctacgccctcgacccggtcaccggacgagcccgcctgaccagcttcaccgggctgctcaccaacgaggtggtgctagccgccttcccgcacacgatggccggcgcggcgatggccggcggcggactgctgctcgccctcggggtgtggcgcctcgccgttcatgacgaattccggacactggcccggctcggcgcctggctgatgctgaccggcggagcgctgaccgcgatcaccggtgaccggctgggcaaggtgatgacgtcggtgcagccgatgaagatggcggccgccgaggcgctctactcgaccaccaccggggcgccgttctcggtcttcgcgctgggcagactcggccacgagaagccgttcctgacggtggagatcccgcggctgctctccttcctgggcaccggatcgttcgacggcaccgtgcagggcatcgacgatctccaggcgcagtacgcggcgcagtacggaccgggcagctacataccgatgatcccggtggcgttctggacgttccgcctgatgatcggcgccggggtggccgggatggcgctcgcggcgtactacctctgggcctcgtcggcgcggaccggccggctgctgcccgggttcctgcgcttcgccgacgacgaggtcccggggtgggtgaagcggatcctgctgctgtcgccgctgctgcccgccgcggccaacacgttcggctgggtgttcaccgagacggcccggcagccgtggctcgccttcggcatctccaaggtcgccgacggcatctcccccggcctgaccagcgccgaggtgatcgcctccctggccggcttcacgctgatctacggcctgctggcgatcgcctggtaccggctcgtgctccacatcgcggcgaaacccatgactccggaagtctcggtcaccgagaacaaagccctggcgtactag

SEQ ID NO: 51 - DNA, 351 bp, Actinoplanes utahensis
atggcacttggcgatcttgaacgtgaggtcatgacccagctctgggacgcttccgagccgctcaccgtgcgacaggtgcacgagcggctcagcgccgaccgcgatctggcgtacacgaccgtgatgaccgtcctcgaccggctcgccaagaaggagctcgtcgtccagcagcgggccgaccgggcgtaccggtacgcgccggcgcagacccgcgaggagatgaccgccggcctgatgctcgacgcgctcagtgccactcccgatcgggacgccgcgctggcatacttcctgggccagctgccgcccggcgccatccaggccgccctgaacgcgacaccgaaagagacgtga

SEQ ID NO: 52 - DNA, 918 bp, Actinoplanes utahensis
gtgaccgcactcctgctcggtgccctcgggttgaccctgtcactggtcgtcccgggcatcctggccggcgcccgatggcccgaccgcgccccggtcgccgccgtcctgctctggcaggccctcacgctgaccgcggtgctctgcgcgctcggcgtggtgctggccgcccccgaggagctgacccgggcggccggcgccggccacccgtgggcggtcgccgcgctggtgttctccctggcggtcgccgccaccatcgtcacccggctgttgatctcactgatccgggtcaccgcccgggcccgggcccgccgcgaacgccaccgcacgctggccgacctgctcgaccgggtggaacggcaccgcgaactgggcggtcccgaggtgcgggtgctcgacgcgccgttgccactggcctactgcgtgcccgggcgcgagccccgggtggtgctcagcgacgcggtgctgcgggtcctcgaccgtgcccaggtcgacgcggtgctcgcccacgagcaggcgcacctgcggcaccggcacgagctggtgatggagtcgttcaccgcgttctaccaggcggtgccggctccgctgcgctcccgggcgccgcttgacgccgtacacctgctgttggagatggtgtcggacgacgccgcgcggcgccggacaggcgcggcgcccctgcgtgccgcgctgtcccggctctccgacgcggttcccctcgcggaggaggccccggccgacccggcgggtgaatcccggcgccgccgcctcgaccggctggccggtcccgaggtcacctcgcggggcctgtcggtgctcgccgggctcgccgcggccagcctgatcgtgctacccacggtgatcctgatcgtgccctggctcggtcaggccctggatgcctggccattccggtcactgtga

SEQ ID NO: 53 - DNA, 1074 bp, Actinoplanes utahensis
gtggggtgtagccgttcgcggccgggcgttcttcccgcccgaacccgtcagctaacccggtcggcggctgaatggaagaaaggacaacgcacctacgtgaaacggataggcgcgcgtggcgtgctgcgcagtctgctctgcgccgccgtcgctgccggactcgttctcaccggacctgtcgttgcccacgccacgccctcgccgtccagcgtcgaggaccagatcgacaagcagtggaacgagctcgagcccgtcatcgaggacttcaacgacgtgcacgggaagctgatcaaactgcagaagcagcagaagcagctgaacgcgacgctcgacccgctgcagaagaaagtggacgtggccatgaaagacgtccgtggcctcgcctcggacgcctacatgcaaggcccgccgaccgctgtcgccgcgattctcagcggttcgccgaccagcctgaccgagaagctctcgctgctcgaacagctcgccgcgaaccgtcaggactcgatcagcgaggtggtgaaactccgcgacaagtacgccgccgacaaggcgaaggtggatgccctggcatccgagatctccgcccgcgacgccgatctgaaccagaagaagacggcgatcgagaaagagatcacctccctgcagaaactgcgcctgcaggcgtacgggaaaacggatgacgggccgttcaagacgggtccctgcccggtcgactacaccaacgacatcggtggccgggccgctcagaaggcgtgcgacctgatcggcaaaccctacgtattcggttccgagggcccgaacagctacgactgctcgggactgacgaaagcggcgtgggcgtcggtcggcgtgcacctggagcactacaccaaggatcagtggaccgagggccgcgcggtttcgcgaagcgaactgaaaccgggtgacctggtcttctactattccgacgtgcaccacgtgtcgatctacatcggcggtggaatggtcgtgcacgcaccgcacacgggcgaccacgtgcggatggcgacgatcgatcgcggtccgatcgccggctatcggcggccctcgggctga

SEQ ID NO: 54 - DNA, 1209 bp, Actinoplanes utahensis
atgagcgacgcgctgatcgacagcctgaccgccgcggtccaggcccgccccgacgacctgccgctgcggctgcacctggccgagttgctggtgacggccggccggggcgccgaggcgatcgagcacgccgctcaggtcctcagccgtgatccggccaacgagacggcccgcggcttgatgacgtccgcgctcggcgggccggccccggctgccgccccggcctccggggtcgactggggcgcgatggagcagcagttcggcgatgtcgtcccgccccggttcgcccgggccggcgacgagcccgagccggtcaccggcgatgccgaccgggcgttcgacgtcgagcggtccaccgtgaccctggccgacgtgggcggcatggccgaggtgaagaagcggctcgaagtgtccttcctcggcccgctgcgcaacccgaaactccgcagcctgttcggcaagagcctgcgcggcggtctgctgctctacggtccgcccggctgcggcaagacattcctggcgcgggcggtggccggggagatgggcgcggcgttcctctcgctgtcgatcaccgacgtgctgaacatgtggatcggcagttcggagcggaacctgcacgacctgttcgagtcggcccgcgggcacgccccctgcgtgctgttcctcgacgagatcgacgcgctggggcacaagcgcagccagttgcactcctcggcgatgcgtaccgtggtcaaccagttgctcaccgagctggacggcgtgcagggcggcaacgagggcgtcttcgtgctggccgccaccaacgcgccgtgggacgtcgacgcggccctgcgccggccgggccggctcgaccggaccgtgctggtgctgccgccggacggtgcggcccgggccgcgatcgtcgagtaccacctgcgggaccggccggtcgccggggtggatctggcggcggtggccgcggccaccgagcacttctccggcgccgacctggcgcacctgtgtgagacggccgccgagtacgcgatgcgcgactcgatcgcgaccggcgagatccgcatgatcaaccagggggacatgctggccgcggcccgcgaggtgcgcccgtcgacggacgcgtggttcaccacggcgcgcaacgtcgcgatgttcgccaacgagagcggcgagtacgacgacctggccgcctacctgaggaaacggaagggccgctga

SEQ ID NO: 55 - DNA, 792 bp, Actinoplanes utahensis
gtgagcgtcgccgccccaccccgtgccgcccgctcccagtggatctccgcgctccgcgagctcggtctggtcgccgtgctgttcacgatctacaagatcggccggatcgccgccaccggccacgtcgtcgaggcctacgacaacgcgcgccgcgtctgggacctggaacgctggatgcacctgcccggcgagctcagccttcagcaccggttgctctcctggcactggctcgtcgaaacggcgaactgctattacgcgtacgtccatttccccgccaccgtggcctgcctgatctggttgtacgtgcgccgccccgcccactaccgctggacccgcaacgtgctcgccctgctcaccggcgcggcgctggtggtgcacttcggcttcccgctcgccccgccacggatgctgaccgccaccggcatgctcgatctgggccgcatctacggcccggcggtgtacggggcgccggaacacgaccagctctccaaccagtacgcggcgatgccctccctgcacgtcggctgggccgtcgtggtggccgtcgccctgatcgccgccaccggcagccgctggcgcggcctgtggctgctgcacccgatgatcacgctgctggtcgtcgtcggcaccggcaaccactactggctcgacgcggtcgccgcactcgccctgctcgccgcggcgtacctgttggtgcgaccccaattttccgcaaccttgaaaccgccggcgctcccggcgatggtccccctgccgcgcctcccgctcgaggagccggcgctgcgccgctag

SEQ ID NO: 56 - DNA, 534 bp, Actinoplanes utahensis
atgcgagactgcggcgcgttggatcaccggtggcgggtgaaatgccccagaatgcccggcgtgaccgtggaggaaatggcggagcatgtccggctggtggccgggctcggcgcgggtggccagattgtctacgagtcggtgctgacccgcccgctcgacgatgacctgcgcatggtgctcggcacccccgccttcgtggaggggctggcggccggcgaccagattcggatccgggccggtggcgggttcgaggtggtgcggcacggcggcaacctctgcctgctggtggtgccggaatcgccgcccgccggggatgatctcgggccgctccgggatgccttcgacgagttgggcgggatcgtggagctgccgccggaccggcggttcatcgtgatcaccgtgccggccgcggccgggttcgatgcggtggaggcggcgatcaacgcctggaccggcccgcgcggcgatcactgggagtacggcaacgtctacgacgtcgacggcaatccgctgaactggtgggaaagcgcctaa

SEQ ID NO: 57 - DNA, 393 bp, Actinoplanes utahensis
atgtcgcttgaggtttcgacggagctgctggagagggccgagcggggcgaggtgaccgatgcggagtttgtggcttgcgtgcgggggtcgctgccgtatgcgtgggaagtggtcagctcggtgatgaccgatctgcaggcgaatggggagcaattcgcggatcacgaggtgccgccgccgtcggagagtgagcgggggcagctgcttcgagcgctggccagcgatgcgatccgcggtgggttggagcggcatttcggggcgaagctggcgttccagaattgccatcgggtggcggcgttcgcgttctcggcggtgggcggggagcggtaccagcggttcgtgtcgccgcgggggcagctgctgaatcagtcccccgagctgcgcaactgctga

SEQ ID NO: 58 - DNA, 618 bp, Actinoplanes utahensis
atgattttggactggccgcattgcgagaacgcccgcgacctaggcggtactcccaccatgaccggcggccagatccgccccggtgccctgatccgctcggacagccacagccgcctcactccggccgctgccgaagccgtccgctcccagccgatcgcccggatcctcgacctgcgctggtcccgcgagctggccgccgaccccagcccgttcttcgcggacccgttctaccgccacgtcccactgctgaacgacccgatgggttacgacccgccgctggacacctacgccccgatgctggaccacaacaccacccggatcgcgcgagcgttccacgagatcgccaccgcccctcccggcaccgtggtcatccattgccgcggcggccgcgaccgcaccggcgccctgaccgccctcctcctggccgtagccgaagtctccccggccgagatagccgccgatttcgcccgcaccccaggcacttcccccgaggcgatgcacaacacgctgacccacgccaccacccgctacggcggcgtccccaactacctgacccactgcggcgtagcccccaccgcactggccgccatccgccaccgcctgaccatcaccgcctaa

SEQ ID NO: 59 - DNA, 804 bp, Actinoplanes utahensis
gtgcctcacccgacgacctgcgagccgaggtcgccgcctaccgcgccgccctcgaccaggtcgaccaggagatgcccgttgcccgcgcgcacgccgaaatatcaggtgatcgccgatgacctgactaccaagatcaaggacggcgagttgccggccgggtccgcgctgcccccgcagaaggagctcagcgcgcggtacggggtgactctggcaacgctgcggcaggccctgaagcagttggaggacgaagggctgctgtcgcaggagccgggccgggggacgttcgtgtacccgcggatcaaataccagctcacgtcgttgcacgggttcgccgaggatctgcgcgaccaggggcagacggtgaccacggagatcctcgaccagtccatcggcacgccccccgactgggccgcgctgatcggtcaggacgaggcgctgcggctggaacgggtccggctggtcggcggccgcccggcggtgcatcagttgtcgtgggtgcgcggcaccgagttggtgtccgctgatctcagcgatctgtcgctgtacgcggcgttgatcgccaagggtcgcctggtccaccgcgctactgaggtggtccgtcccggcctgctcgccgagcccgctgccggcctgctccgccggccgcccggggagccggttctggtctccgagcgggtgacctacgcgctcgacgggtccgcgctggtggtcgaccgcgccaccatgctcggctcggcgatggagatccggaccgaacgcgcggccaccggcctctccgtgcagtggagccgcccctccgcctga

SEQ ID NO: 60 - DNA, 1215 bp, Actinoplanes utahensis
atgtcagcgccgacgcagatgctggagacagcacacatcgagacagcaaggcctcacccggccgcggcgatggaggcaccgacggccaccggccgcttcggcgagttcggcgggcgttatgtgcccgagtcactggtcccggcctgcgccgcgctggcagcggcgtttcgcgaggcctgggccgacccgtcattccacgagcggctcgcccggctccgctcggaatatgcggggcgccccacagccctcacccccgccgccaacctctccgccgagctcggcgtgaccctgctgctcaagcgggaggacctggctcacaccggctcccacaaaatcaacaacgtgctcggccaggcagtgctggcgcagcggatgggcaagacccggctgatcgccgagaccggcgccggccagcacggcgtcgccacggccaccgccgccgccctgttcggcatgcgcgccaccgtctacatgggtgagcgtgacatcgaccgtcagcggctcaacgtcttccggatggagctgctcggcgccgaggtgatcccggtgaccagcggcagccgcacgctgaaggacgcgacgaacgaggcgatgcgcgcctgggtcgccgcagtcgacgaggcacatttctgcctcggatcggtggccggcccgcatccctatccgtggctggtccgcgagctgcagcgggtgatcggcgaggaggcccgggcgcagacccccgtcgttcccgacgtggtcgtggcctgcgtgggcggcgggtccaacgcggccggcaccttcgccgggttcgtggacactccggcgcggctggtcggggtggaggcggccggtggcgccgcgatgaccaacgggacacccggcgtggtgcacggctaccgctccttgatcctgcaggatccggccggccaggtgctcgaggcggaatcgatcgcggccgggctggactatcccggtgtcggaccggagcacgcgcatctggggacgaccggccgggcggaataccgcacggtcaccgacgacgaggtgctcgccgcggtccggcggctggcccgcagcgaggggatcatctgcgcgctggagtcggcgcatgccgtggcctgggtgctgcgcgcggccggcacgcccgatctgcctgccgggtcgacggtgctgctcaccctctccggccggggagacaaggacatggcgacgctggccggtgaggtccgatga

SEQ ID NO: 61 - DNA, 1176 bp, Actinoplanes utahensis
gtgtccgtgtggaagtcgaggccggcactgcgctggctgctaccgggggccaccgcggtcgtcgtcatcgggggcggcgcggcagccggcacgatcgtggcgaatgccggcccctcgctgccggaccgcagcgcggcccagttgctggtggatctgcagggcgccaacccggccggtctctccggcaccgtggtcgagagcaccgatctgggtctgcccggcgtcgccgggctggccagcaagttcggcgcctcggccggcggcaccggtggcctgaccagtctgatcgccggcagcaacaccgcccgcgtgtggtacgcgggtgaggacaaggtgcggttcgccctgctcgggacgcagggtgagaccgacgtgatccgtaacgggtcggacgtctggcagtggagcagctcggacaacacgggcaagcacctgaagctgccgaaggacgccggcaaggggtcgccgcggtcgctgcccagcgcactgccgtcgaccccgcagcaggcggcggacgcggctctcgccgcgatcgacccgtcgaccaaggtcgagaccaccggcgcggccaaggtggccgggcgggacgcgtacgagctggtgctgagcccgcgagacaccgagtcgctggtggggcaggtgcggctggcgatcgacgccgagcagcacgtcccgctgcgggtcgaggtgtatgccaagggtgcggcgaagccggctgtccgggtcgctttcgactccatcagcttcagcgtgccggacgcggagcagttcaccttcaacccgccgccgaacgcgaagatcgacgaggccggaaccccgtcggacgccgccaaggccggcgcggccaagggtgacgcggccaagaagggtctcccgcacccggtcccctccgtctcgtcgcagaaggacgggccgaaggtgatcggcaagggctggacctcgatcgtctcggccaagctgcccgggggcacgctgtccgagctgacgaaggccggcaagggcaccggtgaggacgcccagcaggcgcaggcactgctgagtgtgctgccggaggtgagcggctcgtggggcaagggccggctgctgagcggctcgctgttcagtgtgctggtcaccgatgacggccgggtgctggccgggctggtgacgccggaggcgctgtacaaggtggcctga

SEQ ID NO: 62 - DNA, 678 bp, Actinoplanes utahensis
gtgcggttgctggtggtggaggacgaggaacggctggctgctgcgctgcgtcgtggcttgcaggccgaggggttcgcggtcgatgtggcccacgacgggcaggacgggctggagatggcccgccacggcggatatgacgcgatgattctcgatgtcatgctgccgcggctctccgggtatcgcgtcgtgcgacagttgcgggccgagcggcactggttgccggtgctgatgctctccgcgaaagacggtgagtatgaccaggccgatggtctggattgcggcgccgacgactatctgaccaagcctttttcgtacgtcgtcctcctcgcccggctgcgcgcgttgctgcgccgtggcacgcaggctcggcccgtggttctgacctgtggtgatgtcgagctggatccggcggagaagcgggtgctggtcaccggcaccgaggtcaccctgaccacccgcgagttcgccctgctggagtatctgatccgtcgtccgggcgaggtcgtctcgaagaccgaactgcttgatcatgtctgggatgccgctctggagaccgcgcccaacgctgtggaggtctacatcggctacctgcgtcgcaagatcggccgggaccgtctggaaacggtccgcggttccggctaccgcctcgtcgccgcgtccggcgccctcaccgagtag

SEQ ID NO: 63 - DNA, 1404 bp, Actinoplanes utahensis
atgcggcggcggcttcgggagctgagtctgcgggctcggctgttgctgatctcggtggcggcgctggggttcgggctggcggccggcggggtggtgctggtgacagtgctgaccttcgcgcaggggcgggcggtgcactcgcaggcgatggacacggcgcgaggggtggcgagcctggtcgatcaggggcagctgcccagtcggatcgaggtttcgccggagacgaaagttcaggtcatcgacgaatcggggcgggtgcggtcggtgtcggccacggctgaccggctggtgcccttcctgtacgaggatgagctgcgggatctgcccgacggggagggacggtcgatccccggggagcggatcgggttcgagggcgaggcccgggtggtcaaactgaccgcgggtccggccacccagccgctgcgaatcctggtggcgcggtcgaccagcgagctgacgcagagcgtgcatctgctgcgggtcacgctgctggtggcgttcccgctgctggtggccttgctggcggccgggctgtggcgggcgctcggggcggcgctgcggccggtggacgcgctgcgcgccggagctgaagagatcaccggggggacccgggccggacggctgccggtgccggactcgcacgacgaggtcgggcggctggcgatcacgctcaacgacatgctgcatcggctggacacggcgcgggcgcggcagcgggcgttcgtggcggacgcggcgcacgagttgcgcagcccgctcaccaacatgcgaaccgagctggaggtggcgcagcggctgccggacgacaccgactgggcggccttcaccgacgatctgctcgtcgatgtgcaacgactgtcccggctggtggacgacctgctgttgctggcgcgggccgatgacggggtggggcgggcggcggtcgctcgccggctcgaggaggtcgacctcgggcagttggtcgatgaggtggcgtcgcggtatccgggtgtggaggtcgtggcgtccgacgagccgctgccgatggtggccgagccggacgggctggcccgggtggtggcgaatctgatcgacaacgcctgccggcacaaacgggaccgggtgacggtgcgtacggcagcgtccgggacggacctgctggtcgtggtcaccgacgacgggccggggattccggcggaagaccgggaacgggtgttccaccggttcacccggctcgacgatgcacgggcgcgggatgccggcgggtccgggctggggttggcgatcgtccgggaactggtgcgcaggcacggcggttcggtgacgctcggcgacgctgagccgggactgcgggtcgaggttcgcctaccggccgacaaacagcagacgcccgtatccgcttcaaccccggcgagcccgaagtga

SEQ ID NO: 64 - DNA, 738 bp, Actinoplanes utahensis
atgtcgctgctcaagcgttccgcagtggtggccgccgcggccggattgctgaccctggcgctggccggaccggccgccgcgcatgtgacggtcaacccgaacacggcgaccgcgggcggatacacgaaggtcgccttccgcgtgccgaacgagtcggacagcgcgtcgaccaccaagctcgaggtgaacctgccggccgaccagccgatcgcctcggtgtcggtgaagccgctgccgggatggacggcgaccgcggtgaagacgaagctggccacgccgatcaaatcgcacgacaccgagatcaccgaggcggtttccaagatcacctggacggcggccaaggggtcggagatccagccggggcagttccaggagttcgacgtgtcgatgggggcgttgccgcaatcggggcagctggtgttcaaggcgctgcagacgtactccgacggcaccgtggtccgctggatcgacgagcccaccgcggacgggtccgagccggacagcccggcgccggtgctcaagatcgtgccggctgccgccgcgagcgcctcgccggccgccgctgccgccgccgccccggcgaaagccgacgactccggcgattcgggcagcggtacgggctggggtcttgccggactcgtcgccgggttggtggcgctggtgctggccggactcgcgtacgcgaaagcaagccgtaagccggagaccgccggaaccggcaaggccgccgcaagctga

SEQ ID NO: 65 - DNA, 744 bp, Actinoplanes utahensis
atgacggtccgcatctggcagggcatggcgggcaagtcccgtctttggcacgggctgctggcgttcatcgtcctggcgtcgctgatcacgcagatcgtcctgacggcgacggattcagcgccgcatgccgggcccgcggtgcacgagaccgtggtgacaagattcgtccggctttttagctacttcacgattcagagcaacctgctggtgctgatcgcgaccctggccctgctgcgggatccgaaccgggatgggcgggtctggcgggtcatccggctcgacgcgctgctcggcatcgtgatcaccggaatcgtgtacagcacgatcctggccgggcaggtggcgctgcacggggccgcctacctggccaatctgggtttccactacatcgccccgtgggcggccctgctcggttggctgctcttcggcccgcggccgcggatcgacgcgcggaccatggcctgggcggcgctctggccgacgctgtggatcgggtacacactggcgcacggcgccgccaccgactggtatccgtatccgttcgccgatgtgaacagcctcggttatcccagggtgctggccaacctggcagctgtcgtgctcgttgccgcggtgctggccgccctgctgcgtctgctcgatacgcgtctcccgtacagggtggcggctgctcctgaggcggcggctcctgtcctgccgcttccccgttccggcacggagcccgtcgctcaccgcgataggtga

SEQ ID NO: 66 - DNA, 459 bp, Actinoplanes utahensis
atgtcacgagcgcatctcgaacgacaaactcggccggaggtggacgggcggcggcatcctggccggatgaccacccgcctcctgcagattctgctgggggtacacctgttcggcgccctgccgtcactgttgtgtgcggtgctccgcaccggcgactacgtggcgttgttcgcaccgagcctggcacggctcggagacccgaaggactcgatccccttcccctcggtcgaggcggcgccgtggtggtgcccgctgtacgcgtggttcgtcacggcccacttcctcgtgggattcctcctcttcttcccgctgcctctggtcggctggtcagtcgcgatgtcggcgagagaccgtggcccgtcggtgcacgcgagagcctgggtctgggcgtggggggccgtgaccgtgctgacgttctccccgtggggcttcgccctgcactattggatggcggactga

SEQ ID NO: 67 - DNA, 1596 bp, Actinoplanes utahensis
atgggctgcatcgaagcccatcgctctggctccgattccgcacctcgtcgaatccccgcaccggacggcggcccgcccgccctccggcgatgcccggcggccggagtcggagctgacaaggagatcaccgtggcaaacgaatccccccgccggcgatccctgccggtccgggccctgctcgccggcaccgtcgccgccgtcggcgcgttcaccgccctgatggtgacgccggatgccaacgccgccgccggcaccctgggtgccgccgccgcccagtccggccgctatttcggcaccgcgatcgccgcgggccggctcggcgatgccacctacaccacgatcgccgggcgtgagttcaccatggtcacgccggagaacgagatgaagccggacgccaccgaaccgcagcgcggccagttcactttcagctccggggaccagatctacaactgggccacccagcgcggcatgaaggtccgcggtcacacgctggcctggcattcgcagcagccgggctggatgcagagcctcaacggcagcggcctgcgccaggccatgatcgaccacatcaacggcgtgatggcccactacaagggcaaactcgcctactgggacgtggtcaacgaggcgtacaacgaggatggcagccgtcggcagtcgaatctgcagggcaccggcaacgactggatcgaggtggcgttccgcacggcgcgggccgccgacccgtcggtcaagctctgctacaacgattacaacatcgagaattggtcgtacgcgaagacccagggcgtctacaacatgatccgggacttcaagtcgcgcggcgtcccgatcgactgcgtcggcctgcagacccacttcaccgggggcagctcgctgccgggcaacttcccgaccacgctgtcgagcttcgcggcgctgggtgtcgacgtcgcgctgaccgaggtcgacgtcaccaacgcatccacctcgcagtacgccgggctcactcaggcctgcgtcaacgtgccccgctgtgtcggcatcacggtgtggggcgtgcgggacagcgattcgtggcggtccagcgagagccccctgctgttcgacggtggcggcaccaagaaggcggcgtacacctcggtgctcaacgccctgaacgcggccggtccggtcacctcgtcgccgaccccgggcggcggctccggttcgccgtcatcgtcgccgtccaccccgccggccggcaccgggcggatcgtcggcgcccagtccggccggtgcatcgacgtgccgaacgcgtcgcagaacaacggcacccgggtgcagctctacgactgcaacggccagaccaaccaggcgtggacgctcacctccggcaagcagctgaccgtgtacggcaaccgctgcctggacgccgcggggtcgggcaacggcgcggccgtgcagatctacagctgcaacgggcaggccaaccagcagtggaacgtcaacgccaacgggaccatcaccggcgtgcagtcggggcgctgcctcgacgtctggggcaccggtaacggccagcaggtgcagatctacgactgcagtgggcaggccaaccagcggttcaccctgagctga

SEQ ID NO: 68 - DNA, 672 bp, Actinoplanes utahensis
atggccgacaccgcgatcttcgacgtcgacggcaccctcgtcgacaccaactaccagcacgccctggcctggtaccggtccttccggcgctacgaaatcaccctgccgatctggcgcatccaccgcgccatcggcatgggtggcgatcaactcgtcaaggcggtggccggcgacgacgtcgagcggcgccacggcgacgcgctccgcgaggtctggagcgaggagttcgaccggctgatcgacgaggtccggccgttcgagggagcccgcgagctgatcgaggaggtcaagtcccgcgggttccgcctcgtgctcgccagctccggtaagaagcagcacgtcgaacacttcctcgacctggtcggcggccgcccgttcgcggacgcctggaccactgccgacgacgtggagaacagcaaacccgagccggatctggtggcaaccgcactgcaccgggtcgacggcgtgtccggcgtgatgatcggcgactccacctgggactgcgtcgcggcccgcaaactcgaggtgccgaccatcgccgtgcgcaccggcggattctcggttcaagagcttcacgacgcgggcgccgtacgcgtcttcgactccctggtcgacctgcgggagagcctcgacgacacgccgctcggctcccccgccccggccgacccctga

SEQ ID NO: 69 - DNA, 303 bp, Actinoplanes utahensis
gtgagcacctcgatcagcgcctggcgcaccgggctgaccgcgaacctcaccatcaccgacaccgggagcgccgccgtcgacgggtgggcgctgggcttcacgctggccgccggccagaccatcagctccgggtggaacgcgacctactcgccggccagcgggtcggtgaccgcacggaacgccggttaccacgccgcgatcccggtcaacgggtcggtcaccatcggtttccaggccgggcacaccgggaacaccgcggcgcccaccgggttcaccctcaacggcaacgcctgcggggagtga

SEQ ID NO: 70 - DNA, 1359 bp, Actinoplanes utahensis
atgtccctgctccgcagaacccgctccctgctgctggcctcggccgccgcgggagtcgtcgtggccgcgagcgtcgcggtgatcggcaccgccgaggcggcgaccacgctcggcgcctcggccgcgcagaccggccggtacttcggcgccgcgatcgctgccggccggctcggcgacaccacctacaccgggatcctgacccgcgagttcaatgcggtcaccccggagaacgagatgaagtgggacgccaccgaaccgtcccagggccggttcaccttcaccaacggcgaccgcattctcaaccagggcctgaccaacgggtcccgggtccgcgggcacgccctgctctggcacaaccagcagcccggctgggcgcaggcactgtccggcagcgcgctgcgcagtgcggcgatcaaccacgtcacccaggtcgccacgcactacaaaggcaagatctacgcctgggacgtggtgaacgaggcgttcgccgacggcggcagcggggcccgccgcgactccaacctgcagcgcaccggcaacgactggatcgaggccgccttccgggccgcgcgggccgccgacccgggcgcgaagctctgctacaacgactacaacaccgacgggatcaacgcgaagtcgaccggcgtctacaccatggtccgcgacttcaagtcccgcggcgtgccgatcgactgcgtcggcttccagtcgcacctgggcaccgggatccccggcgactaccaggcgaacctgcagcgcttcgccgacctgggcgtcgacgtccagatcaccgagctggacgtggcgcagggcggcaaccaggcgaacgtctacgcgagcgtgaccagggcctgcatggcggtgtcgcggtgcgccggcatcaccgtctggggcatccgggacaccgactcgtggcgcagcggcgagaacccgctgctgttcgacggctccgggaacaagaaggcggcatacacctcggtgctgaacgccctcaacgccggcgggaccaccacctcgccgtccgcaccgtcgcccagcaccagcgtcagcactccgccgcagccgtccggggcctgcagcgcgtcggtgtcgctcaactcgtggaacggcggcttcgtcgcgaccatcagggtcaccgccgggtccgccccgatcaccggctggaacgtcggcgtcgccctgcccgccggcagcgccgtgaccagcacctggagtgccaccgccggcggcagcaccggcacggtcagcttccgcaacgccagctacaacgggcagctggccgccggtggcaccaccgagttcggcttccagggcaccggcaccggcccgaccgcgacacccacctgcgccgccgcctga

SEQ ID NO: 71 - DNA, 1647 bp, Actinoplanes utahensis
atgccccgaagcagcctgcctggacgacgacggtggttccggacagcgatcctcgccgtcctctgcgtcgccggcgtgatcgccctgcccggctccgcggcgcaggcactcgacaacggggtggcgcgcaccccgccgatgggctggaacagctggaacaccttcggctgcaacatcagcgaatcgctgatccggcagatggccgacgcggtggtcagcagcggcatgcgcgacctcggctaccagtacgtggtggtggacgactgctggttcaacccgaaccgggactcggccggcaacctgcagggcgaccccacgcggttccccagcgggatgaaggcgctcggcgactacctgcacgccaagggcctcaagttcggcctctacgaggtgccgctggacaagacctgcgcccagtacttcaacagctatcccggggcgaccggcagccagggacacgaggcgcaggacgcgcggcagttcgccgcgtggggggtcgattacctcaagtacgactggtgctcgccgaccggcacgatcaacgaccaggtcaccacgttcgcgaagatgcgcgacgcgctggcggccaccgggcggccgatcgtctacagcatcaacccgaacagcgtgcacgccaagaccggcccgcagcgcaactggggagacgtcgccaacatgtggcgcaccaccgaggacatcagcgccgcctgggacaccgggcagaccaacggctacccgatgggcgtcaagaacatcgtggacgtcaccgtgccgctggccggatacgcccgccccgggcagttcaacgacccggacatgatggaggtcgggcgcagcgggctgaccgacaccgagcagcgcagccacttcgcgctctggacgatgctggccgcgccgctgatcgccggcaacgacctgcggtcgatgagcacggccacccagaccatcctgaagaacccgcggctgatcgcgatcgaccaggattcgctcggcctgcaggccacccaggtcagcaacgacggcacccgccgcgtactggcgaagaagttgtccaacggtgacgtcgcggtggctctctacaaccagggtggcgccaccacgaccgtgtcgacgaccgccgcggcgatcggcaagtccggcggttccctcaccctgcaggacgcctggaccggcggcacgacgaccagcaccggcgcgatcagcgcaagtgtccccgcccacggcacggtggtctaccgggtcagcggcgggggaacgggcacgccgccggccggcgcgacgctggtcagcgcctcctcgggacggtgcctcgacgtgccgaacagcgccacggccaacggtacccagccggccgtctgggactgcaacggcggcgccaaccagcagtggaccgccggcggggcgaccctgcagtcgctcggcaagtgcctggacgcgccgaccggcgccaccgccggcagcaaggtccagctgtgggactgcaacggcggcaccaaccagcagtggaccctcaacgccgacggcacgatccgcggcaccgcctccggcctgtgcctggacgtcgaccacaacctgaccgcgaacggcaccccggtcctgctctggacctgcaccgccgccgtcaaccagcgctggagccgtggctga

SEQ ID NO: 72 - DNA, 1365 bp, Actinoplanes utahensis
atgccgaaacgatcctgggcggccgcccttctgatcctggcgagcctggccgtcccgtccgccgcgcacgccgacaacccgatcgtgcagaccgtgtacaccgccgatccggcgccgatggtctacaacgggcgcgtctacctctacaccggtcacgacgaggacaactcgacgtactacacgatgaaggactggcggctgttctcgtccgccgacatggtcaactggaccgatcacggttcgccgatgagcctggccaccttcagctgggccggtgcgaacgcctgggccggtcaggtggtcccgcgtaacggcaagttctactggtacgtgccggtcaccgaccgggcgaccgggcggatggcgatcggggtcggggtggcgaacagccccaccgggccgttcaccgacgccctcgggcatccgctcgccgagaacggtgagatcgacccgacggtcttcatcgacgactccggccaggcctacctctactggggcaaccccaacctgtggtacgtgcggctcaaccccgacatgatcagctacaccggggggatccagcagatcccgctgaccacggccgggttcggcacccggaccggcagcaccaaccggccgacgttgtacgaggagggcccctgggtctacaagcgcaacggaacctactacaacgtcttcgccgcgaagtgctgctcggagttcatcggttactccaccgcgcccggaccgaccgggccgtggacctatcgcggcacggtgatgccgacccagggtggcagcttcaccaaccatccgggcgtcatcgacttcaacggcaattcgtacttcttctaccacaacggcgcgctgcccggcggcggcggatacacccgctcggtcgcggtggagaggttcagctaccacgccgacggcagcatcccgacgatcaccatgaccacgggcggggcgccgcaggtcgggacgctcaacccgtacgtccggcaggaggccgagaccatcgcctggagttccggcgtggagaccgaggcgaccagcggcggccggaacgtcggatacctcgagaacggcgactacatcaaggtgaagggcgtcgccttcggtacgggggccacctcgttctcggcccgggtcgcctcggccacctcggggggccgtctcgaactgcggctgggcagcgccaccggcgcggtggtgggcacctgcacggtgccggggaccggcggctggcagacctggaccacggtcacctgtccggtcagcggggcgaccggcaccccggacctgtatctgcggttcaccggcggcagcggctatctgttcaacgtcgactggtggcagttcgcgggggcggggagcgcgcgatga

SEQ ID NO: 73 - DNA, 2298 bp, Actinoplanes utahensis
atgaccccgttcccgatcagccgccgcggcctgctgcaggcggccggcgccggcgcggtggccgccggcctcgggccgatctcccgggccgacgctgcggcggttgcgccggcccgggccgacctcggtgtctcggccttcccgttcgacctcggacaggtgcggctgaccaccggacgattcctggacaaccagacgcgcacgctgaactacctgcgcttcgtcgacgccgaccggctgctctacaacttccgggccaaccacggcaggagcaccggcggcgccgcggccaacggcggctgggacgcgcccgacttcccgttccgcacccacgtgcagggtcacttcctgaccgcgtgggcgcaggcctgggccgcgctgggcgacaccacctgccgggaccgggcgaactacatggtcgccgagctggccaagtgtcaggcggccaacggctacctgtccggtttcccggagtccgacttcaccgccctggaggcgggcaccctcagcaacggcaacgtcccctactactgcgtgcacaagacgctcgccgggctgctcgacgtctggcggctgatcggcggcacccaggcccgcgacgtgctgctgcggctcgcgggatgggtcgacacccggaccgcgcggctgaccaccagccagatgcaggccatgctgggtaccgagttcggtggcatgaacgaggtgctggccgacatctaccagcagaccggcgacggccgctggctcgccaccgcccagcggttcgaccacgccgccgtcttcaccccgctggccgcgggcgccgaccagctcaacgggctgcacgccaacacccaggtgcccaagtgggtgggtgccgtccgggagtacaaggccaccggcaccacccgctaccgcgacatcgggctcaacgcctggaacatcaccacgggcgcgcacacctacgcgatcggcggcaacagccaggccgagcatttccgtgccccgaacgcgatcgccggctacctcaccaacgacacctgcgagcactgcaactcctacaacatgctcaagctgacccgggaactgtggctgaccgacccggaccgggcggcgtacttcgacttctacgagcgggcgctgctcaaccacctgatcggcgcgcagaacccggccgacagccatggccacatcacctacttcaccccgctacggcccggcgggcggcgcggggtgggaccggcctggggcggcggcacctggtccaccgactacgccagcttctggtgctgccagggcaccggggtcgagaccaacaccaagctgatggagtcgatctacttcttcagcgggaccaccctgacggtcaacctgttcaccccctcggtgctgtcctgggccgagcggggcatcaccgtcacgcaggccaccgcgtacccggtcagcgacaccaccacgctgaccgtgtccggcacgccgagtgggacctggagcatccgggtgcgcattccgggctggacgaccggcgccaccctcgcggtcaacggcgtggcgcagggcgtcggcgccaccccgggcggctatgccaccgtcacccgcgcctgggcggcgggcgacgtgctgaccgtccggctcccgatgcgagtgatcatgcagccggctgccgacaaccccgcggtgcaggcgatcacgtacggcccggtggtgctctgcggcaactacggcggcaccacgctgtcggcgcatccgtcgctgaacgtgtcgtccatcgcccggaccgggagcggcagcctggccttcacggctaccgcgaacggcgccaccgtgtcgctcggcccgttccccgacgcgcaggggttcgactacgccgtctactggaacaccgggtccggtggtgaagcggcctaccaggtggtgaacgtcgcgtccgggctggtgttgggcgtccaggacatgtccaccgcggacggcggccgggtgatcgtctggggcgacaccggcaccgcggaccaccggtgggtccaggtgcccgacggcggcgccgtgcggttccgcaacgtcaacagcggcaaggtcctcggcgtccagaacatggcgaccaccgacaacgcccccgtcctgcagtgggccgacaacggcaccgccgatcaccgctggacgctggtcgccaacgccgacggctcgtaccggatccgcaacgtcaacagcggccgggtgctcgccgtgtccggcggtgcgagcacctgggggagccaggtggtccagacgtccgacaccggcggcaccggcaacaactggcgtctcgtccgggtcgcctga

SEQ ID NO: 74 - DNA, 1392 bp, Actinoplanes utahensis
gtgaagagaaccagaccaatctccgcgtacgcggcggcagccggcgtcggtctgctggcctcgacggccgcggtgatgacggtgcccgcgcacgccgcggccgccgggtgctcggtcacctacgccgtgtcgtcgcagtgggacggcggtttcggcgccaacgtctcggtcaccaacctcggtgatccgctcaccggctggacggtgacctggacgtacggcgccgggcagaccgtgacgcaggcctggaacgccacggtgacccagagcggttcggcggtcaccgcgaagaacgtcgcctacaacggctcggtcgccaccggcggcaccgtgtcgttcggcttcaacggctcgtggaccggcagcaacccggcgccggccgggttcgcggtcaacggcgtcgcctgcaccggatcgccgggctcgccgtccccgtccagtccgtccccgtcgtcgccgtccccgtcgccctcgaccccgggcgggacgtgcacgctgccgtcgacctaccgatggagctcgaccggagcgctcgctcagccgaagtccggctgggtggcgctgaaggacttcaccaacgtcgtctacaacggcaagcacctggtgtacgcgtcggacgtcgccggctccggctacggatcgatggccttcaccccgttcaccgactggtcggacatggccgcggccggccagaacgggatgagccagggcacggtcgcgccgaccctgttctacttcgcgccgaagaacatctgggtgctggcctaccagtgggggcccaccgcgttcagctacaagacctccaccgacccgaccaacgccaacggctggtcggcgccgcagaccctgttcaccggcagcatcaccggctccggcaccggcgtgatcgaccagacgctgatcggcgacgggcagaacatgtacctgttcttcgccggggacaacggcaggatctaccgggcgagcatgccgatcgcgaacttcccgggcagcttcggctcctcgtacaccacggtcctgagcgactcgacgaacaacctgttcgaggccgttcaggtctacagggtgcagggacagaaccagtacctgatgatcgtcgaggcgatcggcagccggggccgctacttccggtcgttcaccgcgagcagcctcggcggctcctggaccccgcaggcggcgtccgagagcaacccgttcgccggcgcggccaacagcggcgccacctggaccaacgacatcagccacggcgacctggtgcggaacaacccggaccagacgatgaccgtcgacccgtgccacctgcagctgttgtaccagggcaagaaccccggtgccggcggcacgtacgaccagctgccctggcgcccgggcctgctgaccctgcagcgctga

SEQ ID NO: 75 - DNA, 852 bp, Actinoplanes utahensis
atggcagctacccggacggacgccgccggtctggtccgggcggctcaggccggtaaccgcgccgcccgcgacgagctggtcggggcgtacctgccggtcgtctacacgatcgtccggcaggccctcgacaccgacccggacgtcgatgacgtggctcaggacatcatgctgcgcgtgctgcggcagctgcggtcgctgcgctccccggacagcttccggtcctggctggtggcgatcgccctgcggcaggtcagcacgcaccagcaccgccgggcccgggacgcggcccgggcggtgccgatcgacgaggccgccggggtgccggacgtcggcgcggagttcgagggcgtcaccggtctgcgcgccgacctgtcggcgcagcgccgccaggtgcgccgggccggccgctggctggacccggacgaccggtccctgctgtcgctgtggctgctggaggcctccgggcacctgacccgggcggagctcgccgacgcgctcggcgtcacggtggtgcacgccggcgtccgcgtccagcggatgcgcgcccagctggaggtgagccgggcgatcgtggcggccctggacgccgagccgcggtgcccccggctcggtgcggagctggccggctggcccgggacgccgggcccgcggtggcgcaaacgcctggcccggcatgtccgtggctgcccggtctgcacccgggcggccggcgatctggtgcccgccgagcgcctgctgcccggcctgctgctgctcccggtgcccgcggcgctgaccgcgacggtgctggccaagagcgtgggtgccggggcggtgctgtccgtcgccgccggcaaggcgctagctagctag

SEQ ID NO: 76 - DNA, 630 bp, Actinoplanes utahensis
gtgaccgccggcacgctgatcgtcggcgccaccgcgggcgcggtctcggtgaccgcgccggaggtgccgcgaccggcgacgatcgcgcggaccccgcagccggccaccatcgcggcgccggcgccggtcaccgcacgcgccaccacgggtgccacccggggcaccaccccgaggccggccggaaccggcacgctgcgcgccggtccggtgtcgctggaggcggcgaacgccaccgggcgctacatcacggcggccggcagctacggcatgctgatcgggaccggccggggcggcccggcggcgacccggcaaccggccaccttccgcgcggtggccgggctgaacgaccagcggtgcttctcgttccgcgcggccgacggccgatacctgcggcacgcctcgtggcggctgcggctgaacgccgacgacggcacggcgctgttccgtggggacgccaccttctgccccggcgcgggccaggcggccggctcgatcacgctggagtcgtccaactatccgggctggttcctccggcaccgcggcgacgagctgtgggtggaccagttcgacggttccgcggccttccgggccgacgggtcgttcctggtacgcccggggctggctggctga

SEQ ID NO: 77 - DNA, 2421 bp, Actinoplanes utahensis
atgaacgcacggagccggccccgccggttacgcacgctgctgcccgtcctgctcaccgcgacggtggccgccggagcggcgctgttcttcgccggcacctccgacgcggcgagcaccctgggcgcctcggccaccgcccgcaaccgctacttcggcgccgcgatcgccgcctcgaagctgggcgacgccacctacgccgggatcctgaagcgcgagttcaccgcggtcaccccggagaacgagatgaagtgggacgcgaccgagccgtcccggggatcgttcaccttcaccgccggcgaccggatcgtcacccaggcgcaggccaacgggcagcgggtccgcgggcacacgctcgcctggcactcgcagatgccgggctgggcgcaggcgctgtccggcagcaccctgcggtcggcgatgctcaaccacgtcacccaggtcgccacccactaccgcggcaagatctatgcctgggacgtggtgaacgaggcgttcgccgacgacgggcgggggacccgccgtgactccagcctccagcgcaccggcaacgactggatcgaggccgcgttcaaggccgcgcggaccgccgacccgtcggccaggctctgctacaacgactacaacaccgacggcatcaatgccaagagcaccgcggtgtacgccatggtcaaggacttcaaggcgcgcggcgtgccgatcgactgcgtcggcttccagtcccacctgaccggcgcgatgcccgccgactaccaggccaacctgcagcggttcgccgacctcggcgtcgacgtgcagatcaccgagctggacatcgccggctccgggcaggccgacgcgtacgccgcggtcacccgggcctgcctggcggtcgcccggtgcgccggcatcacggtctggggcatccgggacagcgactcctggcggaccggcaccaacccgctgctgttcgacgccggcggcgccaagaaggcggcctacaccgcggtgctcaacgcgctgaacgccggtggcggttcgaccggctcgaccatcgccccggccacggcgatcgacaccagcgcctggtatgtgctggtcaaccgcaacagtggcaaggcgctggacgtgtacaacctggcgaccaccgacggtgcgcggatcgcccagttcacccgtaacgatcagacgcagcagcagtggcagttcgtcgactccggcggtggcttctaccggctgaagtcgaagctgtccggcaaggtcctggacgtctccggcaagtcgaccgccgacggcggcgcgatcgtccagtgggccgacaacaagggcgccaaccagcagttcagcgtgcagtccggcaacggcttcatccagctgatcaaccggaacagcggcaaggccgtcgaggtgcagggcgccgccaccaccgacggcgccaacgtcgtgcagtacaccgacgggaacggcaccaaccagcagtggcagctcgttccggtcggcggcgggagcactcccaccacctcgccggcctccggatcgtgtgcgcttccgtcgtcctaccgctggacgtcgaccggcgcgctcgccacgccgaagtccggccgggtcgcgctgaaggacttcacgaccgttccctacaacggcaggcacctggtgtacgccacaacccacgacaccgggtcgagctggggttcgatgagcttcagcccgttcaccgactggaccgacatggcctcggcgacgcagaactcgatgaacttcgccgcggtcgcgccgaccctgttctacttcgcgccgaagagcatctgggtgctcgcctaccagtggggcggctcggcgttctcctaccgcacctccagcgacccgagcaacccgaacggctggtcggcggcgaagaccctgttctccggcagcatcaccggctccggcaccggcccgatcgaccagacgctgatcggcgacggcacgaacatgtacctgttcttcgccggggacaacggcaagatctaccgggcgagcatgccgatcggcaccttcccgggcagtttcggcacgtcgtcggcggtggtgatgagcgacagcaccagcaacctgttcgaggcggtgcaggtctacaaggtgcaggggcagagccggtacctgatgatcgtcgaggcggtggggtccggcgggcgctacttccggtcgttcaccgcgaccagcctgggcggctcctggaccccgcaggcggccaccgaggccaacccgttcgccggcaaggccaacagcggcgccacgtggaccaacgacatcagtcacggtgagctggtccgggccaccgcggatcagacgatgaccgtggacccgtgccacctgcagctgctgtaccagggccgctcgcccagctcgggcggcgactacggcctgctgccgtaccggcccggggtgctgaccctgcagcgctga

SEQ ID NO: 78 - DNA, 732 bp, Actinoplanes utahensis
atgccggagtccccccgctccgaccgccggccgatactggcgctcgctgccgcaaccctgaccgttcttgtcggctactcggccgtcgccaccttcctgctccggacggaacgctcaccgcaggccatgccggcgccgcaaccgccgccggtgtggaccatgccgtcggcccagccaccggtctccgtcgccccggcacccagcacccggccggtcctcgacccggtgtcccggcacagccccgccgcgcccgtcccgccgccgcgccccagccggaccacggccggccgccgcaccgcaccgccccgcctcctcgccgggaccacgctcgggctcggcttcgccggcttccccgaataccggatccgccgctgggacaccgccgtcatcgtcgccgcggtcacggccgcgagcagctcgcacgaccggcgcgacgcccggttcacggtgcgggccggacgggccgacccccgctgcgtctcgttcgaatcggccggcgaacccggacgcttcctgcggcaccgcgaattcctgctgcggctcgagccggccgacggcagctcgctgttcgaccaggacgccaccttctgcccggaacgcaccggcggcggattcgcgctgcggtcggtgaactatccgcagcgccacctgatgctggccgccgacggcatccgcctggaaccgtccgcgaccaggcaggcgaccgtcttcgaagcctgcccggccctgtga

SEQ ID NO: 79 - DNA, 192 bp, Actinoplanes utahensis
gtggtcagcgacgcccggcaccggcacaccgaggcggtccggacgctcgccgccgaacgggacgccgcccgctccgacatcgaccggctgctgctggtgatcacggcgcagcgggagacgctgcggcagcacatcaaccagcggttggacgagctggccgacgggcgaccccggctggcaccccggggctga

SEQ ID NO: 80 - DNA, 270 bp, Actinoplanes utahensis
gtgtgccgcagcatccaccagttgcacaacttcgagccgccggcgacgaccgacgaggtgcaggccgccgccctgcagtacgtccgcaagatcgccgggacgacccggccgtcgcaggccaaccaggcggtcttcgacgaggcggtcgcggcgatcacggcggccacgcaggctctgctggacggcctggtgacgaccgccgcgccgcgggaccgggaggtggaggcggcgaaggcgcgggcccgggccgagcgccggtacgcctcctga

SEQ ID NO: 81 - DNA, 390 bp, Actinoplanes utahensis
atgggcgcctactggtacgagtcatccatcgaccgccagctgcgtgaggccaccgagcgcggcgagttcgacaacctgcccggggcggggaagccgctcgccggccacggcgaggagtacgacgaggactggtgggtcaaggactggctgcgccgggagggcgcgaccgccggcgtggtcccgcccaccctggccctgcgccgggccgccgaggatctgacgacggtggtcgaccgcctgcacaccgagcgcgaggtccgggagcatgtcgcggacctcaacacccggatcgacaaggcccggcgcgggcacctggacggcccgccggtgatcctgccaccgttcgacgcggacgccgtggtgcgagcctggcgaatcagaagaccctga

SEQ ID NO: 82 - DNA, 2880 bp, Actinoplanes utahensis
atgcgcgtacgcctcgcggcgaccctgagcctgtgcctgctcctcggcacggcagtggccctgcaccggtccgggcgggccgccccggccgccgacccgcacgccggccacatcctgcccacggccgtcccggtcgcggtcaccaccgcgctgccgctgccgcacaccggctggaaggtgaccgcggacagcggacagacctccgccgccaaggcgatcgacggcgccgcgggcaccgcctggctcagcggcaccaccgcgctgccgcaccggctggcgatcgacaccggcaaccgggtcgccgtcagcggcctcacctacctgccgcgggcgagcaccgccaccggccggatcggccggtaccgggtgcagaccagcgacaacggcaccacctgggccgccccggtggccaccggcacgttcgccgacgacgccacgctcaagaccgtcacgttcggcacggtgatcacccggtacgtgcggctggtcgcggtcaccgaggcgggcaaccgcggcaggcaggtcgccgccgccgaggtcgacctgctcggcggcaccgacccggcgctgccccggaccggctggacggccaccgcggacagccaggagacggccgcggcgaacggcgccgcggccaacgccctggacggtgacaccaggtcgatctggcacaccgcgtacagcgtggcgccggctgccccgctgccgcacaccttcaccgtcgacatgcgggtcaccaacctggtgtccgggctcagctacctgccccggcaggacggcggccgcaacgggctgatcgggcggtaccggatcgaaaccagcatggacggcaccacctgggggccggccgccgcgaccggcgcgttcatcgacagccaggacgcgcagacggtcacgttcgccccggccctggcccggttcgtgcggatcaccgcgctcagcgaggccggcaaccgcggcccgtggagcagcgccgcggagatcaacctgctcggccggcccgacccgaccctggcccgcaccggttggacggtgaccgccgacagcgaggagaccgccgcggagaacgggcgggcggtcaacgtgctcgacggcgacccggcgaccatctggcacagcgcgtggagtgccacgccggtgccgggactgccacactcggtcacggtggatctgcaccacgccgtaccggtgggcggcctgtcctatctgccgcgccccgcctcaccgaacggccggatcggccgctaccggatcgccacctcgagcgacgcgaccacctggaccgaccgggtgaccgacggggtgttcgcggacaacccggcccggcagacggtgatcttcccgccggccaccgcccgctacgtgcggctgaccgcggtcaccgaggccggcacccgcggcccgtggagcagcgccgccgagctcgacctgctcgggccggccggctcggtggccccgaaacgcggcgtgtggagcgccccggtcggcttcccgctggtcccggtggccgccgcgcagctgcccaacggcaggatcctgacctggtcggcgttcaaggccgacacgttcagcggcggcggcgggctgaccctgaccgccacctacgatccggcgaccggggtggtcacccagcggtcggtcagcgagaccgggcacgacatgttctgccccggcatcgccacgctgccggacggccggatcgtcgtcaccggcggcaacaacagtgagaagaccagcatctacgacccggccacggacgcctggaccgccgggccggcgatgaccacgccgcgcggctaccaggccagtgccaccctcggggacggacgggtgttcaccgtcggcgggtcgtggagcggcggggccggcggggtcaacggcggccggcacaaggccggcgaggtgttctccccggccaccggatggaccgcgctgcccggcgcggacgcggccccgatgctgaccgcggacagcaacccgaacggcgactaccgcaaggacaaccacgcctggctgttcgcctggtccggcggcagggtgctgcaggccgggccgagccgggcgatgaactggtataccaccgccgggaccggcggggtcagcccggccggggtgcgcggcgacgacggcgacgcgatgaacggcaacgcggtcatgtacgacaccggcaagatcctcaccgtgggcggggcgccgaactacgagaacaacgacgcgaccgccaacgcgtacgtgctgaccatcgccggcagcacggtgaccacccggaagatcgcgccgatggccaacgcccgcgccttccacaacagcgtggtgctgcccgacggcaaggtggcggtcttcggcgggcagaactatccggtgccgttctccgacaacacggcggtgctgcaggcggagttgttcgatccggtcaccgagacgttcagtccgctgtcaccggccgcgatgccgcgcacctatcacagcgtggcgctgctgatgccggacggccgggtgttcaccggcggcggcgggctgtgcggcgccggatgcgcgaccaaccacttcgacgcggagatcttcaccccgccgtacctggtgggtgtcaagtcgcggccggtgatcacctcggcgccgacgacggccgccaacgggtcgaagatcaccgtcaccaccgacaagagcatcaagtcgttcgcgctcgtacggatggggaccgcgacccacagcgtcgacaccgaccagcgacggttgtcgttgccgcaggtggccgtgagtggtggttaccagctgaccattccggcggacccgggagtggcggtgcccggttactggatgatgttcgccgtggacgccaagggggtgcccagcatcgccaggaccatcagggtcttctga

SEQ ID NO: 83 - DNA, 1533 bp, Actinoplanes utahensis
gtggcgacggacgatttctggagcaagttccgccggtggcggcgcgcacggccgttctggtcgggtctgctcctgcttctgtcgggcctggagctgctgtacagctcgaacctgtcgctgggcaacctgcagattcacatcggcccgcagggcttcctgtcgtacctgctgccgatcctgatgctgatctgcggcgcgctggtgatgttctcgccggcccagcggatgttctacggcatcgtcggcctgctcaccgcgctctactcgttcatcgggctgaacctcggcggctggttcatcggcatgctgctcggcatcgtcggtggcgcgctcgcgctctcctggtcgccggcgccccaccggccggccaccgccctgcagggcccgctcgacttcgccggaccgtcccagggcgagccggtgccggccgagggcaccgacacccggcacctcgaggttgccgggcacgacgaccggccgcacgagcagccggtggtcagcgacccgagcatcctgcccggcctggcgcccgagcccgagggtgaggacccccgcgggagcctgcccggcccgcgccgcggcctgaaccgcaaggcgctcgcgatcatcaccctgccgatcctggtcggcgcgaccatgctgatcggcagccggctcccggccagcgccgacgactgcccggccggcctgccgtcgatcaagacctccgcgtcacccagcaagaccggcggcaagaagaccccggcgaccatcccggcccggccggccggcaagacgcccaccaagaccgccaccaccaccacgcccgcgccggccaccagcacctcggccgccgcggcgtcgaacgacagcaacccgatcgtcgacggcatccacagcgtggtcgacggcgtcggcaacctgctcggcatcggtggcaacgagtcgcccgcaccgagcgcgtcgccgtcggcgtcggcgagcaaggcggccgagccggccgcgaccgggaccaccgccccgggcgcggcaccggccaagaccacggcgcccgctccggccaggaccaccagcaagcccgccgccgactcggatgtcatcccgtgcctcggcgcccgccaggagaacgtggtcgccgacggcagcgtgccgcggtcggcgatcaagccgggcgtcatgaaggtcgactcgctgaccatgtacaactcgacctacaagggtgtcgccgacgtcccgaccgcgaacggcacgatcaaggcgctgcagttcgacatggacaaggcggtcaacaagccgttcagcctgaccatcgacgagcccggcgacgcggtcaccacgatcaagagcgccgagctgaccaccaccggcaacgtgcacttctacaccccgaagatgaccggcaacctgttcggcctgatcccggtcaccttcaccccggagcagccgccgccgctgacgctgccgatcctctggttcaccaacgtgaccatcgatctggcgttcgtcagctgcaacacgctcaccgggcagccgctgcagatcaccgaaagctga

SEQ ID NO: 84 - DNA, 639 bp, Actinoplanes utahensis
gtggaggattcgcagagcgctccggccaccggacggaccaactggcgccggttcgccgtcgccgttggcgtgccgaccgccgttgcggccggcctggtggtggcgctgcagacgggcgccctggccgccaacttcgtcatctccggcacgcagttcaagctgagcgccgacaccctcgagggcaacggcttcacgcagtacagcgacgcgctggtcgacggcagcggcaagccgcgcgcggccgccatgtccggcatctcgagcgcgacgatcaccaacctgtgccagtcggtctcccagaagaccccgctgggcacgatcaccctgcagatcaaggcggcgaccggcgtcaaggcgtcggacgacgactcgaagaaggtccaggcctccaacctgctgatcgggatgtccgagctgagcggcgacgcgacgttcaccaacatcgagatcggtcgggacgccggcaacctcaaccgggccggcgacgcgaagggtgcggtcggtggtttcggtcagcaggccgagcacgtcaccatcaacagcctgaagcagcaggcgtactcgacgtcggcctcgacgttcaagctgaccgggatgagcctcaagctcctcaccggcgacggcaacgagtgctactga

SEQ ID NO: 85 - DNA, 1929 bp, Actinoplanes utahensis
gtgaggggcgtgagactgcaacgccggctcaacctgggcttcgccgccctgctcgggctgttcacggcgttcctcgtggtgcagttcggcaccggcgggcggctgcgcgacgaccacgaccgccggtccgcccggatcgccgcggcccgcgaggccaatcaacacgccctgcaacggatgaccgacgccgaaaccggggtgcgcggctaccagctcaccggggagcggctcttcctggagccctacgagaacggccggggcgccgccctcgccgcgctcggcaccgccgccgaacagacccgcgacccgcaggtccgggagctggtcgaggccgagcggcaggccgcctacgactggctcgcccagtacgccgcctcggtgatcgaccggcagtcccgcgccacccggaccgatccggcgctcggcaaacacctcttcgaccgggtccgggcactcaacgccgcggcggacgacgcgatcgccgccgagcagcacgccgagaacgcggccggccgacgccggagccggatcctgggcgccggctcggccgcgctggtgctggccgtgctcgccgccggttacctgctggtccgggtcagccggcgacagctgctggtgccgctggcccggctcggcgacacgatccgccggcaggccgccggcgaccggtcggcccgcgccgagctcctcggcgcggcggaactgcgtaccgtcatcgaagctttgaacgatctttccgcgcagaccgaggaactgctcgccgccgagcaggcccgcaccgcccgcgcctggctctgccaggcggtcgtcgccgagctgcagcaggagggcgccgacccggcgcaggtcggtcaccgggtggtcgcccggatcggcggggcgctcggcgccgacgccgtgcacggcaacctgttcgtccccggtaccggtcagatcgcggtccgctggccgccggaggcgcccgacccggcgccggacgccgtcaccgggatccgggacatgcccgccgggcagcccgcgatccgcgccggcggcctggccgtcacgatcggcggcgaccccgactgcccgggcggctgggtgctggtggtccgcgagttcctgccccagttcaccgccccggagcaccgcctgctggccagcgtggccggcgagatcgaacgggcgctgcgccagctcggcatccgggtgcaccaggagctgctgatcggccagctgcggatgctcgaccagcgcaaggacgtcttcatccagaccgtcacccacgagctgcgcacgccgctgaccagcattctcggctacgccgagatgctcgccgacgaggacgaggaactgaacccgatgcagcgccggtcgctcaatgcgatcctacgcaacgggcaccgcctccaggacaccatcaacgacctgctgctgctggaccggccggcgaccgccgtggacgcggtcaccgaacccctcgacctggccgtcctggccaccaccgtgcacgccgagctgcaggccgccgcccaggccaagaacctggcggtcactctcgacgcggcgcccgcctgggttcgcggcgaccgcacgcagctgcagcgggcgctgcgcaaactgctggagaacgcgatcaagttcaccgccgccgggggcagcgtcacctggggctgtgacgcggacagccggcacgtcacggtgacggtcaccgacaccggcatcggcatcccgccggaggacgtgtccggtctgttcaccccgttccaccgggccggcaatgcgatggaccaggcggtccagggccccgggctgggcctggcgatcgtccgcgacatcgtccgcgaccacggcggggcgatcgcggtgcagtcggtggtcggccgcggcacgaccttcacggtgaccctgccggctgttccggcgccggtggccctgccggtctcctga

SEQ ID NO: 86 - DNA, 906 bp, Actinoplanes utahensis
atggctgccatggcggatcagatcattgcgggtgggttccggatcgtggtggacccggtctcggattcggtgaggctttcggcgatcttcgcggtgctcccgctgctgacgctctttctgctgctcggggtgttccgggtgcgggcgtggctggccggggtgatctcgctggtcgtggcgctggtcgtggcgatcgccggctacgcgatgccggtcgggcaggcgctgctgtcggcgagcgagggtgcggcattcgggttcttccccattctgtggatcgtgatcaatgcgatctgggtgtacaacctgaccgttgtcagcgggcatttcgacgtgctgcggcgatcgatggaacgggtcagcccggacatgcggattcaggcgatcatcgtggcgttctgtttcggggcgctgctcgaagcgctcgccggcttcgggacgccggtcgcggtcaccgtggtgatgctgacggcgctcgggttcgcgccgatccgggcggcctcggtggcgctgatcgcgaacacggcgccggtcgcgttcggggcgctggccacgccgatcgtgacgctggcgacggtgacgtcgggggccgggaacgacccgcgactgaccaccgacacgctcggggcgatggtcggtcggcagaccccggtgctggccctcgtcgtaccgcttatcctggtcttcgtggtggacggccgccgcggggtgcggcaggcctggccggcggcggcggtggcgggtctggttttcgcggtggcgcagttcgtggcgtcgaaccatctgtcggtgccgctgaccgacatcgtcgcctcgctggcggcggccgccgcggtggtcctgctgctgcgtctctggcagccggctcgcgccgtcgggtcaagcccgctgaccggagccgcctag

SEQ ID NO: 87 - DNA, 738 bp, Actinoplanes utahensis
gtggcccgcgcctacgctccgtacctgatcatcatcgtgatcttcgcgatcgcgaacctcgggccggtcaagtcggcgctggcgcgatccccctggacggtgatcttcgcgtggcccggcctgcacgtgctgagtgccaccggcaaaccgctgtcctcgacgaacttcaccctgggctggctgccggccgccggcaccctgctgatcatcgcgggcatcctgagcgccgtcgtgctgcgggtccgccccggtgcggcggcccgggcctacggtcggacgtacgccgaactccgccagccgatcgtcaccgtgatggcggtgctggccctggcgtacgtgctgaaccagtccggacagacgaacaccctcggggcgttcctggccacggccggcggcgtgttcgtcttcctgtccccgatcctcggctggatcggcgtcgccgtgaccggttcggacacctcggcgaacgcgctgttcggcgccctgcaggtgcagaccgcggcgaaggccgggctggatccgctgctgctggccgcggcgaactcgtcgggcggggtgttgggcaagatggtcagcccgcagaacctggcgatcgccgcgggtgcggtcgggatggccgggcgggagggggacatcttccggaaggtcatcctctggagcgcggtgctgctgctcggcatgtgtgtgctggtcacgctgcagagcacaccgatcctgggatggatgatcccgggatag

SEQ ID NO: 88 - DNA, 1596 bp, Actinoplanes utahensis
atggccgacctcatcctgatggctgaccgcatccacaccctgacccccggaatccggcccaccgcggtcgccgtcgccggcggccggatcaccgccctcggcgaccgggccgacgtgcgggactggcgcggtcccggcacccggatcatcgacgtcggcacggcgacgatcacgccggggctggtggacgggcacacccacccggtgcacggcatcgggttgacgcgcggcctggatctgtccggcgtacacacgcttgcggggttgaaggacgctctgcgttccgcgtcctcggtgtgcgccgcgccggacggctggttggagggctggggtctggatccggacgcgttcaagggggcgccactgaccgccgcgccgctgatcgaggtgctcggcccgcacgtgccggtcttcctgcggttcttcgacgcgcactcggcgctggtcagcccgcgggcgctggacatcgccgggccggccgcgcggtcgcacgccggcgtcgtccgcgacgcggacgggcagccgaccggctgtctgctcgaactggaagccgtcgaaacggtgcgcgccgtcctgccgccagacccgcccggcacccggctccgccggctccgggaactgctgacccggatggcggccagcgggctgaccgcggcgaacgcgatggacttcgaggaggactcactcgcgctgttccgcgccctcgaagacgccggtgacctgccgatgcggtggcggtgcgcgccgctggtcacacccggcgccgacctcgccgacatcgtcgccaaacagcgcctgcacggacggcgctggcaggtcgaaggagcaaaattcatgattgacggtacggtcgacggcggcaccgcgtggctcgacgaacccgacagtctcggcgagtcgaccgccagcatctggcccgacccgggcgaatacgccgccgcggcccgccacctcgccgggcacggggtgccgacggtgagccacgcgatcggcgacgccgggatccgctacgcgctcgacaccgtcggccggctgccgcggcagcgggtgccgcaccggatcgaacacctcgaaacgatgccgggcgacctgatcggacggttcgccgcactcgacgtgaccgccagcatgcagccgacccactgcacccatcacacccgggccgaccacaccgacaactggtcgcggcggctcgggaaactgcgggccgaccgggcgtttcgggctcgggacctgcgggacagcggggcacggctggtgctcggatcggactggccgatcgcgccgttcgacccgcggggaatcctggcggcggcccggctgcgccggccggccggggcggtggacacgtcgccggtgctgcctgcacaggggttgacggcgcggatggcgttggaggggtatacgtcgcaggcggcggaagcggcggggatcggggactcggggcggatcgcggccggatgccgggcggatttctcggtgttcgagctggatccgttgggggtggatgcggatgagttcgccgagtcggcggtggtgatgaccgtggtggagggggacgttctcttcggaggatctttcgccgcggacggttga

SEQ ID NO: 89 - DNA, 1221 bp, Actinoplanes utahensis
gtggacgacgaggatctcggtactgaccaagacccgctgctggtgcggccgtttgtcgcccaggaggggggcgccggggacgctgaggcttccggggctacctggccggccggggcggcgccggactcggtgacccaggtgctgccggtgtactcgggcggctcggggccgggaggatcgagcgcctcccggtcgggtggctccggggcgggtggctccggggcgggtggctctggggccggtagcgctggggccggtggaaaccggttcgggtcgggcggctcgggagtgggttcgacagctggggcacgggctgacgggctggcgcgggctgatgggcccacacgcgctgacggacggacacaggctggtgggcgggcacgggctgacgggcccacacgcgctgacgggcccacacgcactgacgggcggacacaggctggtgggcgggcacggcggttgttcgggacgcggcggcggccggtgctggtggccggggtgggtgcgggtgcggtggtggttctggcggtggccgggtatgcggctctgcggcccgaatttgatccggcgctctccgcggacctgccccgaccctcgtttccggcagtaaccgggccggggactaccgaggccacgactaccgccgcggggaccgccggggtggtggtcggtgcgcacggcggcaccgggaccggtggtggtccgggggtgaaccggactgccacgcccacagccgcggtgagtgtgacgcctagcaggatcgggggttcggcttccgcggcggcgggcgtgagctcggcggccagcgccggggcccaggcgccggcggcggtcgtggtgggttcgggtacggctggcaccggcattctggtcagtgggaacgggctctgcctcgacctgccgggggcggtcccggtcgatgacagtgtcatccaggtgttcgactgcaaccggtcggctgcgcaggtgtggacgctcggaaccgacggcacgctgcaggtgatgggcaagtgcgcgctgttggtgggtgacagcacggtgcacttgacctcgtgcgacctacggaccacggcgcaatggcggatcaccggcgaccatcagctgatcaacgcggcgagcaaccgctgcctgaccgatccgtcgcagggcgcccgccccggcacgcgggtcgtggtcgtcacctgcaccggtgcctccgaccagcgctggtccctgagctga

SEQ ID NO: 90 - DNA, 201 bp, Actinoplanes utahensis
gtgaacgcccgcatccgccgggcggtccgggcccgcgggcacttcccgaatgagcaggccgccctgaaatgcgtctacctcgccgtgatgtccctcgacccgaccggcaccggccgccgccgctgggcgatccgctggaaacccgccctcaacgccttcgacttcgccttcgaaggacgactcaccgcaggccgcaactga

SEQ ID NO: 91 - DNA, 2664 bp, Actinoplanes utahensis
gtgattatctacgtcaatccgatggggccgggcgagctggagcgggtcaggccggcgcccggatccgggttcggctcgttgcgcaccgaccgcggcaatctgcctctcgaccggctcgacgtgcaggccgcgatcagtgggctggtcgcccgcaccgaggtgaccgccgagtttgtcaacacgcacgacaccgccctcgaggcgacctacgtcttcccactgcccgaccgggccgcggtcgtcggcatgacgatgaccgccgacggccgcacggtcaccgccgagctgcaggagcgtgccgccgcccgcgagcagtatgaccaggccgtggccgccggtcagcgggcctcgatcgccgaggaggagcggcccgacgtgttcaccatgcgggccggcaacatcctggccggcgagcggatcgtcgtgcggctgagcctggtcggcccgatgccgttcgaggacggcgccgccacctaccgttttcccctggtcgtcgcccctcgctacattccgggtgcaccactccccggcccgtatgccggggacggccagaccgccgacaccgacgcggtgccggacgcttcccgcatctccccgccggtgctgctgcccggatttcccaaccccctgcgactgtccctcggcgtgaccgtcgacgcggccggtctggagctcggcgaggtccgctccagcctgcatgcgatctccgaggagggcggcacgctacggatcgctccgggcgagcgggccgaccgtgacttcgtgctgcgtctggcctacgcaccgggtggcaacaccgcggtggcggtgcccgacaacgatggtgaggaggggacgtatcagatcgtgatcctgccccccgccggcgacgtgccaccccggccgaaggacgtggtgctgctcctcgaccgttccggcagcatgggcggatggaagatggtggccgcccgccgcgccgcggcacgcgtgatcgacaccctgaccggcgccgaccgcttcgccgtgctcaccttcgaccaccaggtcgagcgccccgacggtgtggagccggggctgagcgaggccaccgaccgcaatcggttccgcgcgatcgagcacctggcccgagccgacgcccggggcggcaccgagctgctcaccccactcaccaccgggctcggactgctcgccgacagcaccggacgggaccgtgtcctggtgctggtcaccgacggtcaggtgggcaacgaggatcagatcgtccacgaggtgaccccactgatcggcagcacccggctgcacaccatcggcatcgaccgcgcggtcaacgccggcttcctcgggcggctggccgcgctcggcgccggccgggccgagctggtcgagagcgaggaccggctggacgaggcgatggagcacatccaccggcggatcggcgctcccgtggtcaccgggctgtccctgaccgccgatgatgtcaccgcgctggaggggacgcgcagtccccagcgactgcccgggctctatccgggagtgccgctggtggtcaccggccgctattccgggtcgacggcggggaccttcacggtgaccgggaccactcgggacgagcaggcgttccaggccaccatccccctgcgggagcgtgccgagcctgcggtgaccaagcagtgggctcgggcccgcctgcgcgacctcgaggatgccttcgcggccggcgaccacacgctggagcagcagatcgtcgagacctccctgcgtttcggcgtgttgtgccgcttcaccgcctatgtcgccgtcgacgagcgcgtggtcaacgagggcggcgaggtccggcgcgtgacccagcccgtcgagatgccctcaggctgggagtccacggcacccccgatggccgccggcatgatcctggcctcggcgtcctctccgttcccgggcggaccggcgccggccgcacccgggatgttcccgccggcaccgccgatcccgggcggcccggtgccgagccgcccgcgcttcgccccggccagcgccaaactgcgtgcatcccaccgccagccggacgcgttcgacgacgccaggcttgcgggtcagcctccgattgtcggcggccctccgccctccgcggacagccccgcttcacctgcggccagcccacccgcacccaccagcgacgcatcgacccccgcaggtggctcatcggcacccaccggtagcgtgccggcgtccgcaagcggcccgacgtctcccgcaggcggcccgcagtctcccgcaggcggcccgccgtctcccgctggtggcgtgccgcgatccgcaagcggcctcccggccggcggcggccgggtttccccgcgcggtttcggtcggtcgcggcaacccgccgacgccggcatcccgctcgccgacatccggcagctggccacggtcgaagcaggacggttgcgcgacgccgccgaccaccccgactacgagcgtcgcgacctgctggacgacctcgccagccgcctcaccgtcctgctgactcccctatccggcgacgacttcggtcccttgcaggctctgatcacgctgctgaacggcaacgccccactcgccgagaagtggtccaccgccctgcgggttctgaccgaattcggcgcacccacctcaccgaaacgagcgaccaagcccttctggaagcgctga

SEQ ID NO: 92 - DNA, 660 bp, Actinoplanes utahensis
atgtggacgatggaggagctggtcgaccgggtgcgcaccgcactcgccgcggagtattccggcgcgcccaacggccgcgtccgggatctgccggatcgccgctcgatccggtggtattcgacgatcggcctggtcgaccgccccctcggcacgcgcggccgcaccgcgctctacggcccgcggcatctcatgcagctcgtcgcgatcaagagactgcaggcggccggacgcaccctcgccgagatccaggcggacctgagcggggcatcggacgagtcgctcaccgatctggcccgggtgccgtccgagctgctcgaggccgatccatcgccgccgcccgcgacgccccggccgccgttctggaaatcgccacccgctcctcagacggcaccgacgcacgcgctcgattgggccttcccacagtcggaggccccctcaggcctcgcggaggtgccatcaccggccggcgacccgggcacggcgccgccgatcggcgccgacgccctacttaccggggtgccgctcggctcagggctgatcctgctggtccccggttcatttcatctcgatcgcatcgaccgcacccagctcgcaaccgcggcccggcccctgctcgacctgctcgcatcccgtgggctcaccgataggagagattcgtga

SEQ ID NO: 93 - DNA, 735 bp, Actinoplanes utahensis
atggtgacagtgtcaatgattcgtggcaggatgagcggcatgctggatcggctgaggctggtgagcctctcgcacgtgaacgaccccgcgcggatcagcgtctttcccggtgatccgccgttcgagctggacaccgttgccacgctcggcggggagggcttctatctgcgagcggtgcgcggcggcgagcacaccggcacgcactggggcgctccgggccacttcaccgagggcgggctgctcgccgacgagctggagccggccgacctgttccggccggcggtgaaggtcgacgtgcggtccgcgtgcgcggccgaccccgcatatgcggtgaccatcggcgacctgcaggactgggaggggcggcacggccgcatcccggacgagtctttcgtgatcatttggaccgggtgggaggagagattcggatgcgcggatttcgagcggcatcccgggttcgccccggagacggtgcgctggctggtggagaccggccggctgggggagcggggcggcaccggcacggacgcgttcagccccgatgtcagcagcgacgccggcttcacggtttcccgactggtctatcagcgccgccgggtcagcctcgaggtgctggcccatctcgcagatctgcccgccaccggcgcgtgggtcctgtgtggcgggcagatcaaccgggccggttccggttcgacggcgctgatctacggagtggtgccgccggcggccggctga

SEQ ID NO: 94 - DNA, 2343 bp, Actinoplanes utahensis
gtgaaccgcaccggatttgccagtctcacggcagtcgtgatcatggccccgctcctcaccagcccagccgaggcacagccgcagcggccgctcaccccggccgtgcacgggcacgccggggtcctgccggagatcgacggccggggcctcacccgtacacacctgcgtctcggtggcaaattcctgccgcaggcgcgctatcggccgcaacccaccgcccgccgcgcgcccgcggccacccccgcggtcggcacggtccgcagctgggtggggttggacgacaccgacggcgacctgtaccgcaaggactacacgttgcgggcggtcggcaggcacatcgaggtctgggtggccaaggacatcgccttcccggccggcgactgccgtaagaactccaccgaggtgaccgacgcccaggtcgccgatctggtgacccagttcgacaccaacatctacccgaaggagacggcgacgttcagcacgccgccggaccggtcgggcgcgcacccggggatggccggcgacttcagcggtgacggcgacaagaccgtgacgctggtcgacaacgtccgcgacgacaactacttccatttcccggaacgccccacctacatcgcgggcttcttctcggcgcagctcaacgagttgttcgaccggaacgtgatgacgatcgacgcctacgactggcagcaccggctcggcgcggacccgaagaatgaaccgaccgacgacctgtgcaccagccggccggcgcggccgcggatgtacgagggcaccttcgcccacgagtggcagcacctgctggagtactaccaggacccggccgaggtggactggctcaacgaggggctgtccgattacgcgcagaccctggtcggctatgtggacccacggatcggcgtgcaccatcccggctttgacagccacatcgcctgttaccagggtttcggcaacgtgaagacgacctacaacgcgaatccgcgggagtgcggcggcccacagaactcgctgaacctgtgggacgagggcgagcccaacgaggtgctcgccgattacggcatcacgtacgagttgatggtctatctgcgggaccggttcggcgtgaagatgatcgccgagctgcaccgcgacgccaagcaccagtcgctcgacgcgctgcagaccgccctgcccaagggcctcaaggtcgccgacgtgctgcacgacttccaggtgatgaccctggtcgacaaggaggtcggcgagcccggcgggacggtcaccggagtgccgcgcgaccgcgtgaccgcggcggagctccagtcgacggtcaatctcgcgaacccggccacctatgacaagtcgggcgccgcgccgaacggggcggatttcatccgcctgccgcagggtctgatcaagtcggtggcgttcagcggggcgccgaccctgccgccgacgccgctggcctggaagatcgatgcgggcctgctcttctccgggaacacgtcggatctcgacgagaccgcggcccgtcaggtcgaggtgccgaccgccgatccggtgctccggttcaaaaccacttacggcatggagaaggacttcgactacgggtacgtcaccgtctcggcggacggaggcaagacgtaccaggcgatcgagggcaacaacacggtcaagggaccactcgggcccgcgatcaccggtcaggccgcggacgtcaaagagaattacgacctcaaggcgtacgcgggtaagaagatcctgctcggcttccgctacgtgaccgacgccgcggtcaacctcggcgggtggcacctcggcgaggtgaccctcggcgccagcaagatcaccagtgactcgctggacggctggaagtcgcccacccagtggcaccccatcccggtgcgcggctggcacgtctcgctggtcgggctgggccacctgcgcgccgcggtcgtgccgatcaccgaggtcgcggcgctgcgcggcttcccgaaggtcgtcgcgatcgtcgcacaggacgacccgaccggaacggtcacccagtacgccccgtacaccctgaccgtggacggcgtcgtccagcccggcggcggtcagaccgcgaccccgcccccggccgcgtccaccaccaccaagggccacagcacagcgggcaacaccccgggtcacgccacacccggcgccgcaccgagccactccaccccgagccaccccaccccgggccatcccacgccgagccccacccgcagccgcagcactgcgggcgtcacccagggccacgccacacccggcgcgagcccggcgcaccccacggccggctccggccacggtcagccggccgccggcggcaccactccgtag

SEQ ID NO: 95 - DNA, 2697 bp, Actinoplanes utahensis
gtgcatatggcaccaacacgcgcagtcgatcatgaagcatccgccctgcacgcttcacctgtcgtcggcggccgctctccaggatcgcactccccctgccgcgtgggcccggaatcgcctcgcacggcatcggaaaccgtcgtcgagcaggaaggttcggccatcattcagccgatcgcatccgcggcgcccgcggcgtggacacggatgtgggcggttcggggacacgacggggtgtcactcgaagaggctgtgcttcctgccctgctcggcgcggttgcgggcccggcggcgcttctggatcaccaggatgtcgacggcggcgacggccgcccaggcggcgagcaaccagccgggcagagtccagccggcgcggaacaggatcgcggacagggcggcgcagaccaccatgccgaacgcggcgaggacgagccggaggttgagtgggctgtacggctcctcgacagtgccgcggcggccgggtggttgcggaccgatgggcataggcacgaatctactcgtgtcggacgggacgaaaacaactcgccccaagatcgggtagtttcgatatcttcggcgtctggcactgatccgctgtggacaggaggcgccgtggcagagacggggcttaccgagcagaactcgcgcaaactcggcacctggtccgtgttcgtcatcgcggtctccgcgatgacgccactcaccgtcgtggccggggcgctacccctcgggtacggggaagtgaaagagaagggcatccccgtcgcgtacgtgctggtcgccgttgtcctggcgatcttcacggtcgggctcaccgcgatggcgcgccacgtgccgaacagcggtgccttctacgcctacgccgcgaagggcctgacccggccggccggcgtcggcaccgcgttcatcgcgttgctcgcctacaacgccatgcagatcggtctgtacggggcattcggtgtcgccgcgcacaacgccgccgcgatcttcgggctgaagatgtcgtggatcgtctgggcgctgctgggctgggcggtcgtcagcgtcctggggttgcggcagatcgacttcaacgcccggatcctgaccgtgctggtcggcgccgaagtgttgatcgtgctgaccctggatgcggtcatggtcggtcatcccgacggcggatcggtcgcgttcgacacggtcaatccgggcctgatcgccagcgccggtggagtgtcgctgctggtcggtgcggtggccgggatggtcggcttcgagtcgccactggtctacgcggccgaggcgcgcgacccccggcgtaccgtcgcccgggcgatcttcatgacgctcggcgtcgcggcgatcctctacggcggctcggcctgggcgatgtccgtcgtggccgggcccgacaagatcatcgatgtggccgcgcgatatctcaacgacctgttcttcgtgctgcccgggccatacctgccgaccgcggtcatcgacctggcccgggtcttcttcgcgaccagcctgttcgccgcgatgctggccttccatcacaccgtcgcgcggtacgcgttgactgtcgcccgggagggcgtgctgccgccggcgctcgcccgcacccgtgacgacgtgccggtagccgcctcgatcgcccagtccggcctggcgttcatcgttctggtgatcttcgcggcgctggtactgaacccgaccagtgatctgttcttcctcggcacggtctccggtggcctcggcgtgctggcgctgatgacgatcgcgtcgatcgcagtggtccgattcttccggcgtgacacgcacggtgagacgacctggcgccggtcggccgcgccgtggattgccgcggtcttcctggtcctcatgctgcttctatcggtggcgttcttcggcgagctgctggattcggacaatctggtgaaggtgtggctgccgccgatcgcgttcctcggcgtctatctgctcggcgtctggtgggggcggcgtctgcgccgggagcggccggcggtctacgccgcgatcggcaccggcctgccaccggaagccgacaggcccggcctggtcgtcccgccgcagcgcctcaacggtgtggctgccgccgcgaagccggaggccgccgcaaggctcgaaatcgctgacgcggcccccgcgaccgtcggcctcggcgcaacccccggcccggcaaccccgaacccggcgacgacggtcacgccggatgtgacctcccagcccgaggcggccggcaagtcgccaacggccgagccggacgtagtcggccggtcggcagcggtgggaactccggcttcggggctggagccggatgcggccggccgcaccatggcggcgggcatgccggtgacgggggccaagcctggtgtgaccacgcggacggaggcgctcggggaggcggcggcgggtgcgcctgcggatgtggtcgcgcggacggaggcgctcggggaggcggcggcgggtgcgcctgcggatgtggtcgcgcggacggaggcggttcggggtgcggcgggtgacccggtggagatttcggctggggaggcggacggtggcccggcggatgttgtggccggggaggcggcggggtggcggaccgagcgggcgcggccggcggggacggacggcggtggagtgaccaagccgacagtgggtggatcggagccggaagaaggcggaaatccgccggtcagttaa

SEQ ID NO: 96 - DNA, 315 bp, Actinoplanes utahensis
ttggggcgagttgttttcgtcccgtccgacacgagtagattcgtgcctatgcccatcggtccgcaaccacccggccgccgcggcactgtcgaggagccgtacagcccactcaacctccggctcgtcctcgccgcgttcggcatggtggtctgcgccgccctgtccgcgatcctgttccgcgccggctggactctgcccggctggttgctcgccgcctgggcggccgtcgccgccgtcgacatcctggtgatccagaagcgccgccgggcccgcaaccgcgccgagcagggcaggaagcacagcctcttcgagtga

SEQ ID NO: 97 - DNA, 99 bp, Actinoplanes utahensis
atggtcactctcggttatctggcggctcggtcggtggagctcgccggccgcttccgaagccgcttcgtcacggcgtccgccgatccctccggtgtctga

SEQ ID NO: 98 - DNA, 1149 bp, Actinoplanes utahensis
atgtggatcttcgatgggcacaatgatctggctatgcgcctgcgcgggtggcacgggtcgagcacggcgggtctcgacggttcacgtccggagttgcacaccgatctgccccggttgcgtgcgggccgggtcggcgcccagttctggtcggtctacgtgccgtcgtcgctgccggagccggaggcggtgacgcatacgctggagcagatcgacgtcgtgtatcggctgctggccgagtatccggacacgctggaggcggcgcgcacggctgacgacgtggagcggattgtcgcggccggccggatcgcgtcgctgatcggtgtcgagggcgggcattgtctggcgcgttcgcccggcgtgttgcggtccctggcgcggctcggcgtccgctatgtcacgctgacccacaaccatcacacggcgtgggcggattcggctgcggcgccgccggtgtcaggcggcctgacggccgaggggcgggctctggtacgcgagatgcagcggatcggtgttctggtcgacctgtcgcacgtggctccggtcaccatgcacgccgcgctggacgaggccaccgcccctgtcatcttcagccattccggcgcccgtacggtgaccgaccatccccgcaacgtcgccgacgacgtgctggagcgcctgccggccaacggcggtgtggtgcagattccgttcgtagcctgtttcgtctctcctgccgtcctggattggcagcgcgcggcggacgaggagtggcagcgtctgggcctgcccccggtgcaggacacctggccccgggcccctcgcgccggcgagtccgatccgcccacggccaccatcgcggacatgacttccgaacccgccttcctcccctggctggccgcccacccccgcccggacgccaccgccgccgaggtcgccgaccacgtggaccacgcccgcgctgtagccggcatagatcacatcggcctgggcggcgatttcgacggaaccccggacgtcccgatcgacctccccgacgtcgccgcctacccggtcctgctcaccgagctggagtcccgcgactggtcccgcaccgacctgaggaagctggcccaccacaacgtcctccgagtcctccgcgaggcagaacagcacgccaccgccgatctctga

SEQ ID NO: 99 - DNA, 1044 bp, Actinoplanes utahensis
atgcgttcgacgctgcgcaagaccgtactgacgctgaccgctctcgtcgccggactcggcgccgcgacggccacgccggcacaggccgctacgcacgctgccgacgcgggatgtgtgaccggcgccaagctggtcccgacctgtggcgttctgtggggaggcgcggccggtggcttcaccagcgcgccccgggacaaggcgctgaaagactgggagaacgccagcggccggaccgcgacgatcttccaccagtaccacaagggcaacgagccgtttccgaccaaggctgagatcgcgatgaccgccgacagcgcgcacccgcgggtgctgctggagaactggaagatcgcgtacggcaccacctgggccgccgtggcccgaggcgggcaggacaagcgcatcgacgccttcgcggcgcgggccaaggcgtacggcaagaaattcttcctggttctgaaccacgaaccggagaacgacgtcatcccgcggtccggctccggcatgcaggccaaggacttcgcggccatgtaccggcacaccatcgagcggctgcgcgcgcagggcgtgaccaacgtgatcaacgtggtcgcctacatgggcaacgagaagtggatggcgcagtcgtggtggaccgacctgtaccccggtgacgacgtcgtcgactgggtcggcctggactcctacgtctccgtggagaagggttactaccactacggcgacttctccgcgctgctggaccgcaaggccaagggtggcacgctcggctggtacgactgggccaccaccaggcacgccgacaagccggtcatggtcgccgagtggggcgcgtaccaccgggtcggccgggccaccgacaagtcgttcgtctacaacagcgtgatcgaccagctccagaagcgtccggcgatcaaggcgatcgtgcacttcgacaccaagcacgacgacgagggcgaccgcgacatcagcatcaacagctcggcggcgtcgctgaaggcgttccgcaagctggccgccaacccgatcttcgacgtgaagctcggctga

SEQ ID NO: 100 - DNA, 945 bp, Actinoplanes utahensis
atgctcgccgagatctccgcggccgcctaccggctgcgcctgccgctggtgctgtactccgccgtcctcaccgtggcgacggtggccgcaggccggctgagccccgccccgatcgggcccaccgtggcgacgctggcgctggtcgccgtcgcgggcgtcaccgccgtgctcgccctcgccgtcatggccgccgcgcagcggaccggctcgcagcgccccgcgctgatcgtcgacggcgccttccacacaccgcgccccggcacgttcccgctgctggccgtcgccatgctgggcctggcgggcgccgccgtggtggcccccgccgaggccgggcaggcccgtccggtgttctggggcgccggcgccttcggcgtgctgacgctggcctgctgcgctcgggccatccgccacgggatcggcctcacgctcaccccgcacggcctgcacgccgacaaacacaccggctcggtgaccattccgtgggaagccgtcgacccgcgccgggtctggagcggaccgttcgaggtccggctccggtacacccggcccgacctggtccgcaccaccggttgggtggtcaacccgcaccggttccgggtcgacggcatcgccaccggattcgtcgccgcgacgatccagcactacgccgccaaccggaccgaactggtcctgatcggacaaccggctggccagctgcacccggccaccgagccggtaagcccgccgcggtccgtcgagccgtggaacctcagcagcgtgctcccgctgttggcgctggccgcgatgaccggcgccggcgcggtcgccgcggacgtctgggccggccgccgatggggcgacgtctcggtccccggcctggtcgcacacctgctggcgatccaggcgctgctggccgcggccctgctcgcgaggggatcgatcaggttgctgcgccggcgcggctga

SEQ ID NO: 101 - DNA, 261 bp, Actinoplanes utahensis
gtgaccgtccggtcaccgggcccgctctacactcccgcggtgatcatgagactggacacggccgtcgatcgccatcggcggccgatcgtgctgttcgccctcgtgtggacgatgctggcggtcgccgcccgccggctcggccacgccgacgacgccacggcccgagaatccgtccacgttctcgccgcggtggccgcgatcgcgatcggcgcggtgctcatcgacgcgatccgcggtttccgggcccgggcccggatctga

SEQ ID NO: 102 - DNA, 1941 bp, Actinoplanes utahensis
atgacgacgacagccggccaccgggcccgaaacgtcccggagcgtgcctctttggtggcgctactgacggcgacggccgtcctgtacctctggaacctcagcgcctcggggtgggggaacagcttctacgccgcggccgcgcaggccggcgcgaagagctggaaggcctggttgttcggctccctggacgcgggcaacgcgatcaccgtggacaagcctcccgccgcgatgtgggtgatgggactttcggcgcgcatcttcggcgtgaacagctgggcgatcctggcgccgcaggcgctgatgggcgtggccagcgtcttcctgctctacctcgcggtgaagcgctggttcgggcacggggcgggactgctggccggggcggccctggctctcaccccggtggcggtgctgatgttccggtacgacaacccggacgccctgctggtgctgctgatgacggccgccgcgtacaccaccgtgcgggccaccgaggtggccagcgggaagtcgctggcctggaccggcgtgctgctgggcttcggctttctgaccaagatgatgcaggccttcctggtgctgccggcgatggcgctggtctatctggtggccgccccggcgccgctgggcaggcgcttcagacatctgtcgctggccggcctcgccctggtcgcctcggcgggctggttcgtggcgctcgtctccctctggccggcgtcgtcgcggccctacatcgccggttccaccaacaacacgctgtgggaactcgccctcggctacaacggtctcggtcggatcctcggcggcgcgggcaacggcggcggaggcgggggcggcgggggtaacgtcgggttcggcggggcgaccggcatcgggcggctgttcggcacgtcgatgggtaccgagatctcctggctgctgccagccgcgctgatcgcgctggtcaccgtgctcgcggcgacctggaccgcaccgcgcaccgaccgggcgcgcgccgcgatgctgctctggggtggctggctgctggtgaccggggtgacgttctcgtacatgagcggcaccatccacccgtactacacgatcgccctcgcaccgtcgatcgcggcggtgaccggaatcggcgcccgggtgctctggctctaccgcacccggctgtggggccggatcgtgctggcggcgatggtgctggccaccgccgcgtggggcttcgtgctgctcggccgcaccgactggctgccggcgctgcgctgggcggcggtcgtcgccggggtggtcgcggccgccgggctgatcgtgccggccgtcgcgctgcgccggctcgccgtgatcggcatcgtcgcggggctgctgtcggccgggctcggcagcgcggcttacgcgaccgccacggtcggcgtcgcccatacgggctccattcccagctccggaccgtccggaagctccgggatgggcggtggtccgggcggcggcggattcggccgtacgggtgacggggcgccgcccgcgggcaatgcccccgcccagccctccccgtccgcgtcctcctccaccgcgtccgcctcgccgtctgcgcccttccccgggggcgggggcatgggccggggtggtggcgccgacaccgagctgaccgccctgctcaaggcgagcaccaccacgtggtcggccgcggtcagtggcgcgacctcggccgccgacctggagctggcctcgggtacctcggtgatcgcactgggcggctggaacggcagcgatccctcccccaccctcgccgagttccagacgtacgtgaagtccggccggatccattactacatcgccggcggcgtgggtggcggcggggggatgggcggcggttcgaccgactcgtcgcagatcgcctcctgggtgaccgcgaactacccggcgaccacggtcggcggcagcaccgtctacgacctgtcctga

SEQ ID NO: 103 - DNA, 1629 bp, Actinoplanes utahensis
atgagcgaacacgtttccgacagtgccgagtggcaggcgctccagggctacgcggagaagttctcggcggtccacctgcgcgacctgttcgccagcgacccgcagcgtggcgagcggtatgccgcggaggtcgccggcctctacgtcgactacagcaagaacctggtcaccgacgaggtgctgagcgcgctgttcgcgctggccggccgggcgaaactgaatgagcggatcgccgcgatgttcgccggcgagcacatcaacgtcaccgaggaccgtgccgtgctgcacaccgcgctgcggctgccgcgcgacgcgacgctggtggtcgacgggcaggacgtggtcgccgacgtgcacgaggtcctcgaccggatgggcgcgttcgccgacaaggtgcgctccggtgagtgggtcgggcacaccggccagcggatcaggaccgtggtgaacatcgggatcggcgggtccgacctgggcccggtcatggcgtacgaggcgctcaaggacttctcgcagcgtgacatcgagtgccggttcgtgtccaacatcgacccgaccgacctgtacgagaagacgcgcgacctcgaccccgcctcgacgctgttcatcatcgtctccaagacgttcaccacccaggagacgttgaccaacgcgcgcgaggcccggtcgtggctgctggcctcgctgagcgacgaggcggccgtcgccaagcacttcgtcgccgtcagtacgaatgctgaaaaagtcgctgatttcggtattgacaccgacaatatgttcgggttctgggactgggtgggcggccgctactcgctcccgtccgcggtcggcctgtcggtgatgatctcgatcggcaaggagcggttcgccgagatgctcgccggctaccacgccgtcgacgagcacttccggacgacgccggttgagcgcaacgtcccggccctgctcggtctgatcaacgtctggtacgacacgttcctcggcgcgcagtcgcacgccgtcctgccgtacgcgcagtacctgcaccgcttcgccgcctacctgcagcagctgaccatggagagcaacggcaagtcggtgcggctctccggcgacccggtcagcttccagaccggcgagatcttctggggcgagcccggcaccaacgggcagcacgccttctaccagctgatccaccaggggacgaagctgatcccggcggacttcatcggtttcagcgaaccgaaccacgacatcggtgagatgcacgacctgttcatgtccaacttcctggcgcagaccggcgcgctcgccttcggccggacgctggagcaggtgcaggccgagggaacgaagccggaggtcgcgccgcaccgggtgatgcagggcaaccacccgaccaccacgatcctcgccgagtcgctgacgccgggcacgttcgggcagctggtggcgctctacgagcacatcacgttcacccagggcgtgatctgggagatcaactcgttcgaccagtggggtgtcgagctcggcaaggtgatggccaaccagctcgcaccgaagctgaccgcggccgagtcgcctgccgacgacgccgactcgtcgacgaacacgctgatcaagcggtaccgggccgcgcgcggccgctga

SEQ ID NO: 104 - DNA, 1047 bp, Actinoplanes utahensis
atgaccagccttctgctggggtcggtcaccaggtcctcggttctggacatcaccgagtggttcggcgccctgcaggcgcaggatctcaacagcgtgctgtggtcactcggcgcccggctgcgcggcagcaccctgcccgagatcgtcgccgccaccgagaaccgcgacgtggtgcgcacctggccgatgcgcggcacggtgcacctcgtcccgtccgccgacgcgcactggatgctggagctgaccggcgtgcgcgcgctggccggcgcggcgaaacgccgcgagatcctgggcctggccgaggcggacgcggaccgggcggcggagatcctcggcgcggccctcgcgggtggcggccgcctcacccggtcggcctgtgtggccaccatcaatgcgggtggcgtcccggtcagcggccagctcggctaccacctgttgtggtacgcgagccagcgcggcgtcacggcgatcgccccgaacgagggttccgagcagaccttcgtgctgctcgacgagtgggcgcccacgcggaacgcgccgagccgtgaggaggcgctgggcatcctcgcccatcggtatttccgcagccacggccccaccacggcgaaggatttcgccggctggacgatgctgccgatgaaggacgcccgggccggcatcgccacggccggtctccgccgggtcgaggtcgacggcgtcgagatgtgggcggatccggccgtgctcgacgccgggccggtgcgcggctggcgcgccctgcccggcttcgacgagtacatgctgggctacaaggaccgcgcgatgatggccaccccggagatgctcaggagcatcatccccggcggcaacggcatcttccagtccactctggtccgtgacggcagggtgatggcggtgtggaaacgcacgctcggcaggaaggcggtctcgatcaccgtctcaccgctggtcgagttcaccgccggggactggatgcaggccgaggaggcgctgcagccgtatggggcttttgtcggccttccagtgactgtaaagaaacttgcttaa

SEQ ID NO: 105 - DNA, 1311 bp, Actinoplanes utahensis
atgcgtgttcgccgccaggtgctggcattgatcgccggggtgggggtggcactcggcacgacggtgatctactcgaccaccggtgaagcggccgtggcctgctccgccacggtctgggcggagggggtgacctacaccgccgggcagcaggtgacctaccagtccaagctctaccaggcgctggtcacccacaccgcctacgcgggcaccgggtggaacccggccgcgacgccgacactgtggaaggagctggggggctgcagcggtggatcgacgccgacaccgaccccgtctgtgaccaccacctcgccgagcccgacgacatcaccgacgcccacacccacggcgaccggtgggaccggctgcgccaccaagggccgcccggccggcaaggtcctgcagggctactgggagaactgggacggcgcgtccaacggcgtgcaccccgggctcggctggatcccggtcaacgacacccggatcacccagcacggctacaacgtgctgatggccgccttcccggtgatccgctccgacgggacggtgctctgggagaacggcatggacgccggcgtcaaggtgcccacccccgccgagatctgcgcggccaaggcgcagggcgccaccgtgctgatgtcgatcggcggcgcggcggccggcatcgacctgagctccagcgcggtggccgacaggttcgtcgccaccatcgtgccgatcctgaaggcgaacaacttcgacggcatcgacatcgacatcgagaccggcctgtccggcagcggcagcatcagcacgctctccacctcgcaggccaacctgatccggatcatcgacggtgtgctcgcccagatgccggccaacttcggcctgaccatggcgccggagacggcgtacgtgaccggtggcagcgtcacctacggctcgatctggggctcgtacctgccgatcatcaagaagtacctggacaacggccgcctctggtggctgaacatgcagtactacaacggcagcatgtacgggtgttccggcgactcctactcggccggcaccgtgcagggcttcaccgtgcagacccagtgcctgaacaacggcatcaccatccagggcgtcaccgtcaaggtcccgtatgacaagcaggtcccggggctgcccgcccagtccggcgcgggcggcggctacatgacgccggcgttggtcagccaggcgtacaactcggtgccgtcgatcaagggcctgatgacctggtcgatcaactgggacgggtcgaagggctggaccttcggcgacaacgtcaaggccctgcagggtcgctga

SEQ ID NO: 106 - DNA, 558 bp, Actinoplanes utahensis
gtggcacggctgatctgcaccggcatcacctccctggacggctacatcgccgacgagcggggaaatttcgactggagccgaccggacgaggaggtgcactcgttcgtcaacgacctggaacgcccgatcgggacgtatctgtacggccgccggctgtacgaggtgatgcgcttctgggaggacgcggaagcccggccggattcgacgcccgcgaccgtcgactatgcgcgggtgtggcgggccgccgacaaggtcgtctattcgacgacgctggccgaggtgaccacggcccgcacccggctggagcgggtcttcgacccggaggtggtgcggaaggcgaaggaggccgccgaccgcgatctgagcatcggcggcccacatctggcggcgcacgcgttccgcgccggcctggtcgacgaggtgcagctgttcgtctcgccgatcgcggtgggcggcggcacccggttcctgccggacggcgtacgcctggatctcaagctggccgagcagcgccgattcgccaacggcgtcgtctacctgcgataccgcgcgtcctga

SEQ ID NO: 107 - DNA, 2070 bp, Actinoplanes utahensis
atggcattccgggatcgacgactgcctgtcccggctagtggatcacccctgctcatgccggatgcggaggtgtctcggcgaagcggtcgacggcggatcagaaacggtcaccggagaaagaagatcaattccggaaagggtacggggatggccgatcaggaggcactcggccgcgagtatctgctgcacgaggaaatcgggcgcggggcactcgcggtcgtccggcgagccacccgccgctccggcgggccaccgctggccgctaagctgctgcaccccgagctggccagcgatcggcggatccgcgagtcgttcctgcgcgaggaggccgcgctgcgccatctcgaccatccgggcatcgtcggcttccatgacctggtcgtcgagggcggcaccctggccctgttgatggacctggtcgacggtcccgatctgcgccgccacctggcccaccgcggcggccggctgggcgccgcggagaccgccgtgatcgtcgggcaggcagccgaggcggtcgccgcggcgcaccggcgaggcgtcgtgcatctcgacctcaaaccggagaaccttctagtcgtccgcgataccggccccgccgtggtccgggtgaccgacttcgggctcgcggtgctgctgatggacgcggcgcgtggggtggccgggggcacgcccggctacaccgcgccggagatctggcagggtgcgacgccgaccgcggccgccgatgtgtactcgctcgggatcctcctggtcgagctgatcaccggtcacgtcggcggggatccggacgcactgcccgagcggctggccgggccggcccggtcctgccttgccccggatccgcgcgaccggcccgccgcggaacaggtggggggatatctgcgggcgctcgtggcctcgggtgtgctggggccgccgccaccggtcgtggcggagggcgaggcgggggatgtgcccgatccggtgtctcggcggacgacggtgcgcggggccgggagcgtcggatcgccgggggcgggaggcggcgccggcgcggccgtcgatccggagcactccgggatctgggtcgggcagctggccggtggggtgccgttgggtgggtttttggcgggggcgccgccacagggcgggtttttggccgggacaccggcgcagggtgggtttttggcgggggcgccgccacagggcaggttcctggccgggacaccggcacagggtgggcttctggccggggcgccgccacagggcgggttcctggccgggacaccggcacagggtgggcttctggccggggcgccgccgcggggtggtggcgggccgagggtcccggcggccgggctcggcgggacggggctggtcgcggaggcgccgccgaggcggcgtgaggggcgggggatgctggtcgcggccggggtgctggcggtcgtcgcggcggggatggtcggactcgggatcgccaaggtggtcggggaccggtcccatccggcggccgcggtcccggtgagcagcgccccggcggtgacaccgagcgcgggggccggcggggtgctgccgcccaccgagcaggtgcgggccagtgcgagcgccgcgccggtgcgggtcacgctcgccggatatgcggcggacgacggcgggacgctggcgttgtcgatccgggacgggacggcgatcgcgtacatctgtgacgggaacacccgggaggcctggctgcaggggaccgcggtggacgggcggctggcgctgtccggtacgggcggggcgcgaatcaccgggacgttcgacgcgctcggggcgacgggaaaggtgaccgtggccggcgggacgcatgcgttcacgctccggccggtgcagaagccgtccgggctctaccggacgtccgccaaggtgcgtggcgcgcggatccaggggtcctggatcgtcctgccggacgggcggcaggtgggggtgctgaccgacggcggccgcaccgggccggcaccgaggttcgacgtcgccggcggcaccgccacggtcgatggggtggcggtggcggtgaccgcggtcgacgtggacagcggcgcgggcttctga

SEQ ID NO: 108 - DNA, 1116 bp, Actinoplanes utahensis
atgcaattcggcatcttcagcgtcagcgacatcaccgccgaccccaccaccgggaagaccccgaccgaggcccagcggatcaaggacatcgtcaccatcgccaagcacgccgagcaggcgggcctggacgtcttcgcgctcggcgagcaccacaacgagccgttcttctcctcgtcgccgaccaccaccctcgcctacatcgccgcgcagaccacgacgctgcagctgagcaccgcgacgacgctgatcaccacgaacgacccggtgaagatcgccgaggacttcgcgatgctgcagcacctggcggacgggcgggtcgacctgatgctcgggcgcggcaacaccgggccggtctacccgtggttcggcaaggacatccgggccggcatcccgttggcgatcgagaactacgcgctgctgcaccggctgtggcgcgagcacaccgtcgactgggagggcaagttccgtacgccgctgcagtcgttcacctcgacgccgcgtccgctcgatgacgtcccgccgttcgtctggcacggttcgatccgcagtccgcagatcgccgagcaggccgcgtactacggtgacggcttcttcgccaaccacatcttctggccggcgtcgcacacccagcggatgatcgcgctgtaccgcgagcggttcgcgcactacgggcacggcgacccggaccaggccatcgtcggcctcggcggccaggtgttcatgcgcagaaacagccaggacgcggtcaacgagttccggccgtacttcgacaacgccccggtctacggccacgggccgtcactcgaagacttcacccgggagacgccgctgaccgtcggcagcccgcagcaggtgatcgagcggaccctcaagttccgcgactatgtcggtgactaccagcggcagctgttcctggtcgaccacgccggcctgccgctgaaaaccgtcctcgagcagctcgacctgctcggccaggaggtcatcccggtgctgcgcaaggagttcgcggcgctcaagccggcccacgtgccggacgcgccgacccacgccgcactggtcgccgccaagaacgccgccgaggccgccgtgaccgagaaggtggaggtgcaggcatga

SEQ ID NO: 109 - DNA, 615 bp, Actinoplanes utahensis
atgaagcagcgcagcctcgtcgtgatcagcgccggcctgagccagccgtcgtcgacccgcctgctcgcggaccagctgtccgcggcagcggaccgggccgccacccggatcggcgtccagctcgacatccaggtgatcgagctccgcgacctggcgcacgagatcaccgaccatctgctgaccggtttcccgccggccgctctccggcaggcgcaggatgcggtcgccgccgccgacgcgctgatcaccgtcactccggtgttcagcgcgagctacagcggcctgttcaagtcgttcttcgacgtgctcgaaaaggacgcgctggccgacaagccggtgctgctcgccgcgacggccggcaccgcccggcactcgttggtgctggagcacgcgctgcgaccgctgttcgcctacctccgcgcggtgccggtgcccaccgcggtcttcgcggccagcgacgactggggtgccaactcggtggagggcccgctgcgcggccggatcgagcgcgccgccaccgaactggcgcgcgaactcgaccggcgcgaaccggtgacggtcgtcgatccgttcgccctcaccgagtccttcgaggacatgctgaaaaccctttag

SEQ ID NO: 110 - DNA, 546 bp, Actinoplanes utahensis
gtgacctatggaccgccgcagcagcagccgaacccaccgcagcccgccgcgccgaaaaaaaagcccagcggcaagctgatcctgggcatcctcgtcggggtggtgttgctctgctgcggaggcggcgtcaccgcgatcaacgccttcaccggcgactccggcagcaccaaggcgggcgggaccagcacgagcggtgcgcccgcggacgcggtcgtcgtcgcggccgccggctcgccgtccgcgggggtctcggccgcgtccagcccggcgccggtcaccgccaagccgaaaccgaccgccgcaccgaccacgagaacccccgccgcaaaaccggcgacgaccggcaccaggccggccccgccgaagacgaccagaccgaggaccaccaagccgacgaccaaagctccgaccacggccccaccgcagtcgggagtgcatccgggagcgttctgctccccggagggcgcgtacggcaccaccagcgccggcactctgatgcgctgcaccagcaagaacggcgaccgaccccgctggcgcagagcctga

SEQ ID NO: 111 - DNA, 612 bp, Actinoplanes utahensis
atggggcgccggggcgggttgtcccgggtggtgggtcggggggttgacacactctgcgcgtcgacaacggcacgctttgttgttcaagctgttcgggtgggcacgtccaccccggtccagccgttggcggatctcccggacggcgagccgcctgtggtccggcggcatctcgtcgtgctgccgcgcgggcgtcggccggccggcccggcccccgaggcggcgctccggcatctgatcgccatcccgcgcgaacgccccgacacgccgccggcggtcgaccggcgcacggtgccgatcgatggcggcgtccggactcggcccgcggacctcagcgtctccagcctgacgggctccggcctgacgggctccggcgcggcggcctccggcgtggcgggctccggcgtggtggcccctcggctgccggtcggtgactcgggagtctctcgcctggcggtctccgagctgacaggggcttccgggccggtccgctcgaagcggtggtcggtggtcgcggtggtggtttcggtgggaatgctggtgctgttctgcgcgggcgtggcagccgtgaccgtacggctaagtgtgcttcttgttgctctgcgtagcgattga

SEQ ID NO: 112 - DNA, 630 bp, Actinoplanes utahensis
atgaccatgaccggcgcacggggaccggccttggcggaacggcctcgagccgacctgcccgtgacaccgctgacgtggcagcggaccgacacggtcggcaccgagctggtgttcccgcgcggttcgcggccacacggctcggcgatcgtggcgggcgcacgggcgtactcgctgacctggcaggcggaggtcacgtcgacgtccgaggtgacgtcgctgcatgtcacgtcgcagggcgacgggtggagccgggagctgtggctggaccgcggcgcgagcgggtggacctgccgggcggaacacgccggggatgccggtgacctgccgtccgccggtgccgagcagcgggacgcgctcgacccgcgggcggttctgcgcctcgccgactcgccgatcttcgtcgcctgggcggtgcgtggcctcggcctgacggtgaagtccggcccggtcaccgtcccggcgatccgggtgcaggtgccctcgctggcggtgctgcccggcacggtcacctaccacctggtcagcccgcagcgcctgcggatcaccggcgactggccggcgtccaccttcgagctcgacgctgccggcatggcggtctaccaggccggtcacctccgcctggcccgctga

SEQ ID NO: 113 - DNA, 1032 bp, Actinoplanes utahensis
atgatcaggtcggcgaggttgacggcgcttccagccgtcgcggtaggtggggcggcgctgtgggcgtacggcatcgcagtgctgcaaccgctcaccgagccggactcccgttggtgggagatggcacagaactcgtcgtactgggctcgtgacctgcggtggggcgcaatcgtggcgtcgtgtctcgccctcatcgtgctggctggtggcgctcggtggcccacgcgtggggtggctgccggtggcgtcggctggatcgtggtggatctgctgatggaccgcgccgacccgggccgacccgcactgccactcacactgggcgtcggtgtccttgtggtggccacggccgccgtcgtctgcacgcgatgtgggcgccgcacctcactgagacctccggtgttgcgtaccgtcgcagtgatcggcgtgctgagtgcgatcagtatgctcggcgtgggttcgccgagcggcggcgagccgcagctgccgccgacccggctggccgtggtgctgctgcacatcgtgctcgcttggatcgcgaccctgactgcggcagcaccggttgccgcgagtcgggctgcggcgacgacgggagtggcgctggggtgggtggtgctgacggtcttctttgcgcacagtcctccagatgctctggtttggctactcctcgcggggtcgggcctgtttgtcgccgggatctggtcggtgggccatccgtccgcacccgccggcttgagggccgcggtcacgatttcgggcgcgctgatcatcccgatcatgtgcatggtgatcggctacgcgacgatcatcatcgggccggacatgacgcggatggcgggcaacgagtctctcaacggggacgaggacatgctcctcggcttggccggggtgctggcaggattggccgtggcctggtgtgggcgcgcggtcagcaggttgttcgccatgtcaccgcagggttgccggtccgcggaagcggggcccgatgacggcggcgttcaggtgacactgaccctgcccgtcggtgacacgtag

SEQ ID NO: 114 - DNA, 594 bp, Actinoplanes utahensis
gtgccgcgtgtgtccgaagcccacctcgccgcccgccgtcagcagatcctcgatgcggcggtgcgttgtttcgtgcggaacgggttccatcagacgtcgatgcaggatgtgatcaaggaagcggatctgtcggtcggcgcgttctaccgctacttcaagagcaagaacgagctgatcatggcgatcgccggcatcaagatcggcgaggtcaccgggattctggacaacctgctcgcggcggatcccatgccgccgctcccggccttcctggacgcggtgatcggacaggtggaggcgaccctgcaggccgaccagacggtgcggatcgcgatccagatctggggtgaggccacctacgacgacgaggtcgccgaggtggtgcgcgacgtctaccgccggatcagggaacggatggtgcggaccgccgagcgcgccagggccaccggacagctgccgccgggcgcggatgccaccgctgtcggtgcggccatcttcgggctggtgcagggttacatcctgcagcggatcctggtcggtcaggtcgaccgcgagacgtatgtcgccggcgtccgggccctgatgaccccggcctga

SEQ ID NO: 115 - DNA, 654 bp, Actinoplanes utahensis
ttggaaccccgcgacccggagacccgggccggcttggaaccccgcgacccggagacccgggccggcttggaatcccgcgacccggagacccgggccgctgcggagcgccggccgcagcgtccccgcgatccggaagcgcgccgcgccgccctggccgccgccaccatggagatcatcgccgaggcgggggtcggacggaccacccaccgcgccgtcgccgcccgggccggactcccgctcggcgcgacgacctactacttccccactctcgacgacctgatcgccgccggcctgcggtactcgtgcgacgcgatgcgggccgacctggacgtgtggtccacccgcctcgcggccgcaccggacatgccggccgagctgaccgcactgaccgcggaatacctgcaggaccggcggcaggtccgcatcgagtacgagctgtgcatggccgccgcgcgcgacgcccggctgcgggcactcgccgaaacctggatggacggactccccgagatcctccacccgtgggtcggcgagcccgcggcgcgcgacatctgcgccctgctggacggcatcatcctgcgcgccctggtcaccgagaccgagctggacgctccgggcctgacagcagccatccgccgcctgatcccgccggcctga

SEQ ID NO: 116 - DNA, 330 bp, Actinoplanes utahensis
gtgcggtacgtcctcctcgccgtcgccatcggcagcgaactcttcgccaccagcatgatgaaagccaccgacgggttctcccggctctggcccaccctcgtcgtcctcgccgggtacggagtgtccttcgtggccctctcccaggcgatcaagggcggcatccaggtcggcatcgcctacgccatctggtccgcggtcggcaccgcggccatcgtggtgatcggggccttgttcctcgacgagccggtcaccctcgctaaggtgggcggcatcaccctgatcattgccggagtcgtgatgctcaacctgaccggcgcggaagcgcattga

SEQ ID NO: 117 - DNA, 384 bp, Actinoplanes utahensis
atgaccgcagtcgcgaacccggccaccgttgaggaatgtctgcgggtgggcgccggcttcacccagggtgaccggaactggatcgccgagcagttcggcccgctcgacgcccgtctcgccgcgttccacgccgacgccaccgagctggagatcacggtgaaggaccgcgaggcgcgcggccagaaggtgaccctggagtgctggatcggcggccgggagaagatcgtcaccacgtcctcggaggaggacctgcacgccgcgatcatggacgtccgcgacgacctgcggcgccggctcaacgacgcgaagaccaagcaggagccgcgccacaaccggcacctgcgggaggtccccgaggtcgtcgtggacgaagacccgatctag

SEQ ID NO: 118 - DNA, 594 bp, Actinoplanes utahensis
atgcgaccctaccggccggccgacctgcccgccctctacgacatctgtgtgcgcaccgccgacctcggcggcgacgcccgcgggaagtactccaccgacgcgctgatgggcgacctgttcgccggcccgtacgccgtcctggaaccggatctggcgttcgtgctggacgacggcggccgggcggtcggctatgtggtggggaccgcggacaccgcgtcgttcgtcagacgctaccgcgaggagtggatcccgcggctggccggcaggtatccggtgccgccgcccccgccgcgcacgcccgagcaggacatggtggcgctgcactaccggccggagcggatgatcgtgccggagctggccgaccaccccgcgcacctgcacatcgacctgctgccgccctaccagcgacgggggtatgggcggcagctgatcgacgcgctcagcgcggcggcggcccgggccggcgcgaccggggtgcacctcggcatggtgaccgagaatgttcgcgctcggccgttctacgaccggatgggattcacggtgcttccggtccctgacccggggccgttgacgtacctcggcaagcgtctctag

SEQ ID NO: 119 - DNA, 1380 bp, Actinoplanes utahensis
gtgcgccgccgcggcacgccaccccggacgagctggcaacgccgagcgggcgggtgcggcaccgaggttcggcgagtgcgacctggcgctgtggccgttcagctggctggtgcacgtgtggtcggcgccgctcgcccgctcctggcggccgtacgtcgtccgccgcgccccgccggccccggccgtgatccgggactcgcgccggagagtatagggtcggtccatgacgacgctcgacgggcgggacgccacggcactgctggtcatcgacgtgcagaacggggtggtgggcgagacctcggtcaaccgggacacggtgatcgccaacatcgccaccctggtcggcaaggcgcgcgccgaggcggtgccggtgatctgggtgcagcactccgacgacgacctgccgttcggcagcgagcagtgggcctacgtgccggagctgccccaggccggcggggagccggtggtgcacaagaggttcggcgactccttcgaggcgaccgacctggaggagcggctcgccgaacgcggtgtcggccggctcgtggtggccggtgcgcagtccgacgcgtgcatccggtcgaccatccacggcgccttcacccggggctacgacgtgctgctggtcagcgacgcgcacaccaccgaggacctgaccgagtggggcgcgcccgacccggcgaccgtggtgtcgttcaccaacctgtactggagcgggcaggccgcacccggccgggtcgccggcaccgcgccgaccgccgaggtcgacttcgccggggccgccgcgtgaccggtggcaacgagtggctgcgccggagcgccgaggatcccgggcactcacagtggtacatcaagcggttccgggacatggcggcccaaggcgccgatctggccggtgaggcccggctggtcgacaccctggtgccgcggggcgcgcggatcctggacgccgggtgcgggccggggcgggtcggcgggttcctggcgagcctgggtcacgacgtgaccggggtggacctcgacccggagctgatcgaggcggcgatcgccgatcaccccgggccgcagtggctggtgggtgacctgtccgagctgaagctgccgggggtgccgttcgacgcgatcgtctgcgcggggaacgtgatgaccttcgcggcgccggacacccgggtggagatcatccgacggttcggcgagcacctggcgccttccgggcgggtggcggtcgggttcggggccggccgcggctatccgttcgacgaattcctggccgacgtgaccactgccggcctcgccgctgacctgctgctgagcacgtgggatctgcgcccgttcacgccctcggcccagttcctggtcgcgctgctccgccacccttag

SEQ ID NO: 120 - DNA, 1458 bp, Actinoplanes utahensis
gtgacacacctgagcaccgggcaccctgacctcgacctgattctgggcggcggcctgcgacgcggatcggtcgtcgtcctggccggtccgcccggcaccggcaagaccgtcctggcgcaacagatctgtttcgccgtggccaccggtgagcacaaggccatctactacaccaccctgtcggagccgcacgccaaactcgtcgaacaccttcacgacttcaccttcttcgacgcgggctcgctgggcccgcgggtcgagtacgtgcacctcggcgacatgctgcgtgggcaccaggcggccggcctggacccggtcatcgacgaggtggtccgcaaggcgctcgacgacgagccggcgttgctggtcgtcgacagcaccatgatgctgcgcgacttcgtcagcgatcgggccttgcgcacctccctgtacgacttgaccagccgcgtcgcccacagcggagccgtcctgctgctgcttggcgagtacagcgacgcggacatgcagtcgggcatcgaattcactctggccgacggcatcatcgcgctctcccaccagatccgggagccggtcgaccggcgcactctgcgcgtcatcaagatgcgcggcgccgcaccgctcggtggcgcccacaccctgcacatcaccgacgacggtatccgcgtctacccgcgcatcgagtccttcctgcccaccgacatgccgggccgcggtgcgcggatatcgtccggtattcccggcttggacgacctgatgggcggcggcattcccgacggggacggcaccgtcgtactcggcccgaccggagtcggcaagaccatcggctgtctcagctttctcgccgagggcctcgcgcagggccagcggtgcctctacgtcaccttccaggacaccgtcgaggagctgaaggagatggccggccggttcggctgggacttcgccgccgccgaggaacgggatcagctggtcatcgcccacgtcccggtcggcgcgctcgatctcgatctggacgtgctctcgtcgatgattcggcacagcttcgacgacggatcggtccggcgggtggtcatcgacagtctcgccgagatggcccacgccgcccgcgaggcccagcggtttcccgcatacctgcgcagcatgctcgccgtcgtccggtccgccggcgcctcactctgggtgaccagcgagacgcagctgttcggccacgtcgatgatccgctcaccggtctgatgtatctgttccacaacgtcatccaggtgcgctacatcgaggaatgcgccgcggccggccgcttcctcaacgtcgtcaagatgcgcaacagccgccatgacaacgccatgtaccgctgccacatcgccgatcagggtggcctcaccgtgggcgagcggctcgagcaggcgaccggactactcggctgggacgcgccgcgcaactgccttccccccggccgcgacagctga

SEQ ID NO: 121 - DNA, 360 bp, Actinoplanes utahensis
gtgggcacgatcttggtcgtcgacgacgaaccggacctgcgtttcctggccaaacggattctcacgcgagccggccatcaggtcatcgccgcgggcaacggcgccgacgcgttggaggcggttcgacaggtccggccggacctcgtggtgaccgacatgatgatgccggtcatgaacggtgtggagctcattcgccggttacgtgccgacccggtcaccgcgggcatcccgatcttggcggccagctcggactggcatctcgccgtcgaagcagacgccgctctcgccaaaccctacggacgggccgatctggtcgaggcagccgaacgtcttctccgggaaggaagtgaccggcggtga

SEQ ID NO: 122 - DNA, 270 bp, Actinoplanes utahensis
gtgctgtttcgctcacgtccgccttcacgatctggtcgccatggccgaggctcggccacctcccaggcgttgcgccacggtcggattcgcggtcaacttctgggcctgggcgctgctcagcccgctcgccgttcctcggcctggccgggcacagctcgctcacgcttccagtcgtacgcgtggggcttcgtcctgctcggcatggtggccccggcggcgctgctgctggacgtgttcgcggtcaggcgccccgccaccgcccgggcctga

SEQ ID NO: 123 - DNA, 762 bp, Actinoplanes utahensis
atgaccctctacttcgacctgccgcgcaccacacccgtcgcggccgatccgaccccgtggcgtgactaccgcccgtcaccgcgactggtgcacacggcggtcggcagcggcctgctcaccgttctcgtcgcggcggccggcgggtggtcgctgctgctcggcgaaggggcggcggcggtcgcctgcacgatcgcgacgctcgtgctcgggcacctgtccgggctgctgctgcacctgtgggtgcggccgtacaacaccggcgaccggatgcggatcgccgccgccggcgacggcagccccggcctgaccttccggtactcggggcggctctactactggtacggcggcttcctcggactgctgaccatcgcccaactcggcctggcggtcacggtgtggccgttcgccgcgggagccctgctcagcggcgccgcgctggtcatgctgtcacggcacgccccgggccggctcaccctcaccccggacggggtccaccaccacggcatccggcaccagcgcttcctgccctgggagtcgatcagcgacatcctgcccggcgaacaggcccacatcccgatcatcgccgcccccaccaccgggggacagccgcacctgaccatccaggtgccctggctggacaccgacccggccctggtcctgcaggcccttcgctggtaccacgccaacccggtccaccgcttcgaactctcctaccacatagcctgcgaccgcacccgacagcgcgcctggcacctccactga

SEQ ID NO: 124 - DNA, 1689 bp, Actinoplanes utahensis
atgttgaactccttgagccgtcgagccgcggtcgccgcggccgccgtgctggccctcgcggccgccggctgctcgggcgacagcggcaccagatccaccggcggcaacgccgggaccagcgccatcaccattttcaacgggtccaccggcacgatcgtcgagaactggaacccgttcacgccgaccttcctgcagcccaccaacggcctcatctacgagccgctgtactggtacaacttcgccgccgagtcgaagccgacgccgatgctggccaccggctactcctgggacaccgccggcagcgctctgacgatcaccacccgggacggcgtcaagtggtccgacgggcaggcgttctcggccagggacgtggcgtacacgttcgagctgatccggcagaacaaggcgctcaactccaccggcgtcaagctcgcctcggcggtcgccaaggacgacaggaccgcggtgctgaccttcgagaagccgtcgttcaccgacgaggccgcggtcatcgcgaacaccccgatcatcgccgagcacgtgtggagcaggatctccgacccggccaagacgatcaacccgaacccggtcgggaccggcccgtacaagctcaagaccttctccgcgcagagctacgtgatggagaagaacccgtactactggcagcccggcaagccgcagatccagaacgtccgctacatcgcgctggccaccgcggacgccgcgagcgccgcactgaccgccggccaggtcgactggatgagcgccttcctgcccggcctcgaccagctgctgaagaaccagaagaacctcagctacgtcaacaccccggcgatgaccacctcgatcttcacctgcgccggcgccgcgctgggctgcaagggaccgcagaccgacccggcggtgcgccaggcgatctactgggcgctcaaccgcgaccagctgaacaagctggccgggggcggcttcgcggagaccgcgtcgccgaccatgctgctgccgcagcgggacaggagctggatcgccgatcaggccgatgccaccgtgccgggcgcgccggacaccgcgaaggccgagcagctgctggacgcggccggctgggccaagggttccgacgggatccgcgccaagggcggccagaagctgtcgctgaccatccagacggtgaccggctggagtgactacatctcgctgaacgacgcgatgacccaggaactcaaggagatcggcatcgagctcaagccgacccagctgtcctggaacgagtggaacaacaaccaggtgcagggcaagttcgagctgtcgttggactcgatcggcctcggcgcgtcgccgaacccgtacgccacctacctgaagtactccagcaagaccaccgagaaggtcggcgagtcggcgccgccgagcggcaactacgcgcggtactcgaacccgaaggtggacgcggcggtcgacgcggcggcggccaccaacgacgaggcgacccagaaggcgcagtacgcgatcgtgcaggccgagatcgtcaaggacctgccgtacatccccatctacgtcaactcgatgctcaccgagttcaacaccagccacgccaccggctggccgtccaacgacaacaagtacgccctgcccgcctcctggaaacagtgggacaacggcatcgtgctgaccaacctgcagccggcgaagtag

SEQ ID NO: 125 - DNA, 990 bp, Actinoplanes utahensis
gtgcgccatctgcttcgcaaactggggttctacctggtcgccctcggggcggcgctgacggtgaacttcttcgtcccgcgcctgatgcccggcgacccggtcgacatcctgttgtcgaagctgggtcagcgcggcccggtcacccccgagatgcgcgcctcggtcgaggcgatgctcggcaccgacagcggcagaccgctgtggggccagtatctgcggtatctcgggaacctggcacacggagatctgggcgtctcggtgacgttctaccccgcgtcggtcggctcgatcatcgagcagaccctgccctggacgatcggcctgatcggtctcgccacggtgatctcgttcctggccggcgtcggtctcggcaccgtcgccggctggagacggggatcctggctggacaacctcgtcccggtcaccaccatgttccagtccgtgccgtacttctggctggcgctgatcctgctcttcgtcttcggcagcatctggccgctgttcccgctcaacggcggctacgacgtctacaccgtcacgcccggctggaacgccgcgttcgccggctcggtcgtctactacggcgcgttgccggcgatcaccatcatcctgtcctcggtgggtggctggatgctcggtatgcgcaacatgatggtgtccacgctgagcgaggactacatggtcaccgcggaggcgaaggggctgcgaccgggccggatgatgcggcgctacgcggcccgcaacgccatcctgccgtcggtctccggcttcgcgatctcgctcgggttcgtggtggccggctcgatcgtcaccgaggcggtcttctcctatcccggcatcggcaacgcgctgctgcaggcggtcggcagcaacgactacgccctcatgcagggcatcttcctggtcatcacgctgtccgtgctcggcgcgaacctgctggtcgacctcctgtactcggtcatcgatccgcgcacccgcgcccgggcctga

SEQ ID NO: 126 - DNA, 954 bp, Actinoplanes utahensis
atgacgatgaccacggaactcgccgagccgaccatccctcaagatcaaagtccgattgaagtacgccgattcacgcgcaaccggaagctcatcgcgggcctgaccctcggtggcgccatcgtctcgttcggtctgctcggcccgatcttctgccaggacccgtccctggtgcacgaccagggcctgaccggacccggcgccgagcactggctgggcaccacgcagaccggtcaggacgtcctcgcccagctcgcctacggcacccgcggctcgctggcggtcggcgcgatcgtcggtgtgctgacgctgatcctgtccaccttcttcggcgtcgtcggcgcctacgccggcggctgggtcgacgacctgttctccctgttcaccaacgtggtgctggtcatccccggcctgccgctggtgatcgtgatctccagctacgtcccggacaagagcatctggctggtctccctggtgctggcgatcaccagctgggccgggtcggcccgggtgctgcgcggctacacgctgagcctgcgcaaccgcgactacgtgctggccgctcgggtcgccggggagaaacgctggcgggtgctggccgtcgagatcctgcccaacctgatcccgctgctcgcctcccaggtgatcttcgcggtcatcttcgcgatcctcggcgaggccggtctgtcctacctgggtctcggcgccagcggctcgttcacctggggcaccatgctctactacgcgcagaacggcctggccctgcggctcggcgcctggtggtggttcgtgccgccgggtctgatgctggccctgttcggcgccgccctctcgctgatcaacttctcgatcgacgaggtgatcgaccccaggctgcgcaaccggacccgggccgcccgcaagagctggcggatgtcgtccgagcagctgtccaaggcgaaggaggccacgctgtga

SEQ ID NO: 127 - DNA, 873 bp, Actinoplanes utahensis
gtgacggtcctgagcatcgagaacttcagcgtggactatctcgtcgacccggtcgtgcacgccgtgaagaacgtcagcctcgaccttcagcggggcgaagtgctgggcctggcgggggagagcggctgcggcaagagcacattggcgtacggcatcatccgcctcctgaaaccgcccgcaatgatcacttccggccgggcggtgttccgctcccgtgcgggttgcgagaccgactggaacgccctggacgccgaagagctgcgggcgaaccggtgggagaagatctcgatggtcttccagggagcgatgaactcgctcaatccggtgatctcgatccgcgaccagttcgaggacgtcttcaccacccaccggcccgggatgggccgtagggagcgccggcagcgctgcgccgacctgctggaacgcgtcggcgtcgacccggcgcggctcacctcctacccgcacgaactgtccgggggcatgcggcagcgcgtcatgatcgcgatggcgatggcgctcgaaccgcaagtcatgatcatggatgagccgaccaccgcgctcgacgtggtcgtccagcgggagatcctccgggagatcacccggctgcgcgacgaactcggcttcgcggtcatcttcatcacccacgacctgccgctgctgctggagatcagcgaccggatcgcggtcatgcgcggcggcgagatcgtcgaactcggcgccgccgccgacctttacaccaccccgaagcacgaatacacccggcagctgctggcatcgttccccagcctcaccggcgaccgcggctccttcgtccgcggcgccatggacgaccggctgctcgcgctggacgcggtcgaagtggaggcgtcgtga

SEQ ID NO: 128 - DNA, 813 bp, Actinoplanes utahensis
gtgaccaccctcgaagtcagcgggctgggcaaggactaccggctgcgggacggctggcggaccagcacgctgcgcgccgtcgacgacgtcagcctcaccctcggtcacgggaagaccatcgccctggtcgggcagagtggcagcggcaaatcgacggtcgccagactgctcctgcagctggaacggcccagccgcggcgagatccggctcgacggcgaaccggtcggacggcgcggggcgggactcgcggcataccgccggaaggtgcagatggtcttccaggacccgttcgcatcactcaacccgtaccacaccatcggccatcatctggcccggccggtgcggctccaccatcggcggatcaccgacaccgacgtacgggcgaaagtcctggaactgctggaacgagtgcggctgaccccggcggacaccgtggcccggcgacggccccacgaactctccggcgggcagcggcaacgggtggcgatcgcccgcgcgctggcacccaggcccggcatcctcgtcgccgacgaaccggtctccatgctggacgtctccatccggctgggcgtgctcaacctgctggccgccctgcagcgggaagaggatctcggggtcctgtacataacccacgacctggccaccgcgcgccacttcgccgacgagatcctggtcatgtaccagggcgcgatcgtggaacgcggcccggccgacgacgtcatcctgaacccgcggcacgaatacacgaaaatgctcgccgaggcggcgcccaacccggaacggcggatcggggaactccgcgggacagtgtga

SEQ ID NO: 129 - DNA, 663 bp, Actinoplanes utahensis
atggatgtcatcggtgcgggattcggacgaaccggaacactgagcctcaaggtcgccctggaacggatcggcctggggccgtgcgcgcacatgctgccactgatcggggacgaggagcgctgccggctcttcacccgggcggcggccggcgagccgggcgcgctggatcgggccctggacggctaccgctcgacggtcgactggcccggcgtgtacttctggcgggaactcgtggaccggcacccgcgggccagggtggtgctgaccgtgcgggacccggacgactggtacgccagcgcggaacggaccatctgggccgcgtcccgacggccggcggcgcccgggctgacggcgatgcgggagatggtggacgcgaccaactgggtggggacgttcgacggacggttcggcgatcgggcgtacgccatcgaggtcttcaaccggcacaacgccgcggtgcgcgagacggtgcccgcggaacgacttctggaataccggatcggggacgggtgggagccgctctgcgccttcctcgggcggccggtgccggacgaggacttcccgcggctcaacgacaccgcggcgttccaggagcggctgagcggtctggggctctccgtcgatgccggtcgcacgcctacgggagcgacgaacggcaggtga

SEQ ID NO: 130 - DNA, 537 bp, Actinoplanes utahensis
gtggagggccgtcccgttccggtggtttcgtcacaccgccgagataccctcgtgatcggtgcgtcgcgggacgtcgccgacacgaccgacgatcatgagggacatgcgatgagcgactggaacacccaagtcatcgaggagttccgggccaacgagggccgggtcggcgggccgttcgccggggcgccgatggtcctcatccaccacaccggtcggaagaccggccgcgagtccgtcaccccgctcatgtacctgccggacgacaccgaccgggacaccatctacatcttcgcctcgaaagccggcgcgcccgacaaccccgcctggtatcacaacctgaccagcgcgggcagcaccaccgtcgaggtcggcaccgagacgtatgcggtgaccgtcaaggaactgaccggcccggagcgggacgagcgctacgccgagcaggcgcgtcgttaccccggcttcgcggagtacgagcagaagaccgccggcatccgcaccatccccgtcctgcagctcacccgggccgcctccgcctga

SEQ ID NO: 131 - DNA, 216 bp, Actinoplanes utahensis
atggctgaccggaacaacgccgaaccgaacggcgacaaccgggtgaaggatcctgacgactggagcaccggtgacgagccggcgaccggggcgcaggagtcctacctgcacacgctcgcgaccgaggcgcacgaggacgtgccggacgggctgaccaaggcggaggcttcgcgccgcatcgacgatctccaggagaagaccggccgcggccgctga

SEQ ID NO: 132 - DNA, 645 bp, Actinoplanes utahensis
atgagaatgttccgaatagtcctcgccgccgcggcgacggcggcctgcggactcaccggcgccgcgaaccttcccacccccgcgcacgccgccggacccggcgttccgacggcagcgcaccccgccgactctggcatctcgacggccgcgcacgccgcgcacgccgggcccgccgggcccgctgatccgcgaccggacgggctgcgattgaccggggcggaacggtcgatgctgctcgccgccacccgtcgtttccgcgacgtgcgggaggcggtccgggccggctacctgccgaccgacgattgtgtccccggcatgggcctgcactactcgaacccggccctggccgccgatcccaggatcgacccggaacacccggagattcttctctacgtccgcggcgaccatggccgggtgcatctggccggcctggagtattaccgaccggacgccgacggtgacctgcgtaccgacggcgaccggccggccctgttcggccaccggttcaacggaccgatgctcggccacccggtgccggtcggcgctccgcccatgccggtccattacgacctgcacgtctggctctacacccggaatccggccggcgagctcaccaccgacaacccggtgatcacctgtcactga

SEQ ID NO: 133 - DNA, 1431 bp, Actinoplanes utahensis
gtgagagaagcggtcggcgcgcccgcgccggcaggccggcccggccgtggtcgccgccccggcgcccgggagagcatcctcgacgccatccgcgcctgcgagcccctcagccgcgtcgagctcgccaagatcaccggcctgaccgaggccgcggtgtcgatgacggtccgtcggctcctcgaggagggtctggtcgtcgaaaccggccgcacgccgaccggcggcaaaccgcgcacgttgctgcagctggacccgaccgcccgcctggccgtcggcgtccacctcgacgaggacaccaccacctacgtcctcaccgggcagaccgggggtgtcatctcccgcctggcccgcccggccctccccgccatgtccgccacccgcaccggatccaccaccgggaccagcgccgggcccgcccccgcgcccaccgccgatcaacccgtgacggccgcgcccggatcgaccgcgtccggatccgccgcgcctggatcgaccacttccggacccgccacggccggaccagccacgaccggttccgtcacggcttccggcgatggggatcggctcggggacggggtggatctgctgctgcggactctggccgccgacatcgacacgctgctggccggttccggggtcgatccggcccggtgcctgggcgtcggcatcgtctggccggggccgcacagcggcggcccggccgacgacccgctgccccatctgcgcggcctgggcggcgacgaactgggcagccggctttccgccgccaccggctggccggtcctggtggagaacgacgccaccgccgccgcggtcggcgagtactgggtcgcccgggtcggcccggagcaggcgttcgccgccctctacatgggcggcgggatcggcgccggcatcgtcgtcgagggccgggcgatgcgcggcagtcacgccagcgccggcgaattcggtcacctatgcctggacgtcttcggcccggaatgctggtgtggcagccggggctgcctggaggttctggccggcccccgcacggtggtcagcgccgcccgcgacaatcgggtcgccgccgccgaagccggcctggacctgtcccagccgctccgcagcgtggccaccgagttcgccgccatcgcccgggccgcccgggccggcgccccgcactgccgcacgctgttggagacctcggcccgctacgtcgccgccgccgccgaaacggtcgtgaaccttctcgacatcgacctgctggtcctcaccggcccgggtttcgccgccgcctccgccatctacggcccggccatcatgcgccgcctggcccccgccgacgcccgcacctggcaccgcaacgtcaccgtcaccgtctccctggccgccgccaccgcctccgccaccggcgccgccgccctcgtcctgcagtcccaccttcgcgcctga

SEQ ID NO: 134 - DNA, 2478 bp, Actinoplanes utahensis
atgatcagaaccgacctgcactcgggctggaccgtgcgtgccgtgggcgggccggtgcccgcggagatcgccgccgggacggtgccggccacggtgcccggcacggtgcacaccgacctgctcgacgccgagctgatccccgatccgtacctcggggagaacgagtcgctgctggtctggttccaccgggcggcctggctctacgccaccaccctgcgggccgcgccggcggccccggacgagcgggtcgacctggtcttcgacggtctggacacggtcgccacgatcaccctgggcgacgccgagctgggccggaccgcgaacatgcaccgtggccaccggttcgacgtgcgggaccggctgcacggcgcgccgctgccgctgtcggtccggttcgactccgcgctggactatgccgagcggctgcagaaggtgatcggggaacgcccccggccctatccgcacccgttcaacgcggtccgcaagatggcctgctcgttcggctgggactgggggcccgacctgcagaccgccggtatctggaagccggtgcgcctggagcgctggcgggtggcacggctcgcctcggtgcgtccgctggccacggtggacgcggacggccgtaccggcaagtgccgcatctccatcgaggtggagcgatccgggctcgcggccgcgaccgcgctgaccgccgaggtcgcggtcgggtcgcagaccgtgccggtcacgctcccggcgacggccgacgcggtgacgaccgagatcaccgtgcccgacgcgccggtctggtggccggtcggctacggcgaccagccgctcgtcgacgtgcgcgtggtgctgcgcgacggcgacggcgacctcgacgtgttcgacacccgggtcggcttccggacggtgacgctggacgagacgccggacgcggtcggcaccccgttcacgctgatcgtcaacggacagccgatcttcgtgcgcggcctcaactggattcccgaggaccatctgctcacccggctgacccgggcacggtacgcggcggcgatcgagcgggccgtcgaggccaacgccaacctgctgcgcgtctggggcggcggcatctacgagagcgacgacttctacgccgagtgtgacgagcgcggcgtgctggtctggcaggacttcccgctggcctgcgcggcgtactcggaggaggagccgatccgctcggagatcctcgccgaggcccgggagaacgtcgcccggctcgccccgcacccgtcgctgatcctgtggaacggcggcaacgagaacatctgggggcaccaggactgggactggaaaccgcggctcaacgggcagacctggggcgccggatactactaccgggacttcccggcgctgctcgccgacctcgacccgagccgcccctaccaccccggcagcccgtccagcccgggccacgaccccgaaatcatccaccccaacgacgaccggcacggcacccgccacgagtgggaggcgtggaaccggcaggactacacccaccacgcgaacttcctgccccggttctgcgccgagttcggctggcaggcgccggccacctggtcgactttgcgcgagtcgttggctcccgaggacttcgatcaggagtcgccggcgttcctgctgcaccagaaggcggccggcggcaacgacaaactcgacaccgggttggcgcaccacatgcgggtgccggccgacttcgccgagtggcactgggccacccagctcaaccaggcccgggcgacggcgtacgcggtgcaccacctgcgcgggcacgcgccgcgcacgatgggcagcatcctgtggcagctcaacgactgctggccggtcacctcctgggcggtggtcgacggcgccggacggcgcaagccggcctggtacgcgctgcgccgcgcctacgccccgcggctgctcagcctccgcttcccgcccgggtcgccggacggcgcactggtcgcggtcaacgactcgccgacgccctggcggggcacggtgcgggtgcggcgggtctccttcaccggcgagccgctggccgaggggaccgtcgagctggacgtcgcgcctcgatccggatcggtcgtcccgctggacgccggactgaccacacccggcgacgtgacccgcgaggtgctggtcgcggacgccgacgggctgcgcgccacgcacctgttcgccgaggacttcgatctcgcgtacgacccgtcgcccctcaccgcggacatcacccccgccgagggcggatactgcatcaccgtgaccgcttcccgtttcgcccgcgacgtcgcgctgctcaccgacaagatcgaccccgcgtcgtccgtcgacgacctgctcgtggatctcctggccggcgagagccacaccttccacgtgcgcaccacctgggccgacccggcggcgttcggcgcgcccggggtgctcgtcgcggcgaacaccctcgccgccgcgaccgaggcctga

SEQ ID NO: 135 - DNA, 852 bp, Actinoplanes utahensis
gtggccggcgggctgatcgggctggtgctgaccggcagcgccgcgcaggtcggggtcgaaccgttcttcatggagctgatcgccggcatggaggaggcgctcgccccggccggcgccaccgtgctgctcctggtcgtccccgatcgggatgccgagctggccacctaccgccgctgggcgcaggaccacacggtggccgcggtggtcgtggtcaacctggtgcacgacgacgtgcgcccggaccgggtggccgcgctcggcctgcccgcggtgctggccggtcggcaccccggaccgtacgccaaagtggtcaccgacgacgctggggcgatgaccaccgcgatcgccgccctgaccgccctcggccaccgggtgatcggccgggtcagcggccctgccgacctggtgcacaccgcggaacgcaccgcggcgatccgggcggcggcggccgggcgcggcgtcaccgtgcggatcgccgagggcgactacaccgccgagggcggcgtacgggcgctgcggtccctgctcgcctcggccccgccgccgaccgcgatcgtcttcgacaacgatgtgatggcggtcgccgccgagcaggagctgctccgcaccggcacccgggtgccggcgcaggtcagcctgctggcctgcgacgactccccgctgtgtgagctcgcggtgccacccctgtcggcgttgagcaccgacgtgcacgagcacgggctgaccctggggcgggcggtgctcgacgtgctcgacgggggagcgggccgcacccacccgggcccggcggtcagcatccgccaccgggagagcaccggcccggctcccgccgctccgaaagtcagctggtga

SEQ ID NO: 136 - DNA, 2199 bp, Actinoplanes utahensis
gtgaacccatcacgagggacccaccgaggggatgaccaccatgatcgaagagctcacgcgggcggcccagcccaccaccgtgaccccggccccggccccggccgccgatccggtggtcgcggtcctcggccagcggagccgggtcggcgcccttccgcagcacctgccctccggctggtcggtccgcgccctgacggtcctcgacgacgcccgccccggcgagatcatcctgctcagcggcgcccgggtcgaggacgtccggcaggcccgggtcaccctgccccgcgccagccggatcgtcgtcctcatcgacgagtgggccccggccgcgctggtcgccggcatcctcaccgccggcgccgacgtgtgcgtccgcggcggccacccggcgatcctggccggccacctggtcgcctgccgccgccgccagctcgccgagcgctgggccactctggatccggcccgcacgtcgaatatctgatctaccgggtacggtctacgggcttcgtccgtacccggggagagaccatgcgcaagcgcaccatcaggacactgctcgcggccggcgtgctggcggccgggtcggcggccttcgtcaacctcgcgaccgggtcggcgtcggccgggaccgggccgaccacactgaccgggcagcagcgccacgcgatcgacggatatcacgccgaccggatggtggtcgacacggtgcaccagcggctgctgatcgccgacgacgtggcgcaccgcatcctcgcggtcggctacgacggcacggtcgcggcccaggtggccctcccggacggggcgaacgccggcgacctgcggctcacggccgacgcgggccggctctgggcgatcctgccgggcgcccaccagatcgtctcctgggacgcggcgaccctcggcgacgccaagccctacccggtcgacctcctcgacctcggccacctcacgctggccggcggcacgccctggttcaccttcgacaagaactacttcgcctcgctcgacccggccaccggcgcggtcacccggtacgtgctcggcaagggcaacgacacctcggcatcgccgtcccagccgctgatcgccgccaacccggccgacccgacccagttggcgctgacctacgcgggcacccggacgaccctgttccgctacgacaccgccggcgacatgacggcgccggtgaccgccgagaccggcgtgctcgccgcgcacaacacgttggcgtacacccccgacggcacgatgatctacgtggccggtgccggtggcgtcttctacacctgggccgacgacctggccggcatctcggcccgcacgatcggcctggacggcgccgccgacgtggcgaccaccgacggctgggtcgcggccggcaccggcgacgtgcgtctctacccggacgccgagacgaccgcggcccgcgagttcgacttcccggccacggccaccgtgaccgacctcgggtggggtgccggcgccggccggctcttcgcgatcagcaccgatccgaccggcgcgcagagcctgtgggtgatcgaccagcccacggcgacgccggcgccggccacaccggagctcacgctgaaccgcgacgggagcgtcaacgcgtacggcgccaccgtgacgatgaccgcgcacctcggcaccaccgcccagaaccggaccgtggagatctgggccgacccgtacggcaccgaccggccgcgcaccctgctcaagaaaggcgtggtggacgccgcgggcaacctgagcgtcggctaccagctgacccgcaacaccacgttcagcgtggtcttcgccggtgacgccggatacgccgcccggacggtcacctcggcggtgaacacctcggtcgccgtcgccaccacggtcgccaaccactacaccgtcaagcggtcgtactactacgtgcacaagagcaagaacccggttttcggtacgacgatgacgccgtacccgggacgcaccgagcggctgaccctccagcagtactcgggcggccggtgggtggcgttcaagagcgggaactaccggctcagctcggccggcaagtactcgtacaccctcaccggaacgcaccggaccggggtgaagtaccgggtgtcggcggcctacctgaccggcatctccggggaccgggccaacgccacgaccaacgggccctggaagtacttcatcttcaccagctga

SEQ ID NO: 137 - DNA, 984 bp, Actinoplanes utahensis
atgcccgagccccgccggatcaccagcgccgacgtcgcccgccgggccggggtctcccgggccacggtcagctacgtcctcaacaacaccagcggccagagcatctccccggccacccgcgaccgcgtcctgcaagccgccgccggcctcggctatgccccgtccgccgccgcccgcaccctccgcaccggacgctccgacgtggtcctctgcctgctccccgactggccgatcggcaacgaggtcggcaacctgctcggcaacctgtccaccgcgctcgcccgggagggactcaccttcgtcgcccaccccggcagccgcgaggaccggccgatcgccgagatctggaaggcgctcaccccggcggcggtgctgtcgttcaccgacttctccgacgacgaacgcgaggcgatgcgggccgccggcgtcgccctcgtcgtcgcgctgctcggccggcccgggcggcacgggcgggagctggaggtcccgcaacaactcgtcggacgacgacaggccgagcaccttgccggtacgggtcatcagcggctcggatacgcctacccggacgatccgcgtctgcagatcttcgccgacccccgcctcgcgggcgtgcgcgccgcggcaccggtcgacccggtcgtgcgggtcgtcccgctcgacgccgcgcaggcgtccgcggcggtcgcccgctggtgcgccgacggggtcaccgcgatctgcgcgtacaacgacgaggtggcgctggccgtgctcgccggggcgcggcggctggggctggccgcaccgaccgacgtcgcggtgatcggcgtcgacgacatcccggcggcccgcctcgcggtgcccccgctgaccacggtgaccaccgaccagctgacgctggcggcgcacctggccaccacggtggtggcggcggtcggcggccgggcggccccgccactgcccaccggcgacctcatccagctggtcgtccgcgactccgcctga

SEQ ID NO: 138 - DNA, 2355 bp, Actinoplanes utahensis
atgactctcgacctcgccgccaaggtcgccctcctcaccggcgcgaccaccttcacgctcgccccggagccgcggatcggcctgcacgagatccggctctccgacgggccgaccggggtgcgtggcctcaagttcagcggcggccgggtggtcgccctcttcccgaacgcgacgctgctcgcctcggcctgggaccccgacgcggcgtacgaggtcggccggctcctggccgaggaggcgctggcccagcggatccacgtcgtcctgggccccaccatcaacctgcaccgcagcccgctcggcggccggctcttcgaggcgtactcggaggatccgctgctcaccggcagactcgccgcggcgtatgtgcgcggcatgcaggaccagggggtggccgcctgtctcaagcacctggtcgccaacgagtcggagaccgatcgcaccacggtggacagcgtcgtcgacgaggccaccctgcgcgaggtctacctgctgcccttcgagatagccgtcgaggaggccgacgcctggacgatgatggccgcctacaacgacgtcaacggcgccgcggcgaccgagcagcggcacgtcaacaacgagatcgtcaagggtgagtggggctaccgcgggctgatcatgtccgactggttcgccaccaggaccaccgcggcctcggcgaacggcgggctcgacctggtcatgcccggcccggccggcccgtggggcgacgcgctggtcgcggcggtccggcgcggcgaggtcgacgaggcggtgatcgacgaccacctgaaccggctgctgctgctcgccgagcgggtcggcgcgctcggcaccccgcgggggtacccggccggcctgccggcgccggcttccgccctccggcgggagcagctcacccgcctggccgcgagcggcatgacggtcctgcgcaacgagggcgccgtgctgcccctggcccgggacacgcggatcgcggtgatcggccggcacgcgctgcagaccatcgacatgggtggcggttcggcgcaggtcaacccgccctaccaggtcagcatcgcggaagcgctgcccggtgcggtgatcgccgacggggtcgaggtgcggacccgcccggtaccggcccgcggcggtttcctcaccgacccgcagaccggccggccgggcatccgggtccggatgttcgaggccgccgggaccgaactggagagccggttctgcgcccaggccaccaccatgatcggaatggacgacgacttcgacggcgtggtgcacaccgcggagctcaccggccggatcaccgggggcgggacggtcgagctcggcgcgctgggcgccggcacctggaccgtcaccgtcggcgagagccgcgtcgactaccacctggatctcaccgggaacggcttcggcgaggccgtcctcgctccgccgctgcgcgtcgatcgcttcgagaccaccgcgggcgacatcctgaccgcgcgggtccggctgctttccggcggttcgttcgcgaacaccggactgttcggtctcctcgcgcacaccgcgccccgcccggccgtcgacgtgctcgacgaggcggtccgggcagcggccggggcggaggtcgccgtggtcgtcgtcggcctgaccgaggagcaggagaccgagtccgtcgacaagaccaccctcgcgctgcccggcgcccaggacgcgctggtcgaggcggtcgccggggcggcccgccggaccgtcgtggtggtcaacgccgccaccccggtgttgatgccctggctgtcccgggtcgacgcggtgctctgggccgggctgcccggccaggagggcgggcacgcggtggccgcggcgctgttcggcgacatcgaaccggccgggcggctggtcaccaccttcccggccgccgacgggaaatccccggcctggtcggtgaccccggtggacgggaagctcgcgtacgacgaagggccgttcatcggataccgcggacatcacgcggggcgcgcgcccgaaccggccttctggttcgggcacggtctcggttacggcacctgggagtacgccgacgcccgccgcgtcgacggcgacccggccgccgtggccgtcacggtcaccaacaccggcagccgcaccagccgtgaggtcgtgcaggtctacctgcagccggacgacccggcgcagccggtgcggctggccggctggaccccggtcacggtcgcctccggcgagtcggcgcgggtcaccgtcacgcttgacagccggatgtggcgtgtgtggaataccacgtccggagtatgggagcgtgcttccggtggacaattgctgatcgctcgcggcttgggcgacatcagagccaccctgtga

SEQ ID NO: 139 - DNA, 567 bp, Actinoplanes utahensis
atggcggagatcgtgctgatccggcacgggcagacggagtggagcgccaacgggcggcacacgtcgtacaccgatctggcattgacggccgagggggaagcgcaggcgcgccgcgccggcgagcgtctcggcgggcggaccttcgcggcggtgatctccagtccacggcggcgggcgctgcggaccgcggagctggccgggctgacggtcaccgaggtgaccgaggatctggccgagtggaattacggggagtacgaggggatcaccaccaggcagatccgggagagccgcccggactggtcactctgggtgcacggctgcccgggcggggagtcaccggagcaggtcggcgagcggctcgaccgggtgctggcccgggcccgggcgatcgacggtgatgtcgcgctggtcgggcacgggcacagcctgcgggtgaccggggcgcgctgggtcgggctgccggccggcgccggcgggctgctcaagctggacaccgcgaccgtgtcggtgctgggttgggagcatgccgtcgacccggtgctggccagctggaacgcgccctgctga

SEQ ID NO: 140 - DNA, 336 bp, Actinoplanes utahensis
atgagcgctgaggggatgatcgccatgtttctggccgtgctgatcggcagcacgatcgccgccctggcggtcaccttctggccgcagcggcacggcggaccgtccggcctgttcgccgggccggggccggccaccggtccgggcccgctctccgccgtcctgctgccggtcgccaccgtgatcccgccgatgccggagagcaccgagggcatcctgatcgcccagctgatgcggggcgagctcagcgcggagcagtaccggcacgcgatgtccgggatcgccgcccgcgaggagggccacagcccgatgccgctgccgggggcactgcccgactga

SEQ ID NO: 141 - DNA, 381 bp, Actinoplanes utahensis
atgattgtcgtgctggtggcgatgctcggcctggtggccgcgctcgccctggtgttctggccgtggccggcgggccggcgggtgaccggcgagcgccgggagactcgggccgaaccggggcgccgggaggatcgggagacccgggaggatcgggagcgccgggagaagcgggatcggcgcgcgtcgcgggcccggcgggtgtcccggggccgggtcgcgccgccgccattgcggcttccggacagcctggagggtgtgctcaccgtccagctgatgaccggcgagatcgacagccagcagtacattcgggccctggagcggatcgccgcccgggacgagcgccggcacccgatgtcggtgccgcccgactgccgtccctga

SEQ ID NO: 142 - DNA, 117 bp, Actinoplanes utahensis
gtggcccaggagctgcatctcagcccccgcaccgtcgaccaccacctgcgcaacgtcttcacccgcctgggcgtccgctcccgcaccgagatggcccacctgctggccacccgctga

SEQ ID NO: 143 - DNA, 1149 bp, Actinoplanes utahensis
atgtttcatgcaccgctagtgcaagaagttcagcggctgctcaccgctgccgaggccggccacggcggcgccctcctgctctgcggcgcccccggctccggccgcaccaccctgctgcgcaccgccgccgccctcgccggcggctggacggtccacgaactcgccggctacgccagcgagaccgcccggcccggggccgccctccgccgcctcaccgccggacggtcactgcaccaccatctgcgtacgacgtcggcccaccgcccgctcctgcagctgctggacgacgcccacctgctcgacgcaccgtcgctgcgggccatcgcgcacgccgcgcaccgcctcaccaccctgccggtcgtgatcctggccgccggcccgcccgggctcaccgccggcgacctgccgacccgccgcatcccgccgctcacccccgagcaatgccgcaccctgctcggcgcacacgcccccgacctcgccgacgacgtggcgatcgcgctgatcaggatcgccggcggcaacccggcggcactcaccgacctggccaccgggctcaccccggcgcagcgccgcggatacgaaccgctgccggccaccctggcaccggaccacccgcagcgcctgcggctgcgtaccgagctggacgccctgcccgaaccaacccggcgactgctgctgctggccgccgccgggccgcccacacccctgcccgacctgctcgacgccgccgacgccgggctcgccgacctgctgcccgccgaacacgccggcctggtcaccgtcgacgacaccacggtgcggttcgggtcggaactcgcgcgggccacgacgtaccgcgagatgtccgccatcgcgcgccgcgccgcgcacctggcactggccgaagtctcggccgcgcgcggccgccgcctcgacaccctcctgcaccgcgccgccgccgcgaccaccaccggcctcgggacccccagcggcctcgccacccccagcggcctcgcgacccccagcggcgtcgtgattcccaccggccccgccacccccaccaccgaggccgccgcctccgggatctccgctcccccggccgccgtctttccgatctccggcgcctcggtcgcggccactccgatctccggcgccggggtcgctagctag

SEQ ID NO: 144 - DNA, 987 bp, Actinoplanes utahensis
atgttgcgccctgatgacacgaagccggtgatttcgccgatgcgcggctcgtccggcgctgcgcagactggcgctcgtcgatccgtttccccaggtgaaggagtgttcgacgtgcaccgatcttggaagcgactgctggcgacggccgccgccgccctgatgctctccgcaccactcggcgccaccgccgcgcacgcggccgacaacccgtaccagcgcggcccggccccgaccctggccgccctgcaggcggccagcggtccgtacgccgtctcccaggtgtccgtctcccggtcgagcgtgtccggcttcggcggcggcgtcatctactacccgaccagcacggccgacggcaccttcggcgggatcgcgatctcgcccggttacacggcgtactggtccagcatctcgtggctgggaccccgcctggcctcgcacggcttcgtggtgatcggcatcgagacgctgagtacgctcgaccagcccgactcccgcgggcggcagctactggccgctctcgactacctgaccaggagcagcacggtacgcaaccgggtggacgccagccggctcgccgtcgccgggcactcgatgggcggcggcggcagcctggaggcggccaacgaccggccgtcgttgcaggccgcggtgccgctggcgccatgggacctgaccaagtcgtggaccggcatcaaggttccgacgctgatcgtcggcggacagtcggacaccatcgcgccggtggcgagccactcgatcccgttctacaccaccatcccggcgtcgtccgagaaggcgtacctggagctggccgggcagagccacttcttcccgcagacggtgaacaccacgaccgcggtggaggcggtggcctggctcaagcggttcgtcgacaacgacacccgctacgaccagttcatctgcccggggccgagcagcgtgctggtctcggcgtaccgcagcacctgcccgctgtccgccggctga

SEQ ID NO: 145 - DNA, 1992 bp, Actinoplanes utahensis
gtgcggtcaggagctcggcgccgccgacggccgcagcaccttgcaggtctcgatcgccttctcggtggtggcatccgacgggttcggatcggccacgtcggtgacgccgttcttcttcaggcagtcccggtacgcggcgttcgccccgccgcccccgccgttgccgcgcccgccgaagctgggccgcaccgacgcgcacgcctcctgtgccctggtccaggtcgcctcgtccacgtccgccggtttctggaagaagccgccgccacccgggaagccgccccggccgccggcgccgaaactgcccgaggggcgcggcatgccggacgggcgcgcgccaccggaagggcgcgggccgttgcccggcccgaacgacggcagggtgatcgtgacgccgttcttcgccagacatgcggcgtacgccgtgaacgccgcgttgttgccgccgccgttctgtccggtcgcgccggtcgacgtgccggtgccgccgtccttgccgccgcacgccgcggtgaaggccaccgagacgaacgccaccgccgcgcacgccgcgatccggcgggccgccttcgacttgactaccggcatcatcgtctcctcatcgacacgggcccgcccggggaagaacgcggcgggacacgacggcacagcgaaccccggcttcctatgcggaaggtcggacgagcctgggaatctcctttgagccggcatcgcggctcccagggaactccgaggcgggaccgaggccgccgcgaggaccggtggccagactcctcgaccatgggtgttgcactggccggtcgccggcgtgggatctggctcggcgtgaccgtcgtcgtgctcgcggtgctcggctacgcggtggtgcgggcgatgacggcgggtggcggggcgaagacgaaggcggccgagaccgtcgcggtggaccggggcgcggtcagcaccgaggtggccaccaccgggacgctggccgcggcgcagacgcgcagcctgtcgttcgcggtggccggcaccgtggagacggtcaaggtgcgggccggcacgacggtcaccgcgggccaggtgctcgccacggtggacgacgacgacgcgcggcaggcggtcgacgacgcgcagtccgcgctggatgacgccgaggacgcgctgaccgcggcgaagaagagcgccggcgcgacctcctcgacgacgacgtcatgtgtcgcggccgcggcgtaccgggtgagcccctcgccctcgccgtcgtcctcgcccagcccgtcggcgtccgcgcggccgtcgaggaccgcgaccgtgacaccgacgaaggcgccggcccagggcggcaccggcaccgggacgaactgttccgcgaacggcggcggcaccacccgacagggcgggcagaacggcggcggggaccagatcctcagcgcccagcagcgggtcaacgcggccgaggtcaccctgcaggagagggaggatgccctggccggcgccaccatcaccgcgccgatcccggggcggatcctgagcgtcggcggcaaggtcggcagccgggtcagctccgggtcgacgttcatcagcctggccgacatctacgacatgcagatcaccgcgtcgttcccggaggccgacgccgaccatctggcggttcagcagaaggcggtgatcaccctggccgacaagccgggcgagacgttcgccgccaccctggtggtggtcgacccggtcggcaccagcgacggcacgctgacgacgttcggcgtggtgctcgccttcgccgacgcgccgaaggacctgctggtcgggcagagcgcccaggtgagggtgaccaccggcagccgggccgccgtgctgcgggtgcccagcacggcggtgcacgacgtggccggcacgtccggcacggtccagaagaacggcgccgaggtgagcgtgcggatcggcctgcggggcgaccggtacaccgagatcacctccggactggtggagggggatccggtgtcgcgatcctggtga

SEQ ID NO: 146 - DNA, 723 bp, Actinoplanes utahensis
atgaccgtcggcgacgcgtcggcgcgggccacccgcgtcctcgtcgtggacgacgagccgaacatctccgcgctgctcagcgccactctgcggcttgtcgccttcgacgtgcgggtcgccgagaccgggcacgccgccctggtcgcggtgagcgaattcgagcccgacctgatcgtgctcgacgtgatgctgccggatgtggacgggttcgaggtggcccggcggttgcgtgccgccggctcccggaccccggtgctgttcctcaccgcgcgcgacgcggtcgaggaccggatcgtcgggctctcggccggtgccgacgactacgtgaccaagccgttcagcctggaggaggtcgtcctacggatccgcgccatcctgcggcgcagccggccggaggaaccgaaaccggacaccggggtgctccggtacgccgacctggagttggccgaggacgcccacgaggtgcgccgggcgggccgtctgatcgagctgtccccgaccgagttcaacctgctgcgatatctgatgatcaacgcgggccgggtggtcagcaaggcacagatcctggatcgggtgtggaagtacgacttcggcggggacggccggatcgtcgagtcctacgtctactatctgcgtcgcaagatcgaccggaccgagccggcgttgatccacaccgtgcggggcgtcggctacgccttgcggttgccgcgcgagggggaatag

SEQ ID NO: 147 - DNA, 1500 bp, Actinoplanes utahensis
atgggagtgacgctgcgctggcggcactggacgctgcagtcccgcctcgctctggtggtcggcgtgctcgccgcgatcgcgctgctcgccgcgaacgtcgccggcgtcgtgctgatccgcggctacctgctggaccggatcgacagacagctcaccggcatggcccggccgatggagttcgcgaccccgccgtccggcggcttcgtcgcccgccgtggcttccggatcggccccgagcaggtgtcctacctgttcgccgccgacggcacgctcgacaccgagaacagcagcacggccgaccccggcaagcccgcggtgcccaccttcgagcaggtcaggacgcgcgccgccacccggctgccctacacggtgaccagcgccgacggcaccgactggcggctgttcgcgctcccggtcggcaccagcggcaggtatgtgctgttcggctcctcactggacgaggtgcggcagaccaccggcaagctgatcaccatcgacgccggggtgctgctgctcatcctgggcctgctcgggctcggcgccgcgttcgtggtccgggtcggtctgcgcccgctcaccgagatggagcacgccgccgcggacatctccggcggtgacctgtcgctgcgggtgccgggcgcggacccgcacaccgagccgggccggctgggtctggcgctcaactcgatgctcacccggatcgagaccgaggtgaccgcccggaccgcgtccgagcagcggttgcggcagttcgtcgcggacgcctcgcacgagctgcgcaccccgctcacctcgatccgcggcttcgccgagctgtaccggcgcggcggcgccccgcccggcccgcggctggacgagacgatgagccggatcgaggccgaggccggccggatgggtgtgctggtcgaggacctgctgatgctggcccggatggaccggcagcgcaccctcgacctgcgcccggtcgacctgctggagatcgccgcggacaccatccgggatgcgcgcgcccgggtgcccgagcgtccggtgctgctctccgggctcagcgacgacgcggacaccttcgagccggccaccgtgctcggcgacgaccacgggctgcggcaggtggccaccaacctggtcgccaacgcgctgaaccacaccccggccggaacccgggtcaccgtccgggtcgggcacaccgtcgccggacccgccgacgaggctgcggcctgctccggctcgatcactttccgtgatggattgccgctggcggtgctggaggtggaggacgacggccccggcgtgccggacgagcacgcggcacggatcttcgagcgcctctaccgcgcggacgccagccggaaccgcggcaagggcggtggttccgggctcggcctggccatcgtggcggcgatcgtgcacggccacggcggctgggtggagctgcaccacacgcccggcggcggcgccaccttccgggtactgctcccgtcgatcggtgacgcgccgtga

SEQ ID NO: 148 - DNA, 1230 bp, Actinoplanes utahensis
atgaaggtacgcctgagccgccacccgtccctggtggtcaacgccgtgatcggcgtcgtgctcgtcgccggtgccatcacggtgtacgagacattctcctcctccgacgccggcgcgacggccgccgcggcctccgaccggacggtgtcggtccagcagggcacggtcaccaggacggtgaccgcggacggcaccgtggagagtgccagcaccgcgagcgccagcttcgagaccagcggaacggtcaccgagatcgacgtcaaggtgggtgaccgggtcaggaagggccaggtgctggcgaaggtcgacccggccgcggcgaagcgggcgctggccgaggcgcaggcgaacctggatgccgcgaacgacgcgtgggaccgcgcccagaccgccggctccgacaccaccgacgcggagaactcggtcaccacggccaagctcgcggtcaccgacgcggccgccggggtcgccgggaccacgctgaaggcgccgatggcggggacggtcacctcggtggccggcaccgtcggcagttccgccgccggcaccggctcgtcgtcgtcctcgtcgtcgcaaggcggtggcggttcacccggcggcgggggcaccacctcgtcctcgtcgtcctcgtccgccggcttcgtcgagatcgccgacctgagcaggatgcaggtcagcgcgagcttcgccgaggcggacgcgaccaggctgaaggagaagcaggccggcacggtcacctggaacgcgctcagcggcaccagcgagaccgccgaagtgaccgcgatcgacccggccggcaccacctcgaacagcgtcgtcacctacggcgtgacgctgaccctggacagggtgccggccggcgcgaaggtcggccagaccgtctcggtggtggtcaccaccggctccagggcgaacgtcctcatggtcaactcggcggcgatcaccacggtcggcaaccggcacacggtcaccgtggtcgcgaacggcgtcacggagacccgcccggtggagatcgggctggagggcgactcggccaccgagatcacctccgggctcgccgcgggcgagcaggtcaccgtaaagatcacctcgaccagcgccggttccggcaaccaggggggctttccgggcggcggcgccggtttccccggcggcggcggcaacttcggcggcggcggcaacttcggcggcggcatcggggcccgcgccggcggcggggccggccgatga

SEQ ID NO: 149 - DNA, 855 bp, Actinoplanes utahensis
atgagccgtccggtcctcgaggtgcagaacctcaagaagatctacggtacgggcgaggccaccgtgcacgcgctgcgcggggtgtcgatgaccgtgcaccgcggcgactacgtggcgatcatggggtcgtccggctccggcaagtcgaccctgatgaacatcctgggcgcgctggacatccccaccgtcggatcgtacaaactggacggcgtcgaggtgggcacgctctccgacgcgcagctggcgctggcccgcaaccggctcatcgggttcatcttccaggcgttcaacctcattccccgagcgacggcggtggccaacgtcgagcttcccctcgcgtacgccggggtgaaatccggagagcggcgccgccgcgcgatggccgccctggacatcgtcggtctcgcggaccgcgccgaccacgagcccaaccagctctccggtggccagcagcagcgcgtcgcggtggcccgggcgttggtcaccgagccggccctgctgctcgccgacgagcccaccggcaacctggacagcaggtccaccgacgacgtgctgcaggtcttcgacgacctgagcgcggccggccggaccatcgtgatcatcacgcacgaggacgaggtcggcgcccgtgccaaacgcctcgtccggctggtcgacggggcgatcgtgaccgacgtccggcagtccccgatcgacctgccgccggtcggcgcggtggccgcgcacgccggggtacggggggtggccgccggtcacccgccggccgggcaggccgtcgcggcgcgcgcgaacggcaccgcgaccacctatggccggccggccgcggaccggagcggggggcggcacaccgcatga

SEQ ID NO: 150 - DNA, 1242 bp, Actinoplanes utahensis
atgaacttcttcgaggtggtccggttctcgctgcgcgggttgtcggcgaacaagttgcggtcctcgctcaccatgctcggcatcctgatcggtgtggccgcggtgatcctgctggtcgcggtcggcaacggctcggccaaggcgatcagcgaccggatcgaggcgctgggcaccgacacgattaccgtgatgagcaccggccggggcgggtcgagcagcaccgcgctcaccaggccgatggccgacgccctggtcaactcggagctggccccggacatcaagtcggtgtcaccggtggtcagcgcctcctcggcgaccatgacctacgagggcaccgaccactcggtgagcaccttcgtcggcaccgtgccgacctggttcggcgcctccagcaccccggtggagaagggcgcggcgttcaccgccgacgacgtcgcccaggggcgccgggtcgtggtgatcggacagaccgtggccgaggaactgtttcccggcgtcgatccgatcgacaggcaggtcaccgtgagcggcgcgctgttcaccgtgatcggggtgctcaaggagaagagctcgaccggtttccaggacgccaacgacaccgcggtcgccccgctcaccgcggtgcagcaggtgctctccggctacggcgcgctcacctcgatcatcgtcgaggccaacgaccccggcagggtgaacctggtgcagagcgaggtcgccacgatcctcgaccagaagctcggcgtgaagtcgtcgaccaccgcacggacgtccggcggtagaaccaacggcacgggcagcggtacgccgtaccggatccagaacgcctcgtcgctgctggagacccagaccgcgaccgccgacacgttcaccaccctgctgggcgcggtggccgcgatcagtctgctggtcggcggcatcggcatcaccaacatcatgctggtcacggtgaccgagcggacccgggagatcggcatccgcaaggcgctcggcgcccctcgccgggtgatcctgacccagttcctgatcgaggccaccctgctgagcgtgctcggcggcgccctcggcgtggcggccgcgctgatcggcagccacttcacgatcgtcggcgtgaaaccggtgatcgtgcccagttcgatcgggctcgccgtcggggtgtccatcgcgatcgggctgttcttcggcggcctgcccgccgcccgcgccgcccgcctgcgtcccatcgacgcgctgcgctacgagtga

SEQ ID NO: 151 - DNA, 597 bp, Actinoplanes utahensis
gtgaaccggatgaacgacgagaccgccgtgctgccgaccatcccggcgccggacgccgacccggccgggcccggcgacgacgacaacgagggcctggccgaggaactcgccgcggccgccccccggcagtggtggaaccgggggacgatcgggctgggggcggccgtgctgctgatgggcggcttcctcggcggcgtctacgcgcagcgggagtggggcccgaagacgaacgcgacctcgggcttcccgggccccggcggccgctttccgggcgggctgagtgccagcggcttccccggcggcggcttcggccagggcggcaccggccggggcgggacggggaccggtggcaccggcaccgcggcggccgcggccgacacgaccggcacggtgaagctggtcagcggcaccacgatctacgtgcagaccgcggacggcacggtggtcacggtcaacaccgacgggaagaccaccgtgtccgcggcgaagaaggcaaagctggccgacgtcaaggccggcgacgcgatcaccgtccggggcgaggccggtaccgacggcgcggtcgccgccacatccgtcatcacgcagcacaagtga

SEQ ID NO: 152 - DNA, 393 bp, Actinoplanes utahensis
gtgtggccggcagcgggcgcgaaacgctcgcacaccggtgttgatgggggcgttccgcggacgctgccaggcgcgctcctggccacgccgcagccccggtcggcttccgggcacggactagggggtggcgcgttggggcgcgactcgccgattctgttcggccgggcgggactgctcgcggagatcgacgtgcggctcgccgtgggcggcggagtggcgctctgcggtccgcccggcatcgggcgcacggcgctgctcgacgcggtcgccgagcaggcggtggcccgcggtgagctgctgttgcggctgcggccggcccggggcgagcggaccctggcgtacgccggggtcgccgacctcgtccggcaggtcccgccggacctagctagctag

SEQ ID NO: 153 - DNA, 1560 bp, Actinoplanes utahensis
gtggccgccgaacgcctggactggctggtcaccgcggcccgcaccgcgctcaccggtggcgcaccggcgctggccggccgggccgccgaggcggtgatcgccgccgacgccccggccgggcaccgggtccgggcccgggtcgtgctgatcgatctggccggccaggcgctcggcgagatgggcgagatgttcgccgcggccctggccgaggccggcgacgatccggccctgctcgccccggtccggctgcggctcacctggcaggcgatgatcaccggcgagcccgaccgggcggccgccgaggcggtcgccaccgccgagatcgcgcaccgggccggcgacgccaccagcgaggcgatggcgctcagcggcctggcccagatccagcggatgcgcggcgaaccgcggtggcgggagtcgctggcccgcgccctggccctgccggcctttccggcgccggactggctgcactacggcccgcactacatggccgcccggttcgcgctgatcgacgaccggctcgacgaggcgcgcgccgagctgctgcgcctgctcgcggtcgccgaacacgaccggatcggcgaggcccgggtcgaggtgctgcgcagcctctccgaggtggcgacccgggcgggccgctgccgggaggcgctgcgctacgcccaccgggccgtccaggcggcgcaggaggccggcctgagtcccggtcccacctggtacaccgcggccgtggcggagctggccggcggcagtctcccggccgccgccgggttcgcccagcgtggcatccgcgcctccgaacaggagggggacaacctctacctgcgccgcaacctgcacgcgctgggccaggccgggctgcggtccggggacacccgggccggggtggccgccctgcgccggctgcgcgacctggaggccgaggccggcaactcggatccgatgatcgtccgctggcacgccgacctggcggccgggctggccgcgctcggcgagcacgtcgaggcggccgagaccctggcccgcgcccgcaaagccgccgaacagctgggcagcaccccggcgctggccggctacctggaccgggcgaccgcgatcgtgcagtcggagagcggccaggcggagtccgcggtcgagttgtcgaccgccgccgcccagctgttcgagcagctgcgccagccggtcgagcaggggcacgccctgctggtcgccggcggggccgaacgccgtcgccgccggtacgccgcggcccgcctgctgatcggcgcggcgctggccatcttcatgaacgcggacgcccggccgtgggccgaggagaccgagcgggcattggcccgcaccgagggcagcctggcgcccgagcagggactcacgtcgaccgagctgcggatcgcggtgatggtgcgggacggggccagcaaccgggagatcgcgtcccggctgtatctgagcgtgaagaccgtggaggccaccctgacccgggtgtaccgcaagctcggggtgcgctcccggacgcaactctcgtcacgtcttcaggtgctcgaaggcgacccgacgtaa

SEQ ID NO: 154 - DNA, 240 bp, Actinoplanes utahensis
atgcctacccttcgtcagatccgtgtcgccctcgcccaccgtctcgccgagcgccgtgcccaccgccggttgagcgaggagctcgcggcgttccgcaccgccgccgaacggaccgaactcgatctcgtgctggggcggcacaccgctgaggagacccgcgcgatcgaggccatcctcagccggcaggacgccgaacggcgctctctcggcggcagccccgcgacgggcgtcgtccggtag

SEQ ID NO: 155 - DNA, 1002 bp, Actinoplanes utahensis
atgctagaggtcaccgcgctcggctggaccctgaccattggcgtcatcgtcgccctgctcgccctcgacctgactctgggggtggtgcgtccgcacgtcgtcggcttccgcgaggcggccggctggtcgatcttctacatcggcgtggcggtcgccttcggcctcgtcttcgcgagcgtcgccggctggggctacggcaccgagtatttcgccggctacatcgtcgagaagagcctgtcggtcgacaatctcttcgtcttcgtgatcatcatgagcaccttcgccgtccccgagcggtatcagcaggaggtgctcaccttcgggatcatcatcgcgctggtcctgcgggtcgctttcatcgcgctcggcgccaccctgctcaacctgttctcgttcatgttcctgatcttcgggttgatcctgatctacaccgccgtccagctttaccggcaccgcgaccaggatcccagcatcgaggacaacgcgctggtccgggccggccgccggctgctgccggtgaccgacgactacgtcgagggcaagatgatcacccgggtcggcgggaagcggatggtgacgccgctgctgctggtcctgctggcgatcggcagcaccgacatcctgttcgccctcgactcgatcccggcggtcttcggggtgaccgagcaggcctacatcgtcttcgtcgccaacgcgttcgccctgctcggcctgcgcgcgctgttcttcctggtgaaagggctgctcgaccgtctggtctacctgtccaccgggctcgcggtcattctggccttcatcggggtgaaactcgtgctgcactgggcgcacaaggcgatcagccacgcagtccccgaggtcggcacgccggtgtcgctcgcggtgatcatcggcatcctggtcatcacgacggtggcgagcctggccaggtcccgccgcgatccggcactgaaagcacacgccggcagcctgaaggcacaccccgagcaggagccccgacggtaa

SEQ ID NO: 156 - DNA, 762 bp, Actinoplanes utahensis
atgccggccctgttcctcagccacggcgcgccgcccctggtggacgaccccacctgggtcgcgcagctgcgtgacctggcggccgccctcccccggccgaaggccgtcctgatggcctccgcgcactgggagtcggccccgctgatgctgtccgccaccgagaccgtcccgctggtctacgacttcgacgggttcgcccagcgctactacgaggtgcaataccgcgctccgggcgcccccgtcctcgccgaccgggtcgccgcgctgatgccggacggcgagacggtcgcccgcacccgccgcggcctggaccacggcgcctacgtgccgctcaccgtgatgtatccggaggccgacatcccggtgctgcagatgtcgctgcccaccctggagcccgaccggctgctggagctcggcgcccggctcgccccgctgcgcgacgagggggtgctgatcgtcgggtccggcttcaccacgcacggcctgccgttcctgcgcgactggcggcccgacgcggcggcccccggatggtcccgcgagttcgacgcgtgggcggccgagaccctggcccgcggcgcggtggacgagctggccgacttccggtcggcggcgcccggcatgccctacgcacatccgaccatcgagcacttcgcgccgatgttcctcaccctgggcgcgtccggcgcgccggagcaggcgcccgagcagccgatcgacggtttctggatgggcctggccaagcgttccttcgtcagcgcctga

SEQ ID NO: 157 - DNA, 660 bp, Actinoplanes utahensis
gtggcgccgccgcagctaccgcccgcggatgatctctacctgaccgcgcacgacgcgagcagtggccggccgctgctcggatcggccgccctcggtctcggcctgggcgccgcgctgctcggcgagctgatcctgtggcgccgcatcgacctgatcagcgccggcctggtggtcaccgacaagcgtccgaccggcgacaccgccaccaccgcgctgctggagcggatcctgcgtgaggccgatcggcgcggcctgcgcgactggctcgcccggctcgccaccggcagtgccaccgacctggtcggacgtcggctcgcccgcggtggcctgatccggcgggtggagagacgcggactgctcggcaccaggagctcgttcgtgccggccgacgcgatgaccgcggcctggccggccacccggattcgcaccaaggtcgccggcagcgagccgctcaacgtgcccgacctgctggtttccggcctgatccgggccaccggcctggaccggcaggtgctggccgccctcaccgcgcgtgaccgggaccggctgtccgagcagtcccggcgggatcttccggccgagctgcagcagctcgtggcgcaggtcgaggcggccgtcgtggtcgccccttttcgtccgatgtggcgtccaggctcttga

SEQ ID NO: 158 - DNA, 1047 bp, Actinoplanes utahensis
atgtccgcacacgaggtcctgaccatgggacggatcggcgtcgatctctacccggagcagctcgggacaccgctcgctcaggtacggaccttcgccaaatccctcggcggcagccccaccaacgtggccgtcgccgcggcccggctcggccggcgcgccgcggtgatcacccgggtgggcgccgacccgttcggctcctacctgcgggatgcgctccgccgtttcggcgtcgacgatcggttcgtcggcgtcgtcgagcacctgccgacccccgtgacattctgtgagatctttccgccggatcggttcccgctctacttctatcgctaccccagagcccccgatctggagatttccccgtacgacgtggacctggccgccgtgcgcgccgccaccatcttctgggtcaccgggaccgggctgagcgccgctccgtcccgggaggcgacactggccgccctgcgggcccgaggccgcaccggcgtgaccgtcttcgatctcgactggcgaccgatgctctgggcgtcgccggaggaggcccggccctggtatctcgaagccctgcgatacgccaccgtcgcgatcggcaatgtggacgaggtggcgatcgcggtcggcggcatcggcggggtggttgccgcgtctgatggcgtcggcggggcggcaaccgcggggggtgacgacgacctgctcggccggttgctcgccaccggggtcgagctggcggtgctcaagcaggggccggcgggggtgcgggccgccacgcggacggaaacgacgtacgcccccgccatcgaggtcgacgtggtgaacggcctgggcgccggcgacgccttcggcggggccctgtgccacgggctgctcgccggctggccgctggccgagacgatccgtttcgcgaacgccgccggtgcgctcgtcgcctcccgactggcctgcgccgacgccatgccgaccgccgccgaggtgcacgaactgctggccgccggtcgcgctcccgcgcgcctctcggagagccccgacctgccggatgtcgatcatggctga

SEQ ID NO: 159 - DNA, 891 bp, Actinoplanes utahensis
atgtcgatcatggctgaggcccgggccaatccggtcgtgccgcgcggttccaccgccgaccggccgtacgacgtggtggtcagcccggagaacgcgggctgggcgcacagcggtctgcgcgtggtgcagctgccggtcggcggacgcgtcaccttcgtcaccggcagcgacgagatgctggtgctgccgctgtccggcggttgcgacgtggcctgcgacgacgaacgcctgacgcttaccggccgccggtccgtcttctcccgggtgaccgatttcgcctacctgccgcgggatgccgcggtcaccctgcgggcgccgaacggcggccggttcgcgctgcccgccgcccgcgcccgccggcaactcccgttccgttacggagcggccgaggacgtgccggtcgaactgcgcggtgccgggtcggcgagccgtcaggtgaacaacttctgcacccccgaatcgttcgaagccgacgcgctgatcgcggtggaggtgctcacgcccggcggcaactggtcgtcgtatccgccgcaccgccacgacacgctcgaagagatctactactacgaggtggcgacgtcgccgtccgggcggcccggctgcggctatcagcgcgtctacggtgatcaggatcggccgatcgacgtgtgcgcggaggtgcgcaccggggacgtggtgctgattccgtacgggtggcacgggccgtcgatggccgcccccggctacgacctgtactacctcaacgtgatggccgggccgggggagcggcggtggctgatcaccgacgatccggcgcacgggtgggtgcgcgaggcctgggcggtgcaggctgtcgatccgcggctgccgctgaccacagaccgcgaactgctgacccggaggcggacgtga

SEQ ID NO: 160 - DNA, 1872 bp, Actinoplanes utahensis
gtgaagcaccggctcaccgtcgcgcaggcggccgtccgattcctggccaatcagttcaccgaacgtgacgggatccgcgagcgggcggtggccggctttctcggcatcttcgggcacggcaatgtggccggaatcggtcaggcactggtgcaggcgcaccgcaccgggtcgccgtcgatgccgtaccgtttggcccgcaacgagcaggcgatggtgcacaccgcggtcggctatgcccggatgcgcaaccgtctgtcgacgatggcctgcaccgcgtcgatcggtcccggttcgaccaacatgctgaccggcgcggcactcgccacgatcagccggattccggtgctgctgctgccgtccgacgtgttcgcgacccgggtcgccaccccggtgctgcaggaactggaggatccgcgcgccggcgacgtgtcggtcaacgatgcgttccggccgctgtcgaagttcttcgaccgggtctggcggcccgagcagctgcctgcggcgctgctcggcgcgatgcgggtcctgacggacccggcggagaccggtgcggtcaccgtctgccttccccaggacgtgcaaattgaggcgtacgaatggccggacgacctgttcgccgaacgcgtctggcacatcacccggcctgttcccgacccgttgtccgtggagcgggcggccgccgtgatcaggggcgcgcgccggccgctgatcgtggccggtggcggggtgatctactcggaggcgtcggcgcagctcgaccggttcgcccgggaaaccggcatcccggtcgccgacacccaggccggcaagggcgcgttgagctgggatcatccgaacgaggtcggcgggatcggggcgaccggcagcccggtcgcgaaccggctcgccgggcacgccgacgtggtgatcggcatcggcacccggtattcggatttcaccaccgcgtcccggaccgccttccggcatccgcacgtccggttcgtgaacctcaacgtgacctcgttcgacgcgggcaaactcgccgcgctgccgctggtcgcggacgcccgggccgggttgcaggcgttgcgtccggcgctgcacggcaggcggttcaccgatgagttccaggaggacgtggccgggtggaacgcggtcgtcgccgcgcatctccgaccgggcggcggcttgccgacgcaggcgcaggtgatcggcgtggtcaacgacgcgtgcggggcgcgcgacgtggtggtgcaggcggccggcagccttcccggcgacctgcagcggctgtggcggtcccgggatccgaagcagtaccaggtcgagtacggctactcctgcatgggcttcgagatcgccggcgccctcggcatcaagctggccgacccgtcccgcgaagtgttcgcactggtcggcgacgggtcgtacctgatgatggcgcaggagatcgtcaccgcgatcgccgaaggcgtgaaactgatcgtcatcctcgtgcagaaccacggtttcgcctcgatcggcgccctctccgaacaggtcggctcgcagcggttcggcaccagctaccgctatcgcagcccgcagaccggcgactacgacggcgcgctccttcccgtcgacctggcactgaacgcggaaagcctgggcgccgcggtgatccgctgccgcaccacagccgacctggccgagggcctgaagagagcccgcgaacacgaccatctcaccctcctccacatcgagaccgacccactcgccgccgccccgtcctcggaggcgtggtgggacgtcccggtcgccgaagtcgccaccctgcacagcacccgccacgcccgcgccgcctacctcgaagccaaacgcgaccaacgcccccacctacgccccggtgactga

SEQ ID NO: 161 - DNA, 906 bp, Actinoplanes utahensis
gtgagccccgtgcgccggctgcgactcggcagctgccccgattcctggggtgtctggtacgccgcggatccccggcagatcccctggtcccggttcctcgacgagctgaccgaggccggttaccgctggctggagctcggcccacacggctacctgcccaccgaccccgctcaactcgccgacgagttggcggcccgcggcctgtcctgcgccgcgggcaccgtcggcggcgtcggcggcccgcacagggactttccggccgtggtcgccgggacccgccgcgtcgccgccctgacccgcgcggtcggcggccgcgacgtcgtcttcgtccctgttcccggttaccgcgacgacgccaccggcggatacctggaacccgccacgctcggtgccggccagtggcgcgccctgctggacaacacgaacaccctcggccggatagtcaccgaggagtacggcctcaacctccgtttccacccgcacgccgactaccaggtggagaaccagtctcagatcgaacgcttcctggacggcaccgacccccgcttcgtgtcgctgtgcctggacaccggccacctcgcctaccgccgcgccgacatcctgtcactgatcgccgcctatccctcccgcatcggatacgtccacctgaagcagatggacccggacatcgccctccgcgcggaagccgaagatctcgctttcgcgcaggccgtggctctcggcgtcagtgtcgccccaccacgtggcacgcctgacgtgccgaccgtgctctccgcgctcgccgccctggacgcggatctgttcgtcgtggtcgagcaggacatgtatccggtcgacttcgacgttcccctgccgattgccacccgcacccgccggtatctggaagagacaggagacttcgcatga

SEQ ID NO: 162 - DNA, 981 bp, Actinoplanes utahensis
atgaggaaacgcctgcttgccgccgggacggccaccgtgctcgcgctggcggcgtgcagcggtggcggccgggacaagtccgccgcggacacttcgggcgcgggcggcaacgcgcccggcagttccggttacacgatcgcgttcgtcactcatgagacccccggagacacgttctgggacaaggttcgggcgggtgcggtgcaggccgccaaggacgagggcgtcacgctgaagtactccaacgacccggacgccggcaagcaggcccagctgatccagagcgccgtcgacgccaaggtcaacggcatcgccaccaccctggtcaccccggacgccctggccggtgcggtcaagtcggcgaccaccgcgggtatcccggttgtcggcctcaacgccggcatcgaccagtaccagaaactcggcgccctgatgtatttcggttccgatgagtccctggccggcaccagcctcggcaaacgcatcgccggcgagggcgccaagcaccccctgtgcgtgatccaccagaccggttcggtcgccctggaagcccgctgcgccggcgtcaagagcgccgtccccgccaccgagaatctccaggtgaacggcgccgacgacagcgcggtcacgaccaccctgcaggcgaagctggctcaggacaagtcgatcgactacatcgtcaccctcggcgccccggtcgccctggacgcgatcaacgccaaacagcaggcgtcctcggaagccaagctggtcaccttcgacctgaaccaggagatggccaagcgcatcaagaacggcgaggtcgagttcgccatcgaccagcagccctacgtccagggctacatggcggtcacctccctgtacctgtacctgaagaacggcaacgacatcggcggcggccgccccgtcctcaccggtccgtccttcgtggaccagaccaacatcgacaagatcctcccgttcacggagaagaacactcgatga

SEQ ID NO: 163 - DNA, 1392 bp, Actinoplanes utahensis
atgacccctcccactcctcccggaacccccgaccccgcaaaaaccgctgatcccgccggcacccgcgacctcaccgaccatgcccaccacctcactgaccctgcccaccacctcacccaccctgcccaccacctcaccgggtccgcagactcagcccgccagcccgcagactcagcccgccagcccgtgggctcagcccgccatgccacggcgctgggttcccagcccgaaccagcccgtggcacaacccgatcgagggcccggcgagccgcccgcctgctggcgcgacccgaggtcggcgcccttgccgcagccgtcgtcatcttcctgttcttcctcgtggtagctccgtccttccggtccaccgcggcgttcttcacggtcctctaccagtcctccacgatcggcatcgtcgcggtcggcgtaggcctcctcatgatcggcggcgagttcgacctctccgctggcgtcatcaccaccagcgccggcctggtgaactcgatgttctgctggtacttcggcgtcaacctctgggtcggcgccgcgctgtccctggccttctgtctcctcgtcggtttcctcaacggctggctggtgacccgcaccggcatccccagttttctgatcacgctgggcacgttcttcgttctgcagggcgccaacctgggcgtcacgaaactggtcaccggatcggtgtcgagccgcgacatcaccgccatcgacggcttcgcatccctgcagaagctgttcgcctccagcatcaccatcgatttcgccaccatctggatcaccgtcgtgtggtgggccctgttcgtcgccctggccgcgtggactctccagcgcacccggatcggcaactggatctacgctgtcggaggctccgccgggagcgcccgcgccgtcggcgtcccggtgacccgtacgaagatcggtctgttcatgaccgtgtcgttcctcggctggttcatcgggatgcactcgctctaccgcttcaacacgttgcaggccggcaacggcgtcgggaacgaattcctctacatcatcgccgcggtggtcggcggcaccctcctcaccggcggtttcggcaacgctgtaggcgcggccatcggcgctttcatcttcggcatgacaagcctcggcatcgtctacgccggctgggaccccaactggttcaaggccttcctcggcgtcatgctcctgctcgcggttctggtcaacacgtacgtcaaacgcctggccacctccacggccagcttctcctcaaccgcggacacaccacccccacgcgaccgggcgtcgacctctgctcgcccgcccgtgctcgcgggtgccccgccgtccagcgacccggcatcgccttctgcccgcgtcgccgcacaggaggaggactga

SEQ ID NO: 164 - DNA, 822 bp, Actinoplanes utahensis
gtgaccgacaccctggccgaccacgccgaccgcggtctgcggcgcggcgaactcctgatcgagttgaccggcgtcggtaagacgtacggagcgatccgcgccctgctggacatcgacctacgggtccgggccggtgaggtgacctgcgtgctgggcgacaacggcgcgggcaagtccacgcttatcaagatcatctctggcctgcatccacacacctctggttctctcaaggtcgacggtgccgcccggttcctcggctcgccgcgcgacgcgctcgatctgggaatagccaccgtttaccaggacctcgcggtggtgccgctcatggaggtctggcgcaatttctttcttggctcggaaatcgtctccggtcgtttccccctggctggcatgcgcgtgcgggaaatgcgccgcatcgccgaccgggaactccgcaaaatgggtatcgcggtggctgacatcaatcagcccatcggcaccctgtcgggcggccagcggcagtgtgtcgccatcgcccgcgcagtgtatttcggcgcccgcgtgctgatcctcgacgagcccacggcggcgctcggcgtgaagcagtccggggtggtgctgaagtacatcgccgcagctcgggatgcgggcctcggcgtcatcctgattacccacaacccgcagcacgcctacctggtgggggatcatttcgtgatcctccagcggggcgtggccatcctcgatgccgggcgcggcagcgtcaccctggaggagctgaccacgcagatggccgggggtgacgaactcgcggaactgtcgcgtgaattggagcgccgatcatga

SEQ ID NO: 165 - DNA, 1026 bp, Actinoplanes utahensis
atgaccgccctggccgcagtacgcgtcggagtgatcggcaccggcctgatcggccgcgaccacatccgtcggatggcgaccggaatgtccgcgatttcggttgtcgcggtggccgatgtggacctggtcctggcctcccgcgtcgccgcctcggtcggcgccgaggtcttcaccgacggtctcgacctgatcgcctcgccccgggtcgacgccgtcgtcatctgctcctggggccggacccacgagcgatacgtgctggccgcgatcgccgccggcaagccggtcttctgcgagaaaccgctcgccaccagccagcacgcctgcctgcgcatcgtggaggccgaggtcgcgcacggcagccggctggtgcaggtgggttacatgcggcggtacgacccggcctaccgcgcggtgaaacgggtgctggacagtggcgtgatcggcgccccgctgatgatgcactgtgcgcaccgcaacgccggggtgccgtccttctacgagccggagaacacgatcacggacaccgccgtgcacgagatcgacatggtgcgctggatgttcggcgcggaggtgaccgcggtacgcgtgctgcgtccgcgggcgagccggaacgccggcgtcctgcccgacccgtcactgctgcttctcgagcttgcgaacgaggtgctggtggatgtcgaaatctcggtcaacgcccggtacggctacgacatccgcggcgagatccttggcgaggacggcacggtctcgctcggcgatcccgggctgatcgcggtgcgccgggcgggccggctggcgagtcccgtgcccgaggactggcgggagcggttcggcccggcgtacgacatcgaactgcgcgagtgggccgattcgctggtcggcggtggagaggccggcggcccgggcgcgtgggacggctatgccgcctcggtcgtctcggacgcggcggtgcgggcgctgcggaccgcggagcgcatcccggtgagtctggtcgatcggcccaagttgtacgcgttgtcgggctga

SEQ ID NO: 166 - DNA, 714 bp, Actinoplanes utahensis
atgtttaccaaccattcggtcggtaattcaagccctcgccttactctcctcgtcaggtctgacatatttcgctccatggacaccgcgcagcccgcaccgcgccgccgcggccggcccggccacgacgtcgacgccgtgctggccgccgcggtccggctgttcaacgcgcacgggtacgacgcgaccagcatgttcgacgtcgcggagacgctcggcatcaccaagtcgaccctgtaccaccacgtcagcagcaaggagcagctgctcgggatggcggtggatcgcgcggtggacggcctcttcgaggcggccgagcaggtgcgtgacgcgccggcatccgcgacggtacgcctggaggcgctggtccggagcagtgttctggtgctcgccgagcgcctggagttcgtcacgctgctgctccgcgtccgcggcaacacagcggtcgaacagcacgccctggctcgtcgccgggaattcgacgcgctggtcaccgagctcgtcaagcaggcccaggccgaagggggcgtccgcgcggacgtggacccggcgaccgccgcgcgtctgctcttcggcatggtcaactcgctggtggagtggtaccgccctgatcgcggccggcccggggcgctggccgacaccgtggtccggctcgctttcgacggacttcggacaatagacacaaccgatgatcaacacgttcaagacgaacaatga

SEQ ID NO: 167 - DNA, 1686 bp, Actinoplanes utahensis
atgacgacacccgctgacctgtacgccacccaccgtgagctgcttgagcgcgcgatcgaggcggcctccgcccgcgactactggtccgcctacccggagtcgcccagcaagtcggtgtacggcgaggacgccgcacccgccggcgagcgtgccttcgccgccctgctcggcaaccggttcccgatcgacgtccccggcgccaccggcaccgtgtccaccgagcgctcgccgttcggcatcgagctcggtgtcagctaccccaaggccgacccgctcgccctggtcgccgccgcccgcgccaccatcccgtcctggcgcgccgtcggcccgcagggccgggccgggatcgccgccgagatcctgcgccggatcaacgcgcgcatcttcgagatggcgcacgccgtccagcacacctcggggcaggcgttcgtgatggccttccaggccggcggcgcccacgcgcaggaccgtgcactggaggccatcgcctatgcgctggccgccaccacccgcatgcccagcacctcgtcctgggccaagccgcagcgcggcggtgacccgctgagcatgaccaagaccggcaccgtcgtcggccgcggtgtcgccctggtgatcggctgcaccaccttcccgacgtggaacagctaccccggcctgttcgccagcctggtcaccggcaacccggtcatcgtcaagccgcacccgggcgcggtcctgccgctcgccatcaccgtgcagatctgccgggaggtcctgaccgaggccgggctgaacccggacgtcgtcacgctcgccgtggaggagccgggtgacggcatcgccgccaccctcgccacgcatcccgacgtgcggatcgtcgacttcaccggctccagcgagttcggcgactggctcgaggcgaacgcgcggcaggccgtcgtctacaccgagaaggccgggctcaacacggtcctgctcgactccaccgacgactaccgcggcctgctgcgcaacctggccttctcgctctcgctctacagcggccagatgtgcaccaccccgcagaatcttctgatcccccgcgacggcatcgacacggaagccggccgtcgcaccccgcaggagttcggcgcggacctggccaccgcgctcggcaagctgctcggcgatccgaaacgggcggccggcactctcggcgcgatcgtcaacgacggcgtgctggcccggctcaccgaggcggccgggtcgcccggcgtggtgcacccgtccaccgaggtcaccgacgagcagttcccgggcgccaccatccggacgccggtggtgctgagcctggacgccgccgacgacaagacctacacccgcgagtggttcgggccggtctcgttcctgatcaccaccgactccaccgagcacagcctgcgggtgttcaccgagacggtgcgggcgcacggcgcgctgaccgcgctggtccactccacgtcgtccgaggtgctcgcggccgctcgggaagcggcgctggatgccggcgtgcacctctcggagaacctgaccggcggcgtcttcgtgaaccagacggcggcgttcagcgacctgcacggcaccggagcgaacccggccgcgaccgcctcgctgaccgacgactacttcgtgagcggccggttcttcaccctccagtcccgccaccacgtgccggcggcgacgtcatga

SEQ ID NO: 168 - DNA, 861 bp, Actinoplanes utahensis
atgccggacggataccgccagaccctgatccggcagatcgcccagcacgcccactccgagatcatcggtatgcaaccggagggcgattggatcacccgcgccccgacgttgcggcgcaaggcgatcctgctggcaaaggtgcaggacgaggccggtcatgggctctacctttattcggctgccgagacgctcggcgccgaccggggcgatctgacccggcggctgatcgagggtcggcagaagtattcgtcgatcttcaactatccgacgctgagcttcgccgacgtcggggtgatcggctggctcgtcgacggcgccgccatctgcaaccaggtgccgctgtgccgcagttcctacgggccctacgcccgggccatgatccggatctgcaaggaggagtccttccaccagcggcagggctacgagttgctgatgaccatgatgggcggcaccccggcccagcgggacatggtgcaggatgcggtgaaccgctggtggtggccctcgctgatgatgttcggcccgcccgacggtgactcaccgaactcggcccgctcgatggcgtggaaaatcaagcggcacagcaacgacgagctgcgccagcggttcgtcgacatgagtgtgccgcaggccgaggcgctcggcgtcaccctgcccgactccgagctgcggtggaacgccgaccgggagcactacgacttcggtgagcccgactgggctgagctgaaacgcgtgatcaccggtgatgggccgctcaaccggcagcggatcgcgcggcgccggcaggcggataccgacggggcctgggtgcgcgaagccgccgcggcgcacgcggcgaaacagaccgggagcgggcgatga

SEQ ID NO: 169 - DNA, 1176 bp, Actinoplanes utahensis
atgtacgccacgagtggccgctgttcgaggtgttcgtgcgggccaagcgcggcctcaaccacgtgcatgtcggctcgctgcgggccgccgaccaccggatggctctgcagcacgcgcgggatctgtacacccggcgcaacgagggggtcagcatctgggtcgtgctctccgacgacgtggtggccagcgaccccgatgacaaggcggcgtatttcgagccgagcgccgacaaggtgtatcggcatccgacgtactacgccatccccgactcggtgccgcacatctgaggtgaccatggccttcgacgacgcgtacggtgcgctcaccgatcatgacgacgacgcccgctgggcgtatgggaccggcttcaccgaccccctcgccggggtgcccgccgcgttccccgacggggtggatcggggcgacctggccacctactgcctgatgctcggcgacgacgcgctgatcatgtcccaccggttgcagcagtgggtcacccgtgctcccgagctcgaggacgaactggcgctggccaacatcggactggacctgctcgggcaggcccggctgctgctgacccgggccggggaggccgggggtggcgggcatgacgaggacgcgctggcctaccaccgtgacccgcacgagttccgcaacgtgcggttggcggaacgggccgacggcgacttcgcccagctgaccgcccggctgctggtcttcgcgacctggcggctggcgctcttcgaccggctcgccgcctcccgcgacccgatgctggccgcgatcgccgccaagggggtcaaggagctgacctatcaccgggactacgccgcgcagtgggtggtccggctcggcgacggcaccccgctgtcgcacgaccggatgaccgcggcgatgaccggggtgctctcagcggccggcgagctgttccgcccgcacgaggtcgaggcgcggctggcggccgacggcgtcgccgtcgacccggccacccttcgtgccgagttcgacatggtgctcgccgaggtgctggccgcggcgacgatcgacgccggctcggtgacggacgacgacgaggccgctggccagggccgcgacggcgcacacaccacggccctcggcgagatcctcgccgaaatgcaggagctggcccgtgctgtccccggaggtacgtggtga

SEQ ID NO: 170 - DNA, 489 bp, Actinoplanes utahensis
atgaacgccgagctggtcgtcggcaccgtcaccgacccggagctgccgatggtgaccctggccgagctggggatcgtgcgcgaggtccggcaggacggtgacggtgtggtcgtgacgatcaccccgacctattcgggctgccccgccatggaggcgatccgcgccgacatcgctacggcgctgcgccgggccggcttcgggccggtcgaggtgcgcaccgtgctggcgccggcctggaccaccgactggatcagtgagtccggccgccgcaagctcgccgaggccggcatcgcgccaccgggggccgcgcctcgccgggcgggcgggccgatcccgctcaccctcacgccgcggtccggcgccgtcccgtgtccgcgctgcggctcggcggagaccgaagcggtcgccgcgttcggcgccaccgcctgccgggagttgcgtcgatgcccggcctgccgggagccgttcgaacacatgaaggagatctga

SEQ ID NO: 171 - DNA, 1047 bp, Actinoplanes utahensis
gtggcgatcagcggtttccacacgctgcgggtcgccgcggtcgatcggctgtgcccggacgcggtcgcggtgaccctggccgtgccgcccgagctgaccgagcgattcgcgttccggcccggtcagtcgctgacggtccagcgggccggcgaacgccgaacgtattcgatctgcgcccccgccggcggcgcgccccggatcggtgtgcgcgaggtgcccggcggccggatttccggctggatcgtgcacgacctgcgcgtcggtgacgagttggaggtggcgccgccgtccgggacgttcacccccgatctcacggcgggcgggcggcacgtgttgatcgcggccggctccggcatcaccccgatgctgtcgatcgccgcgtccctgctgcgtcggccggatgccgaggtcgtcctgctctacggcaaccgccggaccgacacggtgatgttcgccgaggaactcgccgacctgaaagaccgctatccggcccggctggagctggtccacgtgttgtcccgggagccccgggaggccgacctgttctccggtcgcctcgacgcggcccggctgcgggcactgctgccgctgctgatcgacgtcccggcggtcgaccactggtggctgtgcggcccgttcgggatggtcgtcgacgccactgaagtgttgagcgaggccggggtcgcacccgagcgcatccaccgagagttgttctgggccgacgaggcgccgcccgagccggttcgccccgagccggagtcccgcggcccgagcagcgagatcaccgtccacctggacggccgcgcgaccacggtcaccgtcgaacagggcgtaaccctgctggacggcgtccagcgcgcccggcccgacctgccgttcgcctgcaagggcggcgtctgcggcacctgccgagcccgcgtcatcgaaggcgacgtcgccatgcgccgcaacttcgccctggaagacgccgagttggccgccggcttcgtcctcacctgccagagcacggccacttccccgaaagtggtggtcgatttcgacgaataa

SEQ ID NO: 172 - DNA, 603 bp, Actinoplanes utahensis
atggaggttttcgatcaactcgctgagaagtatcagggcgagcacagccataatccctaccagtcggcgctgatcgagaagatcggcaccctgcttccggccggcacctcggtgctcgacctgggctgcggcaccggggtgccgaccgcccgcgttctgaccgagtcggatcaccgcgttgtcggtgtggacattgccgagggcatgctgcggctggcccgtgagcaggtgcccgcggccgagttcgtgcatgccaacttcgccgagctgccggcggatttcggcaggttcgaggcggtcaccgcgttcttctcgctgctcatgctcagcaaggcggacatcgaacgcaccctcgacaagatcgcgggctggctgcagccgggcggatacttcgcgatcggcatggtcaacttcgacgcggacagcatcccgatcgaattcatgggagtgccggtgaccgtttccggctacctggagccggacctcagggcggtcctggaaaagcacggcttcgaggtcgcaacgatcgagacggtgttcttcacgccgaccgacgggccgcaggagagccagatcttcgccctcgccaagctccggccctga

SEQ ID NO: 173 - DNA, 285 bp, Actinoplanes utahensis
atgaccgctcgaggaatgctcaccatggtcggcaccgccgtcggcggtctgatcggctggccggaaagcacaccgtccgccgacccggcgagcctgcgcaccctgttcgccgacttcggcgtcacggtcggcccggaaccggcggacctgacccaggcggtgctcgccttccaggcccgggtcggcctggacaccgacggcaccgccgggccggagacggtgcacctgctcgcccgctatgccgccgaggcccgtgaactcaacgagttccgccgggccgcctga

SEQ ID NO: 174 - DNA, 342 bp, Actinoplanes utahensis
gtgaattccggtcgtatcgcctgctccatcggttttgtcatgctggtgctgggctccaccgcgggatgctcccactcggacgccgtgtgggtgcagggccgcgcccatcccgccgcgagcgccccgccgcccgccgacaaccaggatcgcttcgtcgctgccgtccgtcaggaactgcccgaactagccgtggatcgccgggacgaggagatcgccgatctgggcagcacggcctgcgcgtcggcacacggtcaagaacatgacgatcttgccgcgtacggcgtatcccccgaacaggcccgcaaactgaccgacgtggcccgggccgccctctgtccgtag

SEQ ID NO: 175 - DNA, 1002 bp, Actinoplanes utahensis
gtgggcgtggccgggggtccggcagcgccgtggtggcgacaggggcgatggcgtacagcgaagtcacagaccgctcaccggttcgggacaatctccgggaacaccgtgaagaacatgaccgagccgctgaaccgttccgccgccgagcatcaccacgtaccgtcgtcgttctacccgcccgtcacgcacatcccgccggcgatggtgcggaccccggccgacccgcgttggaagcgccggatcgccggcggcgccgcggtcctggtcctggtcctggtcggcggtggcagcagtgccggagcgttcctgaccgagcagtacctgaacgggcgcccggccacggcgagcagcatctccgggacgaccgtggcctccaccacgatcaccgagggtgacgagctggcgccgatcgtcgcgaaggtgcggccgagcgtggtgaccgtgctggtcgacggggcgcgcgaatcgtcgctcggctccggtgtggtggtcagcgccgacgggctgatcctcaccaaccatcacgtgatctcttcgaacggcacggtcagcgtgcgcctgtccaccggcacgacggtgccggccaaagtggtggccgcggacccgacgcacgacctggcgctggtgcaggcgaccggggtgtccgggctgaccccggtgaccttcgcgaccgacgacagcgtggcggtcggtgacacggtgctggccttcggcgccccgctcggccttgaggggacggtgacctcggggatcgtgtccgccttcggccgcagcctggacaccggtgccgagaagctctccggcctgctgcagaccgacgcgccgatcaacgagggcaactccggcggtgcgctggtcgacacggccggccgggtgatcgggatcaacgtcgccatcgccacgtcgggggacagcaccggcagcgtcgggctcggcttcgcgatcccggccgatacggtcaccggggtggtccgtcagcttcagacccgggccgccggctga

SEQ ID NO: 176 - DNA, 3489 bp, Actinoplanes utahensis
atgcgcctgctccgcgacctgtgggttacctcccgaagtcgcacggcgctcgccgtgttcctgatcgtgctcggcgccgccggctcgtccgtcgcgctggcgctcgccggatcggtcctggtcgaccgctccgtcctgctgttcaccgtgctggccggggcactcggcgcgatcgtgctcagcgacgtcgtggtcggcctgatcgccgcccggctgaccgccgactgggccgccgaggtccgccgcgggctcaaccgggtcgccttcggccaggacatccccaccctggagaacacgccggtcggcgagctgctcgaccggatcgactcggacgtctaccaggtcgcctccgagctgcgcggcagcggcgtgcggatcgcgcagagcctggccgtggcgaccctgtcgatcgtcaccgcgttcttcgtctggtggccggccggcctcgccatgatcgcggtcgccgtcctgatcttcatcaccatgaacaagccgatccagcgcatctccgccatccggatcgccgaggaggaggcctggtccgacctggccgcggtgatggaggaggcgatccacgggcaggacgacgtgcgcaccagcctcgccgcgccgtacgtgctgcgcctgtacgccgaccgggcccgcgaggtgctctcccgtggccgccgcgtctggcgcacctcgtcccgggtcaccatgggcgccggcaccatcacccgcacgctgatcgcctcgctcgtcgtggtcggcgcctgggcgctggccaccgggcacatcgacggcgcccggctgaccggcgtgtggctgctcgccctgggcttcggcggcaccctggaacagatcacccggatggtgcccgagctgcagaacgcgctcggcgcctggggccgggtgcagatgctgcgcgccgtgccgcaggagccgtccggtggccgggcgcccgccgacggcgacctgatcgtgcgtgacctgaccttccgctacggcgaggcggacagcggccgcccgccggcgctgcgcggcgtcaccctcaccttcgcccgcggccggtcgtacacgttgatcggccgcaccggatccggcaagtccaccctggccaaggtgctgacccgggccgtcgacgtgccgcccggcacggtcttcctcggcggcgtcgacctgaacgacctcgacgtcgaaggcctgcgccggtggaccgcgatcgtcccgcaacgcaccgagatcctggccggcaccctggccgagaacatcgcgctcttcgacgaggacctactgccccgggccggcgcggccctcgacgaactcggtttgagcagctgggtcgccgggctgccggacggcatcggcacccggctcggcgagggcggctacaagctgtccgccgggcaggagcaactggtggcgttcgcccggatcctggtccgcgacccgcaggtggtgatcctcgacgaggccaccgcccggatggacccggtcaccgagtcgtgggtgcagcaggccaccgaccggctgctgcgcggccggatcggggtgatcgtcgcgcaccggctctcctcggtgcaacgctgcgacgaggtggtggtgctcgccgacggcgaagtgctcgaagccggcccgttgcgcgaatcgcgtcgcttcgccgagctcatggccagcagcaacctgaccgtgccggcgccggcccgagaccggtccggcggcgtgctcgtcgaggaacgccatgactgggacgccgctgtccggctcgaactcggcccggacgcgctcagcaacccgctgccgaccgtcgagccgcctccgctgcccaccccgccgcgaacccggacgatgcgggagatcgtccggctcgccaccaacgacgcgcggtacgggctgggcgcggtctcgctcttcgtcttcctcgtggtcttcgggctcgacggcgcggtcctgccggtgctgtggtcccgggtggtcgacggggtcggcaacccgatgctgcccgccgtcgggatcgccgcctgcctgatcgcgctgatcccgaccctctacttcaccggggcctggttcccggaatggtgggtgcggcagatgctgcggatcagcctgcgcctggtgcacgggcagatcgggccgcgccgggtcagcaagcacaccccggccgaggtggtcgcccagggcggcgacaccgagcgggtggtgatgctggccgacaatctgatcgacaacggggtggcgctcgtcgtcgtggtcgccatgaccctgacctcgcgctcgccggtgccggccctgttcttcgtcggcaccatgctgctgtccggcctggccgccaccctgttcgggccgcgcctggaacaggcggcccggcgcaccgtgggggcccgcgccgcgttcgcgaccgcgctggtgtccgcactgtccgcggcacgcacggtgaaactggccggcgcgaccgaaccggtgctcgcccacctggccaaacttgacgcccggcgcagcgaactgcagtggcgggagatcgcgatccaggtgtgggcgcggtccaccccgtcgatcgccagcggcctgctgccgatcggcgtctggtcgctgtacctcaccgaccggctcagcgccgcggccaccctggtcgcggtcgccaccctcggctcggcccgctggttcgcgtggaccacggcgtcgctggtgtcacacttcccgtcggcccgggtgtggacggcgcggaccgtcgcgatgaccggctccgccgaatacaccgccgagatcccgggcgtcgacatctccgccggcaccgcgccggcaccggcggccgcggcgcgcaacccgctgcgcaccctgcagctgcgcggcttcagcgccgtccacgaaaacggcgcccaaggcgtacgcgacatcgacctgaccgtcgaccgcggcgacctggtgctggtcgtcggcccggtcggatcgggcaagtcgtccctgctgcgggccctcgccgggatcgtgcaccacaccggcgacctgtgctggaacggcgaaccggtgaacgagccggaactcttcctgcgacccaaccaggtggggtacgtcgcgcagctcccccgggtgctttccggcaccgtggccgacaacatccgcctcggccacgaggtggacgccgaggacgccgtgaccgtggcgcagctgcggcacgacctgtccgcggccggcggtgggctgcagctgctgatcggccacaagggaacccggctctccggcggtcagctccagcgcctcgccctggcccgcgcgctggcgccgcggaccgagctgctgatcgccgacgacgtgtcgtcggccctggacgtgacgacggagctggaactgtggcgggcgctgcggtcgcatggggtgacggtggtgggctcgacgtccaagcgggccgcgctggcgcaggcggatcgggtggtggtgctgatcggggggaaggccgaggatcaggggacgtgggccgagctggaggaccggtggggtcacctggccggctga

SEQ ID NO: 177 - DNA, 1194 bp, Actinoplanes utahensis
atgcttgtctgcatgtcagtggaagaggcggcggtcgcggcgcggccgcgacgccggcgggcgggcgcccggttcggtgtcattctggtcgcggtgctcgcgctgctcttcggcgtgccgtgggccacgctgctctggtcgggcaacgcttggccggccccggtccggatcgccggcacggtggtgttcgtgctggtggcggcggctttcccggtcctgatgttccgcggtcacggccgccgtgacgaccgcagctcgcggatcgccgacaccaccctgggcgtggtctgggtgctgttcacctggtcggtgctcggccagctgctcggcctggtgctggccctcgccggggtcgccgacccgatccgttcccggctggtcaccgggctggtcctggcgatctccgcggtcctgctgctctggggccaccgcgaggcgatgcgggtctcccgggtccgcgcggtcgacgtcaccatctcccggctcggccgcgggctggacgggctgcgggtggtgctgatcaccgacacccactacggcccgatcgaccggtcccgctggtcgcgcggggtgatcgacgtggtcaactcgctgcgaccggacatcgtggcgcacaccggcgacatcgccgacggcgaggtcccgcagcggctcgcccaggccgccccgctcggcgacgtccgggcatcgatggcccgggtctacgtcaccggcaaccacgagtacatgtccggcgccgccggctgggtcgagtacatgtcgtcgctgggctgggacgccctgcacaaccgccacctggtcgtcacccgcggcggcgactcgctggtcgtggcgggcgtcgacgaccgcaccgcggccggctccggcgtccccgggcaccacgccgaccacgaggccgccctggccggcgccgacccgaccctgcccgtcctgctgctggcccaccagccgcagcagatcgacggcgctgtggcgcacggcatcgacctgcagctgtccgggcacacccacggcgggcagatgtggccgttccactacctggtccgcatcgaccagccggtcctgcagggactgtcccggcacggcgaccgcacccagctctacaccagccggggcaccggtttctggggcccgccgttccggatcttcgcgcccagcgagatcacggtgctcaccctgcgctcggcggagtga

SEQ ID NO: 178 - DNA, 654 bp, Actinoplanes utahensis
atggagagcacgtttccggagttggtggatcgggcccgcgggctggtggccggcgggcggcgcgcggtgctggggatcaccgggccgccgggcgccgggaagaccaccctggccgagtcgctgctggcggcgctgggcccgggtgacgaggtggcgcacgtgccgatggacgggttccacctggccgacgtggagctggagcggctgggcaggcgcgatcgcaagggcgcgccggacaccttcgacggctggggatacgcgtcggtgctgcggcggattctcgccgatcaggacgagatggtgtacgcgccgggattcgaacgggtcctggaacagcccatcgcggggacgatcggggtgtcccgcgccgcccggctggtcatcaccgagggaaactacctgctgctcgaggacggccggtgggcgggactgtccggagtgttcagcgaagtctggtatgccgatctggagccggccgaacggctgcgtcgcctggtggcccggcacgttcggttcggcaagtcgccggaggacgcgctgacctgggcgaccgggaccgacgagcgcaacgccgagctgatcgccaccacccgggaccgggccgatctcgtggtgccgtccgcgctgctgagaacgctggggagagtgtcgtag

SEQ ID NO: 179 - DNA, 654 bp, Actinoplanes utahensis
atgttccggctcatccagctgcacaccgaggccggtgtgccacagatcggcgtcgacccggacggctacgtcagcgcccgcgccgccctggcccgctaccgcaccgccccggccacctacttcgcggtcggccgcttcgaccacgagggcaccctcaccgaggtgatcctcgacccgtcctgcggcctcgacggcgcgtgccagcggcccgcgtcggtcatccacgccaagacctaccagcggctctgcgagggctgcgcggccgggatggacgtgctcaccgttccgcagctggcccgccggctcggcatcgcctgccggctagcgccgccgatcagccggctgcggcagaacaccctcggcgggctgcgctccccggccgggaaccggatcgcccgcgaattcgccgaccacgtgcacgacccggcctggcgggccgagctctgcggcgaactgggccagacgccgatcgcgctgaacgggctgctgatcggggccggggcgctcagccaccggcaggtgctcgatctctacccggtgctctgcgcgctcggcgacgaactgcccgccggggtgcgggacgacctggcgcgggccaccgcccggccactgtcgccggccggcgtggcggggctgcgactcgggctgggctga

SEQ ID NO: 180 - DNA, 174 bp, Actinoplanes utahensis
atgctggtcggcgtgcgtaccggtcagggggtggcctgtgtctgcgggcacccgttcgaggctcatcagcactaccgcgccggcaccgagtgcgtgatctgcgcgccgcgcgagtgtgcccgcttccgccgcacccgctggtggcgccgctggaccgcgggccgtgccgtttag

SEQ ID NO: 181 - DNA, 954 bp, Actinoplanes utahensis
atggcacttcccgacttcctgatcgccggtgtgcccaaggccggcaccacggccctgcacgcggcactggtgcaccaccccgacctgttcctgtcgccggtcaaggagcccaagttcttcctctccgacgggccgccgccgcggcacggcggtccgggtgacgtgcagacctaccaggagcacgtctggcggcgcgaggactacgaggcgctgttcgcgcccgcgccggccggcgccagactgggcgaggccacgccgttctacctgcacgacctcggcgcgcacgaccgcatcaaggcggtgcggccggacgtacggctgattctgcttctgcgtgatcccgtcgatcgggcgcactcgaactggacccacctgtggaacgccggcctggagcccgaggccgacttcctggccgcgtgccgggccgagcccgcccggatcgaggccggctgggcgcagttctggcactacctgggcctggggttgtacggccggcagctggagcacctctaccagcgcttcccgcgcgagcaggtgctgctgctgcgctacaaggagctcaaggacgcgccggcggccaccctggaccgggtctgcgcgttcctcggcgtgcgcaccgggctgctcaccgcgatcccgaaggagaacgtcaaccggcacgtcgtggaggacaacggactgaaccgggtgctgcgcgggctgctgcgcgccggcggcggtttcggtcagcacttcccggtgccgctgcggctggccgcccgcggcccgctgctcaccctgctgcaccgcaagaagggtgcgcgcccggtgaccaccccggccgagcgggcggagctgctgccctacttcgccgaggacatcgcgctgctgcaggacatcaccggcgagcggtacgacgactggctcagtgtggaccgacacgcccgcgcgccggaaaccccacccgttcaatag

SEQ ID NO: 182 - DNA, 912 bp, Actinoplanes utahensis
gtgtctgtcggaaccaccgccctgcccctgccccgctgggaagactccaccgtggtcgtggagccgccgggcaccgagccgggtgcgtggtccggcgcgcccagtgcgatcgccgccgacgggcacatctacctggcgtaccgggtgcgcctgccgatcggcgccggccgcgggatcgccaacgtgatcgcccgctccgccgacgggctcgccttcaccgtggtcgccgaagtgggcaaggaccggttcgccgccgagtcgctggaacgcccggcgctggtccgcaccccgcaggggcggtggcggctgtacgtcagcgcggccaccccggggaccaagcactggcgcatcgagatggtcgaggcggacaccccggagggtctggccgcggcgccggcccggaccgtgctggccggtgacgccgagttcggctggaaggacccggtgctgcaccacgacgggcacggctggcacctgtgggcctcggtgcacccgctggagtcctgggacgacgccgaccggatgaccaccgagtacgcgaccagcccggacggcgtgcactggacccggcggcggaccgcgctgtccggccgggcgggccggtgggacgcccgcggggtgcgggtgtcgtcggtgtcggtgaccggcgacgacatcaccgtggcctacgacggccgggcgaccgcgggggagaactgggaggagcgcaccggggtggcccgcggccggcggctcgccgacggcagcttcggggagctgaccgccgaggacgacgagccggtcggcagcccgcacccgccgtacgggctgcgttacgtgagtctggtcgatctgccggacggcacccgccggctgtactacgaggccacccgggaggacggggcgcacgacctgcgtaccgaacgggtgtag

SEQ ID NO: 183 - DNA, 999 bp, Actinoplanes utahensis
gtgcgcacgctgggcggccggtatcggctggagcaccggatcgggctgggcggcatgtccgaagtgtggcgtggccacgaccaggtgctggaccgcccggtcgcgatcaagatcatggcacccgcggtggagggcacgctcggtcagaccggtgtcgacctgatccgggccgaggcccgctcggcggcccggctggcccacccgaacgtggccggcgtgcacgatttcggcacctcgccggcacccggtcggcgcgacgtcccgtacatcgtgatggagctggtcgaggggcagacgctcagccagcacctggccggcggccggctcgactggcggatcggggtgcggatctgcgccgaggtggccgccgccctggccgccgcgcacgccgagcaggtggtgcaccgcgacatcaagccggccaacgtgatgctcaccccgagcggcgccaaggtgctcgacttcggcatcgcggcggcggtcggcgcacccgagccggacaccggcgggatggtgatgggcaccccggcctacgtcgccccggaacgcttcgacgggatgccggccaccccggcctcggacatgttcggcctgggctcgctgctctaccactgcctggccggccgggtgccgtggaccacccgctcgcccaccgagctgatccgcgcccagcgctaccacgacccggagccgctgccgagcctggacggactgccgcccgaggttctcgacctgtgtttccgctgcctgcgccgggacccggcggagcggccgaccgcactggtcgcggcgctgctgctggccgaggcggtggacgcccgggtgtacgtgccgatgatggagatgaaaccggtggtgccggcctgggaccggaccgccgccgaggccgcgacgtatgccggcccgcaggagcaggccgcgacgtatggcggcctccagcagcaggccgcgacgtatgccggcccgcaggagcacgcgggccggcaccgcctcgactag

SEQ ID NO: 184 - DNA, 1410 bp, Actinoplanes utahensis
atggccagaccagggttgttcgcgatccgcgacgtcggatcgctggtgcaggacaccgccgaggagggcaccgagctcaagaaggcggtcggggtcacccagctgaccgcgatgggcgtcggcgcgatcatcggcaccggcatcttcgtggtgatcggcaagggctcgggcatcgccggcccggccgtcgtactgtccttcgtgctcgctgcggtggcctgcgtgttctccgcgctgtcgtacgccgagctggcgtcctcgatcccggtctcgggcagcgcgtacacctacacctacgccaccatgggcgagctcgtcgcctggatcatcggctgggacctgatcctggagtacggcgtctcggtggccggcatcgcgatcggctggggcggcaacctcaacgcgttcctggacgccgcgttcggggtcagcctgccggacacgatcgccaagtcccccggcgagggcggggtggtcaacctgccggccgtcttcgtcgtgctggcgatcaccctcctgctggtgcgcggcgtgaccgagagcgcccgggccaacctggtcatggtggtggtcaagctggtggtgctgatcttcttcctggtggtggcgttcgccaacttcagcacgcggcacttccacccgttcgccccgcacggcacgcacggggtgaccgcggccgcggcgatcatcttcttcgcctacatcggcttcgacgccgtctccaccggcagcgaggaggcccgtaacccgtcgcgcgacctgccctgggcgatcatcggctcgctcgccatctgcacggtcttctacgtgctcaccgcgatcggggcgctcggcatcgccagcccggaccagatgaaggacagcgacgccccgctcgcggccgccctcgaccagggcgccgggatgagctgggcggccgggatcctggcactgggcgcggtggtcgcgatcaccagcgtggtgctggtgatcttcttcggccagacccggatcttcttcgccatgtgccgcgacggcctgctgccgcgccggatggccaccgtccacccgcggttcggcaccccggcccggatcaccgtcacgctcggcgtgctgatcgcgatcctggccgcgctggtcccgctgggcaccatcgtggaactggtcaacatcggcaccctgttcgccttcgtgctggtcaacatcggggtgatcgtgctgcgccggacccgcccggagatgccccggccgtaccgggtgccgtggtcgccggtgctgcccctgatcggtgtcgcgttcgccgtctacctgatgagcgacctgcccggggccacctggctgcggttcggcgtctggctggtggccggtctgatcatctacgggctgtacggctaccggcactcccgggtacgtctggagcgggcggactag

SEQ ID NO: 185 - DNA, 327 bp, Actinoplanes utahensis
atgggtgaggccgtgatcaccacgcggcggcaggccgacggcgccctggtcgtcgaggtgcgcggcagcctggacgcggcgaccgtcgacgggctgcgtgccaccctcgtcgacaccgtgctgcgcgaccgtccggccgtcgtcgtcgtcgatctgacctatgtgaccttcatggactcggtcggcctcggcgccctggtcgccggcgagcggacggtccgcgacatcggcggccggttccggctgcgcaaccccagcgagttcgtgcatcgccagctccgggtcaccggcctggccgagttgctcggcgtcagcttcggtttctga

SEQ ID NO: 186 - DNA, 1470 bp, Actinoplanes utahensis
ttgccctcgtctcgtcgttccgtcgtcaaggcgggagtgttcggcgcggtggccctcggcggcggtctgagcgccacccgccccaccacctcgcaggtcagcgccaccatcctggagaaccggttccagggcaacaagggctggctgccgcaggagaacgtgaacgacgccgcccggcagatccagggcttcgcctccgcgacctcggtcaacaagggcgacacgatcgacttccacgtcaccctcgcgacgccgcagcacttcaccgtccagctgttccggctcggtcactaccggggcgtcgggggccggctggtgcacaccagccccaacctgtccggcagcacgagggtggtgcccacggtggacccggtcaccggaacggtggactgcggtgactggcccgcggcgtactcgttcaaggtcccgccgggctgggtctccggtctctacctcgcggtcttccgcacccaggacgggcaccgctcggtcaccccgttcgtggtgcgcgacgacagccgccgctccgacttcgtcatggtggtgccgttcaccacctacaacgcgtacaacgtgtggccggccgacggccgtaacggcaagagcctgtacaagggctaccggccggacggcctgatgggcgacgccacccagcgggcgtacgaggtgtccttcaatcgtccgttctccggtgggggccgtcccacctggttcgacatcgacgtcgccaccgcgcagtggatggagtcgcagcggtacgacgtcacctatgtcagcagcatcgacctgcacgagggccgggtcgaccccagccggcaccgggcgctgatcttctccgggcacgacgagtactggaccgcttccatgcgggacgtcgtgcagaaggcgatcaccggcaacacccacgtcgcgttcctggcggcgaacaacctgtactggaacatccggatcgaggcggacgcgcgcggcacctccggccggatcgtcacctgctacaagggtgcgcccgacccggcgcccgacccgatcggcgagaccaccctgtggcgcaacctgggcaccggccaggagcacgccgaggcccggctgctcggcgtgcagtacaggggcatcctggccaccccggtcccgatggtcgtgcagaacacccagcactggctgtgggccggcaccggtctcaaggacggcgacacgatccgggacctggtggcggtcgaggcggacggcttcgagtcggatctgccgaccgactacgagtcgacccagacgctgctgtccgccagcccgtacaccgaccggatgggccgcggcgaccgggtgcagaacaccagcgtctgcgagacgccgaacggcaccatcatgttcgtcgccggcaccttccactggccgctcgcgctggtcaagtcgaaggtgaccgacgcccgcatccagcgcgccaccaagaacctgttcgatcgcttcctgaggtag

SEQ ID NO: 187 - DNA, 1266 bp, Actinoplanes utahensis
atgcaggctctgcgcttcgccgccgcgttgtaccagcgtcaactagccatcaactactggggccgggtgcggcgggatccactgtcccgcctgcacctggccgaggggcgcaacgacccgtacgccgtatacgacgaggtccgcgcccacggcccgctgatgccgacccggctcggcaactacaccaccgccacccacgcggtctgcaacagcgtgctgcgcgaccgcagattcggcccgcgcgcggtcgagatgaacgggccgggtgccccgggcgaccagatcgacatgtccttcctggacaaggatccgccggaccacacccggctgcgccgcctcgcccagccggcgttcagccccaagcagatcgccggttaccgcccgcgggtcgagcaggtggtcggcgacctgctcgacgcggccgccgccaagggcaccttcgacctggtgagcgagttcgccgcgccgctgccgatcgcggtgatctccgacctgctgggcatcccggacgcggacgccgacgcgttcgccgagcacggcgcggtggtcggcagcgccctcgacggggtccgttcgctgcggcacgcggccgcgctgatcgccgccagcaacgcgatggacgacgtgttcatccggctgttcgcgctgcgccgccgggagccggcggacgacgcggtaagccggatcctggccgccgagggtgatcagatccagtcacacgaattgctgccgatgtgccggctgctgctcgtggcgggcttcgagaccaccgtcaacctgatcggcaacgcggtcaacgcgctgctcgaccacccggatcagtgggccgcgctggccgccgacccggccgggctggccgatgcggcggtcgaggagacgctgcgctgggactcgccggtgcagcgtacggcgcgctgcgcgcgcgaggatgtcgaggtggcaggccgtacggtacggcgcggccagttcgtcgtctgcctgctcggcggggccaaccgggacccggcggtgtacgcggacgcggaccgcttcgacatccggcgcgtgccggaggccgatcacctggccttctccagcggcatccactactgcgtgggtgcgccgctggcccgcctggaggccggggtcgcgctgcggatgctcgccgaacggatgcccgacctgcggcgggccggccggctgcggcgccgcgacgccagcatcatccgcggaccgcggtccctgctggtcgccgcgggatcccgggcccggccggtgtcggtctga

SEQ ID NO: 188 - DNA, 2193 bp, Actinoplanes utahensis
atgcatctatgggagcgctcccccgtgatcgccgcggccgccgccctcctgctcgtgggggcttccgccccggcccgggcggacgaggtcgagcaggtcgtcaacggcggattcgacggaacatccgaccccttctggtccaccgcgggcatgccgatcagcctcaccgacggccgggcctgcgtggacgtgcccggcgggaccaccaaccgctgggacgccgcgatcgggcagaacgacatcgacctggtcgccggcgagacgtaccggttcagcttcgacgcctcgggcgacgccgggcacgtggtccgggcgatcaccggcctcgcggtcagcccgtacgacacctatgtcgagcagtcgcccgtcctcggcgacctgcagcactacgagtacaccttcaaggccgcggcgagcaccgcgcagggccaggtcgccttccaggtcggcggcagcgccaccccgtggcacttctgcgtcgacaacgtctcgctggtcggcggcgtcccgccggtggtgtacaagccggacaccggcccgcgggtccgggtcaaccaggtcgcctatctgccggacggcccgaaggcggccacggtggtcaccgccgcgaccacgccgctgccctggcaactcaagaacaagaagggcaaggtggtgtacgagggtgacaccaccccgcgcggcgtcgacccgtcgtccggccagaatgtgcagaccatcgacttcagccggtggagcgccgccgggaccggcttcaccatcaccgcggacggggagacgtcccgcccgttcgacatcggcaggaccgccttccggtcgctgcgcgccgacgcgctgaagttctactacacccagcggtccggcatcgagatccgcgacgatctgcggcccgggtacgcgcggccggccgggcacctgggcgtggccccgaaccagggtgacggcaacgtgccgtgccaggccggggtctgcgactaccggctggacgtgaccggcggctggtacgacgccggcgaccacggcaagtatgtggtgaacggcggcatcacggtctgggaactgctgagcgagtacgagcagtcccatgacgtacgcaccgtgaatctctccatcccggagagcggcgaccgcacgccggacatcctcgacgaggtccgctgggagctcgagttcctgctgaagatgcaggcgccgaacgggatggtgcaccacaaggtgcacgaccaggcgtggaccgggctgccgctgctgcccgaccaggacccgcagccgcgggagctgcacccggtctcgaccgccgcgacgctgaacctggccgcggtggccgcgcaggcgtcacggatctgggagaagtacgacccggcgttcgcggccaggaccctcgccgcggcgcgcaaggcgtacaccgcggccaagaccaacccgatcgcgctggcctcgccgtcggacggcaccggcggcggcacctacgacgacgcgaaggtctccgacgagttctactgggcggccgccgagctgtacctgaccaccgaggagaagcagtaccgcgcggacgtgctcgcgtccccggagaacaccgcggacgtgttcggcgccggcgccttcgactggggatccaccgccgcggccggccggctcgacctggcgctgatccagaacaacctgccgggcctgggcaggatcaggaagtcggtggcccaggccgcggacaggtatctggccgttcagaaggcccagccgtacggcgtgggctacgcgccggcgaacaacgtctgggactggggctcgaacagcatcatcctgaacaacctcgtggtgatgtcggccgcccaccaactgaccggtaagcagaagtaccgcgacggcgtgctgaccggcctggactacgtgttcggccgcaacgcgctgaaccagtcgtacgtgaccggctacggcgaggtctcgtcgcagaacgagcacagccggtggtacgcccacgagctggacccgagcctgccgcacccaccgaacggcacgctggccggcggcgccaactcctcgatccaggatccgctggcgcaggagaagctgacgggctgcgtcgcccagttctgctacatcgacgacatccagtcctggtccaccaatgaggaggcgatcaactggaacgccgcgctggcccgcgtctcgggttacgtcgcggaactgtcctag

SEQ ID NO: 189 - DNA, 1239 bp, Actinoplanes utahensis
gtggccgacgtcgagcacaccatcggcatgctgctgggcaccgaggacgactggccgcgcgctttcgagtcgctgttgcgccggctcggcacggtcgccggcccggacgggcgttcgcaccggacccgggcggtgcgggtcaccatcgagccgttcaatctgcgggatcagccgaagcacgacctggtcatcgaccggctggcgtactggtactaccacccccgggagtggctgaagaagatcgccctgatggacggggtgtacctgttgaacagcccgttcaccttccagtcgatggagaagcacgcggcgtactgcgcgatgatgcggctcgggctgaaggtgccggagacggtgctggtgccgttcaagaatccactggacaactcccgctgggcgtacaccgcggcgcggtacaacaacccgttcgatctggaggcgacggccgcctcgatcggctatccgctgtacatgaagccgtacgacgggggcgcctgggtcggggtctccaagatccgcaatgcgcaggagctgcatgccgcgtacgacgcgtccggtgagcgcctgatgcacctgcaggcctcggtggaggattacgacgtgttcgcccgctcgctgaccatcggtccggagacgatggtgatgcggttcctgccggaccagccgatgcacgcccgctaccaggtcgaccaccacttcctgtcggatgcggcgggagacgaggtggtgaccgtctcccggttggtgaacgcgttcttccggtgggagttcaactcgtgcgagtcgctggtccgcggcgacgaggtgttcccgatcgactatgcgaacgcctgcccggacgtggcgctgacctcgctgcactactactttccgtgggcgatgacggcgctgctgcgatggagtgtcttctgtgtggtcaccggccggcggatgcggctggacacggacaccgccgactacttcgcgatcgccgacgacccggaccggtcgtacccggagaagctgtcgggttatcgggatctggcggaccggtatttcgagatcgaccggtaccgcgagttctgcgacacgcatctgggcgcggtcgacgacatcgtctacgactgggtgacctcggaggagttccgttcgctgctgcgcgaaaccgtccgggcgatgtacccggtgcacgagcacgagaagtttctcggccacttcggcggcctgatcgacgcctggattcgtgaccaggggcgttga

SEQ ID NO: 190 - DNA, 684 bp, Actinoplanes utahensis
atgggtggtggccgctggcgaacgatccgcctgccgctgcccgccctgcacacgtcgatgaccgcgcgggtctggtccccggccggggatggcgaccggctgctgatcgcccacgacggtccggagtacgagtcgcagaccggtctgacggcgcgcctgcccgggtgtcatgtggcgctgctgccgcccggtgagctccgggaggactggtatgcggcgtcacccgcgtacgcgagagccctggccctggagatcgtcccgcggctgcgggcgcggctgggcgcgcgacccgtcgtcggcgccggcgccagcctgggcgcgctggccatgttgcacgcccagcggtcgttcccggccggcttcgccgggctgttcctgcagtcggggagtttcttccagccccgccacgaccgccaggagtcgggtttcgcgcactggtcgcggatcgtgcggtatgtgcgccgggtgctgaccgccacccgcggcccggccgtgccagtgaccctgacctgcggttccgccgaggaaaacctggcgaacaaccgggacatggcggatgcgctggacaaacaggggtatgccacgactctcgccgtcgtcccgggcgggcatgactgggcgacgtggcgcaccgcgctggacccacatctgaccgccctgctgaaccaagcctggcctgagtga

SEQ ID NO: 191 - DNA, 801 bp, Actinoplanes utahensis
gtggcggagatctaccggagtgcggcggccgagaacgagcgcggcgaggtgctgcgccgtgccggccgcccggcggaggcgaccgagcacttctctcgcgccctggcggcgctgctcaccagctcggatccggatccggccacgcacgccgcgatcctcgacaatctggccctggtcgcgcacgagcgcggggacctggccgaggcgaaacggcacctggtccgctcgctgcaggtgggaccgctggtcggcgatccggtcgggcgggccatcacgtacgacaatctgggtgtcgtcgaggtcgagctggcccgcgccgggcacggccgccgggaggcgcatctgggtgaggcggagcggcatttcgccgcggccgagcgactgttccgcagtgtgctgccggacgcggtggacgactacctgcggtcggtgctgaaccgggcggacgccgccgagctgcgcggtgacctggatcgggtggaccggctgagccggcatgccgccgaggtggccgcgcatcacgcgatcgcgccggagaacgctctggaggcggtgaccatgcgcggcggtttcctgcatcagcggcggaaccggccgcgggtggcggtggagctgctgaccgcccggttgccggcactgctgccgggctgcccgccggcatcgagcatggcggcgctggcggtgttgttgcgggcggcgaccgcgaccggggatccggtgctgatcgaggacgtcacggcgcggatcaccgaactcggcgaaccgggcacatcgaaggcgaaaatcatggcgcggcgttaa

SEQ ID NO: 192 - DNA, 435 bp, Actinoplanes utahensis
atgcggatccggatcgaggggcgggagctgccgcagacaccggaactgcggctcaacaacgtgcacgtgggggtgcagcggcgggccgaggtggtcggccgggtgccggtgaccgcgggcagcgccgtctgggagatggacgtcgaggtgcgcgaggtcgacgggctgatcgacgtgggcgggccatgggtgcacgggtcgcccggggcgcggttcctctacctgagctggggggcggtgcacgacggggagttcgcgatgttccgccgggcgaagttgctcttcggggacgttcccggtgcgctgctgcggggagccgtggcgggggagggggtgctggtgggccggctcgggctgaccgattccgccggcgatccgctgtgcgcccgggtccggccgccggtcatcgcctggaccctttccccgttctcgtga

SEQ ID NO: 193 - DNA, 1644 bp, Actinoplanes utahensis
atgcgcgatcccgtcctcgccgatctcgccgtgcccgttccggtgaccccggccggcaccccggtgggcgatgtcgaggccgctctgcgcgccgacccggagctgctcggcgtgctcaccgagtccggcggcgagctgttcctgatcgaccgcgccttcctcgatctggtgctggccggccggctcggttacggccgggcgctgctgcaccgccggccgttgcggtcgctgctgcgccgcccggcgttggtgctgccggccgccaccgactggggtgacgcggcccgcgccgcgatggagcgccccgacggttcgaaggcgatcccgatcgtggtggcgctcggtgacgacacgttcggcctggccccggtgggcccgctggtggagcacatcagccggcgctatcaggcgatggcgctgaccgacgacctgaccggcctgggcaaccggcgcagcctgatgtcgcgccgggcgccggcgccgggggcggccgccatggtgatcgacctcaaccggttcaaggagatcaacgacacgctggggcacacccgcggtgacgagttgctgcggcaggtggcggtggcgctgtccggggcgtgccggccggcggaggcgttccggctgggcggcgacgagttcgtggtgttcaccccggatctggcggtctggccgggcctgtcgccgtgcgaggccggtcaccggctgctgcacgcgatccagggtccgttcccggtgggcggtgtcccggtgacggtggaggcgtcgatggggatcgcggtggtcggcccgggcgatccccgtgatctggaggatctcgtctcccgagccgattccgcgatgtacgcggcgaagcgggaccgcacccaggtcgagttgtggcacggcgcgctcgccgccggcgccatcgacctggggctggacaccgatctgtgggcggcgatcggcaacggcgagctggtgctgcactatcagcccctggtggacgcgcagacccgggcgaccgtctcggtcgaggcgctggtccgctggtcgcatccgcggcgggggctgttgccgccgggtgtgttcctgcctcaggcggagcgctcggatgtgattcacatgctgaccgcggcggtgctgggtgacgccgtacgccaggccgcgacctggcaccgggcgggccgggacgtgccggtggcggtgaatctggcggcgccggtgctgagttcggaccgggtgctcaccaagatcggcgagctgctggacgagaccggcctgccgccgcggggcttgatcgtggaggtgaccgagagcgcggtgatgacccggccggcggagagcgctgatcgtctgcggtcgctgcgggcgatgggggtgggggtggcgatcgacgatttcgggaccgggaacacgtcgctgggcctgctcacccagctgccgttgagcgagttgaagctggatcgctcgttcgtcacccggatccatcagccgcaggaccgggtgatcatcgagtcggtcgcccggatggcgaacggcctgggcctgaccctggtcgccgagggcgtcgaggatgccgacaccgcggacacgcttaccgcgctcggcttcgacctgttgcaggggtaccacttcggccgccccgaaccgatcatggctgcctag

SEQ ID NO: 194 - DNA, 1035 bp, Actinoplanes utahensis
atgcggcccggcggccatctgtcggtcgccgtcgatctccgtgcggatcgcggccatccctcgcgcattacggcccacccccgctgcccgctgcccgcccacccgcctgccgcccacccgcctgccgcccaccggcctgccgccgcctgcccgcctgtcgccggtcccgctgcccgccggccgttggcccgcccgggcctgcctgatgggcggccccgggtaggcggctgtcgcgttcggatggcgctgagctgggtggacggcaaagtgtcggaggggcggcctagagtcgtccgcgtgctgaagctcctcgacgacgagcccccggtccgggtcctgcacggattcgtgtcccgggacggcacgctgagcctgtgggccgagaccggtgtcccgatcccgatcccggcggccgcccgcggcgtcccgtggcatccgttcgcgctgccgcccgccgatctgccggccggcgagcggcgcgatccggccctgctcaccctgccgtccaccggagccggtccgctgccctcgccgcaggtcgggctcccgccccggcgcggcgcccggcgggcccgggtctggcgcgtccccgcggtcgaggtgccgttcctcgacgccgacctcgccgccgagttcgacggccgggtcgcgccttcggtccgctggctgatcgagctctgcgggttcgccgccggcctggtccgccgcggccgggtgctccccggcgtccggctcgacggtccccgccccgccgcctgctggcgaccgattctgatcggctccgacgcggcccgccacgccaccctgctcgaccggatgccacccgcctgccgcgccgaggccacccccggctcggagagccgcccggcccgccagggcgacaccgctcccacggccgcctccgccgccgacctctgcaccgcggctctggagcgcctcgtcgacgtcctcgtccgcacccgcctcgccgaggccggcgtcaccctgaccgagccggccatcccacccaccggcatcagcgccctagctagctag

SEQ ID NO: 195 - DNA, 2340 bp, Actinoplanes utahensis
gtgcaggacgggctcgggggggtgctggcggcgctgagcggggagccgtggttcagcatgccgggggacgagctcgacgagttggtccgggcgctcgacgcgtggttcgcccaggcggcgcgtggggctgaggtgcgggtgtgcttccggctcagcgatccgcgggagcacgagccggtgctgcccggcgaggtgccgctgcccccggacgcgtggcggctggagttcctgctgcaggccgccgacgagccgagcgtgctggtgccggccgccgacatctggcgggacgatttcgccccgctgcgccggtggacgctgcacccgcaggagcggctgctggccgggctggggcgggcggcgcgactctacccggcgctgggcgacgcgctgcaccaggcgcatccggtggagatgatcgtggacaccgagggggcgcacggcttcctgagtcacgccgcgctgctcgacgaggcgggctacggggtgctgctgccgggctggtggcggcgccgatccgggctgggcctggcgctgcacgtgcgcagccccgagccgatcacgccggtgctgcgggaccgtacgaccggcctgcgggacctcgtcgactacgagtggggcctggcgctgggcggccgcaccctgaccgaggacgacctggccgacctggcgaaggcgaaggtgccgctggttcggctgcgcggccgctgggtcttcctcgatccggacaaactggctgccgggctggcgttcctgagccgcggcgggggcacgatgaccgcgggtgacgcgttgcgggtgacccgccttctgccgccggaggggctgccgctgccggtgaccgacgctcggggcgagggctggctgggcgacctgctcagtggcgaactggagcagcggctcgccctgatcgagcctccggcaggactcggcacggtgctcaggtcgtaccagatcaggggtttctcctggttggtcttcatggactccctgggtctgggcgcgtgtctggccgacgacatgggcctgggcaagacggtgcagctgctcaccctgctgctgcaccggcgcgacgggccggcgctgctggtctgcccgctgtcggtgctgggcaactggcagcgggaggccgcgcggttcgcgcccggcctgcgggtccgagtgctgcacggcgccgaccgggacgatccggccgccctggccgacggcgccgacctggtgctgaccacctatgccacagccgtccgggacgccgacgcgctcgccgcgatcacctgggaccgggtggtgctcgacgaggcgcagcacatcaagaacagtgccggtgcggcggccagggcggtgcggcgtttcccggcccgcaaccggatcgcgctgaccggcaccccggtggagaatcggctggccgagctctggtcgatcctcgacttcgtcaacccggggctgctggcgtccgcgcacacgttccgcgcccggttcgcggtgccgatcgagcggtacgaggacgaggaggcggccgcccggctgcggcaggcgacccggccgttcctgctgcgccgcaccaaggccgaccccggcatcgccggcgagctgccgtcgaaacggcacgtccggcacctgtgcgggatgaccaccgagcaggtcaccctctatcgcgcggtcctcgacgagctgctggagcgtctcgccgagccgggggagacccgccgcaagggcctggtgctggccgcgatgaccaagctgaaacaggtctgcgtgcacccggcgctgctgctcaaggacgcctctccgctgcccggccggtccggcaagatcgaacgcctggaggagatcgtcgaccgggccctggccggtggcgagagcgtgctgtgcttcacccagttcgcccggttcggtgggatgctggcgccacacctggccgcccggttcggggtgccggtgccgttcctgcacggcggcacgccgcgcggtgcccgggacgcgatggtcgccgagttccagcgggccgaacgccccggtgtcttcgtcctgtcgctgaaagccggcggcaccggcctcaacctgaccgccgccaaccatgtgatccacgtcgaccgctggtggaatccggccaccgagacgcaggcgtccgaccgggccttccggctcggccagcgcagggacgtgcacgtgcacaccctggtctgcctcggcaccctggaggagcggatcgaccagctcctcaccgacaagggtgtgctggcggagcgggtggtgggctccggtgagggctggctcaccgcgctgtcgaccagcgaactccgtgacctgttcgctctcgccccggaggccatcattgactga

SEQ ID NO: 196 - DNA, 804 bp, Actinoplanes utahensis
atgagcgatttcgcgcccgcgttcctcgggatgttcgagtcgttgcggatggggccgaccttcgcccgcggccgccgcgacgagcgggccgggcacgtgcgcagtctgaccgtctccagcagcctggcggtcgcgctggtgcgcgggccggacgatccgtcggcgttccgatcccggatcgcggtccgggcgttcggcgcggccgagtgggcccgggtggagagtgccctggtcagccaggcccggttcgtcgccgggctgctcgacgggcggatgccgcccggggtggaggcggtgttcgccgacgccggcctgaccctgctgcccctctcgctggacgaggtggcgatggactgcacctgcgagcgctggccgatgccgtgcgtgcacctggccgccacctgttacgcgctcgcccggatgttcgaggccgacccgttcgaggtcttcgcctggcggggccggcaccgcgacgaactgttgatgcggctgcgccggctgcgggaggcggccgcggtaaacgcctccgacgtcgccgatgctgcgaaaaccgccacccaggcggaaaatcccgtcgagccggagccgccgctgatcgacccggatgatctggagaccttttggggccgcagcctagatcttggcgaatctcctgttcaggagccatccggcggccgtcccgacgcgcttctcgatcagctggatccgccgcggatcgggtatcagggccggccgttgactgacattctgcggccggcgttccgcgctctcgctgacaccgagggggtcggccgatcggcttag

SEQ ID NO: 197 - DNA, 747 bp, Actinoplanes utahensis
atgaacaaggcacagcgtttcttcgcgctcgccggcatgggtgtcgccgccggcgcgctgatcggcatgggcccggcgcaagccgcctcggccgccggcacgccggtctccgccggcggcgccgctaaacacgcgtccgactggggcgacgatcacgtgatcgggtattaccgcaccgaatggtcgtgcgaacgcgccggcttcaccggcaggcgctacggcgcctgggacgactacagctgcgatccgatcgactacggctggcggggctgggtcttccgcctcgtcgtcgaccaggacgactggcggtggagcgactggcgcggcgactggccgggtggctggccgtaccgccccgactaccggggtggctcgttccacatccgtgccatccacgatcactcgggcccgcacggctggccggaccggaacgaccaccgtggctggccggaccggaacgaccaccgtggctggccggaccgcggcggcaacgacgaccgcaacggcgaccgcggctggcccgaccggggcggtaacgacaaccgtggcggtaacgacaaccgtggcggtaacgacaaccgcggcggtaacgacaaccgcggcggtaacgacaaccgcggcggtaacgacaaccgcggtggcaacgacaaccgcggtggcaacgacaaccgcggcggtaacgacgaccgcggtggcaacgacaaccacggcggcaacgacaaccagcaccactggcccaggccgtga

SEQ ID NO: 198 - DNA, 1410 bp, Actinoplanes utahensis
atgaccggcagtgacccgaccgtgggcgtggatccggaccgcctggcggtctgcctcggcgtgctggccgaggtggaggggctgccgccggagcatccggacgcggtgcgggtgcggcgggctacggcggcgctgttcaagacggtgaagttgcagcggcgcaaggaccggcggcaggccgtgctcgacaacgatcgggcggtgacggcggcgaccgcgaccggggcgcccgggcggatcgatgacgagaccgccgggattccgctgaagagccagacggtgggagcgaccgccggggtgctcaagcaggcgcgcgggtgttatgtgtgcaagcagcggtacacgatggtggatgcgttctaccaccagctctgcccggactgcgccaaactgaaccatgagcggcgagatgcccggaccgaccttaccgggcggcgagcgctgctcaccggtggccgggccaagatcgggatgtacatcgcgctgcggctgctgcgcgacggggccgacctgacgatcaccacgcggttcccgcacgacgcggtgcggcggttcaccgcgatgccggacagcgccgactggctgcaccggctgcgggtggtcggtatcgacctgcgggacccggcgcaggtggtgggcctggccgagtccgtcgccgcccgcgggccgctcgacatcctgatcaacaacgcggcgcagacggtccggcggaccgccggggcgtacgcggcgatcgccgccgccgaggcggaagcgctgcccggcgggagacttcccgaactggagtatttcgggagtgccggtagttccccggcggccgtgctgaccgccggcgcccagcatctgaccccgcagcagatcaccgagctggcgctgaccgcgcggtcggtggcgatcgacgcgggcgggctggtgccggacaccacggcgaccaacagctggagcgaccgggtgcacgaggtggacccgctggaactcctcgaagtgcagctgtgcaacgtgacggcgccgttcatcctggtcagccgcttgcggccggcgatgaccgcatcgtctttcccccggcggtacgtcgtcaacgtgtccgcgatggagggcatcttcgcgcgtggctacaagggcgccgggcatccgcacacgaacatggcgaaggcggcgctgaacatgctgacccggaccagcgcggtggacatgttcgccgacgggatcctgatgaccagcgtggacaccgggtggatcaccgatgagcggccgcatccgacgaagatgcggctgcatgaggaagggtttcacgcgccgctggatctggtggacggggcggcccgggtctacgacccgatcgtgcggggggagcagggggaagacgtctacgggtgcttcctgaaggattacgcgccggtggcgtggtga

SEQ ID NO: 199 - DNA, 5463 bp, Actinoplanes utahensis
gtgttcgcgggctggggatcgcgggtcgcccgcctccgttggccggtactgctcgccaccctggtggcggtgctcggtgccggcatctgggggatgggcgttttcgggcagctcaccgaggggggctacgccgacccggccagcgagtcggcgcgcgccgccgaggtggtcgccgacgaggccggcgggccgggcggcgacgtcatcgccatctacaccccggcccggggcatcggcatcgacgacgccgggctgaccgggcggatccgggaacgacttgccgggctgcccagcaacacggtcaccgcgacctcgtcgtactgggaccgcaagagcgcggcctacgccgcgaaggaccggtccagcgcggtcgcggtgatcagcctggccggcgccgacgacgccgccaagaccgaggcgttcgcggggatcgccgacgacttcgcggtcagcggcgccaccgtgcgactcgccggcgccgtcccgctcgcccacacctccaaccagcggtccaccgacgacctcggcaaagccgaactgatctcgatgccgatcgtgctgatcctgctgctgttcatcttcggctcgctggtcgccgcgaccctgccggtgatcgtcggcggctgcgcggtcctcggctcgctgggcgtgctcaacgcgatctcccacggccacgacgtcaactcgttcgcggtcaacgtggccagcctcctcggcctcggcatggcgatcgactacgggctgttcatggtcggccggttccgggaggaacaggccgccggccacgacccggccgaagcggtccgccgcaccgtcggcaccgccggacgcaccgtggtgttctccgccaccctgctgatgaccgccctggccgggctgttgctgttcccgcagggcttcctgaaatccctcgcctacggcgggctggccgcggtgttcctggcgatgctgctgtccctcaccctgctcccggcgatcctcgccatcctcggcccgcgcgtcgacaaactcccggtccggctgcccggcgcacagcgcaccggcgacggctgggggcggctcgcccgcttcgtgctacgccggccggtgctcgtcgccatccccatcctggccgggctgatcgtgctcgcgctgccgatcggaggcgtccgcttcggggagaacgacgaacgggtccttccggccggcgacccggcccgggtggcgatcgagacgctgaaaacgtcgtacccccagttcagcggcgacggggtgcaggtcgtcgtgcgcgggccggcagccgcggccaagcccttcgccgcgcagctggcgaagatccccggcgtcgcctcggtcggtccggccggcgccggcaaagacctcaccgtctacaacgccgccctgcagagcaccgactcgttcagcgcccccgcccgccgggtcgtcgacgacatccgcgccctgcaacccccgcccggcaccaccgtcctggtcggtggcgtgaccgcccgcaacgtcgacagcctcgccgccatcggcaaccgcctccccctgatgatcggcctgctcaccggcgccaccctgctgctgatgttcctggccttcggctccgtcctgctgccgatcaaagccgtcgtgatgagcggcctcagcctgtccgccaccttcggcctgctcgtctggctcttccagcagggccacggcgccggcctgctcggcgtcaccccggccccgctggaagccggcatcgtcgtgctgatggccgccgtcgtcttcggcctgtccaccgactacgaggtgttcctgctctcccggatggtcgaggcccgcaccaggggcgccagcaccgccgaagccgtcaccatcggcctcagccgcaccggccgcgtcatcaccgccgccgccctgctgctgatcgtggtcaccggcgccttcgccctctccagcatcaccaccatgcgcttcgtcggcgtcggcatgatcaccgctctgatcctggacgccaccgtcgtgcgcatgctcctcgtcccggccgtcctcgccctgctcggcaacgccgcctggtgggcaccgggacccctgcgccgcctgcaggagagggcgggcctggcggagcacgacccgctgccggccgtggcggaaccccgaaccgaagtgttggactacacggcggtggcggcacacctgggcgcgggacgcgacgcggagaccgccgtcatcccccgcgtccgggacaacgacgaaacaaccacccttcccaccatcagcgacgacacagcggttctgcccgccgtccgcggcgacaacgaagccgacgcgggccccgaagccgacatcgacgccgacgcagaccccgaagccgacgagacaacgacgccgcccgcgatccacgacgccgagaccgacccccacgccgcgcccggcgacggaaccgaccccggcgccgccgacgcagagtcaaccggcccggccgccaaccgcaccgccgatacagcggtcttcccagctgtcaccgacggcgagacagcgacgctgcccgcggcccgcgacgacgcgacgggctccgttgccgtcactgacaccgaggcgagcggcctgaccgctgacggcgacgaatcgttggtggtcgcaccggacgaaacgtcgatcctggtctgggatcccgcggccggcgaaaccgctcctgccagcgacctcaccgactcgggcgacatctccgacagcggcggcatggccgattcgggtgacctcgttgacgccgacgacgccggcaccgacaccgcttcccacgccgacaccggcgccgctttccacgccgacaccggcgccgcttcccacgtcgacgctgtgcccgacaccgacgccgcttccaacgccgacattgcatttgatgccggagccgctcgtgacgccggcgccgcttctgacgccggcgccggttccgaggccggcgccggttccgatgttgcggcggcgttcgatggttcggcggtttccgacctcgaaactggtgccctcgccgacccgtcggctcgcgatgccctctcggatgccccggacagccgcggcctgacggccaccgcgaagcacgaggcagcatccactccccctccggcggccgcttcagctccggatgcgacctccacctcgttctccccttcgaattcgaccgacagtcgggccgggaccacaggcttcagcgcttggacgaaatccaggcccgccgacgcggcttcccgggaattggccggaagcggagccttcgacgtcacccaggtgatgccgatcctctccccccatctgctgcgctcccgctccacgaccactcccaccccggtcgcccccgaatccgactccacccaaccagccgatcacccgtcagggccgtccgaaggcatcccagccccggaccccgtatccgcggatcccgtatccgcggatcccgtatccgcggactccgcatccacggacgcagcactctcgaacccgacgtcgtcggaagccgcatcctcggacgcccgggccggggacgccacattcccgggagcagatctctcgggcccagcgtcgtcgaggcctggatcctcggacgccgcattctcggagtcgaccgggctggcggagccggctgacccgctcgacagctcgtcgctgtgggcccaggtcgaggccactctggccgcggacgcccggacggccgcctccggttccgcggaaacgcccgccgccgaggcctcgcaccaggctcccgcaccgcaggggatggcgcctgaaccgcgagaacagggatccgaaacgccggagccggccggcaagatcatcagctcggacctgatgtcagacaccgggaaagtggtcaccgggccggagcccaccgctgcggcagcgacttctgccgcggaggtgcctgcggtcgcgccgatcatcgcgccggaaaccgacgccgacacgacagccccggcggcggacgtcgccgagatggcaccggtcaccgccatcccggcggaggtcgcggacgcgttcacctggatgtcggatcccaggatcgccggcatcgtcagcggcgggaatgagtcgaccgagacgggttcggacttcaactggcttaccgagaccagggaattcccgataacgccgacttccccggagcagcccggcgccctggacttcccggtggcgaagccggcccgtccagcgaccctgggggaccttcccaacgctccccgccgcgcgaatcccgtttcggaggacgtcgccaaggccgccgagccccagaccgaatccgctgtcgaagcgggcagcgagcctgaaggccggacagaacccaacaccgaccccccagacggcccggccgaagccacgccggacgccgtgcccataggcgacgtcgacgccaatcccggatcggcggacgaaacggccaccggtgacgtggccgaagccagcaacgacgccagcccctcggtcgaagcagacaccgatgacgcggcggaaatcggcaacgagacgggatcctcggtagaggacgacgtcagcgctgagtcgccgacctcgccgaagcccgaggccgacgccgagtccaggatcgaagtccgtgccccggttgacgtcggtgccgccgttgacggtggtgctgtcgacggtggtgctgtcgacggtggtgccgggtttgacggggatgccggatctgcggacgcgtccggcgccggacctgcggtggaaaccgagatggaccccggatctacggtgggatccgaggtcgacgccggatccgcggcggtgaccccggccgacgctggggtcggggcgggaggtcaggctgctgccggggctggggcggacagcgatggcccgggttccggatcggcggccgaggcgaccgtcaacgcgcccggggtcgggcggcggcgaccgcagacgttggacgagtggctgcatgggagtcggccggctaccacgccggtcgaggtgacgccccgcgtgtcgccggtggacgagtcgcagaagcggcccgcggcggtcggtgatgtggccccggtgagtgcggcgccggtcagctccgtgccgatgcggcggccgcagacgctcgacgaatggctgcatggggacccggcccagccgcgtccgcagagtcttggcgatgtgaccgccggcgaggttcggccggtcagctccgccggaccgcgcccgcgcagcctgggcgacctgaccgccgggcagaaccggccggtcagttcggccgggccccggccgcagagcctggaggacctggcggctggcgagaaccgaccgatcggctcggccggcccgcgccccgggaaggcgaccggccagaagccgcccgctccggcccggcgcccggcttcgctcgccgaccactaccccgaccgcccccgccgacccggcagcggaccgcagcaacccgcccccgagagcccggcggcgccggaccgcgacaacgatccggacccgtccgcatcctga

SEQ ID NO: 200 - DNA, 801 bp, Actinoplanes utahensis
ttgcgccgtcgtcgcctccaggtgccggatgtgctgctcaagccgggcagcccgcgctggcgggatcacctcggcccggccgtggtgatcctgatcggggtgctcctcgtggtcgcggtcggcgtggtggcgaaactgagccacggtgaccatccggcggccgatccggtgaccggcgcggtcgtcgagccgaccgtggaacaggtgccgatcccgctgcccagcccgtcgatcaccgagagcgcaccgccggtcaacgcgatcagcgtcgaggagggatcgatcccggacaccgtcgacctgagcgccgagggcacgatcgactgggtgcactggggcgaggacggcacgtactcgctggaacgcagctcctccggcggattcgcgatcctggagggcaccccggacgcgccgcgccggcggcacacgctgagcccgcaacgctacgtctggagcggcggcaccccggcgccgaagaacgccggcgccaccagcggcgtgcgcacctgcggcaccggcaacgggttcaccctctccgcgccggccaccccggatcagcgcaccctgcgcctctacctgggcgtggccggggcgaccggcacgctcagactcaagctcaccaccggcggcgagacctacacctccgcgctgacccgcaaggccgcgacgctggccaccacccgatacacgatcaactaccgctccaccgggcctggcaagatctccgtcgagtggatcaccgggaagacgttcgacccggactgcggcggggtcgcgctcgaggccgccacactgcactag

SEQ ID NO: 201 - DNA, 567 bp, Actinoplanes utahensis
atgagtgaccggaccaccccgtcggacaagcgccgcggccaggcgatcgcgggcggcgtcgcgggcgcgctcgtcttcgtggtgctcgtggtggtgttcttcgtggtgcggggcggccacgacaagcagccggccgcgaccagcgccgccgtgcagcaggacagtgccgcagcggtcgcgcccccaccggcggaggcgtccccggccgccggccttcccccggagctgtcccacgagcccgacgtgcagccgggcaccggcggcccgctcaccgagctggtcgccctcccgctgatcgtcggcacgggcccggtggtcgccgccggccagacgatcaccgtcaactacaagctgatcccctacaagggcggcgcggtgatggactcgtcctggagccggcacgagcccttcaccacggtgatcggcgccggccaggtcatcaagggctgggaccagggcatccccggccagcacgtcggcagccgcatccagctggacgtccccgccgcgctcgcctacaaggaccaggacctccgcttcgtggtggacatcctcgccgcgcactag

SEQ ID NO: 202 - DNA, 810 bp, Actinoplanes utahensis
gtgctcattctgctgccgccgtccgagggcaagactcccgccaccaccggttccccggtcgacccggacaccctgtggctgcccgcgctcggcgcggcccgccgccgggtgatgaccagactggtggcgatgtgccgacgcggcagcgcccgctcgatcgccgactcgctgaccgttctcgggctcagcgaggggcagaggagcgagatcgcccgcaacgcggccctgccggaggcgccggccggtcccgccgccgagatctacaccggcgtgctgtacgaggccctcgcccccgccacgctcgacgacgccgcccgggcaaggctgtacgagacggccgtggtcttctccgggctgtggggggtggtccggctcggcgaccgcatcccggcgtaccgctgctcggtcggggtcagtctgcccgccccggtcggcgggctgaccgcgtactggaagaagcagttgagcagggccctcgacccggtggccgccggcggaccggtcctcgatctgcgatccggtgcgtacgcggcgatgtggtcgccgcccgcggcgaccgcgagccgggtggcggccctgcgggtactgcacgagcgggtggtcggcggggtggcgaagcggtcggtggtcagccacttcaacaaggcgaccaagggccggctggtgcgcgccctggccaccgagccggtcgccccgtccagcctggacgagctgatcacggcgatgcgcgacctgaagttcaccgtcgaggaacgcccggcgccgcccggccggccccgccagctcgacatcgtcgtcgccgagctctag

SEQ ID NO: 203 - DNA, 471 bp, Actinoplanes utahensis
atggacatggccgacgacgagccgctctacaccacccgggaggagcggcaggtctggtcccaactcgcctgcatggtcgtgtccgcggcggcctacaccgcctgggtcctgcccgaggtggcccgccacccggtcgccgggatccactgggtggtcccgctgttctgggccaccctggccggcctggtctgcaccgtggtggtcgccgtcgtgctggagatcgtggtggtcgtccgtcgcggcgcggaggcgaagagcgcggtcaccgtcgacgtccgggaccgggagatcggccgccgcggcgtgcggctggccaccccggtgatgggcaccgggctcgcggccgtcctggtcctggccgcccgcggcgccgacgacttctggatcggcaacgtggcgttcctgaccggcctggtggccgcggtcgccgagagcattctcaagatccgcctctaccggcgcgggttctga

SEQ ID NO: 204 - DNA, 222 bp, Actinoplanes utahensis
atggcgccgaaagccacccgggtcaccaaccggatccgtgccctgcgcgccgcggcgggcgggatgacgcaggccggcctggccgagcggctgggggtcacccggcagacggtgatcgccatcgagcaggggcgctactcgccgtcgctggagctggccttccagatcgcccgcatcttcgagcagccgctggacaccgtcttccagtacgacgaggggtga

SEQ ID NO: 205 - DNA, 984 bp, Actinoplanes utahensis
ttggcgcagcccgcctcggtggtcaccgcgcggctggtcagggcactgggcccggcgcggagcaggatccggtcggcggccgcgaacagctggcggcggacgtcacggagggctacccctgtcggcaccgatgatcctctcccgctgagcctggcccctcaacctacccggtcctatagtgggcacatgcccactcaggatctgcgccaggccgccgagtcgttcggcatcgacgccgcacgatacgaccggacccgcccgccctacccggccgagctgctggaccgcatcctggcggccacgcccggccgcgcggtgctcaatgccggctgtggcaccgggatcgaggcccgccagctgcgcgagcgcggctgcaccgtgctgggcgtcgagcccgaccggcggatggccgatgtcgcccgggccagcggcattccggtcgaggtcgcccggctggaggagtggcagcccgccggccgcagtttcgacctggtggtggccgggaccgcgtggcactggatcgacccggtggccggcgccgccaaggccgctcaggtgctgcggccgggtggccggctggccccgttctggcacacgttccggctgccggacgagctgaccgccgcgtccgccgaggtgttcgcccggctggcgccggactcgccgatccggctgccccggcaggcgcccgccacgccggtggagggttaccggccgatcctcaccgcggccgccgacggcatccgggcggccggcggcttcaccgagccggagcagtggcaggtggactgggagaaggcctacacccgggacgagtggctcgaccagctgcccacctcgggcgccttcacccggctgccgggcgatcagctggccgcggtctgcgacgcggtcggcgcggcgatcgaccggctgggcggcggtttcgtgatggcctacacctcggtggcggtcaccgcggtcaggacttcgccggcacggtga

SEQ ID NO: 206 - DNA, 1620 bp, Actinoplanes utahensis
gtgctcgtgctgctcctcgttctggtgggagcgctgctcgcgacgccgcgggcggcttccgcgcacgccgcgacggtggggtcgagcccggcgccgggcagcgtggtggccgcctccccggccgaggtgacggtcaccttcagcgagacgatcaccccggtcagcgggcacatccaggtggtggcgccggacggcgagcggatctccgggctggccacggcgcgcggcgcggtgctgcacatcccggtccgcgcggctcggcacccgctcgggacgtacctgatcagctaccgggtgatctccgcggacagccatccggtcggtggcgcgatcaccttctcggtcggtgcgccttcggcgcgtccgcaggccgcggccagcaccggcatccatcccagcgtgcggttcgctgtgcccgcgttccgattgctggggtacgcgggcatcacgctcaccatcggcccggcgctcctgctcgccctgctgtggccccgccgccggtcgcgcaccgggccgatccgcacggtccgcgccggcttcgccctgatcgccctcgccaccctcggggccctcggcacccaggcccagcagggcagcggcgccgccctgtggcaggtgtccgccggcgagctggccgaggtcgccggcagccggttcggcctcaccctgatcgcccgcctggccctgctggccgccctgtatccgctggtgcagcccctgctgcgggccggcccggccggccgcccgcgggtggcggcaaccctgctgctcggcgcggccgggctggccacctggccgctgaccgggcacgcggtcgccgccccgctgccggtcgtcacggtcaccgtcggcgtggtgcacctggccgccatggcgatctggatcggcgggctggtcaccctgctcgccttcctgctgcgcggcaccgaccgccggatcctgggcgtgctgctgccggtctggtcccgctgggcgatgctgtccgtgctgtggctggcgatcgccggtgcggtccaggcggtggtgcaggtcggcgcggtggacgcgctgctgcacaccgggtacgggcaggtgctgctggtcaagctgggcgtgctggtgctggtcctggcggcggccgcggtcgcccgccggctggtgggccgctcccccgaggggcgcgggctgcgccgcacggtcgggatcgaggtcgccgcgaccgcggtgatcctggcgttgagcgcggtgctggtgcaggtcaacccggggcgtacggccggggccgaggcgggtgcggtgaccggtgtcggggtgtcgcagacgctgacctgcccgctgtacacactgcagttcaacatctatccggtggagttgggcgagtacaacaccgtgcacgcgttcctgtacaccccggagggcaagccgctgccgccggccgagtggcagatcagcacacagttgatgggtcagggcctggaagcggtgaaggagccgctgctcgggctggagccgccgcaccacgcgctggggtcggtgtcgttcccgctgcccggcacgtacgagatcgccttcaccatccgggtcgacgacctgaaccgggccaccgtgaagaccacggtcaccgtgccggcgaagtcctga

SEQ ID NO: 207 - DNA, 1686 bp, Actinoplanes utahensis
gtggtgcggaaaggttcaagacggccgcggctggataccatctccagggattccaaggaggccaagatgtccgtccacgcccgcgccggccgccccgcggaagcgtccgatctgatcgacgttccgaaggtcgtctcccggtactacaccgagcatccggacccggccgaggtggtgcagcgcgtcgcgttcgggacctccgggcaccgcgggtcgagcctgcggaccgcgttcaacgaggaccacatcgccgcgaccagccaggcgatcgtcgagtaccggcgggcgcagggggtcgacggcccgctgttcatgggccgcgacacgcacgcgctgagcgagccggcgcagatcaccgcactgtcggtgttcgccgcgaacgacgtgacggtcctgatcgacagccgggacggttacacgccgacgccggcggtcagccacgcgatcctgacctacaacaggaagaatcgggccaaggccgacggcgtcgtggtgaccccgtcgcacaacccgccggacgacggcgggttcaagtacaacccgccgaacggcggcccggccgacaccgacgccaccaggtggatccaggatcgggcgaacgagctgatcgccgacggcctcaaggacgtccgccgggcgcacggcaggggcgacacctacgacttcctcggctcgtacgtcgacgacctgcccgcggtgatcgacatcgacgcgatccggaacgccggcgtccggatcggcgccgacccgctcggcggcgcgagcgtcgcgtactggggcgagatcgccgaccggcaccgcctcgacctgaccgtggtcaaccccacggtcgatccgcgcttcgccttcatgaccctggactgggacggcaagatccggatggactgctcgtcgccgtacgcgatggcctcgctgatcgagcagaaggaccgcttccagatcgccaccggcaacgacgccgacgccgaccggcacggcatcgtcaccccggacggcgggctgatgaacccgaaccactacctcgcagtcgcgatcgactacctgttccgctcccgcgacggatggccgggcggcgccgggatcggcaagacgctggtctcctcctcgatgatcgaccgggtcgcggccgacctgggccgcaccctggtcgaggtgccggtcggcttcaagtggttcgtgcccggcctgctcgacggctcgatcggcttcggcggcgaggagagcgccggcgcctcgttcctgcgccgtgacggcggggcgtggagcaccgacaaggacggcatcctgctcgacctgctcgcctcggagatcatcgcggtgacgcagaagacgcccagcgagcactaccgggcactgaccgcccggttcggggagccggcgtacgcccggatcgacgccccggccacccgggaggagaaggcggtcctgggcaagctctccccggagcaggtgaccgcgaaacagctcgccggggagccgatcaccgcggtgctgaccagcgcgcccggcaacgacgcggcgatcggcggcctcaaggtggtcaccggctccggctggttcgccgcccgtccgtccggcaccgaggacgtctacaagatctacgccgagtcgttccacggcccggagcacctggcccggatccaggaggaggcgcgcgcggtggtgtccgccgcactccggggctga

SEQ ID NO: 208 - DNA, 2301 bp, Actinoplanes utahensis
atgagtacccggggaacggcagctgaacagcgacgacgcggcgggctggcgcccgccgcggtggctctgacggcatccgtcgcggtggtgctctggctggcgctcggcgccggcaacctgtacgccggattcaccggcggcccgatcgcgatggccgccgcggccttcgcctgccagcggatcgccgcgacggtgcgcctgccgccgccggtccggtcgttctggcggcagctgcagtacgcggccttctgccttctcgccgcctcggtcgtcacgctgttccggtcgaacaacgacaccggtctgtcgccgtacgtcggtctaccgatgctggtcggcatcctcatcctgatgaccgcgttcctgcgcctgccgttcggcacgcgcaccgcgaccggcctggtccgcgccctgctcgacggtgccaccgtggccgtggccagcggactgatcttctggtacgtggtcctcgacctcgccccggccggcacctccctggtcgcccggatcgtcgcggcggtgatcggcgtctgcggcgtcctgctgctcgtggtgatcggcaaggccgccgccgcgccgtccagcccggtcgacccggcgtcgctgcgggtcctcaccgtcgccccggtggtcgcggtcaccggaaccatcctgctgatcgccggctccgaccggggccggctgatcctgtcggtgctggccgtcccgtcggtcgcggtcgccatggcggtcgccgcgtatctgcagcgccgggcgcggcggacgacgaccgcgaccgccggccgctccctgctcagcctgctgccgttcctcgcggtgaccgccaccgccgcgctggtgatcagcgtcagtgcccagcagatgtccagccggcagcgcaccgtgatcatcggcgccgtgctgatcgccggtttcgtggtcgcccgccagctgctcagcctgcgggagaacaccatcgcgatgcgcggcatccgccgccagcaggccgaactggaacgcctggcgctcagcgacacgctgaccggcctgccgaaccgcacccggttcgcggtggcgctcggcgacctgatcggcgagcaccgaccggccagcgccctgctgatcgacgtcgacgacttcaagatgatcaacgacacgctcggcccggccgccggcgaccagctgctcttccaggtcgccgaacggctgcgccggcactgcctgcccggcgagctgccggcccggctcgggggcgacgagttcgccgtgctgctaccggtcgacgacccggccgaggcggaggccgccgcggcccgcctgctggccggcatcaccgaacccttcaaggtcggcgaccagcagctgctgctgcacgccagcgtcggcatcgcgatcgcggcgaccggcgagaccgccgacgaggtgcagcgcaacgcggacatcgcgatgtacgccgccaaggaggccggcaaggcgtcctgggtccgcttcgagccgcggatgcgccacgacatggtgcaccacgcccggctcgccagcgaactgcacaacggcatcatccgcggtgagctgcggctggtctaccagcccgtcttcgacctggtcaccggccgggtcgcgggcgccgaggcgctggtccgctggcagcacccgacccgcggcttcgtctccccggcggacttcatcccggtcgccgaacgctccggcctgatcgtcccgctcggcgcctgggtgctgcgcgaggcctgcgcccagctcgcccgctggcgcgcgcagtacggcgacgacgccatcgagtcgatcaacgtgaacgtcgcggtccggcagctgcgcgagaccggcttcgtggacgaggtggcggccgtgctcagcgaggccggcctgacctcgcgcaacctgatcctggaggtcaccgagtcgtcggtggtcgacggctggcaggtgcgcgagacgctgcaggcgctgcacgagatgggggtgatgctggccctcgacgacttcggcaccggccagtcgtcgctcagcctgctgcgcgccttcccggtcgacgtcctcaaactggacaagtcgttcgtcgacggcatcgcggacggtgccgaccggggtcgcctcgcggtggccgcggcggtggcccagctcgcggaatatctgcagctcaaggcggtggcggaggggatcgagagcgcggagcagcgggaccggctgcgggacatggggtaccgctacgggcagggttaccacatggccaaaccacttccggccgaggagtgcggcgccctgatgtccgcggcgcccgttccggccgccgtccggtccgcttga

SEQ ID NO: 209 - DNA, 1209 bp, Actinoplanes utahensis
atgagcatggatccggctgaccatcccccgaccgaacccgatcattgcgtcccactgctgaccgaccggtccctggcctctcccctacccatcggcgccgccgacgatccggccaccggtgccgccgcagatgccgccaccagcgccgccgcagatgccgccaccggtgccgccgcagatgccgccaccggtgccgccgaggatgccgccaccagcgccgccggggatccggagccgaccggtgagtggccgctgccggggccggacgacttcgccgaggacgacaccgacccgcacgggttcatcccggtctccggggcgccctatccgccggccaccgatccgttcgacgatcccgcgttcacctcggcctatccgctgcccggctggagcgcgccgcccgacccggaaccgctgccgagcgcgctgcggcagcgccggccgatgctgctggcgatcggcgcgttcgtcgccctggccgggctgatcggcgcgttcctgctggtccggcacgatgcctcggggacccgcgcgacggtctccgaggcgacggcgccgacggggatggcggccgggccggcgaccgaggcgaccggcggcaccgggccgcgcgaggtggccggtccgcgggacgggctggccgcggcgtccttcgagatcctggacagcgccacgctggtccgggtgagcgccgccgatctgggcgccgacctgttccgggtcggcaccgcggcgggcagcgggctcaccccggccgtcgaacggtccgacggcacggtgcggctgcggctgcggtcggacggcagcggcgggtcggcggcggtcaccgtccagctcagctcggcggtccgctggacgctgcgcctggacggcgggaccgcgcagaccagcctcgatctgaccggggccgacctcgcggcgctggacctcggtggcggtgccagccggatcgacctgacgctgcccgccccgcacggcctgctgccggtccggatgtccggcggcgtcgaccagttccgggtggtcctctcccgggccaccccggtccgggtccgcgtccagtccggcgccgggcagatcacgctcggcggcgcgacgcaccggggcatcgcgccgggccgctcgttcaccaccgccgactggtccggcagcaccggcgtcgacctgctcgcggtcgccggcctcgccacgctcaccgtcaccggctga

SEQ ID NO: 210 - DNA, 1095 bp, Actinoplanes utahensis
atgagcctgcgcccccggatcggagcaccgaccagctcgcggccacggaccggtgcaccgacgagcttgcggccacggaccggtgcaccgacgagcttgcgtccccggatcggggcacggctgaggcggctgctgacaccgctggtcgtgctgaccctggtcgccgcgccggccgggtgcggcgccgaaccggcacccgacgatccggccggggcacgggccgtcgtgccgctgccggagaacgtgcaggacccggccccggtgccgagcgccggcccggtcccggactgcgtgccacgggccagcctgcgcccggacggcccgctcccgacggcgggccggatgccggccgggagcccgatggccgcgatcgccgcccgcggccggctgatcgtcgggatcgaccagaacgcctacctgttcagtttccgcgacccgaagaccggcgacctggccggtttcgagatcgacatcgcccgggcggtggggcgggcgatcttcggccgggacgacgcggtgcagttccaggcgatcaccacggccgaccggatcccggtgctgcagcagaagaaggtcgacctggtcgtccgcaccatgtcgatgacctgcgagcgctggcagcaggtgtcgttctccaccgagtatctgacctcgcaccagcgtctgctggtgcgccgcggctcgggcatccgcgagttcagcgacctggccggccgcaaggtctgcgccacccggggcagcaccagcatccggaccatcgccgagcagccgtcgaagccgattccggtggccaccgacagcaccctggactgcctggtgatgctgcagcaggggcaggtcgacgcggtgtccacgatcgacgtgctgctggccggcctggccgcgcaggacccgaccaccgaggtcaccgggcggttcagctcggacgagccgtccgggatcggcatcccgaaggacgagcccgacctggtccgcttcgtcaacgcggtgctggcgcggatgcgggcggacggctcctggacccgcagctatcagcgctggctgaccccgctcggcccgcccccggcaccaccggccgcggtgtaccgggactga

SEQ ID NO: 211 - DNA, 1251 bp, Actinoplanes utahensis
ttgcccggtttgcgacgactggccacaccggacctctaccgactgaccgccgcggcgctgatcctgctcggcatcgcgctcggcgggaccgccctggccaccgtgcaccaccgtgccgcgctgacccgggacatcaccggggtgagcgggccgttgagcgtcggcgcgcaggagctctaccgcgcgctgtccgatgccgacgcgaccgcggcgaccgccttcctgaccggcggggccgaacccgccgcgctgcggcaacgctacctcgacgacctgtcccgggcgggcgcggcgctgaccaccgcggcccgcgacgccggggacgccgacgcggcccggatcgcggtgctcaccgatcggctgccggtctacgccgggctggtcgaaaccgcccgggcggacaaccggatgggcatcccgctgggcggggcctacctgcgggaggcgtcggcgctgatgcgcgagacgctgctgccgcaggcgcaggggctgttcgccgcggcgcaggcccggctcgccgacgcgcagcgcggtgcggccgggtcgtcctggcagatcctggtgctcggcctgctcaccgtggccggcctgaccggcgcccagacgctggtcgcccgccgcaccaaccgggtgttcaacatcgggctgctcgccgccagcctggccgcggtgatcgcgctggcctggtccgcggccgcgctgggggtcgcggcgaaccgggtcgaggccggccgccgggacggctcccgcctggtcagtgtgctcgccgacgcgcgccgggcggagttgcaggcgcgcgccgacgagtcgctgaccctggtcgcgcgcggcggcggcgcggccttcgagaccgactaccgcacggtcgccgaccggctgaccgacctgctcaccactgccgcggcgcaggcaccggaggccgaccgggcgatgatcctgaccgcccggtcgcacgcggcccgctggcacaccctgcacgacgggctgcgccggctcgacgacagcggcgactacctgggcgcggtggggcaggcgacggcggccggcccggacggcctgaccgccgtcgtcaccgacctggacaccgcggtggcccgggccctggccaccgccaaccagcgggtcgaccggcaggccgggcacggcggccgggcgctgaccggcctgcagatcgcgatcctgctgctcaccgcgggcctggtcgccgcggtcatgctcggcttccgcccccggatcggagagtaccgatga

SEQ ID NO: 212 - DNA, 1449 bp, Actinoplanes utahensis
atgcggggcggggaggtcgtacaggtggttggtcgggcggtcgcgcaggcgctgagcgagcggcgggtccgggcggacgccgtggtcgagcgggcggtcggcctgctcgccgggcgggcccggtgccggatcgccgacgcgtaccggcacctgctgcggatcgccgccgagcagggcgccgacccggcggtggtggccggccggatgatccggctgctcgaccacgtggacgcgccgctgtcgccgttcaccggggccgatctggtcaccgaccggctggccggggtcgaggagctggccgggctcggctggggcgagtgggacctggtcaccggcgaggtctactggtcgccccagctgtaccggatctatcagcgcgatccggcgctcggcccgctgagccgcgccgagggccggctggccggggtgtccgacggcctctcgctgcgcgacgcggcgctggccgccacgcagagccgggaccgtgtcgaactggtcaaacgagtcacgatcaacggccggatcagacgcctgcgtacggtcgtcgacaccgtccgcgacccggacggccgtccgatccgactgttcggcatcgtgcaggacgtcaccgagcagccggtcagcgcacagcggctggccgaggtggaacgcaagctggacgagcagcgccgggccgcggacgccgagcacgacctggccctgcgtctgcaggagatcatcctgccgatcccggacgagccgatcgagctgcccggtctcaaggctgcggtgcgctatctgccggccgggcaggagaccatggtcggcggcgactggttccacgcggccgccctgcgcgacggctcggtgctgctggcggtcggcgacgtggccgggcacggcacccaggcggccagcaacatggcccagttacggcacgcgctgcgcgcgctgaccgtggtcgacagcgacccggccaccctgctcggccacctgaaccggctcacctgcgagctggagtcggagaccccggagctggcggcgaccgcggtgatcgcccggttcgatccgcaccggttccggctgacctgggcgcaggccgggcatccgccgccgctgctgtgccggggcgggcgcaccgaggcgctgcatcgcccggccggcccgatgctcggagtgctggaggacgcccggtatgcctcgacagtgatcgatttccgcccgggcgacgtgctcctgctctacaccgacgggctggtcgagcaccgcgggcagagcctggacaccggactgaacgcggtgatccacacggtcgacgacgcggtccgcgccgccccgctgcagccgctggccgaactggtcggccggctgcgccgggcgaacccggacgacgacacctgcatcctggccgcccgcccgtccaccggcggcacccgggatctgcgccaccacctgctcggccggaattga

SEQ ID NO: 213 - DNA, 384 bp, Actinoplanes utahensis
gtgatcggcgcggcggtacgcttccagccatgccgaaccggaccaagccgtcatccggccggtgctgacgtgcgccggggcgagatctggaccatcggcgaccgctccgatctgcgctatcgggtgctcgtcctctccgcggacagctacaacgaacgcgacaacgcctcaccctactgcgccccgatcgtgcgtcagcgcggtgtgaccgagctgcccccgttcgccgtcgccctcaccgagcaggacccgatcaccggcgtggtggtgatcaaccggatgcgccgcctgccggcctcggtcggcgccgaacggatcggcatggtcaccggtgccagcatggcccgactgaccgaggcgatgcgggacttgttcgagctctga

SEQ ID NO: 214 - DNA, 1440 bp, Actinoplanes utahensis
atgtcgcagaaggcgcagatcggagtcaccggccttgcggtgatgggccgcaacctggcccgcaacttcgcccggcacgggcacaccgtggcggtgcacaaccggtcctacagccgcaccaaggagctggtcgaggagttcggccaggagggcacgttcctccccgcggagaccgccgagcagttcgtgcagagcctggagcgcccccgccgggtggtcatcatggtcaaggccgggccggccaccgacgccgtgatcgacgagttcgccccgctgctcgaagagggcgacatgctgatcgacgcgggcaacgcgcactacgccgacacccgccgccgcgaggccgcgctcaaggcgcagggcctgcacttcgtcggcatgggcgtgtccggcggcgaggagggcgcgctgcacggcccgagcatcatgccgggtggtccgcgcgagtcctacgacgcgctcggcccgctgctggaggacatcgccgccaaggtcgacggcgagccgtgctgcacccacgtcggcccggacggcgccggccacttcgtcaagatggtgcacaacggcatcgagtacgccgacatgcagctcatcgccgaggcttacgacctgctccgccaggtcggcggcctcagcccgcaggagatcgccgaggtcttcgggcagtggaacgagggccgcctcgggtcgtacctgatcgagatcaccgccgaggtgctcaagcagaacgacgcggccaccggccggccgttcgtcgacatcgtgctcgaccaggccgagcagaagggcaccggccgctggaccgtgcaggccgccctcgacctgggcgtgccggtcagcggcatcgccgagtcggtgttcgcccgggcgctgtccggcggcgccgacgtccgcaaggccgccgccgacgccggtctgcccggcccggccgccggcgccgagcaccccggcggcgacctgcgcgccgacgtcgagcaggcgctgttcgcctccaagatcgtcgcctacgcccagggcttccagcagatccaggccgccagcaaggagtacgactgggcgatcgacccgggcgcgatggccaagatctggcgggccggctgcatcatccgggccaagttcctcgacttcatcaagcaggcgtacgacaagaacccggagctcgccaccctgctcgtcgacgactacttcctggacgcggtcagcggcgcgcaggacgcctggcgccgggtcgtcgccaccgccgcccagcagggcatcccggcccccggcttctcctcggcgctggcgtactacgacggcctgcgggccgagcgcctgccggccgcgctgatccagggccagcgcgacttcttcggcgcgcacacctaccgccgggtcgacaaggacggctcgttccacacgctgtgggcgaccgacgaccgtcccgaggtcgacgcctga

SEQ ID NO: 215 - DNA, 615 bp, Actinoplanes utahensis
atgtgccgggctcgtcgcgggcccgggcggaacgccgcgccagcaggatccggccggcaccgtcgtggcacacgaaaacacaggagaccgaaggcttcacccggaacatcctgtcaaaccggccggattctagaatcatggcccgatatggacgagatccccatcggcccggcgggaccggccgacgccggcgagatcctcaccctgcagctggcggcctacgtcaccgaggcccagctgtacgacgacccgcacctgcccgccctgacccagaccctggacgagctgaccgccgagctcgccgacggcctggcgctgaaggccaccctgggccaccggatcgtcggcgcggtccgcggccgcctggacggcacggtgctgcggatcggccggctgaccgtcgcccccgacctgcgcggccgtggcctgggcacccggctgctgaccgcgatcgagcgcgcggcggccggacaggccgaatggtatgcgctgttcaccggccatctgagcgagacgaacatccggctgtacgaacgcgcgcggtacgaggaaacccatcgggagcaggtccgacccggcctgaccctggttcacctgatgaaggagaacgcctga

SEQ ID NO: 216 - DNA, 3204 bp, Actinoplanes utahensis
gtggagctgaccctgctgtcccgggtggccgcccgcggcgtcccgatcagcggcgcccggctggccgacctgctcgccctgctcgccggtgacctcgccggcggctgcggcgccggccggctgatcggcgagctgtggcccgacgagcagcccgaacatccgtcgaaggcgttgcagaccctggtctcccgggcgcgcgcccggctcggcccggacgtcatccgcggcaccccgaccggctaccggctcaccctgacgccggagcaggtggacgcgtcggcggtactgctgcgggccgccgacgccgaacggcacgcccgggccggcgcacacgccgccgcggtggccgccgcggacgccggcctggcgctgttcggcggtccggaggcggacggtcccctcggtgccctgcgcgccgcccgcgcgacggtgcgggagacgctgctccgggctcgggcgctggcgcttggacggctcgggcagggctacgaggaactcgccaggatcgccgtggaccggccgcgcgacgaggagatactcgtcgacctgctgcgggtggaggccgcgacgcaggggccggccgcggcactgatccgctacgacacctaccgtcggcaactgcgcgacgaactcggcaccgagcccggcccggcgctacgggccgcgcaccgggagctgctgctcagcgacgccccggtggtccgccagggcctgcgcttcgagccgaacgagctgctcgggcgcgaggacgacatcgcggcggtcggagcactgctgcgtaccgcgagggtggtctcgatcgtcggggccggaggcctcggaaagacccgcctcgcgcaggcggtcggccgccgtgccggccaccggatgatcttcgtggtcgagctggccggcgtcacccgcgacgccgacgtactccccgaggtcgccaccgccctcggcgtcgccgaagcccccgacccggtcgccggcacggcccccaccctcgtcccggagcgggcctcgcgctccggtgcagcccccgccttcgtcccggagcaggccttgctgtccggcgtggccggcgcgctcacccccgggccggcgctgctcgtgctggacaactgcgagcaggtgctcgacggcgttgccggcctggtccaggcgctgatcgcgcgcagcggtgcggtgaccgtgctgaccaccagccgggccccgctcggaatctggtcagaatcggtctatccgctcgccgaactcgatctcgacaccaccgtcgagttgttcacccagcgtgcccgcgcggctcgcccggccgctgacctgccggccggcccggtccgcgagctgtgccgccggctggacgggttgcccctcgccgtcgagctggccgccgcccggatccgggtgatgtccccggccgagatcggccaccgtctggacgaccggttcgccctgctgcgcgacggcagccgggacgccccggaccggcaccgcaccctgcacgcggtgatcgactggagctggcacctgctcgacgacgagggccgcgcggcgatgcgcgccctgtcggtgttccccggcggcttcaccgcggaggccgcccggcaggtactcgccaggcccgtgtccggaaaggacgcggacaccgcccggcacgtgctcggcgaggacgcgggggctgtccggcacctgctcggcgctgacgcggtggcccggctcgtcgagcattcgctggtcaaggtgcaggacagtccggccgggacccggttcgtgatgctggagacggtccgcgagttcgccttcgcccaggccgggccggccgacgaggcggcattcctggcgtgggcccgcgacctgggcgtccgcgacgaaccggacctcgccgcggccctggtggtcggcgtcgacgggttccgcgccgaccatgacaacctggtgcgcgcccaccgcagcgcgctggccgccggggacgccgccacggtggcctcgaccacggcgctgctcggcacgctctgggtcaccgactccaacgtgaaccggctgatcgcgctggccgccgaggcgcccggcgcgctggtccggttccggcccgacccggcccaggtggagaccgtccggaccgccgcggtgtggtgcacggcgatcgccttcctggtgtccggctcgccgtcgttgcgcgccctggccgtgctccgccggctgccttcgcccgacccggccacgctggccggcgcggcccagacggtgatctgcgcccccgacctcgcagcgctggcgacgggcggaaccccggtagaagggagcagctgttcggtggtctcgggggcgggccgggacgcggggagcggcggttcggtggcggccggcgggagaccgccggccgcgggcgggagcccgctggtcgccgggctggccaactacgcgctcagctacgtcgccgagaacgccaacgatccggtcgccgcggtcgccgcggcccgcgcgatgttggtctgtctgcagggcgagcatccgtggctgcgggcggtggcccacgggcggatcggtgagctgtgcctgcgcaccgcgccgggggaggaggcgttccggcatctcgacgcggcactgtcgatcatggaggagctgggcgcctcggcgagtgcggcccgggctcgctgggcgatcgtcctggcggacctgcagcgtggtgctttcgaccgggccgagcagggactggaggtgctcagccggggcgttctcgacgaggaggccggccggatgctgttcgaacgctgcacccgcgccgagatcctgctcggccgcggtgacgtggacggcggcctggccctctggcgggaggcggcccgggcattgcgtcgtacccccgggctgtgggcgaacgagatggtcggggtcgcggtgctggtgcactgccggcacggccgcctcgacctggtccaggatctcgcgggggagttgcccgggcggctggcggcgctgctgcccgacgtgccggtggtgtcgttccgggtgtgcggggtgctgctgatggccctggccgaggtgcgtgccgcccggggggagccggacgacgggcaccgcgacctggccgagcgtttcggcttttcggggacgttccaggcaaccgtcgcggtcgccggcggcaccggccccgacctggaccacgaggcggtgcgcgccgccgcgctggccctgctgcgaatccctgcggagaagcgatag

SEQ ID NO: 217 - DNA, 753 bp, Actinoplanes utahensis
atgagcgacgcgatgaccatgctgcgacgcaccgtgaagcacacgtcccgcaacccgggcgcggtcatcatgacggtgggcctgccggtggtcctgctgctgctgttcgtcggggtgttcggcggctcgctgaacgtcggcatgtccgaagacgactacatccagtacgtggtggccggcgttctgctgatgacggtcggttacggggcgacgaccaccgcgctcgcggtgaaccgggacatgaccgccgggatcatcaaccggttccggaccatgcccatctcccgggcctcggtactgaccgggcacgtgctcggctcgagcatccgcaccctggccagcgcgacactggtcgtcgcggtggcactggccctcggcttccgcggcgacccggacccggcccggtggctggccgcggccggcctgctggccctgctgaccgtggcactgacctggctcgcggtggcggtcgggctggccgcccggaccgccgaggggatcgcgccgttcaccctgctggtgcagctgctgccgttcctgagcagcgcgttcgtccggccggaggcgatggacggggcggtgcggtggttcgccgggcacgaaccgttcacaccgatcatcgacacgctgcgcgggctgctgctgggcagtgcggtcggggatgcgtggcggtcggcggtgctctggtgcctggtgctggcggcgggcggctacctgtgggcgcggctgctgttccgccgcgacccccgataa

SEQ ID NO: 218 - DNA, 933 bp, Actinoplanes utahensis
atggacgagaacaacggtgtgacggtgcgcggcttgcgcaaatcgttcggtggcacggtggtgctcgacggcgtcgacctggacgtcgccgaggggaccacggtcgcgctgctcgggccgaacggcgcgggcaagaccacggtggtccggatcctgtccaccctgatcggcgccgacgccggcgaggtcacggtggccgggcacgacctggcccgggacccggccggggtgcgcgccgcgatcggggtgaccgggcagttctccgcggtcgacgacctgctgaccggggcggagaacctggaactgatggccgacctgcaccacctcggccgggccggtagacgggaccgggtggacgcgctgctccaccgattcgaactggaggacgcggccgggcggaccgcggcgacctactcgggcgggatgcggcggcggctcgacctggcgatgacactgatcggacggccgcgactgatcttcctggacgagccgaccaccgggctggacccgcgcagccggcggatgctgtggcagatcgtccgggaactcctcgccggcggggtgaccatcttcctgaccacgcagtacctggacgaggcggatcagctcgccgaccggatcgcggtcctcgacggcgggcggatcgtggcggcgggaacaccggcggaactcaaacgcggcgtgccgggaggacacgtacggctgcgattgcgggatgccgcggcgcgggaagccgcagcggacctcttcccggacgcgtcccgggaggacgacgacgcgctggcggtgcggatcccgcgccggatcccggtccgtgagctgctcgaccgcctcgaccgcggcggcatcgaggtggacgagctctccgtgcactcccccgacctggaagacgtgttcctggcgctgaccggtccgaaggaggccggacgatga

SEQ ID NO: 219 - DNA, 612 bp, Actinoplanes utahensis
atgtctgagccgccgccggtcgtcgtcgcccggttcctggaacgcacccgcgccgaggggccgggcgagcggaccgcggtctgggtgcagggctgctcgatccgttgccccggctgtttcaacccgcacctgttcaccccccgcggcggcacaccggttccgccggctgagctggccgcccggatcctggccaccggcaccgacggggtgacgctgctcggcggcgaaccgttcgaccaggccgccgggctggccgcggtcgccgccacggtgcgggccgcgggtcgcacagtgatgaccttcaccggttacgaccacgcggagctgcgctcccgcgcggaccagggcgtcgccgggctgctcgccgccaccgacctgctggttgccggcccgttccggcaggatctgatcgaccgcgtacgcccctgggccggctcgaccaatcaacagttcgtgcatctcaccgatcggcttccggtggacgtgaccccggaccggctggaagtgaccgtctccggcaccggtgacatcgccgtcaacggctgggccgacaccgagaccctcgacgccctgctggccgggctgcagacccggcgcctgaagccgcggtga

SEQ ID NO: 220 - DNA, 789 bp, Actinoplanes utahensis
gtgacgtggaccccgcctgacgggaccggcccctaccagcccccaccgccggccgggccgggcgccggctggcggatcgggcacagcatgtggctgttcttcccgatcctcgggttcggctgcctgtccggcggcggtttcctctacgtcggcctgcgcgcccaccggcccgcctggtggattccggggatcgtctacagcgtgctgtccatcgccgggttcaccatcggcggctccgcgcccaccgactcgctgcggcagaacctctcctacgccgtcctgttcggcgcctggctggtcagcatcttccacgccgccctgatcaacggcgcctggctgcgctggctggccggttatcaggcctggcaggcgcagatgcgggcggtctgggtgggccagcagccgacgtccttcgcgccgctgccgccgtacctgcagggcgtggtcgcacccccacagcagttctacaacaccgccccgggctaccagccggcgccggtcccgcaaccggccgtccaccagccgtccaccccggcgcaggtggacgtcaacaccgccaccgagcagcagctcgccaccctgcccggcctcacccccggccggatcgcccaggtcctgcagtcccggcagcagcggcgcggcttcctcaccgtcgacgacttcgccgccgcggccggcctcgccccgcacgagttcgtcgccatccgcgaccggctcacctgcagcgcggccccgccgccgccggacgacacgaccagcggcccgtacggccgcgtggtggatgtctga

SEQ ID NO: 221 - DNA, 216 bp, Actinoplanes utahensis
atgagcagcccccgcatcgtggtcacggtcagcggcgacggtcaggtgagcgcggagaccctcgacatcctgggtgaggagtgcctgaactacattgccgttctcgaagatctgatcggcggtaaggtgcggcacagcgcctggaccgccgactacacgcgccaggcacagcatgtgcaggaacagcaggtgaaccgtgacgtggaccccgcctga

SEQ ID NO: 222 - DNA, 444 bp, Actinoplanes utahensis
gtgagcgtttcactactgctggtgccgctggcactggccggggcggccgcggtgcaggcccgcgccgaacgccggtcgaacggtcagacgctggtccaggtgaacacccggatgcgcgatgtgaccctgctggccgacgcgctgcgcgacaccggcgcggtggtgtccggcggcgaggccgcgctgaccgcgcgctggggtgaccaggccctgaccttcggacgcgacgccgacggcatctggtcggcgcacgccgacggagtgggcgtggagcgggcggtcgagttgatcaccgcggtcgacgcggcgtacggacggcgggtgcagcaggccgtcctggaccggatccgggcacaggcgccggccgccgggctgcggctggagtccgagtcacggcaggacgacgcgagcgtccgcctggtcttcgaggtggagacggcatga

SEQ ID NO: 223 - DNA, 330 bp, Actinoplanes utahensis
gtgcacctggcccgggcgctgcgccacccgcgggtggccggtgacctgctggtcgacccggatctgcgggccgatctggccgggctgaccgaggggtactcgggcgccgagatcgagcaggcggtgatcgccgggctgttcgacgccttctccgagcgccggccgctgcgtcgcgacgacctggtgcgggcggtgatgagcatcgtcccgctcagcgtcacgcaggccgagcggatcgcggcgttgcgcggctgggcccggaaccgggcggtcccggcgaccgccaccgacgatggggatttccgcaacgagacggggagtgtgcggtga

SEQ ID NO: 224 - DNA, 1248 bp, Actinoplanes utahensis
atgtccttttcggagactttggcgcagctgctcaaggcccgtttcccggtgctctacgtggagacgttcgaggagcagcgcgccctgcaccggatcgccgcggtcgccggtgacgaggtgctggtgcgcacgccgcgggggctgtggacgtggacgctgaccggtggcctcatcccgccggacggcaagccgcgctccggcacgcacggggcggccggcgccctgcaggcggtgcagcgggtggacgagccgggggtcttcgtcttccgcgacctgcaccccgcgcacgtcgacgggcagtatccgcagaacatggagctgatccggctgctccgggacaccgcgcaggcgttccggtccggctcgcagccgcgcaccctggtgctgctctccccggtgctgagcatcccggccgagctgcggaaaacggtgaccctggtcgagtttccgctccccggggcgcctgacctgcacgggctgctggacgcgatgatccgggcgaacgccgcgtccgggcggatccggatcgacctcgacgacgccgggcgggagcggttcgtggccgcggcggccgggctgaccatggaggaggcggagaacgccttcgcccgggcgatcgccaacgacgccgtgctcgacctggaagacgtgcggatcgtgcacgacgagaagcagcagaccgtacaaaaatcgggttttctggattttgttcccaccgagatcgtgctggacgatgtcggcggcctggggaatctgaaagcctggctggtcaagcggaacggttcgtggctgcccgaggccgcggagtgggggctgccggcgccgcgcggcgtgctgatcaccggcgtccccggctgcggcaagtcactgaccgccaaggcgatggcgaccgcgtggaacctgccactgctgcgcctggacgtgggtcgggtcttcgccgggctggtcggctccagcgagcagaacatgcgctcggcgctgcgggtcgccgaggcggtggcgccgtgcgtgctgtggatcgacgagatcgagaaggggttcgccggcggtgcggtcggtgactcggggaccggcgcccgggtgttcggcacgttcctcacctggatgcaggagaaacggcggccggtgtttgtggtcgccaccgccaacgacttcgaggggctgccgccggagctgctccgcaagggccggttcgacgaggccttcttcgtcgacctgcccagccgggccgagcgggccgctagctag

SEQ ID NO: 225 - DNA, 210 bp, Actinoplanes utahensis
atgaaacgtgcctcgcgagcggccttggccttgaccgccgccgcggccctgctcgccggatgcagcaccgtgcacatggcccgcccccgctccccggaagtgaaactgcccgccaacggcatcgccggcctcgacgcggacgccatcctgtccgacgccgagggagccctgaaagcggccggctccttccgcctgcggctagctagctag

SEQ ID NO: 226 - DNA, 543 bp, Actinoplanes utahensis
gtgccacccggcgcgggcagcggcgtcacggccgcttcggccggtccgcggttcgccctcgacctgcgcatctccggcgacgacgtgatcggctcggtctggctgccgcaggccagcgggcaactgctcaccgtgggcggccaccactacgtgcgtccgggtgccgagttctggcgagcggtcgaccccaagggcgtggcccgcaaacgcctgggtgaccgctggctccgcgccgacgccaccgacgtcgccgggatcagccacttcttcgacccggccgtgctgctccgcaccctgctcaagcccacgaccccgttgacgaagaccgccccgctccagatacacggcatcccggcgatcggcctgacgtacgcccccggtgtcaccctctacatcgccaccgccggccgcccctaccccatccaactggacttcccgggcgccgagggcctccgcttcaccgagttcggcgccacgttcggcggcatcaaggtccccgacacctcccgctgcgccgacctcgccgccctccaactgcgctga

SEQ ID NO: 227 - DNA, 516 bp, Actinoplanes utahensis
gtgccgtgttcgcggggggacctggccacccggcagctccgggccgaagatgggctgatgggacgctccacgctctaccaggccgccggtggggcggcgggaatgctcgccctcgccaccgacttccacgcgcgctgcctggccgacccggtcctcgagcacccgttctcgcacctcgacgacccggagcacgtccagcacctggccgcgtactggggcgaggtgttcggcgggccgcccacctattccggccggcacggcggccactcgggcatgctgcggatccacgccaaccagtgcgacgaggacccgttctcgggccggttcctggaagtcttcgacgaggcggtcgcgcacaccctgcccgacgacccggcgctgcgcggcgccctgcacgactacatggtggcggccacccgcgaggtcgccgccgtgttcccggcctcggccaccgtcccggacgccctgcccatgccgcactgggcctggtccggccccaccggcggcgactcctag

SEQ ID NO: 228 - DNA, 1269 bp, Actinoplanes utahensis
atgatccggtacggggacgaggtggcgtcgatcgcgcgggagctgcgggacccgggtgatctggagattctgctcgatcgggcggagtcggcgcggatcgtgatgatcggtgaggcgacccacggcacgcacgagttctacgcctggcgttccgttctgacgcagcggttgatcgaggaacgcgggttttcgttcgtcgccgtcgagggggattggcccgacggagaacgggtcgacgccgcggttcgtggcggccccggcgctcccgatgatccgcggtcggcgttgatccgctacgaccgttggccgacctggatgtgggccaatgaggaatcggtcgatttcacgcgctggctgcgcggcctgaacgccgtccgcccgcccggcgagcgcgtcggttttcacggtctggacgtctattcgctgtgggagtcgatgcgggagatcctcacctgggtgcgggagcacgacccggatctggtcccggtcgcgctggatgcctaccgctgtttcgagccgttcgacgaggatccgaacgcgtacggctgggccacccagttcgtcgacgcgacctgtgcggaggcggtcgtccggatgctcgccggcctccgcgggcgggatttcggggtgtggcagaacgcggccgtggtcgccggagcggagagttactaccggaacatggtgcgcggcggaccggaggcgtggaacggccgcgaccggcacatggacgagacgctggatcgcctgctcaaccactatgggccgggatcgaaggcggtggtctgggcgcacaacacgcacgtcggtgacgcccgcgccaccgaccaggtggaccacggcgaggtgacgctgggtcagctggcccgggaccggttcggctgggacgaggtgctgctggtcggcatgggcacgtatcgggggagtgtggtggccgggccgcagtggggcgcgccgatggagatgatgggggtgccaccggcccgggccgggtcgctggaggagatcctgcacctgaccgcgccggcccggggcctgttcgtcttcccggccggctcggacggcccggacctgctcaccacgatcctgccgcaccgggcgatcggggtggtgtaccggccggagcgggagcgctgggcgaattatgtgccgaccgtgctgggcgatcggtacgacgcgttcctctggttcgacgagtcgcacgggctgcggccgttgcacacgctgcgggtgaacacgcacgagccggagacgtatccgagcggtgtgtaa

SEQ ID NO: 229 - DNA, 1104 bp, Actinoplanes utahensis
atgaaaaagatcgtccgcctgctcctcgccgcattgctgagtgcgtgcggggtgaccgtcgtggcggccggaccggctgccgcgacgctggcgtccgggtacgtgctgagcagttcgaccgccacccttccggccgagctgtccgccctcgcgaccggcaagcgcgtgcagtacctgtccacctcgatcaccgggagcacgatcaccgccaccgggctgatcctcaccccgaagtccggtaggaagaacagggtcgtcgcctgggcgcacggcaccaccgggctcgcctaccagtgcgcgccgtcgaccaaccagagcgtgttctgggaggaggcccggatcgcggtcgccgccctgctcaaccgcggcttcacggtcgccgccacggactatccggggctcggctcgggtggccagcacccgtacctgatcggcgccagcgaggctcgcgcgatcatcgacagcgtcaaggcggcccgcaacctcgacgcgtcgctgagcacccagtacgcgatcgacggccactcgcagggtggccagggcgcgctgttcgccagccagatcgcccccgcgtacgacggcaatctggtgttggagggcacctccagcatcgccccgctgtcgaacgcggacaccatcgccccgttcatcccgggcacggccgagcagggttacctggtgatggcgctgtacggcctgaacgccgtcgacccgagtgtgcagccgctgaccatcctggccaccccggccaaggccaaggtgggcgtcctctactcgggctgtctcaacgagatcctcgcctcctaccagagtctgaccgccgcccagctcgtgaacaacggcgtggtgccggattacgtgctgaccaaactcgcgcagtacgacaacccggcgcagtccgccccgaccgcgccgatcctggtggtgcagggcaccgcggacgaggccgtcccctacgacatcacggccggcatgctgatcccgcaactgcaggcgtacagccagccggtccagttcgtgccgatccaggacgcgacccacgacaccgcggtgatccagtccgcggacctggtcgccgactggatcaccgcccgtttctcctga

SEQ ID NO: 230 - DNA, 1026 bp, Actinoplanes utahensis
gtggagcatcgacgactcgggaccagcgggctgttcgtcagcgaggtcatcttcggcaactggctcacccacggggagacggtcgacgaggccgcggccacggcgtgcgtccgggcggcgctcgacgccgggatcgacacgttcgacaccgcggacgtctatgcccagggggccgcggagacgctgctcggccgggcgctgcgggggctgccccgcgaatcggtgacgatcgcgtcgaaggtgtgcctgccggtcggggacggggccaacgaccgcggtctgtcccgcaagcacatcatccagagctgccacgactcgctgcgccggctcggcaccgaccacctcgacctctatcaggcgcaccggttcgatccgggcactccgctggacgagacgttcgaggccttcgacaccctgatcgggcagggcaagatcgggtatgtcggtgtctccgaatggacggccgagcagctgcggcaggggatcgcggcgagtgccgggctgcgggcccggatcgtggcgaaccagccgcagtacaacatgctgtggcgggtgatcgagtccgaggtggtgccggtctgtgccgcggccggcatcgggcaggtggtcttccagccgctcgcccagggggtgctgaccgggaagtaccgtcccggcgagccggtgccgccgggatcccgggcggcggccggcgggcgggcgccccggttcatcaaccgggtgctcggagaccggctgctggagcgggtgcaggcgctgcggccggtcgccgcggaggccgggctgtcgatggcgcagctcgccgtggcgtggacgctgcaccggccgaccgtgaccgcggcgatcatcggggcgtcccggccggagcaggtcacggagaacgcggccgcctccggcgtgccgctcggcgatgatctgctgaagcggatcgacgaggcgctcgacgagttggtcgaccgggacccggccaagaccgccaggatgatggcggtccggccgggctggtcagccacaccgccggactga

SEQ ID NO: 231 - DNA, 414 bp, Actinoplanes utahensis
atgagcgccgccgagcgcgcctggcgcgcgatgcgcgcgctcgtcaccgaacagcacgacgcgaaggtccaggtcagcgcggcgctgggattgagtttcgtccgcgtgaaggctctgctcctgctcgccggaggtccccacacgctcagcgagacggcccggctgctcggctgcgacccgccctacgccacggtgatcaccggcgacctggcggcccgcggcctggtgacccgcgagccgaacccggcggacggccggtcccgcctggtcacgctcaccccggccggccgggacgcggcccgggaggcgaaccggatcctgggcactcccccacccgagttgctcgccctgccgcccgaggacctggcggccctcgaccgggtcctgagccggctcggaccgacacctggatga

SEQ ID NO: 232 - DNA, 1365 bp, Actinoplanes utahensis
gtgccccgccgttacctgatcctggcgatctgctgcatgagcctgctgatcatcagcctggacgtcaccatcatgaacatcgccctgccggccatccgcgacgatctgcacgccccggtctccggcctgcagtggaccatcgacgcgtacaccctggtggtggccagcctggtggtgctggccggcgcgaccgccgaccgggtgggccggcgccgggtcttccagaccggtctcgccctgttcaccgtcgcctccctgctgtgcagcctcgcaccgcatctggaggcgctgatcgccttccgggtactgcaggcgatcggcggctcgatgctcaacccggtcgccatgtcgatcatcacgaacaccttcaccgagccgcgcgagcgggcccgggcgatcggcgtgtggggcgcggtggtcggcttcggcatggcgctcggcccgctggtcggcggtttcctggtgcacgggctgggctggcggtcgatcttctggatcaacgtgccggtcggcgtcgcggcgctgatcctcaccgccctgttcgtgcccgagtcccgggccccgataccccgccggctggacgcggccggccaggtcctggtgctggtgctgctggccacggtcaccttcgcgatcatcgaggggccgggggccggctggtggtcgccggagatcctgggctgtttcacggccgggctgctcgccctgctcggactgctgtggtgggaaccgcgtcgcgccgagccgctgatcgatctcggcctgttccgcagcccgccgttctccggggcggtgctgatcgcgatctgcgcgttcggcgggctgggcggattcctcttcctgaacacgctctacctgcaggagacccggggcctgtcggcgctgcaggccggcctctggacgctgccgatggccggtgccaccgcgctggtctcgccgttcgccgggcggctggtggcgagccggggaacccggctgccgctgctggccgccggggcggcgatgaccctcgggccgatcccgctgacctgggcgcgaccggacaccccggtctggcagctgctgatcggctatctgctgttcgggatcggcttcgggatggtgaacgcgccgatcaccaccaccgcggtcgccggcatgccgcgcgagcgggccggcgtggcggcggcgatcgcctccacgtcccgacaggtgggcagcgcgctcggggtcgcggtgatcggggcggtgctggcctccgggcaccggcacgccggcgctgccatcctgtgcgggctcggggcggcggtgctggtgctcggccggctcagcacgggcgacggggcgcgcacccacacgcgtaccgcggaaagcgtcccggcatga

SEQ ID NO: 233 - DNA, 2109 bp, Actinoplanes utahensis
atgaaaatctggccgggcaacccgtatccgctgggtgcgacctatgacggcggcggcacgaacttcgccatcttcagtgaggccgccgagcgggtcgagctgtgcctgttcgacgacgagggcaacgagacccgggtcgacctgcccgagcgcgaggcgctggtctggcacggctatctgccccgggtcacccccggtcagcggtacggtttccgcgtgcacgggccctacgacccgtcccgcggcctgcgctgcaatccccacaagctgctcctcgacccgtacgccaaggccatcgacggcgactaccggtgggatcaggcgctcttctcgtacgacttcggcgacccggcgtcgtacaacgacgccgactcggccccgttcgccccgcgctccgtggtgatcaacccgttcttcgactggggcaacgatcggccgctcaagatcccgatgtggcagacggtgatctacgaggcgcacgtcaagggcatgacgatcaaccaccccaagatccccgatgacgtacgcggtacctactccggcctcgcgcaccccgagatgatcaagtatttccagcgcctcgggatcaccgccgtcgagctgatgccggtgcaccagttcgtgcacgacagcggcctggtcgagcgcggcctgagcaactactggggttacaacacgatcggcttcttcgccccgcacaacgggtacgcgtcgttcggcggcgccggcgggcaggtgcaggagttcaagtcgatggtcaaggccctgcaccaggccggcatcgaggtgatcctggacgtcgtctacaaccacaccgccgagggcaaccacctgggcccgaccctgtccttccggggcatcgacaacccggcgttctaccgcctcgtcgagggcgacaagcagtactactacgacaccaccggcaccggtaacagcctcaacgtccggcaccacgagtcgctgcggctgatcatggattcgctgcgctactgggtgaccgagatgcacgtcgacggcttccgcttcgacctggccgcctccctggcccgggaattccacgaggtggaccggctggccgccttcttcgacctggtcaaccaggacccggtcgtctcccaggtgaagctgatcgccgagccgtgggacgtcggggacggcggttaccaggtcggtggcttcccgccgaactggaccgaatggaacggcaaataccgcgactcggtccgcgacttctggcgcggcgaaccctccagcctcggcgagttcgccagtcgcttcaccggcagctccgacctgtaccaggacgacggccgccgcccgatcgcctcgatcaacttcgtcaccgcgcacgacggtttcaccctgcacgacctggtgtcgtacaacgagaagcacaacgacgccaacggcgagggcaaccgggacggcgagagccacaaccgctcctggaactgcggcgccgaaggcgagaccgacgacgccgagatcgtcgtcctgcgcgaacggcagaaacgcaacttcctggccaccctgctgctcagccagggcgtcccgatgctcctgcacggcgacgaactgggccgcacccagcgcggcaacaacaacgtctactgccaggacaacgagctcagctgggtcgactgggagaatgcccgggaggaggacgttctcacccacttcacccgcctgctcctgaagctccgcgccgagcacccgatcttccgccgccgccgcttcttcaccggcgccttcgccgacgagaacaaactccccgacatcgcctggctgcgccgcgacggcgaggtgatgaccgaagccgactggaacaccccgagcggcatgacgatgaccgtcttcctgaacggccacggcatcccggaacgcggcgccctcggcgaggagatcaccgacgactcgttcctgctgctgttcaacccgctcagcgaggacgtctcgttcaccctgccgtcccgcgactacggcaagacctgggagatcgtcgcccacaccgccgatccgctgctggcccgccgccgcaagaccgcccgcgccggcagccgcgtcgacgtcctccgccacgccctggtcgtcctgcgctgccgctactga

SEQ ID NO: 234 - DNA, 516 bp, Actinoplanes utahensis
gtgtctgtgggaaatccgctggcgccgcggcccggccggtgctgggctggcggcgtgacgagaatcgagcgccggtcggatccggtggcgaccggacggattctgcgggccctgccgtcctggttcggtctcgaggaggccgtccgcgactacgtcggcgacgcctccgtgctgccgagctatctggcggtcagcggctcggcgacgatcggggtcgccctggtccgccggcacttccccgaatccgccgagttgcacctcatcgcggtgcacccggacgcgcggggctccggcgccggcacgctgctcctcaacgcggtcgaggaggatctccggtgcgcgggtgtccggctcctccaggtcaagaccatcggcgcgtcgtacgagcatgaggggtatgcgcagacgcgcggcttctatcgcgcccgggggttcctgccggtggcggagatgcgcggcctggtctgggacgggccgacgctgctgctggtgaaggtgatcgccccggatccctaa

SEQ ID NO: 235 - DNA, 381 bp, Actinoplanes utahensis
gtgagtgacacacccctgtcggatgtcatggccgagcatgcgcagacccgtgacgcggaggcgtaccagcggttcgtcgcgctcttccggtcctcgaccgtcggcgtcgtggtcaccgggacaccggtgccggacgcgccgggcggcttcgtctcggacggcaccctggccgtgcgccggaccggtcacggcgacggccggcagcggatcctcaccttcgccgacccggaggtgttcgcccgccggttcgggcccgtgttcaacgccggcatgtccggcgacgcgctcctgcggatggccgccgacgaccgagagtgcgccggcatcctggtcaacagcgcgaccgcggagaccagcgtcatcatcagcagcgtccattag

SEQ ID NO: 236 - DNA, 417 bp, Actinoplanes utahensis
atgagtgacctggaacgcttcgtccgcgcccaggacggcgtttatgagcgagcccgcgacgaactggccgcgggccgtaaacgtacacactggatgtggttcgtctttccgcagttgaccggtctggggtcgagccccaccgcgcaggcctacgcgatcgctgacctggccgaggcccgtgcctatctggcgcatccggtgctgggcgcccggctgaccgatgccgcccgcacgctgctgggcgtcgagggtcgcacggccgagcagatcctcggctatccggacgatctgaagctgcgctcgtcgatgaccctgttcgccgcggcggccgccgagccgggcgtcttcggcgaggtcctcgaccggttctacgacggccccgacccgcggacgctggagctgctcggccgggggtag

SEQ ID NO: 237 - DNA, 1041 bp, Actinoplanes utahensis
atgcatttcacgccgcgtgacggccgggtcggcgacctgttcggggtactgcaccgcgacgggcgctaccacctgttctacgagcaccggtccggcggcgacgccggctggggctgcgccgtctccgacgatctggtgatctggcgggagggcgcggtcgccgccgcgcccggcggcccgggctgcgggtcggtcgtcgacggcccgtccgggccggtgctcttccattccggtccgggctccggggtgcgccgggccaccgccgccgccgatctgacgggctggctggccgatcctgatcagccggtgctgggtgccgccccggagggcttctccgacgtgcgcgatccgttcgtcttcgcggcacctggcggttggcggatgctggtcgccgccaccgcggccgggggcggctccgcggtcctgcaataccgttccgcggatctggacgactggtcgtacgacggtgtgctgaccaccgccgcgggcgggcaggtggactgcccgcggctgttcgaactcgacggcgagtgggtgttgctcgtggcgggggccgatgcgtcgtacgccatcggcggttatgacggtgtcgccttccggccgcgcgcccggggcgtcttcggccggggccggctggggccggccgcgcccttcgtcgacgccgccgggcgccgctgcgtgctggcccgggtcggcggctccacgtgggcgggcgcgctgagcgtcccgtggatcctgtcggtgcgtggtaccagcctgctcgccaccccgcacccgcacctcgaccgatacctggtgaccggggtcaccggcctgaccgcggacgccggcgagctgcgtgaccacggcgacctgatcctgcggatgccggccggcggggagaccacggtgctggccgacgcggacatcgtcgaggtcaccgtcgagggggtgagtggtctcggcgcggcccgccgcgcggtgcccggcgagcccggcgcgcacatcgcgcggatcgccggctccggccggcgacacgattaccatcggggggatgagtga

SEQ ID NO: 238 - DNA, 222 bp, Actinoplanes utahensis
atgacagagaagacctacgctgcgagctttgaccggaacggggcatgctggcgtcgcagtactcgcagctattcggacaactgcgtcgaggtcgccgatctggccgacggtggccgcgcggttcgtgactcgaaggacccggacggcccggtgctgttcttcaccccggacgagtggacggcgttcgtcggcggcgccaaggacggtgagttcgacgactga

SEQ ID NO: 239 - DNA, 813 bp, Actinoplanes utahensis
atgtggtccttgaaggcgtggcaggcgcgtttcgcgaccggtgaccggctgcgggcgtacgccggatggtgcaatgcggtggaggggaacaccaccttctatgccacgccggcccgcgcgacggtggccacctgggcggagcagaccgctccggacttccggttgatcccgaaggttccgaaacggatcacccacgagctgcggatgtccggcgccgaggaggacctgcgcgtcttcctggacgcgatggagccgctcgggccgcgcgccaccgctctgtggattcaacttcccgggtccttcggacccggcgatctcgccgttctctcccggttcctgcgctccctgccgatggatcggcggtacgccgtggaggtgcgccacccggacttcttcaccgatcccgggcgtctgacggaactgctcgccgcgcatgacgcggaatgggttccgttcgacacgaccacgttcttcgccagcccgccgacgagcgccgcggaacgggacgcgtggttgaagaaaccccggatgccacgccgcgacaccgcgctgaccgaccacccgatcgtccgctatctgggccgggacgacaccgagcgcacggtggccggctggcagccgtgggtcgcgacgaccgccggctggctgcgggagggccgatccccgacggtcttcctgcacaccccggacaacgccgacgcgccggatctggcccgccggttccacgccgaggtcgccgccctggtaccgggcctgccaccgctgccggaaccggctccccgggaggcggaggggccggcgacgctgttctga

SEQ ID NO: 240 - DNA, 669 bp, Actinoplanes utahensis
gtgaccgattccgtgggccggatcggcatccgcgccgcgtccgccgcactgctgctcgccggtgtgaccggcggcgtctacctgggcgagcaccgaccgccgccgaccagcggcaccctggactcggtgcaggccgaggcgaacgacatgcagctgctcaaggatcggcagaacgaccacgccgcggcccgcgcccggatcaccgcggccgagggcgtcgccgcgcagaaggccgcgtcgaccgcccgcaccgcctcgggatacgccaaaaccctcgacaagcaggccaccgcggccaagaaggcggcccagaagccgagcggcccggtcgccttcgccggcccgattcccggctcctgcaccgaattcagcggcagccgggcggtcggatgcgcgctcaccctgcaggccggcttcgggctcgaccagttcgcctgcctgaacaagctgtggaacaaggagagcggctggaactaccgggcggagaaccggggctcgggggcctacggcatcccgcagtccctgcccggctccaagatggcgtcgttcggcgcggactggcagacgaatccggccacccagatcaagtggggcctggactacatcaagaagcgctacaacaccccctgcaacgcctgggcgcactcggtccagttcaacaactactag

SEQ ID NO: 241 - DNA, 285 bp, Actinoplanes utahensis
atggtcgccaacggtggctacgaggtgcagaagctcggccaggccgcgctggacagtgaggacccggtggtcatcgccgagttctacaacaccgggtacgcggcggccagcaagcaggacgcggacgcggagcagcagatcaccgacgcgctcgcggcccggtccaaggcggtcgccgacctgaccgatctggcccaggcggccgggaagccgttctgcacaccactgctcatcacccgttctgggacgccggcacccgaagctggatcgatgccggactgttga

SEQ ID NO: 242 - DNA, 507 bp, Actinoplanes utahensis
ttgagggccggcgccactcttcgcacgccgcgcggcggcactgtcaaggtcaccgccgttcaccgcttcctcggtgcccggacgatgcacaacctgacggtcgccgatctccatacgtactatgtgctggccggtggcacccctgttctcgttcacaactcgatactttgtgatatccacgggaatcctatcgatgacagtgagccgctatatgggccattccaccggctccaatccccgactcagagcccggctgtagcccagcaaatcttggagagcagccaattgtggggcaaggagccccgtgtgggactcattgatataccgcagccacaggcgcatctcgggccgctgcccgagggggccgcaggggtggagttctacacgggtatccctccggggccgccgtatccagggcaggtcagatggctcggcggttccccgggtgtgccgatcgaggatgggtacgcgaagcttccgattatcatcaccaagtacacccaatag

SEQ ID NO: 243 - DNA, 93 bp, Actinoplanes utahensis
atgcggcgaccctatccgctgcgactttccgccgccgtgaccgcgcgcacgtcgccgttcgcgatatccgggttgctcaacctgatcggctga

SEQ ID NO: 244 - DNA, 708 bp, Actinoplanes utahensis
atggtggaggcggttttgttcgactgtgacggggtgctggtcgactcggagcggatcacgaacgccgtgttgcggggcatgctgcacgagctcgggtgggcggtcggcgaagccgagtgtttccggctgttcgtcgggaaggcgctcgccgacgaggtgggggtgatcaccgcgcacaccgggttcgtggtcaccgacgagtggatcggcgagttccggcggcgccgcaacgaggggctgctggccgggttggagcccattcccggggcggtcgccgcggtgcacgaggtcgaccgggctttcggcggccgggtggcggtggccagcggcgccgaccggttcaaggtcgagttgcagctcaccaaggtcggcctggacggcgtcttcgccgggaagatcttcagcgggatggagatgccgcgcagcaagcccgccccggacgtctatctcgcggccgccgcggcgctcggcgtcgatccggcccgcgcggcggtcgtcgaggacaccgcgaccggcgtgcgggccggggtcgccgcgggtgcgaccgtgctcggctactgtccgccggacagccccgcccaccacgcgccggaggttctcctcgcggccggcgccgcccacgtcttcaccgacatggcgcagcttcccgccctgctcacggcgatgcctgcagatcggccggcgcccgcatccgccaggcatcggtga

SEQ ID NO: 245 - DNA, 360 bp, Actinoplanes utahensis
atggctgacgcggacgacgtacgccggctggccctggcgatgcccgaggtcaccgagatcgacagtgacgggttcgacttccgggtggcgaacaaggggttcatctggtcctacccggaacgcctgcccggcaggccgcgggtgatccgcaccgacatcgccgtgctgtacgtcggcgacgaggcggagaaacaggcgctgctgctcggcgagccggagctgttcttcaccacgccgggctacgacgggctcccgctggtcatggtccggctgccgcgggtgagcaccgaccggctcgccgagctgatcaccgatgcctggcggatgcgggcgccggccgatctgcaggcatcgccgtga

SEQ ID NO: 246 - DNA, 351 bp, Actinoplanes utahensis
gtgaccgagcagatctgcgaagtggtgatcacggcgggttcggcggagtggctcgccgatttcacccggcgcctggtggagcggcggctcgcggcgtgcgggcagatcacgccgcaggtgcggtcgatctaccgctggcagggtgcggtggaggacgagggggaggcgcgggtcgcggtgcacacccggctgtcgctggtcgacgcgatcgtcgcggcggccgagcgcgagcatccctacgacgtaccgtgtgtgctggcccttccggtcgtcggtggaaatccgcggtatgtggcgtgggtcctggagcagaccggtcaggagatcgccacgtcgaccagccgcgactga

SEQ ID NO: 247 - DNA, 741 bp, Actinoplanes utahensis
atgatctcctcgacgctggtggcgctggtggcgctgtccgccactcccccggtctcgatcacggtggccccggcgacgctgccgatcacgatcggacagtgcaacggcggcaccatcacggtgaaactcaccaaccacggaaagaccccgatctacgccgacgcttcgctcagcgccgacccggcgcttcaccttccccgctcgctgatcaccacctggctcccggccggttacacgagcagcgttccggttgcggtccgcgcgacccgcgcgggcgatttccgcgtacgcgtcactgccggccccagccgcgtcgaagtgccgatccgggtgggcacccccgcgcccggtgccgccctgaccaggctcgccagccgggtcaccgcgtcctccgcgcgggccggttccccggcctgcgcggcgatcgacggccgggcggacaccatgtggaacgacaccaccggcaaacgctggccggactggtggcagctggactgggacacggcacaccgggtcagccggatcgcggtcaccaccaccgcggacggcggcctgcgcgactgggatgtgcaggtcgcggtgcccaccggctggcagaccgtcgactccgtacgcggcaatcgctccgccctgaaaatcagcaccttcacggcgcgggcgacgacagcggtgcggatcgtgaccctcgccgggaacggggtgaacgatcagtcgcggctggtcgacgtggcgatctcctga

SEQ ID NO: 248 - DNA, 1536 bp, Actinoplanes utahensis
atgctgcaacttccccgccggcggctcttcacgctgagtggcgtggcgctggccggcgccctcccccggccgaggctcacgaacccgttcacgctcggtgtcgcatccggcgatccactgcccggaggcgtgctgctctggacccggctcgcgccgcgcccgctggagccggccggcgggctgccgccggtgagctatccggtggactggcaggtcgccgaggacgcgaagttctcccgggtcgtccgcagcggcaccgggaccgccgcccccggctacgggcactcggtgcacgtcgacgtgaccggcctgcgccccggccgcgactatttctaccgattccgcagccagggcttcctcagcccgaccggccggacccggaccgcaccggcgaagaccgccacgccgcgggcactgcgcttcgcggtcacctcctgtcaggcgtacggcgacggctactacgacgcctggcggcacctggccgcggagagtctcgacctggtgatgttcctcggcgactacatctacgagggtgcgatcaccagctcgggcggcagccggatggacccgaagctgcaccttccggacacgttcgagctggagacggacaccctcgatctgtaccggatgcggtacgcgctgtatcgcaccgacccggacctgcaggccgcgcacgccgccttcccgtggatcctgacctgggacgatcatgaggttcaggacaactacgccgacggggtctcccgcttcgtcaccacgccggtgcgggacttcctggtccgccgagccaacgcgtaccgggcatattgggagaatcagccgctgcgctggccgcgacaaccgtccggtccggacatgtcgctgtatcgacggttccggttcggcgatctggcacacgcctacgtgctggacacccgtcagtatcggtcagaccaggcctgcggcgacaacctgcgggccggttgcaccgcccgcgacgacccgcagcgcaccctgctcggggcaccgcagcgggactggctgctcggccggatgggccgatccccggcccgctggaacgtgctcgcccagcagatcatgatggcccggtgcgtctacggcggcccggcgaaccgcctcgacatggacaagtgggacgggtactccgccgatcggcagcgggtgctggaactggccgcgcggatgcccggcacggtcgtcgtctccggcgacatccacaacaactacgcctgtgacctgcggctcgacttcggcagaccggagaccccgccggtcgccgtggagctcgtgggcacgtcgatctccagcggcggcgacggcagcgacaccaccgcgcaactcgacatgcagcgccgatacaacccacacctgaagctcgccaacggacagcgcggctacgtgctctgcgagctgggacgcgacgtgatgcgggccgactaccgggtgatgaaccaggtgacgcggcgcggcgggacgatctccacgcgggcgtcgttcatctccgaacgggcccgggccgggctggtgccggcatga

SEQ ID NO: 249 - DNA, 798 bp, Actinoplanes utahensis
atgccagaccacacccccacccacgccccctccgccgtcggccccgacccggacgccgccgtcggcctggcgccggccgcagcccatccgtcacggcggcggctggccgtgatcctgggggcggtgctcgcgatcctcgccgcggtgaacgtcgccgacaagtacggcccgcaccacaccggcctggtggccggccccacggtggccctggccctggtcctgctcgcccgccgcgccggcctctcgtggcacgacctcggcctgtcccgccgcaccctgctccccggcctgaagtatgcgatcggcgccgtggccgtcgtcgccgtcgtctacacgatcggcgccgcgatccccgccacccgggtcgccttccacgatgtccgctaccacctgcacccgggcgccgccctgctcaccgcgttcgtcatcgtcccgctgggcaccgtcctgctggaggagatcgccttccgcggcgtcctgctcggcctgatccaccgccaccgcggcgccacctgggccagcatcacctcctcggtcctcttcggcctctggcacatccttccgtcgctgcgcctggccgaggtcaatcaggccgtcggcggcaccctgggttccggcctccccggcaccatcctggccatcctcggcgcggtcgctttcaccgccatcgccggcctgctgctctgcgaactccgccgccgctccggcagcctgctggccgccgccgccctccactgggccaccaacggcctgggcctcctcatcgccgccgccctggccaccaccaccctcacctga

SEQ ID NO: 250 - DNA, 297 bp, Actinoplanes utahensis
atgcgtgttcccactgctgtgatcactgccggctccctgatcggcggctggcaggccgcccgccgcaccggcgtccgccccctcggcggcctggtcctcgccgccggcggcgtcctcgccggccgcgagtggtcccgccgcaccaccccggccgtcaccggcgccctcgccgccacctacctcggagccttcggcctgtcccaccctctggccaagaagatcggcgcctggcccgcggtcctcaccgtctccgccgtcaccgccgccgcctcctacctcgtcgccgaccgccgctga

SEQ ID NO: 251 - DNA, 1683 bp, Actinoplanes utahensis
atgtcgatgccccctgcccgacaacgaatactcaccgcgctggtcgcgctgaccgggctggtcgccaccccggtcggcgcgcccgccgcgcaggccgcggaaaccctggtctcgcagaacaagccggtcaccgcgtcgtcggtggaatgggccggcaccccggcgaccgccggcgtcgacggcgacaacggcacgcgctggtccagcgcgttcgcggccggccagtggttccaggtcgacctcggcgcgcccaccgcgatcagccggatcgcgatcaactgggagaacgcgtacgcgaaagccttcacgatccagttctccggcgacggcagcgcgtacacccaggcctacgccaccagcagcggcaccggcggccagcagagcatcccggtcagcggcaccgcgcgctacgtccggatcaacctgaccgcccgcgcgctcgacctctacggatactcgttctgggaattccaggtgttctccggcggcggaaccaccaaccccaccccccgattgctgtcgtacgccaaaccggcgcgcgcctcgtccgaacagaacgacgccaactgcaacccgtgcacggccgacaaggcgttcgacaacgacccggcaagccgctgggcgaccagcccgacgaacggctgggtcgacccgggctggatctacgtcgacctgggcgccaccgcgcagatcagccaggtggtgctgcagtgggatccggcgtacggcaaggcgtaccagatccaggtgtcgaacgacgccacgaactggacctcgatctacgccaccaccaccggcgacggcctcaaggacgtcatcaacgccaccggcaccggccgctacgtgcggatgtacggcacggcgcggggcggcccgtacggctattcgctctgggagttcagcgtgtacggcaccggcggcaacccggtcgacccgcccgccccaccggccgacccggcgttcccggccacgagactggtcttcgacgacgagttcaacggcgccggcggcgccaaaccggacaccacgaaatggacgtacgacccgggcgtcccgcagaacggcgaagtccagtactacaccccggacagcgccaacgcgtcgatgaacggcgccggccagctcgtcatccaggcccgccgcgaggactaccagggccgtcaatacacctcggcgcggatgaacacgagcaacaggttcagcctgcagtacggtcgggtcgaggcccggatcagggtgccgaagggcaacgggttgtggccggccttctggatgatgggcgccgatttcctcaccggtcgcccatggccgtacaacggcgagatcgacatcatggaggtgctcggccgcaacaccaccgagtcgtactccacgctgcacgcccccgcctacaacggggccggcggatacggccagaagtattccaccgtcgacctgtcccaggacttccacgtctgggcggtcgaatgggacagcaaggggatgcgattcttcctcgacaacaccctggtcttcaacgccgtcaaggacaccgtggagaacacccgcgggccgtggatctacgaccaccagttctacatcatcctcaacctggcggtcggcggcgacttccccgggccgatcgacagcagcaccccgttccccagcaccatgctggtcgactacgtccgggtctaccagtga

SEQ ID NO: 252 - DNA, 609 bp, Actinoplanes utahensis
ttgcacacctggtacctgtggggcctgtcggcgctgggcccggcgtccggcgcgctgacactcctgtggcgcaggcggcaggcggcggcgctgaccgacgcactgaccgggctggccaaccgggaccggttcgacgccgtgtcccaccggagcctgctccacgccgcgcggaccggcacctggtcggccgtgctggtgatcgacatgaacggtttcgcggagatcgcggagacgctgggccgcgcgcccgccgatcaggtgctgaccggtttcgccgaggtgctgcggcagtcggtgccggctcccgggctgccggcccggctcggcggggaccggttcgcggtgctgctgaccgatctggcctttcccggccaggcctacgaggcggccggccggatcgccgcggcgatgggcacggtcgcggtcgccggtcggctggtccccctcgccgccggcatcggggtcgcggtgtcggcaccgggcgaactcacccacgacgagctcgtgcaccgcgccgacgcggcgatgcgccgcgcgaaggcactcggcccggacacccgctgggcggtctggcaggactcccccaccccggaggcggtcgccgcctga

SEQ ID NO: 253 - DNA, 1182 bp, Actinoplanes utahensis
atgccagtcccgcagacgcacgacgaggcggtcgaggccgcccaccggctcgccgccgtcctcacccccggcgcgatcgggcgcgaccgcgacggagcgacggtgatcccgtccgaggcgctcgccgcgctcgactcctccggcctgctcgcgatcaccgttccggccgccgacggcggtcccggcctcggcccgcgcaccctcgccgaggtcgcccggatcatcgcggccgccgacccgtcgatcgcccaggttccgcaggcccactacctgatgatcgacgtcctcgccgtgcacggcaccccaccgacccgcaagcggttgtacgacgaagttctcgccggccgccggctcggcaacgcactcgccgagcgcggcggacagcacgcccaggatctgcggacgaggatcagcggcggccggctggacggcgtcaagtactacaccaccggcgccctgaccagcgcctggatcgcggtcagcgcgctggacgagcagggccggctggtgctcgcgttcgttgcccgcgacgccgagggcgtgaccgtcgacaccgactgggacatggtcggccagcgggccacgatcagcggcaccgccaccttcaccgaggtgatcgtcgagcccgggatgcggctcgactacgccggcgcctatcagcagccgcagcagctcggcgcccgcgcccagctctaccacgccgcgatcgaggtgggcatcgccggcgcggcgctcgccgacgcccgtgcctacctgcgcacgaaagcccgccccgccaccgaggcggtccgggcgggcgcgggcgtggcggccgacgacccgcacgtcaagcatcggtacggccgcctcgccagccgggtgcgggccgccgaggcgctgctcgacgcggccgcacgcacgctggaggcgatcaccctgaccccggcggacgccgacgccgcggcccggggctcgctcgcggtggcggccgcgaaggccttcggcagcgagatcgcggtcgaggccggctcggagctgttccagatgtgcgggacgagctcggcggccgcgaaatacgacctggaccggcactggcgcaacgcgcggacgcacagcgtccacgacccgctcgactggaagtaccaccacctcgccgcctacgacctgctggacgtgctgccgcccaaccacgggcagctgtag

SEQ ID NO: 254 - DNA, 663 bp, Actinoplanes utahensis
gtgctgaacaaccccgtgtgggccgccctctccgggccacaggccggctacgccgaggccgccggagacgccgcccgatacctgcccgagatctcgccgttctgcgccgtcagcgacccggccgaccccaaggcctggcgtgacctggccaccctcaccgaccacgcactgctcaccggcccggcgatcagcccgccccgcggctgggtcgaggagggccgctcagccggcgtgcagatggtcggcaccgcgatgaccgccgtcgacgatccggaggcggtgccgctcaccgagcacgacgtccccgagatgctcgacctggtggcccgcgcccagcccggcccgttccgcaagcgcaccgtcgacctcggccgctacctgggcatccggtccgccgacggccgcctgatctcgatggccggcgagcggatccggatgcccggctggaccgaggtctccgcggtctgcaccgatccggagttccgcggccagggcctgggcgcgcgcctcaccctggccgtggcggccggcatcctggcccgcggcgagctgcccttcctgcacgcggtccacgacaacgagaacgcgatccggctgtacgggcggctcggcttcgagcacagcgccgacgtggtcttcgccgcgttccgctacaccggctga

SEQ ID NO: 255 - DNA, 3060 bp, Actinoplanes utahensis
atgacgacgcggacggctcgcgcatgcttcgccgcctggtcgctgttgctggtcgcgctctactacgcgttcccggccgcccacctgtacacctgggcgctactcggctactcgtcggcggcggcgatcctggtgggtacccgactgaaccggcccggccggcgcctgccctggtatctcgtcagtgccgcgctcgcctgcttcaccaccggggacagctggtacaacctggtgctcgcgctcggcggcaggcccggcttccccggcctggccgacctgttctacctgctcgtctacccgctgctgaccggcgcgctcctgctgttcatccgggcccgctcgggccgcggcgacaaccgcggcgccctgctggacgccctggttccgaccgtcggcctgggcctgctggcctgggtctactggatcgccccgttcacccgggcacaggacctgaccgtgttgcagaagatcgtctcgatcggctacccgctcggcgacgtgctggtcctcgcgatgatcctgcggatgctgacccagaccggcacccgtccccgcaccctgggcagcctcggcgtcgcgatgctcggcctgctggtctcggacatcttctacgggcagtcccagctgcgcgacgactgggtcctgggcgggccggtcgacctgggctgggtcctgttctactcggcgatgggcttcaccgcgctgcgcccgtcgatgcggcagctcaccgaaccggccgagcggtgccgctcgatcatcgggcggcaccgcctggtctggatgaccgcggccgcgctgatcgccccgatcctgctctgcctggagtatctgcagggccgcccggccgagatccagcgcgacggcatcgtcgacgcgccggtcatcgcgggtgccgcggcggtgatgttcctgctggtcctgggccggctcgcggacctggcgatggcgcagcggcaggccgtggcccgggagcgggcgctgcgcgaggccggcgccctgctcttcgcggccgccaccgaacgcgacgtggtcgcggcgctgcaccaggcggtggcccggctgatgccgcccggccagccctaccacctggagctgccgccgcaggcccccggcccggccgacgtcgccgtgcactggcgggccgccgccgacctgcccgccggggtggacgcgggcggcttcccgacggtcctgttcgccacccagccgctgcccggccggcagtggcacgggcagctgatcgtcggcgcggccgaggacgtgctgcagaccctgcggcccgcgctgcagacgctgggcgcgcagatcgccgtcgtgctggaccggatctcgctgaccgcggaggtcggccgccgggagagcgagacctacttccgcaccctggtccagcggaccgtcgacgtcatcctgatcgtcgacggcgaccaggacaccaccgtccggtacgccagcccgtcggccgacaagctgttcggcacggtcatcccggccggcaccccgctggccgacctgatcgcgccggaggcgcaggaggcgctgcgcgacgtgctctgccggctgcgccgcgggcacggcgatctggacggcgtcgagctgaccgcgcagggtgccggcggccgccggatgaccgtcgagtgcgacctgcgcgacctgcgcgacgacccgacggtcgccggcctggtggtcaccctgcgcgacgtcaccgagcagcgccgcctcgaggacgacctgacccaccaggcgttccacgactcgctgaccgggctggccaaccgggtgctgttccgcaaccggctggaacaggccttcacggtggccagccgggacggcgccacgctcggcgtgctcttcgtcgacctggacgacttcaaggaggtcaacgacacgctcggacacgcgatcggcgaccagctgctgatcgcggtggcccggcggatctcctcgatcatcggggccggcagtaccgcggcccggatgggcggcgacgagttcgccatcctggttgagcagagcgacaccgcgcacgccgccgaggacgtggcggcccggctcgtcgccgcactcgacgcgccgatcgaggtgcccgacggtgagggtggcctgcacctggtcagcggccgggtcagcgtcggcgtcgcgaccagcggcgacgcggacaacgccaccgagctgctgcgccacgccgacctggcgctctacctggccaaggggatgggcaaggcgggctggcagcgctaccagagcgacctggcgcacgccatggtgcagcgcctggagatgcgcgcccaactgcacgaggcgatcgaggacgagcagttcatgctgcagttccagccgatcgtcgagctcgccgaccagcgggtcaccggcgtcgaggcactggtccgctggcagcacccgacccgcgggctgctcgggccgttccacttcgtcgaggccgccgaggagaacggcgcgatcgtcggcatcggcaactgggtgatgcgcgaggcgctgtgccagatcgcccgctggaaggccgacgacccgcacaccacgctgcgctacgtcagcgtgaacgtgtcgccgcgccagttccgctcggccgacttcgtcgaccaggttcgcgcggcgctcgccgcggccggcgcgcggcccgagtggctgctgctggagatcaccgagagcctggtgctgcgcgacgccgacaaggtggtccaggatctgcgcgcgttgcgcgccatgggggtccgggtcgcgatcgacgacttcggtacggggtattcgtcgctcagctacttgcggcagatgccggtggacgtgctgaagctggacaagtcgttcatcgacgacattctgaccagccggcagcagcacgccctggtcgacgcgatcgttaccctggccggcaacctggacctggctgtcgtcgccgagggcatcgaggagcccgggcagcacctcgccctggacgccatgggctgccactacggccagggctaccacttcgccaagccgctgtggccgaccgcgatcccggccctgaccgccgcggcggaggcgatcgcgatgacggcgtaa

SEQ ID NO: 256 - DNA, 843 bp, Actinoplanes utahensis
atgtcccttcggcgcatcggggtcgcactggcgtccctgacacttctcggcaccggcgtcaccgccgcgtcgccgcaggcccaggcggccaccaccgtcccggccttcgaccacatcgtcctggtgatgttcgagaacaaggcgtcctcgcagatcacctcgtcatcggctgcgtacttcaccgccctggccggccagggcgcgaagttcacccagtcgtacgcgatcacccaccccagccagcccaactacatcgcgttgttctccggcgccacccagggcgtcaccaacgacaactgccccaagacgttcaccaccggcaacctcggcgcccagctgatcgcggccggccggacgttcaagggctactccgaggcgatgccgtcggacggctacaccggctgctccagcggcacctaccggcgcaagcacaacagctgggtcgacttcagcaccgtgccggccgccagcaacgtccggtactcgaccttcccgtccgactacacccaactgccgacggtctcgttcgtcaccccggacatgtgcaacgacatgcacgactgctcgatcagcaccggcaacacctggctcaggaacaacctcgacgggtacgcccagtgggccaagacccacaacagcctgctcatcgtgacgttcgacgaggacaactcgctctcgctgaaccacatctacaccgccttcgtcggcgcgaacgtgaaggtcggctcgtactccgagaagatcacccactacacggtgctgcgcaccatcgagtccgcgtacggcctgtccgccctgggcggcgcggccggcgtctcgccgatcaccgacgtctggcagtag

SEQ ID NO: 257 - DNA, 1233 bp, Actinoplanes utahensis
atgtatctggcctcggtggaacgtccggccgtgcgccggaccgaccgcacccagcgcctcgccggcacggttctggctctcggcacggtcagcctgatcaccgacgtgtccagcgagatggtctcggcgatcctgccgctgtacctgatcgccggactggggctcagtcccgccgtctacgggctgatcgacggcgtctacaccggggcgaccgcactgctgcgcctggccggcggctatgtcgccgaccgggcgcggcgccgcaagacggtcgccgcggtcggctacggcctctccgcggtgatgaagttcggcctgctcgcggccggcaccgcagtcccctggatcagcgccgcgatcgtcgccgaccgggccggcaagggcctgcgcaccgcgccccgggacgcgctgatcaccctggccacccccgctacctcgctggggcgcgcgttcggcgtccatcgcgcgatggacacggccggcgcgttcgccgggccgctggtcgcgctcgccgtactggccgcctccgggcaggcctacgactcggtcttcgtggtcagtggctgcatcgccatggtcggcgtgctcgtcctggtgctcttcgtccgtgatcaccgcggcccgcggccggccgcgaacaccgtcagcctgcccgctgcggccgcgctgctgcgccgcaaaccggtccggatgctgctgatcggcgcggtcctgctcgggctgagcaccatcggcgacggcttcgtctacctgctgctgcagcgccgggagagcctcgcgaccggatggttcccgctgctcgcggtcggcaccagcctgacctacctgctcctcgcggtgccgttcgggcggctcgccgaccgggtcgggcgggcgccggtcgtcctcggcggctacgccgccctcgtcgtcgtctacaccatgctcggctccgggctcggcggcccggtcaccatcgtcgcggtgcttgtgctgtacggcggttactacgccgccacggacggagtgctgatggccctcgccggtccactcctgccggccgagttgcgcaccaccgggctggccctggtgcagaccgggcaggcgctggcctacctggtctcctcggtgctgttcgggctggcctggcagtggtgggacgcgaccggggcgatccgcgccttcaccgtcctggccgtgctgaccctgtccgtctccgccgggctcctgctgaggtcgaaccgtgagcgctga

SEQ ID NO: 258 - DNA, 996 bp, Actinoplanes utahensis
gtgagcgctgaaccgtctctgcgccggcgggtgctgctcgccgccctggtctccgtggtcctgctcggcggggcggtggtgtacgtggtgatcgccgggcgccgtggttcggcgccggccgcggcggcggtggtcgacgcgggccccggcgaccgggtgctgttccgcagcacggcggcgtccgggtacgggcgggtggcgaccgtggcgcgtggcgccgagacggggcagcggacggtctccgggctcgactgtgaccgggtgtacgcggccgccgggcgcgggatctgcctgcgaccggacgggccgctcgccacctaccagttggcggtgctcgacgccgggctgcgggtgtcggacacctacccgctggtcggggtgccgaaccgggcgcgcgtgtcgcccagcggcaacgtcctggcatggacggtgttcgtgaccggcgactcgtacaacggcgggaggttctccacccgggccggcatgctgaacctggccaccggcgacacggtggactcggtggagttgttctcggtggtccgcgacggccggccctaccgggcggccgacgtcaatgtctggggtgtcaccttcgccgacgaccagcacttctacgccaccctgtcgaccgccgggaaacgctatctggtcgccggcgacgtgaccgcgcagaccgtgcggaccctcgccgagaacgtggagtgcccgtcgctgtcacccgatcggacccggatcgccttcaaggaggcgatcaagggggatccctcgaaggggtggcggctgaccgtcctggatctggcgacgatgcggcggacgccgctggccgagacgcgcagcgtggacgaccagacggcctggtacgacaacaccacggtgatgtacgcggtgcggcgcggcagccggaactccgacgtgtgggccgccccggccgacggcggcggaacggcgcgactgctcatcccggacgccgagtcacccgcggcgctgtggaattga

SEQ ID NO: 259 - DNA, 858 bp, Actinoplanes utahensis
gtgatcacgcaggagcacattcacacgctgagcggccgcgacgtccacgaccgggacggcgacaagatcggcaccgccgggcaggtgtggaccgacgccgccggtctgcccacctgggtcagtgtccgcaccggcctgttcggactgaacgagtcgctggtcccgctgcaggacgcggacctgcgcgacgaccggctggtggtgccgttcgacaaggcgacggtcaaggacgcgccgaacgtggacgcctcgcacgacgagccgctgacccaggccgaggtcgaccagctctactcctactacggcgtgaaccagcacgacagctaccggtcgtaccaggccggggcgaccgccacgaacgagaactacaccggcgatagctacaccgacgagaactacaccggccagagccgccccggcggcaccgactacgagctcggcgccggccagggcgacggccacctgcgcggcgacgacgcgatgacccgctcggaggagcggctgaccgtcggcaccgagcgtgagcggaccggcaaggcccggctccgcaagtacgtgacgaccgagcagcagcaggtcagcgtgccggtcacccgcgaggaggtgcggctggagcgtgagccggtcaccgacgcgaaccgggacgccgccttcagcggcccggacctgaccgagtcggagcacgaggtcaccctgcacgaggagcggccggtggtgcagaccgagacggtgccggtggagcgggtgcgcctgggcaaggagacggtcaccgacgagcggaccgtcagcggcgaggtccgcaaggagcagatcgaggccgagctgcccggcgacgagcgccgtcgtcgcctcggctga

SEQ ID NO: 260 - DNA, 870 bp, Actinoplanes utahensis
atggccggcgagattctcccgcggatcggctcgccgcggcgcgtcgcgatcgtgaccgggggtggcgcgggcctcggccgagagctgaccgtgggcctggccggggccggtttcaccgtggtcgtcgcggatgtcgacggtgcggctgccgaggcgagcgcggcccgcgccgagcaggtcgcgggtgcggctgcgggtgcgggtccaccggcgggcgcggatgcggctgcgggtttatcggtgggcgcggatgcggcagcgggagcggattcaccggcggtggccggcggggtggcggtcgcggtctgcgctgatgtgaccgatgcggagcaggcgagaggtgtggtgcgggtcgcggccgagctgggcggtccgcacgtgctggtgaacaacgcgggcgggtggacgcgtggcgggcggcagtatccggacgcggagccggcggactgggcggccaccctcgcgctgaacctgaccgcgccgatgctgctcacccagctcgtccgggagccgatgcgccggctcggcggcggggtggtggtcaacgtcgcgtccagtgcggcgcgcggggacggcgcctacgggtcaccggagtatgcggcggccaaggccggcctggtccggctgacgaccagcctggccgggctcgacggggtgcgggtgacctgtatcgtgccggattggatcggcctggaccgggcgcacgcggagttcgccgcgctgagcccggccgagcgggcggtcacgccaccgctgatcccgccggctcaggtggtcgatgccgtcctggacctgatcgccggcggcgcgagcggcacggtggtcgagctccggggcggccgcgagccgatcccgcgcaggccggcctga

SEQ ID NO: 261 - DNA, 909 bp, Actinoplanes utahensis
gtgacccgaccactgctggccgtcgacgcccccagcctctatttccgggcgttccacggcatcccggagaaggcggcgcagaccgacgccggcgagccggtcaacgcgatccgcggcttcctcgacatgatcgcccagctggtccgcacccggcggccggatcggctgatctgcgccctcgacgcggactggcggccggcctggcgggtcgagctggtcccgtcctacaaggcgcaccgggtcgcccacgacaccgtcgaggaggtgccggccgcactggagcgccaggtgccggtgctgctggaggtgctcgaggcggtcggcatcccggccttcggcgtgccgggctacgaggccgacgacgtgctcggcaccatcgccgcgacccaggccgccccggtcgaggtggtctccggcgaccgcgacctgttccagctggtcgacgacgcgcggggcacccggctgctctactgcgggcgcggcgtggccaagctggaggacgccgacgaggctctggtccaggggaaatacggggtgccggcgcggtattacgcggacttcgcggcgatgcgcggcgacccgagcgacgggctgcccggcgtcgcgggcgtcggggagaagacggccgcccggctgatcgagcgctacggcgggatcgccgagatcctggccgccctcgacgatccggaggcgggcttcgcccccggcgtccgcacgaagctcgccgccggccgggactacctggcgaaggctctgccggtctgccgggtggcgctcgacgtcaagctgcccgacgtggatccggcactgccgcgcgagcctcgcgacccgcaggcgctgctcgccctcgccgagcggtggaatctggccggctcggcgcgccgcctggtggacgctctggcgggctga

SEQ ID NO: 262 - DNA, 1134 bp, Actinoplanes utahensis
gtggatcgactgcttcccacccctgaggcacacgacctgctcgacctgacccgtgagctcgccacccgtgagctggccggcaaggtcgacgactacgaggcgcgcggcgagttcccccgggagatcctgcgtacgttagggcgttccggcctgctcggcctgccttatgccgaaagcgacggcggcgccggccagccgtacgaggtctatctccaggttctggagatcctggccggcacctggctggggatcgccgaggcggtcagcgtgcacacgctgtcgtgcttcccggtggcggccttcggcagcgagcggcagcgcaaggcgctgcccgagatgctcggcggcgagctgctcggcgcctactgcctgtccgagccgcagggtggctcggatgccggcaacctcgccacccgggccgtgccggacggcgaggactggctggtcaacggcaccaaggcgtggatcacgcacggcggccgcgcggatttctacaacctgttcgtccgcaccggcggccccggccccaagggcatctcctgcctgctcgccgacgccgccacgccgggcctgctgccgcaggcgccggagcggctgatgggcctgcgctcgtcggctccggcccagatcgtgctggacgacgcgcggatcccacacgaccggctggtgggggagcaggggcaggggttcgcgatcgcgatgcaggcgctcgacgcggggcggctcgggatcgcggcgtgcgccgtcgggctggcccaggcggccaccgactacgcggtcgcctacgcacgggagcgggagcagttcgggcagccgatcggccggttccagggggtcgggttcatgctggccgacatggccacccaggtgtccgcggcgcgctcgttgctgctggccgcggcccggttgaaggacgccggccggccgttctcggtcgaggcggccaaggcgaagctgttcgccaccgacgcggcgatgcgggtgaccaccgacgcggtgcagatcctcggcggctacggctatgtggccgatcatccggccgagcgctggttccgtgaggcgaaggtgttgcagatcgtggagggcaccaaccagatccagcggatggtgatcgcccgctcgctgaccggctga

SEQ ID NO: 263 - DNA, 450 bp, Actinoplanes utahensis
gtggaagagatcgaccgggcgatcgtgtcagccctcaccgtggacggacggctgacctataccgatctggccgagcgggtgggcctcagtgtctccgccgtgcaccagcgggtgcgccggctggaggagcgcggggcgatcgccggttacacggcgaaggtgtcgttcgaggcgctcgacctgccgttgaccgccttcgtggcgatccgcccgttcgatccgtcgcagccggacgacgcgccggagcggctggcccacctctccgagatcgactcctgctactcggtggccggtgaggacttctacatgctgctggtccgggtgaagagcccggccgacctggagcggctgctgcaggacatccgcacggcggcgaatgtgacgacccggaccacggtggtgctgtccactccttacgagaaccggccacccaggatcgcccccgaatag

SEQ ID NO: 264 - DNA, 579 bp, Actinoplanes utahensis
atgtgtcggatgaacgccgacgacgtcgacgcggcagttcaagagctgcaggacacgcttgcgccgtacgcctacggccccgcctggtccacccgggccggcgacctcgactggacctgccggcaaaccgccgtgcacatcgcgcacgacctcgtggcgtacgccgcccagctggccggccgggccgacaatgggtatctcccgctggatctgcgggtcgacccgggcgcgacgccgggcgaggtcctgcgggtgatcgcggccgcggccggactgctcagcgcccagctgcgcgcggcgtcgccggacgaccgggcctggcactgggggccggccgacccgtcgggattcgccgcgctcggcgtcaacgagatcctgatccacacgtacgacgtggccggcggtctgggtgttgcctggcggccgccggcggcgctctgcgcggcggtgctgagtcggctctttcccgggcatccggacggcgacccggtggccgccctgctctggtgcaccgggcggatcgcgctgcccggccgcccccggcgcacctcgtgggtgttgcgggccgccgtggattga

SEQ ID NO: 265 - DNA, 675 bp, Actinoplanes utahensis
atgcggcgacgaactctgctggccgccggcggcgccggcgtggcgaccgccgtggccggcgggctgtgggcccgcggatccgcgccggccacggtgcccgcggtgcccgtgccgtcggtgccgcccggtccggaacgctgcgagctccggtactcgaaggcccgcgggacgaccgtcgacttctacaccgcggtgccggccgggcacggggacggcaccgggctgccggtctgcctcgtgctgcacggcggatcgaagcggcccgccgacttcgaggcactcgggctcggacactttctgaccgacgcggtggctcacggcgcgccgccgttcgtgctggccggcgccaccggcgaccgtctcgcctggcagcccgacgggcgcgacgacccgcagcggatggtgcacgaggaagtgccggcctggtgcgcggcacgtggcttcgacaccagccggctggtcgcctggggctggtcgatgggcgggtacggctcgctgctgctggccgagaccttccccgggttcgtccgcgcggtggccgcgttctccccggcggtggtgcccggggacgtggtgttccagaacgcggaccggctcggcgcgacgccggtgggattgtggtgcggcagccgggatccgctgtacggcagcgtgcgggcgttgctagctagctag

SEQ ID NO: 266 - DNA, 768 bp, Actinoplanes utahensis
gtggcggcgacgtcgttgctgaccgtggccggcaacgcgatgggtctgtccaaccggggcgccaagcaggccgacaccgtgtacgccgcggatctgccgctgcggaaggcgaacaagccgacgcacaccgccgacctgtccgctctgcgggtgcaggtgtgccaggacgcgtcggtggccgcgcgcaacgccgatcaggtgaccgcgcaggccggggtggcggctaccgcggcggccacgctggagaagaccggcctgacccacggcatcgcctggtccgaggtgacccaggcgcagggtgacgccggagcggcggcgaagctggccgcggagacggcgtgtcatgcggccgaggcgacggaggcggccggcaaggctctggacgccgaccacagcgcgaccgtcgacgcgaacaacgcggtgaagtaccggcaggccgcggagcgcgagcaggccgccgcggagaagctggcggacaaggcggagaagctggcggctgccgcgctggcggcggcggccgacgcgaaggcgcagcggttgcgggccgagaaggatgcggccagcgcccgccagcacgccgccaacgcggccggctactacgcggacgcgaagcggcagcgggggatcgcccgggaggcgaccgcggcggcgatccagcactcgctgaacgcctactcggcggcgcagcgggcgatcgcgcagcagaacgtggtggtggccaagggcgccgaggccaagcagaagcaggatgaggcgctcgctagctag

SEQ ID NO: 267 - DNA, 564 bp, Actinoplanes utahensis
atgtgggcggtcgcgcagaacatgggccggatggccaagaccctgcaggacatcgcctggcaggcgtacaacgccgagcaggcggcggcggagaagaagctcaacgactggatcgacgacaaggcgaagtggctcaacgaccacatcggcgggtcggacgtcacgaagggcttcatcgacggcgcggccggcatggtcaaggggatcatccagaccagcaactgcgtgaccggcacgttcctgggcaccgacgcggccaccgacgagtacacggtgcccgaggtcagctacctgccgaactcggacaagtcctgcaacatgctggtcaagggcttcaaggacctactgagcgacccgaagcagctgctgcactgggacgactggaagaagaactggaagtacgcgctgggcgagaccctgttcgacggggccttcttcctggtcaccgacggcaccgggctgatcaccaagatcgctgagagcggcgtggcgcagaccgccaagcaggcgatcagggacatcgccaagctgtcggccaaggacatggcggccctagctagctag

SEQ ID NO: 268 - DNA, 996 bp, Actinoplanes utahensis
gtgggtggcaagctggcggtcaccttcagtgccgacgaattgaaggcgctgtccaaggcgatcggtctcaagggcatcgacgcggtggagaacgcgctgcgtggcctgaaggatctgccggtcctcaaggggctcaccgatctcctggagagctgtttcaagcgcaacagtttcgccccggacacccgggtcctgctcggcgacggcaccagccgggcgatcgccgacatccgggtgggcgaccgggtgctggccaccgacccgatcaccggggtcacccggccggagccggtcaccgcgctgcaccgcaacgacgacaccgcgctcgccgacgtcacggtcgaggaccgggccggccggcagagcacgctgcacaccacgcgggaacacccgttctggaatgccggcacccggcagtggacctacgcgggtgacctgcggccgggcaccgcgctggccaccgtcggcgcgggccggtgggcgggcgtcgcccgggtgcgcacgttcaccggcgagcggacgatgcacaacctgacggtcgccgacctgcacacgttctacgtgctcgccggccggacgccggtgctggtgcacaactgcaacgtcgcgctcggtcagaagatggccggcacctacaagtgggcgaaggacaacaacttcgagcacttcggcgacctgggcccggacgagtggatgggcccggtcaaggacgcgatccggaattccaacgtgaccctgcacgtcaacatggaggagatgggtagcttcgtcgaatcggtgcgggtcggcatggagggcgtcggtggcgccacggacctggagatgagctggatcgcgacggcgatcatccggggtgagcggacctggtcgtcggtgaacttctacaagctggtcaacggcaagatgacgaagatcgtcgtcgaggagccggactggtcgaagatcaccccgcagcgctggttcaccgatccgccgacgagctgcaaatgtctgtga

SEQ ID NO: 269 - DNA, 663 bp, Actinoplanes utahensis
atgagtgaccggatggccgagctgtatcccgaggtggtccgcgccggcgggctcgccgaggcgctgcgccgggccgcggcggcccgggacgtggatctgggcccggccctggagcagtcgtcggcccgctggtcggcgagcatcgacgcgccgcacgggggctgcgaggtgagcgtcggcgccgagcaacggttcttccacgtggagatccggcggtcggactatcgggccacctgggtcagcggcgccgcaccggagctcgatcccgtcgccggggtgatcctggcctggctggcgggggagagcgcggcggcggtgagcgcccggttcccgttcgtcaccgcgggcgagttcgccgacgtcgcgggcgacgacgagatggtcgccgcgcagtggcggtcgctgctggccgccccggagtaccgcgacgaacggccgcttctcgcggcggtccaccgttcgccgcgggctcgccggctgtttccggtgctgacccacggcatgctgcggctgagcgcggacatgggccgggtcggcggccgggagatccggatcgtgccgctgcggcacggcggtcaccggatcgaggacggtgcgggcaccgtgctggccaccctggagtcgctgctcagtctggatccgctgctcgacctggactcctga

SEQ ID NO: 270 - DNA, 726 bp, Actinoplanes utahensis
atgatcgcgctcgtggatcacgaagccacctccttcgggtcggccgccggcacctacgagcgtggccggccgccgtaccccgagcccgcgctcgactacctgctccccgggggccgcgcgcgcgttctggacctcggcgccggcaccggcaagctgacccggcagatcctggcccgcggcctggacgtggtcgccgtcgacccgtccgagggcatgctggccgagctgcgccgcaccgtgcccgacgtcccggcccacccgggcaccgccgagcggatcccgttgccggacgcttcggtcgacgtggtcctggtcgcccaggcctggcactggatcgacccggcccgcgccgtccccgagatcgcccgggtgctgaccccgggcggccgcctcggcctgatctggaacctgcgcgacgaacgcaccgactgggtgcaccggctcggcacgatcatcggccatgaggcgccccgcggcacgaccatgggtccgccgttcggcccggtcaccaccgccaccttcggctggacgcacccggtgcgggccggcgagctgctggacctggtcgcctcccggagccgtcagatcctgctgccggccgacgagcgggccgccgtgctggcccaggtccgccagctcaccgccacccatccggcgctgctgggtcgcgactcgtacgcgttcccgtacgtcacccagtgcgcctacgccgacctgcccgcctga

SEQ ID NO: 271 - DNA, 192 bp, Actinoplanes utahensis
atgagcttcaccgacaaggtcaagaacaagaccgaggaactgaccggtaaggcgaagcagggcctcggcgaggcgaccgacaaccagcgcctgtacgccgagggcgaggcccaggaggccgccgcgcacgccaagcaggccggcgagcacgtgaaggacgccggtcgcgacgtgcgcgacgcgctcagctga

SEQ ID NO: 272 - DNA, 1365 bp, Actinoplanes utahensis
gtggttgccgagctcgacagcggacagccttacgagtaccagcggcgtgagctggtcgagccggattggacccggttccccggttggcgggacgtcaccgccgcccagtggcagtccgcccagtggcagcgggtcaactgtgtgaagaacgtcaagcagctgcgcaccgtcctcggtgacctggtcgacgagtcgttctacgccgacctggagaaggaccaggccgagctggcgaccatgtcgatgctgctcccgccgcagatggtcaacacgatggtgccgcaccaggtgccggacaccgcgtcgttctacgccgacccggtgcgcctctacatgctgccggtcgcctcggaccggcgccgggactggccgtcgcacccgaacgccagccgtgactcgctgcacgagcacgacatgtgggtcgccgagggcctgacccaccgctacccgaccaaggtgctcgccgagctgctctccacctgcccgcagtactgcgggcactgcacccggatggacctggtcggcaacagcacgccggcggtcgccaagctgaagctggtgcagaaaccggtcgaccggtacgcggcccacctggactacctcaaggcccacccgggcgtccgggacgtcgtggtctccggcggcgacgtggcgaacgtgccgtggaagcagctggaggcctacctgatgggcctgctggcggtgccgaccgtccgggacatccggctggccaccaaggcgctgatggggctgccccagcactggctgcaggacgacgtggtggagggcatgcaccgggtcgccgtgaccgccgagcggcgcggcgtcaacctggccgtgcacacccacgtcaaccacgtgaactcgctgaccccgacggtcgcccgcgcggtccgcaccctgctcgaggtcggcgtccgcgacgtgcgcaaccagggcgtgctgatgcgcggcgtcaacgccaccgccggcgacctgctcgacctgtgcttcgcgctgcagggcgaggccgggatcctgccgtactacttctacatgtgcgacatgatcccgaacgcggagcactggcgggtcccggtctggcacgcccagcagctgcagcacgacctgatgggctacctgcccggttacgccaccccgcggatcgtctgcgacgtgccgttcgtcggcaagcgctgggtgcacatggtcgccgagtacgaccgcgagcacggcatctcgtactggaccaagaactaccgtacgtcgatcgagaaggacgacagcgaggcgttgagcaagctgtacgcctactacgacccgatcgacacgctgccggagagcggccaggactggtggcgcaagcagtccctcgccggcgcctag

SEQ ID NO: 273 - DNA, 1011 bp, Actinoplanes utahensis
atggcgggatcggtgggtctgggccgggtgctcgagccgagtggcgtgttgccgcaggccgcgtggcggctggacgccagcccggagatcgggccggacgaggcgcgcatccgggtgcagcggctcaacctcgacgccgccagttatcggcagctcggggagaaacatgcgggggacggcgcggcgatccgcgccgaggtgctggagatcgtcggcacgcgcggcaagatgcacaacccggtgaccggctccggtggcatgctgatcggcgtggtcgaggaggtcgggccggagtcgccgctgccgatcaagccgggcgaccgggtggcgacgctggtctcgctgaccctcaccccgctgcggatcaccgacgggctggccggctgggacgggctgtccgagcaggtgccggcggacggcacggcgatcctgttcggccgctcgatcgtcggcgtgctgcccgacgacctgccgccggagctggcgctcgcggtctacgacgtgtgcggggcgcccgcgctcaccgaccggatcgtccggaagtatcaggacccgaccgtgctggtgctcggcggggccggcaagagtggatcgctgagtctggccgcggcgaaacgggccggtgcccgtaccaccgcgatcgtcgtctcggaggcggagcgggccgcgctcagcgaagcgggcgtggccgacgagatcgcgatcgccgatgcccgcaatccggtgcaggtcgccgagaaggcgaccgccgacatcaccgtggtctgtgtcgacgtgccgggctgcgagcacggcgcgatcctggccaccaagcccggcggcacggtgatcttcttctcgatggcgaccagtttcgccgcggccgcgctcggtgccgaggggctggccgccgacgtgaccatgctggtcggcaacgggtacgtgccggggcacgccgacttcgcggtcgacctgctgcgcaccacccacgcggtccgtggcttgttcgagaagcggatagcgggagactga

SEQ ID NO: 274 - DNA, 1536 bp, Actinoplanes utahensis
atgacgcttccctcggtccgctacaccaacggtcgtttctactccgccgccgagccgcgcgccaccgcgatgctggtccgcggcggcaccatcgcgtggctgggcgacaccgccgacgcgccggccgccgaccgcaccgtcgacctggacggtgcgctggtcaccccggcgttcgtcgacgcgcacctgcacgtcaccgacaccggcctggccgccgacggactggagctgtccggcgtccgctcggcgggcgagctgctggcggcggtggagcggttcgcccggaccaggccggccggcgcggtggtgcacgggcagggctgggacgagtcgacctggaccgagcagcggctgccgaccgcggctgagctggaccgcgccgccgccggccgccgggtctacctgacccaggcgtcggtgcactcggcgctggtcagcgcggcgctgctgccggccgccgagggggtcgacggctacgacccgtccgggtgggtgcgcgagcacgcgcaccacgcggtgcgggcggtcgcgctcggctcgctgtcgccggagcagcggaccgacgcgcagcggaccgcgttgcgcacggccgccgccgccgggatcgccgcggtgcacgagtgcggcggtccggggacctccagcgaggccgacttccagtcggtgctgcgcctctccgggcagaaccttcccgaggtgtacgggttctggggcgagctgggcggcgccgacaaggcgcgtgagctgggcgcccacggcgcggccggcgacctgtacgcggacggggcgctcggctcgcgcaccgcctcgctgcgcaccccgtatcgcgacggcgaccacggttgcggcgaggcgttcctgaccgccgagcaggtcgccgagcacctgctcgactgcatccgggtcggcttccagggcggcttccacgcgatcggcgacgccgcgatcgcgaccgtgctggagggcttcgcgctcgccgccaagcaggtcggcgtcgaccggatccgggagggcaaccaccggatcgagcacgtcgagctgatcgacaaggcgatgatcgcccggatggtcgaattcggggtgaccgcctcggtgcagccggtcttcgacgcgctctggggcggcgccgaccggatgtacgcgcagcgcctcggcgccgaccgcgccctggccagcaacccgatcggggcgatgcacgccaccggggtggcgctcgccttcggctcggactcgccggtcaccgcgctcgacccgtggtcgaccgtggtcgcggcgatcgcgccgcgcaacccggtctaccggatgaaggttcgggccgcgttcgccgccgccagccgcggcgggtggcgggccgccgggatcagcggcgccggcgtgctcgcgcccggcgcctccgccaccttcgccgcctgggacaccccgggcggcctgcacgagggactgccggccctgctgccggatgtcgacggggccgtccccgcacggccggtctgccggcgcaccgtgctgcacggcgacacgattcacgagatttag

SEQ ID NO: 275 - DNA, 1545 bp, Actinoplanes utahensis
ttggccgggaagctggatctggacccgcggatcgtcgcgcgggcgcgggcgctcgccgccaaggccgggcagcccgtcgtcgacctcgcgcggtcgcacaccaccgtgtcggtggagcgggcagtgctgcgcctggccggcgtgcacggtgccgactcggacgggatcccctgggtgaaccgcctggtcgacgccgtgcgcgcggatgtcgggctgggccacggggtggccgtgccggtctgccacgcggcgctgaccacgggcgtggacgacctcaccgtgctcgcccagaaggcggccgcgggcgcggtgcggttcggcgtaccggagaagaagccggagatcgccgccgcccggcggctggcgaagaaggccgccgccaacggtctcaagatcgtcgatcgccggcgcgccgagcgcgacagactcatcaagcggtacggggatccgcagcagcggccgtggatctacctgatcgtcgccaccggcgacatctacgaggacatcccgcaggcgcaggcggcggcgcgggccggggccgacatcatcgcggtgatccggtcgaccgggcagtcgctgctggactacgtgccggagggggcgacccgggaagggttcgcggggacgtacgcgacgcaggagaacttccggctgatgcgggcggcgctcgacgagacctcgcgcgagctcggccgatacatccggctgaccaactacgcgtccgggttgtgcatgccggagatcgcggcgctggccgggatggaacgcctggacatgatgctgaacgactcgatgtacggcatcctgttccgcgacatcaacccgatccggaccttcgtcgaccagcggttctcgcggcaggtgcacgcccgcgccgggatcatcatcaacaccggtgaggacaactacctgaccaccgcggacgccgtcgaggccgcccacacggtcacggtgtcccagctgctcaacgagttcttcgcccacgaggcggggctggcggactggcagctcggcctggggcacgccttcgagatcaatccggatctgccggactcgttccggctggagctggcgcacgccctgctcgcgcgggagctgttccccgaggcgccgctgaagtggatgccacctaccaagcacatgaccggtgacgtgttccgcggcaacctcctcgacggcttcttcaacctcgccggcgcgctgaccggccagggcatcctgctcgtcggcatgatgaccgaggcggtcgtgaccccctggctgtccgatcgggacatcgcgctgcagaacgtgaaatatgtgctcaacggcgccggtaacctgcacgaggacttcacccccggcccgttcatccgcggccgcgccaaccaggtcctcggcgaggccatcgacctgctcgaacgcatcgtcgacgacaccctgatggatgccatcgcggacggcaccttcggcctgatgaagcgcccggccgaccgcggcaagggcctggacggcgtcgcgaagcaggaagccgactactacaacccggtcgaggagatgctgtga

SEQ ID NO: 276 - DNA, 732 bp, Actinoplanes utahensis
gtgatcatccgcccctacggcgacaccacgggcgacggcatggtgcagctctccttcaccctgccgatcccgcacgacaaacgtgccgagggcgccgccctgcagctggccggcaagatgggcatggacccggcgatgctggtgcacgccaagcagatgggcggcggcttcaccttcttcgtcgtctacggcaaggtcacccacctggtcgacaccgagcaggtgcaggtcgtggaacgcgacttcccgctgctgtccgccaaagaggtcaacgcggtgatcaagcggaggttgcggcgccggctcaacgtggtcggcgcctgcatcggcaccgacgcgcacaccgtcggcatcgacgccatcctcaacctcaagggcatcgccggcgagaagggcctggaatattattccgagctgtcggtgaccaacatgggcgcccaggtgtcggtgcccgacctggtggagaccgcccgcgcgcagaaggccgacgcggtcctggtctcccaggtggtcacccagcgcgacgcgcacctgcagaacaccaaggccatgtcggccgccttccgggaggcgctgccggccggcaaacgtccgctgctgatcgtcggcggcccccgcttcgacgagctgatgaccgaggaactgggcgtcgaccggatcttcggccgcggcaccaccccccgcgaagtggcctcctacctcgtccacgccctgattgagagcagaaattga

SEQ ID NO: 277 - DNA, 366 bp, Actinoplanes utahensis
ttgatcaccgtcacgcaccgccgctacgtcccctactcgcacgcgcactacgccgggaacctggtcgacggggcgtattcgctcgggctcttcggcgacgtcgccaccgaggtgtgcatccagctcgacggcgacgaggggctgttcgcctcctacgacgacgtgcagttcaccgccccggtgcaggccggtgacgtcctggagatcaccgcgacggtggtgcacatgggcacgcgcagccgccggatcgagttccggtcggtggtcgtctgccgggggaccggtggatccggcgcgcaggtgctcgccgaaccgatcgtcgcggtcacggcgaccggcaccgtcgtcgtgccgcccaaggcgtga

SEQ ID NO: 278 - DNA, 1242 bp, Actinoplanes utahensis
gtgaactctgcggtctgcgtcgacgtcggatcgacgtacaccaaatccgccaagatcgacctgagcggcgcggaactgatcagccgggccgaggtgccgacgacgtccggaacggacgtcctggagggtctgaccgccgcggtcgccgcggtcgacggtgcgggcgcgccgctctacgtctgctcgtcggccggcggcgggctgcggctcgccgtcgtcggctacgagagcctggtcaccgcggaggccgggcaccgggtcgggctgtcggccggcgcccaggtggtgcacgtcgcggccggtccgctcaccggtgcggcggtggccgcgctgcgcgcggcccgccccgacgtggtgctgctcgtcggcggcaccgacggcggcgacggcgaggtgctgctgcacaacgcccggcgcctggccgccaaccggttgcggattccggtggtcctggccggcaatgtcgaggtacgtgcggaagccgcccggttgttgcgcgagcgcggcgtgccggtgaccgagaccggcaacgtgctgccgcgcatcggcgtgctcgacccgctgcccgcccgggcggcgatccgggcggtgttcctgcggcacgtgatcggcggcaaacggctgtcccgaggcaaccgtttcgcgtcgatggtccggtacgcgaccccggacgcggtgctcgccggggtcgaactgctcgccgaccgggccgccgggggcgtcctggtcgtcgacgtgggcggcgccaccaccgacgtgtactcggcgctcgtgcccgacgcggaactggagaccgggccgcggcgcgacgtggccggaaccctgtggcgggcccgcaccgtggagggcgacctgggggtggcggtcggcgccgcgggaacccgggaagccgcggtcgccgagaaactgccggaaccggccggggaccgggaactggccgccaccgcggcccggatcgcgttgcggcggcacgcccgggggcactcggcggggccgggacagccgcgcaccgggggccgcgacctgcgggacgtgcggctggtcgtcggctccgggggagtgctccggcacgggggtggtgatcacgtgctggatgccgtgctgcacgatacggccgggggatgggcgctgccggaccgggcgcggacggtgatcgacaaggagtacgtgctggccgccgccggactgctggccacggaccatccggccgtctccggggcactgctgcagacactgctgtga

SEQ ID NO: 279 - DNA, 903 bp, Actinoplanes utahensis
gtgcagggcaacgtgccgcgcctgggcctcgacttcaacgcccagcgccgcgccgtgctcgacaaccacgtcaccgcgacccggcagctggccgccggcgtcgccgccggccgccagccgcagcccgacctggtggtctggccggagaacgccagcgacatcgacccgctgcgcaacaccgacgcgtccgccgagatctccgcggccgccaccgcgatcaaggcgccgatcctggtcggcgcggtgctgcgcaccgacaagccggccgatatcaagaacgccggcctgctctggctgccggacaccgggcccgacctggcgcagacctatgtcaaacagcacccggtcccgttcgccgagtacatgccgctgcgctccgtcgcccggctggtcaccgaccgggtcgacatggtcaagaacatgctcgccggcgaccactccggggtggtccgcaccggctcgctgaccctcggcgacgtgatctgcttcgaggtcgcctacgacggcatcgtccgggacaccgtcaccggcggcgcccagatcctcgccgtgcagaccaacaacgccaccttcgacgtgggcgaggcccggcagcagctcgccatggtccggctgcgcgccgtcgagcacgggatggactcgctgatggtctccaccgtcggggtgtccgccttcgtcgatacccggggtgacgtgcacggcgcgacgggtttcaacaccgcgaaagtggtggtgcataaaatgtccctcggggctacgcgtacgctggcgactcgttcgggcatctggcccgaggcgatcgcggtcgggctggccgtcatcgcactggccggcgccgcgcccctgcgccgtcggcggccggtccccagcacagacgacgacatgagcgtggaggaacgttga

SEQ ID NO: 280 - DNA, 789 bp, Actinoplanes utahensis
ttgaccgaggtggaaggctacccgggagtgggccgggtcctcgtgatcatccccacgtacaacgaggccgacaacgtccgcctgatcaccgggcgggtccgcgccgcggtgcccgaggtcgacatcctggtcgccgacgacaactcgcccgacggcaccggcgccatcgccgacgagctcgccctcgccgacgaccacatcttcgtgctgcaccgccagggcaaagagggcctcggcgccgcctacaaggccggcttcgcctgggccaaggacaagggctacgacgcggtcgtcgagatggacgcggacggctcgcacgcccccgaggagctgtcccggctgctcgacgcgctgagcggcgccgacgccgtgctcggcacccgctacatcccgggcggcagcgtgcacaactggccgatgcgccggctgctgctctcccgcggcggcaacatctacatccggatggccctcggcatgccgttccgcgacgccaccggcggctaccgcgcctaccggatgaccgtcctcgacgccatcgacgtcccgtccgtcgcctccaccggctactccttccaggtcgaactggcctggcgcgcctaccgcggcgggttcaagctggtcgaggtcccgatcaccttcaccgaacgcgagcacggcgtgagcaagatgagcggcaacatcttcaaggaacagctgctgcgggtgaccgtgtggggcgcgcaggcccgcaaggagagtctgctcaccctgctcggccgcaagccccggcaggaacagacctggccgtga

SEQ ID NO: 281 - DNA, 513 bp, Actinoplanes utahensis
atgcgccgtggcctgtccctcgccctaccgctgctgtcgctggccgaggtcgccgtcttcctgaccgtggcccacctgatcggggccggctgggcgttcctgctgctggcagccttcaccctggccggtttcgcactgctgcgccgcgagggcatccgcggctggcgcgccttccagcagtccgccgcggccggccgcccgcccggcgccgaggtgaccggctccctcgtcggcctcggcggcgcgctgctgctggccctgcccggcttcgtcaccggcatcgccggcgtcctgctgctcctgcccccgctgcgcggcatggcccgccgcggtgtcgagcgcttcgccgagcgccgcctcggcgccggcatgaccggcgacctgttcggcccacgcaaggtccgggtccgcgtcgacgacccgacggtggtcaactcctcggtggtcgacgccggcttcccgccttccccgcgccaccccgccgccgccatcgagggcgaaatcgtccgctga

SEQ ID NO: 282 - DNA, 339 bp, Actinoplanes utahensis
atgggcgaacgcatgctgcgcggcagccgtctaggcgcagtcagctacgagtccgaccgtaacaccgagctggcgccccgacagacccgtgagtacctgtgcgtcaagggtcaccagttcgaggtcccgttcgctgtcgacgccgaggtgcccaccacctgggagtgcaagttcgacggcagcgtggcccggctggtcgacggcagcgagccggagcagaagaaggcgaagccgccgcgcacccactgggacatgctgctggagcgccgctcgatcgccgagctggaggacatcctcaacgagcgcctgcaggaggtccgcactcgccgcgggcgctga

SEQ ID NO: 283 - DNA, 330 bp, Actinoplanes utahensis
gtggccgaggcgggggctcgggccgaccgggccgcggccgaggcgggggcggtgcgcgaggagctggcgggggtggtggccgagcgggatgggctacggcgtaccgccgcggaagttgatcgtgctcgggaagatctgcgccgggccggtgaggaacgggcggacctggagcggcgcctggtggcggcgcgggcggacgcggacgccgcgcatcagcgggtggctcagctgaccggtcaggtcagcgacctggcgtcggcgctggcggcgctcggcacgagccgtccggcggcggccgcaccggcgcaggccgcatcgccggaggcttga

SEQ ID NO: 284 - DNA, 390 bp, Actinoplanes utahensis
atgacgacgcaggaccaagccgccgaggccatcgaaacccgaccctgttcccactgtgggcgacccgttccgcagcgggcctccgccggccggccgttccggtactgccgggacaacgacggtgagtgccagcgcgcctcccggaatgtccggatgcggcaccggtcgtcgcccggcctggccgggtcggtcgcccggacctgggaagtggtggaccgcctcgaccagatggtggggacgctgaccgaggcgctgcattcggagatgtcgccggccggggtggaacgccaggtcgccgaggtgcgggcggagacgtcgcgggcggtggcggccgcgcacgccgaacgcgacgatgctcggcgcgacgcggagcaggcggcgacggcctag

SEQ ID NO: 285 - DNA, 1842 bp, Actinoplanes utahensis
atggcctcggcggcttggtcctgcgtcgtcatagcacctcccaccctaggccgatcggcgatcttaccgatgtcaccacgctggaccggcttccgcggcccgggtgcaggggggcagcgtgtctatcgcggtgtccggaccgcggcccgggtggagggggcagtgcgtgtaccgcggtgtccggattgcggcccgggtggagggtacagtgcgtgtctaccgcggcgtccggattgcggcccgaccggtcggaccaggcgtcattgccggatccgccgagagaaatgtgcggccaaggtcgccgtcgaactgtcgggttcgggattgcggcacaccgtggggatgccggtggccgggcggcaccgtacggtggccgccatggcactaccgttcgatctatgggggcagcgcggctgggccgcggctgaggtcgccggcgagtcgcaccatcacgaggcgatccgtgggctgttcggcggccggttgtcggccgggggagcggagatggcggtcagcgcgcagctgctgcccgatccggcgaacccgcacgaccgggacgccgtcaccgtctgggtgggcccggtccaggtcgggcatctgcccccggacgccgcgaaacgctatgcgccggctctggcgagcctggtcgcccgcggctggacgccgcaggtcggggccaggatgttcgccacgcagcgggggccgcacgacttcagcgcctcgatccgcctggacctggccgagccgcacctgatcgccccggcgaaccacccgccccgcgaggcgtatcggctgcttccgaccggcgcgccgatcgaggtggccggcgacgacgagcaccgcgacgtcctgatcgagttcctgcgccccgagggcgagtgctgggtccacaccaccctgcacgaggccggcgaccggacggcgacgatcgaggtccgcctcgagggcctccgggtcggccggctcagcccccggctcagtggcgagctcctgcccgccgtccgccacctccacgatcgcggcctcaccacctgcgcccgcgccatcatcagcggcgacaccgtcaccaccaggctcatggtgtacgccgtgaaagcccacgaactgcccgaaagctggctggacgccccgcccgaaggcgcctcaccggccgggccgaccgtcccggagcccatggcggcgcccggtcgcccggccgtggtccccgccctggaatcgtccccggccgccgaaaccgcggtcctgcccgcgccgctcctgtcggccccggtcaccccggatccggccgccggcgcccccgtgccgtcggcgtcgccttccccggttccggccgcaccgccgtccgcgcctccgccggggacgcccgcgccgtccgggctcccgacggcgttgccgtcaccggttgtgcccgcaggcgtggtggcgccgccggtggcacctgtgcggcatcccgccccccgcccgcggccgacgcccgagtcgaattcggcggccgacaccgctgtcctgtccaccgcgccggccggctcgcccgtgaccatgcccgcggtaccgggccaccccgcggaggtcggccggcgcacggtcccgatcgtcccggcgggcagcggccccgtccctgtcgttccgggcaccgtcggcgcgggtccgggcggtgcgcccggcacgccgatgccggggcccaccgccgatggcggattctggggcgcaccgagtatcgagcagggggacgctgccggcgcgcctgagttccccggcactccggatggccggcacggcgggagttctggtgtcccgggttcgccggtggtcgggcagggcgggagttctggttcgccctag

SEQ ID NO: 286 - DNA, 1032 bp, Actinoplanes utahensis
gtgtcgcccggctccccggcgggtgggcacggcgccttcggcttgcccggcgcggcgggtggggggcgcggctcggaggctcacgacgtacgggaaaccggttttgcggaaactcgcggcgcgcaagcgccgagatcgccgcaagccgcgcatcggccggccggtcttcgcttcaacccgccgccggcctggccggcgccgcccgcgggctggacgccgccgccgggctggacgccggatccggcctggggtccgccgccggccgggtggcaactgtgggtcgaggaccgcggcttctcgccgaccgatcctgccgccgggcaccgccaccccggcgccatcgatgtcgactggctgcgcgcggggtctgatgcgacgaccacggagttcgaccgcatacgtcccgacggtgaggcctgggtcccggatgtcgcctcgcccggggatggcggcgacgggtggcccgcggagggtgatcggtcgcgggttggcggcgacgggtggcccgcggaggttgatcagtcccggggcagtggcgacgcgtggcccgcggagattgatcagtcccggggcagtggcgacgcgtggcccgcggagggtgatcagtcgtggggcacgcgtgacgtccgggccccggaattcgctgacgcgcatggcggggcctccgctgtcgggttcggtgatccgctgtccggtggcgacggctgggccgcggagttcgatcaagggcgggcggacagtgacgcgctccacgcggagctcgggcgggtacgggcggaccgcgatctggcggtggcggagctcgaacggctgcgggcggatcgggacgcgctggccggggaggtcgaccgggcccacgctgaccgggatgtgatggcggcggaggtctcccggctgcgcgcggaccgggaggcgatgcgatccgagatcgagcggcttcgggatgagctgggcagggtgggccaccccgaggtccccgatccggggcgggaccggcggcgggaggatttcgggggctaccggctgcggtga

SEQ ID NO: 287 - DNA, 1329 bp, Actinoplanes utahensis
ttgtgcagctcaaagatcggcgacaccgcgaaccgggtgtgcagcagatcctcggcgccgacctcgaaccgcatcacgacgccgacgttacgcctcctggcgaatcaatcgccagcagcgtgcgccgggccggagggtggccgggtgacctatcgcgacgtcttcgcggaaccacggttccgggtgctgtttctgggccggaccgcggccatcgcggcggaatcgctgcggatcttcgcgctgtccgtgttcgtcttcgaacggaccgggtcggcgctgctcagtgcgctcgcgttcgcggccggtttcctgccgcaactcgcgggtgggctgctgctcggcgtgctgaccgaccggatccggccacggccgctgatcgtcaccggatacctggccggcggggtggcggcgctgctgatcgcggtggtgccgctgccggtcgccgcccagctgacgatcatcggggtggtggcctgcgggacaccgatcttcatgggcgcggccgggcggctggtcgccgaggtgctgaccggtgacgcgtacgtgctgggccgctccgttctgaacgccgcctcgtccggcgcgcaactgctcggcctcgcgctcggcggcgtcgccgtcgccgcggccggaccgcgccaggccctgctgatcgcggccggcgggcaggccctggccgcgctgatcatccggctcgggctgcccgacctcgccggcgaatccgcggaccggggctccgcggtgcgcgccagcctggccggcgtccgcgacctgctcggcgacccgatcatccgcgccttcctgctggcccagtggctgccgtcggcgtgtgtcgcgggggcggaggcactgctcgtctcgtacggtcacgggcgcggcttcccggccggcgccgcgggcgcgctgatggcggccgtcccggtcggcatgctcgccggcgacctgatcgtcggtcgctgggtgcgcccggctacccgggaacgcctggtccgcccgctcatcctgctcgccggcgcgccgctgctcctgctgctgaccgggcccacgctgccggcgacgctgggctgcctggtcctcgccggcgccggatacgcctaccagctcggcctgcaacgcccgctgctggacgccaccccggagggacgccgcggccagatgttcaccctgctctccaccgggctgatgaccctgcagggcctctccccggtggtgctgggcgtgctcgcccagtggggcagcccggccgccgccatcgccaccgccggagccggcacactgctgtgcatgatcctgccaccccgaaccagggagctggtcaagcggacatga

SEQ ID NO: 288 - DNA, 972 bp, Actinoplanes utahensis
atgcggttcgaggtcggcgccgaggatctgctgcacacccggttcgcggtgtcgccgatctttgagctgcacaatctgctacgggccctgcacgcacccgccccgggtctccccgagtcctggctggcccgtttccggcccgctttcgatcagctgcgcccggacccgtggctgaccgccgtcctcgcgctgaagtcggcccgctccggcgcgaacttcttcgcaccgccgcctcgcggcatgacccagaccatcgaccaggacctcgccgcgatccgcgcggtcccgctccgcgcggcccgtaccgaaatcgacttctatctggcccgccgccgggttccggccccggtcagaattctgctgtacgccgatgacgtcctggaccggatggccgccttcctgtcggacgcctggtcggcgctgatggcgccggaatggcccacgatccgtgccgtctgcgaacgcgacgtcgtccaccgctccgccgaactcggccgcgccggctggtccgcggcactcgccggcctcgcccccaaggttcgctggcaccgcggcggcattgaactgaccgcccaccgcggccccgccggcaccctcgacggcaccggcctgctgctcatcccgtccgtcctgatctggccccgcaccgccgtcttcggcgacgacccatggccgaaagcgatcgtctacccggcccgcggcgtaggcaccctgttcgaactgtccccacccgccgtcccggacaccctggcagccctgctgggccgcagccgagcccagctcctcaccgccctggccgacccggccagcaccacacacctggccaccgccttcaacctggcccccggcgccgtcggcgaccacctgtccgtcctgtaccgctccggcctgctcagtcgagcccgttccggccgctccgtcctctactcgcgcaccccgctcggcgaccagctcgtccacaccgcccgctga

SEQ ID NO: 289 - DNA, 390 bp, Actinoplanes utahensis
atggcatcccgcaccgtcagcgccgccgttgctctcgtcggggcggccggcctctcgctggccgccgccgtccccgcgcaggccgccaccccctgcgtgcagaaggtctcggtgatcaacaacggtggcttcgtgatcgacttccaggtcaccacccgcaccggggagctgtccgcgtccaccgacgactacccgatcaaccagtaccgcgtcgtcgacctgaactcgaccccgttcgccgagggctccgacgtccgcccgctggtccacgcgcaggccggcaacaccgtgcccggcaacgtgttcgtgtcgttctgcaacaacgggcagaccgccacctacaccgcgagcggcaccaccctgaactacacggtcaccctcctcacctga

SEQ ID NO: 290 - DNA, 600 bp, Actinoplanes utahensis
atgacgggacgctcgacgcgatctgcatgtgaagagcctccctcgggggtacgacactttccgatgtgcaaccttcggttgctcaagagccgatggtgggctaccgttacctgcaaccaaaggttgcaggaggacgtcatggagcagggaatcatcgagcgcgaaatcttcatcgaggcgacgcccgaggtcgtcttcgaggtggtcagcagccccgaacacctcaagggctggtggcccgacgatgccgactacgaagcgcggccgggatcggagggaaccatcaccttcggtgactgcagcgccggaggcaaggtcgtccagttcgccgtcgtcgatgcccgtccgccgcgaacattctcgttccgctggacgcaccccgccggtgagccgccgacggccggcaactccctgctggtcacgttcgagctgactccgtccggcggtggcacgctgctgcggatgacggagaccggtttccgggagcggggctggtcgcaggcgatcgccgagcaggagtaccgggagcatgtgcacggctggggcatcttcctgccgcgactcgcgccgtatgtcgccacgctccaggtccagccgtga

SEQ ID NO: 291 - DNA, 339 bp, Actinoplanes utahensis
gtgagcacggccgtcgacgacgatctgtggtcggcggtcggcgacccgacccgacgacgaatgctcgacctgctcctcgcccacggtgagggcaccgcgaccacgctcagtcagcagatgccggtgacccggcaggccgtcgccaagcatctcaccgtcctcgaccgggtcggcctggtccgcggcacccccgccggccgggggaagcgttaccgcgtcgacgacgcccagctggcccgcgccatcggccagctggcctcggtcggcgcggcctgggacgcccgcctgcgccgcatcaggaccatcgccgaggcgatccagcaaaccacgaccgattga

SEQ ID NO: 292 - DNA, 468 bp, Actinoplanes utahensis
atgtgcggcaggctggaccgcatgtctcttgagatcgcacgcgagcttcagatcaccttcgacgccgccgacccggccgcgctgtccgcgttctgggcggaggcgatcggctaccggctgcagcccccgcccgcgggcttctcctcatgggagcaggccctcgaggcgtggggtgtgccgcccgagcgtcgcaacgacgcctccgcgctgatcgacccgaagggcgccgggccgcggctgttcttccagaaggtgcccgagggcaagacggcgaagaaccgggtgcacctggacgtccgcgcagctcccggcctcaccggcgacgagcggatggcagccctcgaagccgaggcggcgcgactggtgggcctgggcgccacccgggtgcaacgccatgagccggtgccgccgaacgccggacacatcgtcatggccgacccgggcggcaacgaattctgcctcgactga

SEQ ID NO: 293 - DNA, 744 bp, Actinoplanes utahensis
gtgggcggcatcggttgcgagagactctggagcggctcgggctgccgtcccgctgaccacgcgtcccggcggctcctcgtcttgccgatggcgcagaatcggtgggtgacgttccgcggatggccggtcgaggcactcgagttctacgaggggctcggcgccgacaactcgaagacgtactggaccaggcacctggcattctacgaggagcaggtgcgggggccgatgctggaactgctcgccgccctggaaccggaattcgggccggggaaagtgttccggccctaccgggatgtgcgcttcagcaaggacaagaccccgtacaagacgcatctgggcgcctggctcgaatccggcggatacctgcagctgagcgcggacgggctggccgccggatccggctactaccggatggatccgggccagctcgaccggttccggcgggcgatcgccaacgacgtgaccggcatccagctgaccaccctcatcaccgacatcgagagaaccggaatctcggtggtcggcagagacaccctgaaaaccgcgccgcgcggctacccgaaagatcatccccggatcgatctgctgcggcacaaggggctgatcacctggcgggaatgggagccggccgcctggctggggacggcggccgcgcagaagcgggtggtggagttcctgcgagccggccttccgctgcggcactggctcgacgaccacgtcggtccgccgctcgccggcgcctga

SEQ ID NO: 294 - DNA, 843 bp, Actinoplanes utahensis
atggatgccgccgacttttcaagcttccgggagacgcccgtgtccgaactgctcgccgcccggtacgggaccgccgccgcgccgctcgacaccctcaccgacaccatccgcctgcaactgcgccgccgctcggtgcgccgattcctgcccggcgaggtgaccgacgaccagctgaccgcgctgaccgccgccgcacaatccgccgccacctcctccaacctgcaggtgtggagcgtgatcgcggtccgcgacccgggccgccggcagcggctcgccaccctcgccggcaaccagtccttcatcgcgcaggccccgctgttcctggtctggatcgccgacctgtcccgcgcccgccgcctcgccgaccgggccggctcctccctcaccggagcggactacctggaaagcaccctgatcaccttcgtcgacgcggccctcgccgcccagaacacggtgatcgccgccgaatccctcggcctcggctccgtcttcgtcggcgccgtccgcaaccgacccgaggagatcgccgccgaactcaagctgccgccccacgcggtcgccgccttcggcctggccgtcggcacgcccgacccggcggaggcggccgcggtcaaaccccggctgccgcaggcggcggtgctgcaccatgagcagtacgacgcggacgccgccgacgcgcacatcccggtctacgacgaacggctggccgcctacaaccggcggttcgggctcagcggcggctggagtgagcgggtgctgagccggctgggtggggcggaagcgctgggtgggcggcatcggttgcgagagactctggagcggctcgggctgccgtcccgctga

SEQ ID NO: 295 - DNA, 1065 bp, Actinoplanes utahensis
gtgataggaaaagcgagcgagttcctctggtacatcccgaacgaggaccgccccgggcaccgcggcgacgacgtggtcgacggccacaacagcctggcggcgctcaccgcgcaggccctggcctgcgagcggcacggctggagcggcgcgctgatcggcaccggctggggccgtccggacaccttcacggtggccaccgcgctcgccgcccgcaccaccacgttccggccgctgatcgcggtccgccccggctactggcgtccggcgcagttcgcgtccgccgcggccaccctgcagcacctcagcggcggccgggtgctgatcaacatcgtgtccggtaaggatcgtctcgccgcctacggcgacgaggagcaggaccaggcttcccggtacggtcgtacccgcgagttcctgcacctggtccgccggttgtgggccgaggagcacgtcacgcaccggggtgggcatttcgcggtcgacgactcgaccgtggtcccgcgcctggccacgcccccgcggctgtatttcgggggtgcctcggccgcggccgagcgggtcgccgccgcggctgccgacgtgcaactgttctggggcgagccgctggacggcgtacgggaaagaatcgagcgcctgacggccctgagccgggaggtgggccgggacctcccgccgctggagttcggtctgcggatcaccacggtggtccgcgagaccggcgcgcaggcctgggcggatgccgaggcccgggtggccgcgatggccggcggcccggcgatcgacccgctgtgggcggcggcgaccgggcagcgccggctgctcgacctggccgcccgcggtgacgtgctggacgacaatctgtacaccgcgccggcccgggtcggcgggggcggcgcggggacgacctggctggtcggctcggccgcggaggtggcgaggtcgctgcgcaagtatcagaatctggggatcagccacttcgtgctgtccgacacgccctacctcccggagatcgcgaggcagggcgggcagttgctgcccctgctggcggagaccgcgctcagagcgtga

SEQ ID NO: 296 - DNA, 1752 bp, Actinoplanes utahensis
atgggtaacaccgtacgaacgcactggaccggtgacagtggtgctgactccccggttccaccgggcactaccccaccgtcgacgatcttacgtggcggctaccctcagacggataggattcgcgccgatcacaggtgcatgcgcatccgtgacatcggcgtcggcactcggctgggcgcctcctacctggtcctcaccacgctgatcgtcacctcggccggtgtcggctggtccgggctgcgccagcaggccgccgccgagaaggaactggccgccctggaacgggtgcgcgacgacatccagaccgccaagtacaacgccgccgacgtgaccggctggcagggcctggtcatcgcggacatcggcgcgttcggctacgcgttcgcgaccgggccgaaaggctacaaccggcagggcgagatgaagtccaaggccgccatctacgctcagctggccagcgccgacacggctgacatgtcgccggccgagcgggccgagttcgccaagctcaagaccgcctgggacgagttcttcacctgggacacgaccgtcatgcggtggctgtcggcggacacccaggccagccgcgcgaaggcgatggacagcatcaacggcggtgatgcggccgccgcctacggcaaggtcctggacatcaccgctggactggacaagtcggtcaccgaccgcaccgcggcgctgcgcgcccacgtgcagcgggtgcgcaccgacgcgatgcgggggctggccatcgccctcgccctggccgtgatcctcgccgtgctgatgggcacctgggtcacccgctcggtgatccgcccgctggccaccgtggtcgcggcgctcaaacgtctggccgcgcacgacctcaccgtccgggtcagcctggaccgccgcgacgagctgggaacgctcggcgacgcggtgaactcgaccgccgagtcgctgagccacacggtcgcggcgatcgccgggcacgccggcaccgtctcggccgcctcccaggacctctccgacgtctccacgcagatcgccgcggccagcagcgagatggacacccaggccaccgcggtcgccacctcggccgaccacgtctccggcaacgtgcagacgctgcaggccggcagcaccgagatgaccctggcgatcgacgagatcgcccgcaacgccggcgaggccgcccaggtcgccggcgaggcggtcggcgtggtcgcccgcaccaaccagaccgtcggcaagctcggcgagtcgtccgccgagatcggcaaggtgatcgccatgatcaccgcgatcgccgagcagaccaacctgctcgctctcaacgccaccatcgaagccgcccgcgccggcgagctcggcaagggcttcgccgtcgtggccggcgaggtcaaggagctgtcccaggagaccgcgaaagccaccgaggagatcagccggctcgtcgacgcgatccaggcggactccaccgaggcggtcggcgcgatcggcaagatcggcgacgtggtggcccggatcagcgacttccagaccctgatcgcggccgccgtcgaggagcagaccgcgaccaccagcgagatgggacgcaacgtcgccgaggtggccgacagcagcaccgcgatcgcgaccagcatcgccggggtggcgaccgcggtgggcaccaccaccgaggtggtcaaccaggctcagtcgaacgccgccaacctggcgcggaccagcagcgagctgcgcgaactggtggccggcttcacgctctga

SEQ ID NO: 297 - DNA, 726 bp, Actinoplanes utahensis
atgaccgacgcggtacgtctcgaagccctcgtcaagacctacgacaacgccgtgaccgcgctcgacggggtcacggccgccttcgccgacggcacgttcaccgccgtgatgggcccgtccggctccggcaagagcaccctgctgcactgcgcggccggcctcgaccggcccagcagcggccgggtcttcctcggcggcgccgaactgaccgcgaccaccgacaccgaactcacccgcttccgccgggcccgggtcggcttcgtcttccaggactacaacctgctgcccgcgctcaccgtcgaacagaacgtgcaactgccgctgcgcctggccggtcgccgcgccgaccgcaggcgcggtcgggccatcctggaccagctcggcctcggcgaccggctcacccagctgcccgccgaactctccggcggccagtgccagcgcgtcgccgtcgcccgcgccctgctcaccgaacccgcggtgatcttcgccgacgaaccgaccggtgccctcgacctgcgcggcgcccgggaggtcctcaccctgctccgccaggtggtccgcgaccacggtcgcaccgtcgtcatggtcacccacgacccgatggccgccgcgtacgccgactccgtcctcttcctggccgacggccgcctggccggctcgctcgccgcacccgccccggacgccgtcgccgaccgcctcgcccacctgaccggggtgccggcctga

SEQ ID NO: 298 - DNA, 1176 bp, Actinoplanes utahensis
gtgcggcgtacaggaaccaacctgccgaaagtcggccagtacaaccgggccgtcgtcctcgatcagatccagctcgccgacggcatcagccgggtcgagatcgccgagctgaccggtctcaccccgcagaccgtctccggcatcgtccggcggctgatcggcgaaggcatcgtccgcgaggacggcgccaccgtctccaacggcggcaaaccccgcaccctgctgcgggtcaacgccgccgcggggctggccgtcggcgtccacttcgacccgtcccagctgtcctgcgtggtcgccgacctgctcggccgccccctggtccaacggcagcagccgatccgccccggcgccggccccaccgaggtcgtcgccgcggtcgccggcctggtcaccgacgtgctcgcggccgccggcgtgccccgcgaccgggtcctcggcctcggcctggccacccccggcccgatcgaccagagcctcggcgccctggtcgggccgccgcagctgctcggctggacccgggtgccgctcaaggacatgctggccgccgccaccggcctgccggtcaccctggacaacgacgcgaccgccgccgccatcggcgaatgctgggccggcgccggccgcggcgtcgccgacttcgcctacttcttcttcggcgccggcgtcggcggcggactcatcctgggccagcaggtctatcgcggcggctcgatgaacgccgccgaattcggccaccagacggtgctgcccggcgggccgccctgctattgcggcaaccgcggctgcctggagagcctgatcagcccgggagctctcgtcgcccggtccggcctgaccgattacgacaccctgcgccaggccgcgctcgacggcgaccgcgccgccgtcgacgtcgtcgaggccgcggccgaacatctggccaccgccgtcgtcaacgtcgccaacatcctcgacgtcgacctgttcgtcctcggcgggcacggcctgcgccacctggaatcccgcttccgcgacgcggccgccaaagctttggagacccgccccctggcccgcagcatccgcaccgtccgtgtcgaggtctccccgctcggcgccgacgcggcggtcgtcggcgcggcggccctggtcctgcacacgacatacgccccgcaggtctcggagctgctctccctctga

SEQ ID NO: 299 - DNA, 1548 bp, Actinoplanes utahensis
atgagcgctgctgcgccgctgctcgaaatgcgctccatcaccaagacgttccccggtgtcaccgcactgtccgatgtgaacctgacggtccgcgacggggagatccacgcgatctgcggggagaacggggccgggaagtcgaccctgatgaaggtgctcagcggcgtccacccgttcgggtcgtacaacggctcgatcgtctatcgcggggccgaggcccggttcgccgacatccgggccagcgagcacgccgggatcgtgatcatccaccaggagctggccctggtccccggcatgtcgatcaccgagaacatcttcctgggcaacgagccgacccggttcggccggatcgactggaaggcggccaaccgccgggtgctcgaactgctcgccatggtcgggctgaacgaggatccggacaccctggtcaaggacatcggggtgggcaaacaacagctggtcgagatcgccaaggcattcgccaaggacgtacaactattgatcctggacgaaccgaccgcggcgctgaacgagaccgactcccggcacctgctcgatctgctgcgcgggttccggaaacgcgggatcacctcgatcatgatctcgcacaagctgaacgagatcgaggcgatcgccgactcgatcaccattctgcgcgacgggcggacgatcgagacgatcgatgtcgcggcggagggggccgacgaggaccggatcgtgcgcggcatggtcggccgggatctgggcagccgtttcccggagcacgagccgcacatcggcgaggtgttcttcgaggtgcgcgactggacggtccggcatccgatctcggccgagcggctggtctgcaagaactccggcttcaccgtgcggcgcggggagatcgtcgggttcgccgggctgatgggcgccggccggaccgagctcgcgatgagccttttcggtcgcagctacgggatctacctgagcggccaggtgttcaaggacggtcaggagatccagttgcgctcggtggccgaggcgatcgggcacggcctggcgtacgtcagcgaggaccgcaaggcgatcggtctgaacctgctcgacgacatcaagacctcggtggtcgccgcgaaactctccaagatcaccaagaacggggtgctcgacgaggccgcggagtaccacgaggccgaggcgtaccggcgcagcctgcggatcaagacgccgagcgtggacgagggcgtcaccaagctctccggcggcaaccagcagaaggtcgtcctggccaagtggatgttcaccgacccggatctgctgatcctcgacgagcccacccggggcatcgacgtcggtgcgaaatacgagatctacgggatcatccagcgcctggccgccgagggccgcggcgtcatcgtgatctcctccgagctgcccgagctgatcgggctctgcgaccggatctacacggtcttcgagggcacgatcaccggcgagatcgcccgccgcgacgccgacccggaagtcctgatgaagcagatgacctcgacgaagaagctggccaccccatga

SEQ ID NO: 300 - DNA, 1575 bp, Actinoplanes utahensis
gtggatgttcaccgacccggatctgctgatcctcgacgagcccacccggggcatcgacgtcggtgcgaaatacgagatctacgggatcatccagcgcctggccgccgagggccgcggcgtcatcgtgatctcctccgagctgcccgagctgatcgggctctgcgaccggatctacacggtcttcgagggcacgatcaccggcgagatcgcccgccgcgacgccgacccggaagtcctgatgaagcagatgacctcgacgaagaagctggccaccccatgagtcggataaaagatctccagaaaaacctcttcggcggtacgacgtcgaacgcccgccagttcgggatgatcttcacgctggtggcgatcatcgtgttcttccagatccgcaccggcgggctgaccctgcagccgggcaacctgatcgcgctgacccagcagtacgcgtacatctcggtgctgtcgatcggcatgctgatggtgatcgtggccgggcacatcgacctgtcggtcggctcggtcgcggcgttcgtgggcatcgtggtcgccaaggcgatcagcgtgcaccacgtcccctggccgctggccatcgtgctgggcctggtcgtcggcgcggcgatcggcgcgtggcagggcttctgggtggcgtacgtcggcattcccgccttcatcgtcacgctcgccggcatgctgctgttccgcggcggcaaccagtacatcggcaacgccgacacggtgccggtgccgccgggcttccggcagatcggcgccggctatctgcccgaggtgggcccggacaccggctacaacaacctgaccctgctgctcggcctgctggcctgcgtcgcggtggtctggcgggaactgcggtcccggcaggtccgcaagcagatggagggcgccgagccggccccgatgtgggtctcggtgatccggatggcggtgatgatcgccgtcatcatcttcgccacgctgcgcttcgccggtggccgggtcggtaccagtttcccgatctccggcatcatcctcgccgtcctggtgatcgcgtattcgttctacacgcgcaacaccgcgggcggccgacacatctacgcggtcggcggcaacgcccgggccgccgagctgtccggcgtgcaactgcgccgggtgaacttcctggtcatcatgaacatgtcggtcctggccgcgctggccgggatgatcttcgtggcccggtccacggcctccggcccgcaggacgggctcggctgggaactcgacgcgatcgccgcggtcttcatcgggggtgcggcggtctcgggcggtctcgggacggtcggcggctcgatcgtcggcggtctcgtgatggccgtgctgaagaacggtctgctcctcaccggcaccggctccgacatggaccagatcatccgtggtctgttcctgctcggcgccgtcgccctggatgtctacaacaagaagcagggccgcttctcgatcatcggttcactcacccggcagttccgtccacggcatgaggtggcggccgccgaaaccctcgcagaggaccgcgagaagacccctgcaacccgcatctag

SEQ ID NO: 301 - DNA, 1104 bp, Actinoplanes utahensis
atgcgctccttcatgatcaagagtcttgcggtcggcacggccgtggtgctcgccctgtccgcctgctccaacgaccgcaccaagtccggtggcgacaccggcaacaccaagggcttcgccaaggacggcctgatcggcgtcgccctgccgtcgaagacctcggagaactgggtgctcgccggtgacctgttcaccaacgggctcaaggatgccggcttccagtccgacgtgcagtacgccggcgcctccaccacggtcgccgaccagcaggcgcagatcaccgcgatggtgaacaagggcgccaaggtgatcgtcatcggtgccaccgacgccggtcagctgaccaaccaggtggcggcggcgcaccaggccggcgccaaggtcgtcgcctacgaccggctgatcaccaacaccccggacgtggactactacatcgcgttcgacaacttcaaggtcggccagctgcagggccaggcgctgctggacggcatgaaggcgaagaagccgaagggcccgtacaccatcgagctgttctccggctcgccggacgacaacaactccggggtgttcttcaacggcgcgatggacgtgctcaagccggagatcgccagcggcaccgtgatcgtcggttcgaagcagaccgacgtgaagcagaccgcgacccagggctggaaggcggagaacgcgcagagccggatggacgcgctgctcaactccacctacaccggcggcaagacgctggacggcgtgctgtccccgaacgacaccctggcccgtgcgatcatcacctcgatcaagggtgccggcaagcccgtcccggtggtcaccggccaggactccgaggtggagtcggtcaagtcgatcatgaagggtgagcagtactcgacgatcaacaaggacacccgcaagctggtggccgagacgatcaccatggtcaaggcgctgcaggccggcaacgagccgcaggtcaacgacaccaagtcgtacaacaacggggtcaaggtggtcccgtccttcctgctgccgccggtcatcgtcaccaaggccaacgcggccgaggcgtacgcgaacgacccgaagctggagccgctcaccaagagctga

SEQ ID NO: 302 - DNA, 714 bp, Actinoplanes utahensis
ttggatctgagcgatgcacgggagctggcgctgcggttgatggccgagcaccggctgtcccgctggcggctgaccttcgacgacgcgaagacgcgggccggggtgtgccggccggggcgccgggagatcggcctgtcccggccgctgatcagcctgtattcgccggagcaggtgaccgagacggtcttacacgagatcgcgcacgcgctggccggggcccggcacgggcacgacgaggtgtggcgggcgatcgcggtgcggatcggatgttcgggccggcgctgcgtgcccgaggaggcgccccgggtcgacggggcgtgggaggggttctgccggcaggggcaccggaccacggcgcaccgccggccggtgcgggtgcggtcgtgccggaactgttcgccggggttcaaccggtcggcgctgttcgcctggacctaccgtggccatccggtgccgctgcacccggactacgtcgcggagctggtccggttgcacggtgccgcccccgtcgccctcgcggtcggtgaccgggtgcgcctgcggggcggcggcaagtacggcggcgtgctcggcaccatcgtcaagcagggtcgcagccgctaccagatccagacgccgcgaggcctgctcaacgcctccttctcgatggtcgaacggatcccgccgaacagcaccaggacgtccccggatcgggaacgccctggccggtgctga

SEQ ID NO: 303 - DNA, 1668 bp, Actinoplanes utahensis
gtgtccggcgccgcccgcttcgcggccgaccatccgtgggacggcctggcgtacggctggatcgtcgcctccccggtcgctcgcggccggctgaacgcggtgttcaccgacccggccgaggacgacgacgtactggtcgtcctctggcacggcaacgtcccgcacctgcccggagccgggtccccggaggcaacggccggggcgggcgcgccatcaccgtccaccccggcgagcgtcccgggcccgcccggattcgacggtccggagcccccgccgctgcagtcggaccggatcgcccatcgcggacagccggtcgccctggtcgtcgccgacaccctggagggcgcccgccgcgccgcccggctggttcggtgggacatcaccgaggagcggcacgacgtcgtgctccgcgccatcgatcccggaccgcccaccgacatcggcctgacgccggacaccacccaccccggaccgcccgccgcaggcaccgacatcggcctgacgccggacacgacccaccccggaccgaccaccccgggcaccggcatcgacgccatgtcgggtgccgcaaaccccggcgtcgacgtcgtctacacgacgccggccgcgcccgacggtccgctggagccgcccgccacgatcgcccgctgggacggtcagcggctggagttgtccgcttccggccaggacccggacaccgtcgcggagctcttcggcctgcccaccggacacgtccgcgtgatccccgggcccggcggcggcagcggtccggttcgcccggacgccgtgctggccgccctgggcgcgtgggtgaccggacggccggtccaggtgacgtcgccgcacccggccggcttccgggccccgaccgtccagcggctgcggatcagcgccaccccggacggccggctgaccgccatcgaccacacggtgcggaccgcgaccagccgcttccgcgatccgggggtggtcccccacggcggatacgacgtcccggacctgacgctgcggcaccgggccgtcccgctggacgtaccgccgtcccgctcggcgcggacgcccgggacggtcgcgctggagtgcgcgctggacgagctggccctgtcgatcggcatggatccgctgaccttccgggagcggaatctccgcggcgactgcttgcggcgcctgcgtgcgggcgccgcccgtttcggctggccggatcgcccgcacgggcgcgccggtgagtggctgatcggcaccggcctcgcgggcggggcgcacttcgcggaggtacgggtgagcaccgtcaccggcgaggtcggggtcacccgcctgttcggcgtgtacaccgcccgggacgccgccgacgcgcgagccacccggtcccggttcctcggcgacatggtcgcgggcgtgagcatggccctgcacgaggcgccggcccccgaccccgaggggggcacctggaccgattccgccccgggcggatcccgcatccccgcgtaccccgacatcgcctggatcgacgccgcctgggtggacggcttggagccgtcccggtccgacatcggcagccccgccgccgccatcctgaacgcggtcgccgacgccaccggcacccggatccgcaccctccccgcccgcctgcccgacctgctcgccggtgggaccgctgcgcccgcttga

SEQ ID NO: 304 - DNA, 1026 bp, Actinoplanes utahensis
gtgcggggcgtacccggcgatggtcccggccatccggcaggcggcgggccgatgaagaccttcgattaccgtacggcgtcggggctcgccgacggcctcgaaccgggtgcggtgtttctggccggcggcacgaacctggtcgatctgatgaagctcggcgtggccgccccggacgtgctggtcgacgtgacccggctgccgctgcacgacatcaccacgctggccgacgggacgatccggatcggttccggcgtccgcaacagtgatctcgccgcggatcgccgggtgcggaccggctttccgctggtgagccaggccctgctcgccggcgcgccgggccagctgcgcaacatggcgaccaccggcggcaacctgctgcaacgcacccgctgccgatatttcctggcggccggcctgccgtgcaacaagcacctgcccggctcggggtgcccggcccgcaccggcgaccatcgtgacctggcgatcctgggtggttcggcaggctgcatcgccacccatccgtcggatctggcggtggccctcgccgccgtcggcgcggtgatccgggtggacggtccggccggcgcccgggagatcccggtgaccgatctgtatcgcctgcccggggacgaaccggagcgcgacaccgtcctggaacacggcgagttgatcaccgcggtcgacctgccgccgctgtcggccgcggctcggtcggcctaccggaaggcccgtgaccgcgcctcctcggcgttcgcggcgggctcggtcgcggccgcgctgcggaccggggacggcctggtccgcgaggtgcggctggcgttcggcgcggtggccccgaaaccgtggcgggcgctggccgcggaggaggcgctgcgcggtgggccggccacccgggagcggttcctcgcggcggcggacgccgaactggcggcggcgcgcccgttgcgggacaacgcgtacaagattcccctgatccgtaacctgaccgccgccgtgctggagtcgctgaccgaggacgcccgatga

SEQ ID NO: 305 - DNA, 561 bp, Actinoplanes utahensis
atgcgcatcagcgtcaacggtgttcagcaccacctggtgggcctggatccgcggaccacgctgctcgacctgctgcgggagcggctgcggctgaccggagcgaagcgcggttgcgatcacgggcagtgcggggcctgcacggtgctgctggacgggcggcgggtcgccagctgtctgattctggccatcagtcagcaggacgccgaggtgaccacggtcgagggcctgggacatgccgccgatccgcacccggtgcagcgggccttcctggcccatgacggattcgggtgcgggttctgcacgccggggcagatctgctcggcggtcggcatgctcgacgaggtggcgcggggctggtcgagcgcggtcaccggcgcggccggtccgccgagcgacccgcaggccgcccggcacggcgacgcggaggccggcccccacagcgacccgcagggcgatccgctcagtgatgcggagatccgggagcggatgagcgggaacctctgccggtgcggggcgtacccggcgatggtcccggccatccggcaggcggcgggccgatga

SEQ ID NO: 306 - DNA, 174 bp, Actinoplanes utahensis
ttgggtatgcggatggcgacctgcaacctctgccaccgtgacgtgcccgatgagcagatcgaggaacaccgccgcgacgtgcatccggacgtcgcggcggacggcacccgggagacggacgactcccggatcgtgccggattccaccgtgccgcccgctccgagggaggagtga

SEQ ID NO: 307 - DNA, 1872 bp, Actinoplanes utahensis
ttgatctttgaaggccggagccgccgcatatctcgggaatacgctgttttcgtgcggttgtcggcggtgctgttctcggtggtcacggtgaccgccttggcggtgtggtccgcgttgatgcccacccggatgttgctgttcggcaccgtggcgatcggtccggccctggccgcggccgccgcccttccctcggtcgtcctgctggtcggcggctatgcgttcgccgccgcactggccgtttcgacagctgagggtctgttcgggacggcggatcagtggttgcggctggcgttcatcgcgtgggcgaccgcggtgtcgtgggggctcgcggtgttccagcggcgggcgcagcggtcggcgtccggggcggcgcgggagcggcaggtgctggccgcggtggccgagcagtccggggacgcgatcatctcgacgagcctggacggcacgatcgtcgcgtggaacgggggagcgacccggatgtacggctggccggccgcggaggtgatcgggcgttcgctggccgagatcctgccggacgaccggggcgacgaactgcagcgggcgctgggtgagctggcagccgggcggcggcttcatctggacgagtcgcgccgggtgcgccgggacggaacgccgctcctgatctgcgcggatgtctggcccatccgggacgagaacggtgtggtggtcgcggcggcggccaccgagcgggacatcaccgaggagaaactggcccgggaacggtcggcgcgcgccgatcggctggagagcctcggtcagctggccggcgggatcgcgcacgacttcaacaacctgctggcgatcatcctcaattatgcggatttcctcgatggggaggtgtccggtgaggccgccgaggatctgcggcggatccgcaacgccgccgaccgggccaaggagctgaccgggcagctccttgtgttcgccaagcgggagccgacccaggtggaggtcatcgacctgaaccaggtggtgaccgaggccggcgagctgctcagccggaccatcggcgagaacgtgcgcctggtcaaccggccgtcggccgcgccgatgccggtccgtgccaaccgggcccggctcgaccagatcctgctcaacctggtgatcaatgccagggacgcgatgccggacggcggggtggtcgtggtcgagaccgacctggtcgaggtgggagaggggccggccgcgccgctgccgcctgggcggtatgcccggctcaccgtcagcgacaccggctgcgggatgacggccgaggttcgcgaccggctcttcgagccgttcttcaccaccaaaccacccgatcgcggtacggggttgggtctggccacggtgtacggcatcgtcggcgacgcgggtggcacgatcggcgtcgagtcggcgcccggggtcggtaccacgttccgcatcctgctgccgtcggccgccgtgccggccggcgcgtctcccggccccagccaggcggaactcgcgcacgggcacggcgagctggtgctggtcgtcgaggacgacgagttcgtacgggacctggtgatccggatcctgcgggacaacggctaccgggcgacggcgctgggcgacgggccgctggccgcgctggacctgcacgacgtggcactggtgatcaccgatgtggtgcagcccggccggtccggtccggcgctcgccgcccggctgcgcgcccggcggcccgacctgcgggtgctgttcatttccgggtacagcgacgccgatgtgcgccgggagcatcgcatcgaaccggaggcacggatcgtgcagaagccgttcaccgccgtcgaactgctcgccggggtgggcgaggcgctggccgcggctcacgcaaacggggcttga

SEQ ID NO: 308 - DNA, 597 bp, Actinoplanes utahensis
gtggcgatcaccccggccgagatcaacggcatcgccttccggcggccgcggcccggtgcgtcgggctatcacgaggagcaggtggacgcgttcctggaggacgtggccggggagatgcgccgcctcgaggcggagaaccgggcgctcagctcccggctggggcacgacgacctggccgagcgggtgcgccgggcggagctggagtgtctggaggcgcaggagcgggcccgtgccctgcgcgaggcgctgaccgcggcgcgagaagcgtccttcactccggtcaatgcggataagtcgggcatgttggaggtcgctcagcggaccgcggatgcctgcgtcgaccaggcccgggccgaagccgagctgctcgtggagcaggccaccaccaaggccgcccaactgctcagcgacgcgcagctgcgggcgtcgacgatcgtcgccgacgcccggcacgcccacagcgaagcgatcgccggcatcgaagcccagcgggccgccaccctcgacgagatcagcgagctgatcgcgctcgccggccgtcagcgggcggcgaccgccgacgacatctccggccgcctgcaggagttcaccagctga

SEQ ID NO: 309 - DNA, 2223 bp, Actinoplanes utahensis
atgcctcgcacggtgctggcgtcgaccgcgttggcgctgagcgccatcgtcgtcttcgccgccatcctggccggctggcatgtcccgccggtgctgctctggctgcccgcggcaccgtcctgcatgatcccgatggtgatcgcggcgcggatcacccggatcagcgggtttccgcgccctacccggatgttctgggggcatctggccgcctgcaccgtgctgtccgcggtcggcagtgtctgcaacgcggtcgacgcgctcgggcacggtgcgccaacccaggagatgtcgccgtggacggtggcggcgtacggcggatgtgtggtggccctgatggccggcatgttccgactgccgatgggctcgacggggtccggcgaccggctgcggatcgggctggacgccgggaccgtgctgctcgccgcgtcgatcttcatgtggcagttccagcggaccggatcgccggtggtgatcgggttcaccatggtgctgcagctggtcaccatcttcgcgatcgccaaggtggcactggccgggcatcactacatcgcccgcaacgcgctgcggctgttcgccctcggactcttcggcggggtgctgatcggcgcgtcgcagcggttcatcgcggaccggccggagctcaacatgggcccgctcggcgtaccgctgatcatggtgttggcgaccgcggccgccgaggtgcagcggaacagctgcccctcccgggccgggctgcgggtcggtggccgccggccgttcagcgtgctgccctacctcgcggtcgtcgcgatcgacggcctgctcgtcgccacctgctggccgcatccgcgggagcggctggtggtgctgggcgcggtggcgctgaccgcggtggtgatgtggcggcagatcaccgcgatgcgggagaacaccggtctggtcgcccgtctcgaccacaattcgacccacgacgcgctcaccggcctgccgaaccgggcgctgttcaacgcccggctggccggcggcgaggccgggcagccggtcagtgtggcgctgatcgacctggacgacttcaagacggtcaacgacacgctcgggcacggcgccggggacgcactgctcaccacgacggcgcgccggctgcgggccagtgtgcgggaggtggacacggtggcccggctcggcggcgacgagttcgtggtgctgatgcccgggctgaccgcggccgaggcggaaccggtggcccgccggatgatcgggtcgctggccgagccggtcctcgccgaggggcacgatctgctggtgcgggccagcatcgggatcgccgacggcccgggtgacgagcccggtgagctgctgcgccgggccgacatcgcgatgtacgcggcgaagcacgagggcggcggcacggtgcgtgtctacaccgccgggatggccggcgcggtggccgacaccgcggcgctcggcgcgcagctgcgccaggcgatcgccggtggccagctgcgcctggagtatcagccgatcgtggcgctcgacggcagccacctgaccggcgtggaggcactggtccgctggcagcatccgcagcgcgggatgatcccgcccggcgagttcattccggtcgccgaacgcaccgggctgatcgtgccgctcggcgagtgggtgctgcgcaccgcctgcgagcagcacgccgcgtggcggaccgagctgggtccggacgcaccggcccggatgaacgtcaacgtgtcggcgcggcaactgtcggaaggggacttcctggagcgggtggtgcacatcctggcggtcaccggcatgccggccgaactgctcaccctggagatcaccgagagcaccgcggtggcgctcggcgaggagtcgaccggcaagctggaggcgttgcggcggaccgggatccggatcgcgctggacgacttcggcaccgggcagtcgtcgctgaccctactgcacgagctgccggtcgaccagttgaagctggaccgctcgttcgtcgaggcgacccagggccgccggctgaacatgccggccgcggtgtttgccctggccggcgcggccgggctggacatcgtggcggaaggggtggagacgccggagcaggcggaccggctggccgcgctcggctaccgggccgcgcagggcttccacttcgctcggccgatgccggccgatcagctggtgaactcctgcaggcggccggagatgtcgtcggcggtcgccgcccgctga

SEQ ID NO: 310 - DNA, 1155 bp, Actinoplanes utahensis
atggtaccggcgaggttcggggcggatcgggcgtggggcgagcgagccgcgcggccgctgcggatcctggccggcaacggcgcgcggccgagcaatgcggaactcgccgcgctgcgggccggcctgacgcgtcgggacgagccggcggccgccctggtccgggcggtgcgggagtccccggtgctgaccatcggcgacctgcaccggatcgtcgcggcggggcccgccgaggacctgccggagccgttcgccggcttcttcgcgacggtcgcgcggcggcccgactgggtcgacgacggcctgctggagcgcggggcgcaggcctgccgggcgttcgggatggacgccgggctggtgctcgcctacgggtcgctgctcggcggataccggaccggcgcggcgctcgaacccctggtccggaccgggcgcctgaccggcggcgagacgctgcggcggatcaaggagacgtcgctctggtggcggtcggtcaccgcaccgggcggccttgccccggacggcgccggtctcaaggcgaccctgcacgtacgcgtcttgcacgccctggtcaacgcccgcctggagaacgacccgacctgggatcacgccggccgtggtctgccgatcaaccagtacgatcaggcgagcacactcggcgtcttctccaccagcttcctgctccaccttcgcctcctcggtgtccgtgtgacccgcgccgacgcccgggccgtgatgcacctgtggtgttatgtcggctggctgctcggcgtcgacgagcagtggcttccgcacaccgaacgccagggccgccgccagctctaccacttcctctcccacgacccgcccccggacgcgaacagcgtcgccctggcccgggccctgatcgcgatgaccgacgacgtcacccacggctggcgccggaccttcgaacgtgaacgagccctctcggtcagctcctggcttctgggccgccacgccctgcgcgacctgggcctgccttaccgcccgccctggtacgccctgacgcgcgtcgccgccaacctcctgatcacgcacgtcctggcgcggctgcccggcggccgcacccgtctcctgacccgcgccgaacgccaggcccaggctcagttcgcccgctggggcgccgagctgcccgcctga

SEQ ID NO: 311 - DNA, 735 bp, Actinoplanes utahensis
atgtctcagcagcgagtggcgatcgtgaccggcgcgtcgcgcggtatcggccgggcggtcgcgcagcggctcgccgccgacggcgccgcggtggtcgtcggctacagcggcaacgccgcggccgccgccgcggtggccgacgagatcaccgcggccggtggccgggcgatcgccgccggtgccgacgtcgccgacgaaaccgcggtcgccgccatgttcgacttggccgagcaggcgttcggcggcatcgacgtggtggtcaactcggccggcatcatgcacctgtcccccatcgccgagctggacctcgacgacctcgaccggatgcaccgcaccaacatccgcggcgccttcgtgatcgcccgcgagtccgcccgtcgtctccgcgccggtggcgccctcgtgatgatctccacgtccgtgctcggcctgcagttccccacctatggcggctacgcggccagcaagggcgccgtcgaggcgatgaccatgattctcgcccgcgagctgcgcggccgtgacatcacggtcaacgcggtcgcgcccggccccaccgccaccgacctcttcctggagggcaaggaccaggccaccatcgaccgtctggcccagcagccgcccctggagcgcctcggcacaccggcggacatcgcggccgcggtcgccttcctggccggcccggccggccactggatcaacggtcagacgctgcgcgcgaacggaggcatcatctga

SEQ ID NO: 312 - DNA, 627 bp, Actinoplanes utahensis
atgacggggctgcgcgatcgatgccccggacggcactatggcgggatgacggggagagacaacgacgtacgccgaccgtccggtttggtcaccggttcgctgatcgggctcagtttcggcacggtcttcgtgatggtgaacagtggcgatctgcccgatccctggccgacggtgatccgggcggccgccgtggtgaccgccgccgctctgctgttctggatgttccgggtggtccggtcggccgggtcggcggccgggagcgacgacgtgcaggggttcgcccaccgcgcatactggtatgcggtcgtcggcgaggtgatcgcgctcttcggcgggctgtatgtgatcaatcaggtgctggacaagccggacgtcgcggtcgcctgggtggcactggtggtcggggtgcacttcgccccgctggcgtgggcctggcggatgccgttctactactggctggccgccctcatggccgcactcggtctcggtggtctcctggcgtatgccgcgggcgcctcggccggcactgtcgccctgattgcgggtgtcggctcgggcttcgcgctgtacggcgccgtcgcggccggccttcggtacgctcagcggcgcgcggcttccatcgtctga

SEQ ID NO: 313 - DNA, 984 bp, Actinoplanes utahensis
atggtcgacatcggttgggtacgcaggatggacgcgatcaccggtggtgcgatcgtgctgaccgtcgatgccgtcatcttcctgatgaccgctctggtgggcgcgccgctgctgctgttcttcatggcggacgacgagggtgccgggccgctgtggccctacgcgaccgtgtggggtgtgtccgcggtgctgggtgccgggtccgcggcggtggcctacctgatcggcgatcggggcacccggggcatccggcagatcggcgcctcgatcgcgctgaccaccgcggtggcgaccggcgcgctggtggtgggcgcgatcgagtcctcgccggtcctggcgatggtcagtgcgctgttcgcggcggcgaacgtcggcgcggtgaagatgcttctcggcccggagccggtggaggccggtccgccggcgctgccgaacacgttcctgctcgcggctccgctcgcggaggccgagttccgcacccgggagaccgtcgagatccaggtccgcccggcgcccgcgatcgcatcgggggacacggaggcgcccgcgatcgtatcgggggacacggaggcgcccgcgatcgtatcgggggacacggaggcgcccgcgatcgtatcgggggacacggaggcgcccgcgatcgtatcggcggacacggaggcatccgcgaccgcatcggcggacaccgaatcggccgccggcgagcgccgggacgagaagaccggggccggcgagacgacccgcaccgagtcgcagaccggcttggcggcattcagcgggacgatcgacgccgggctggcggacgtcgacgcggcgggcggcgagtcggattcagaggtggctgaggccgagtcggtcgatgtcacatcaccggcacgacggatcgtcgggcgcgatccgcggatcaggccgcgaggctcggccgcgatgcacaccatgggcggcgtccgcctccctccgagagccacgcgccggcgaagctga

SEQ ID NO: 314 - DNA, 777 bp, Actinoplanes utahensis
atggtggacggcgcggatgttttggaggtcgctggacgattggggccctatttccgttgggagccggtgaacgacgccgcggactggcggccattccgcgacctgctggaccacaacgttgcggccgagcgggtagccatcgcgcggagcaccctggtacggatgtcaggcctcaccccggacgccatcggcgaacgcgaaaccgcctcgatcacctttctggggctggcctcccgcctgctgtccccgctgctcggcgccgcatcgatcgccggcgccctgccgctgcctgagcccgaccgcctgtggtggcggccggtgcccggcggtcctgtgccggtcgcctaccgcgccgtcgacgccgtgccctgcacgaccgaacccgcgacggtcatcgccgcccgcttcaccgagaccgcattggcccggctgaccggcccgctgctcgaaacgttccgaacgcggttctccctgtccccgcaggtgctgtggggaaatgtggcctcggctctcggcggggccgccgggatgatcgccgaccagtccccgccacacgcgtcccgggccgccgagatcctcgaagccctcctgctccgcgcacccctgagggccaccgccgacctggtccgacccgacccggctcgcgaccgccgcttcctggtacgccgcaactgctgcctgtattaccgcatccccggcggcggcacctgcggcgactgcatcctgaccccacccaccgaccgcgagaaccactggcgcgcagtcctccaccgctga

SEQ ID NO: 315 - DNA, 1704 bp, Actinoplanes utahensis
atgaaactggaggtacgacggctgtggccgatcttcgccgcattgaccgcgtgcgtcctcggctttctgctcctgcgccaggtcgcgaccagcgccttcgatggtctggaagcgcggcaggtggcccaggacgccgaccggatccggatcggcctggacaaccaggctcagctgctgaccgctttcggggtcacgaacagcatctgggacgaggcctacttcaccatcgcccggggcgacgaggccgctttcgatgtcgactatccgccggccagccagcatgacgacaacggcctggacggcgttctcggtgtttcggcggccgggaagctgctggtcggcggtctcaccgacggtggtgacaggtttaccgcactgcccgccgacctgaacgacccggcgctgctcaagcggctgtacgacccgaacgcccgggccggcaccccgacctgtggggtgctcgcggccggcggcggctacctcttctgtgggctgggcgcgttccgcagctccggcgagggcgccccgtcgggcggtttcatcatgctgaaacggctggacgccgcccggctggccggcctcggcaaggagctgagcctgagcatcggcctggtcggcggcgtccggccgggcgcggtcgcgcagccggcgctgtccagccggatgggcgccgtgcaggtgcacaccgcggtgctgggcaccgaccagatggcggtcgacgcgagcgtcgccacggtcgacggtggcagcctcaccatggaggcggtccagcctcgaccgatctatcaggcggcgacgcgtaccgcctggcggcttttcgccctgatggtcgtcgccaccctgctgctggtgctgttcatgcgctggtcgacgcgccgcgcgttgcgggtgcgggtgcggccgttgcgggagacgacggagcagatcatcgcgtcgggtgatcacacgttgcggatcaatgcgtccgggtcggacgatctggccgcgctgggccggacggtcgacggcatgctggaccggatcagtgcgaacgaggagttgctgcgcaccgagcaggagcagcggcagcaggagttgcagcgggcgcacgacgagcagaccgccgcccagtcggcggcgcagcgggccgcccgggagctggtctccggcacgtcgacggtggtcagcgcgcagctggcggacgtctcggagcgggccggttcggtgagtgccgcggccgcccggatcgagggtcaggtggcggatgtccgggaggtcgccggccggctgctgaccgggaacgccgaggcgacgggtgcgatcggcaccctgcacgcgagcctggcccaggtggacgaggtggcccggttcatcggcgggatcgccaagcagacgaatctgctggcattgaacgccacgatcgaggcggcccgggccggtgcggcgggcaagggtttcggggtggtggccgacgaggtgaagtcgctggcactgaccacggccgagtccacccggacgatctccaccacgctcgacgagctgaacgagcacgtcgccgcggtcgtggagatcatgtccgggatgagcgccgcgatcaccgacatcgacgcgaccacagcccgcgcccagtcgatgacggccgagcaggcgaccacgctgaccgcgctgaccggacaggtgtccgcggcgatcaggaagctggacgacctagcggttgctgactga

SEQ ID NO: 316 - DNA, 543 bp, Actinoplanes utahensis
atggctatcgacattcacggcaaacgcatcgccttcctcgccaccgacggtgtggaggaggtcgagtacaccgagccgcgcaaggcggtggagaacgccggcggcaccgccgaactcatctcgatcaaggacggtgcgatccaggcggtcaaccacctggacaaggccgggacgtacgcggtggaccggctggccaaggacgccgccgtcaccgactacgacgccctggtgctgcccggcggggtggcgaaccccgacttcctgcgcgccgacccggacgcggtccgcttcgtccgcgacttcgcggcgaccggcaagccggtcgccgcgatctgccacgggccgtggacgctggtcgaggcgggtgtcgtcgagggccggacgctgaccagctggcccagcttgcggaccgatgtcaccaacgccggagcgacctgggtggacgcggaggtccacgtcgacggggcgctggtgaccagccgcaagccggatgatctgccggccttctgcgagcagctgctccgctcagtcagcaaccgctag

SEQ ID NO: 317 - DNA, 495 bp, Actinoplanes utahensis
atgactgttccgacttgggtgaagacggcggccggggtggtggccgcggccggcgccggagtactggccaccgatccggattcgcggtggtaccggaggctgcgcaaaccttcctggcagccgcccccggcggcgttcccggccgtgtggaccccgctgtacgcgctgatcgccgtggccggggcccgcgcgatcgaccgggcggaagggtcggagcaggcggatctggtccgggcgtacgccgtcaatctggggctcaacgcggcctggagcggcttgttcttcggcgcgaagcggccgaaggcggcgctcgccgagatcctcgccctgaacgtgtccaacgtcgtactgctgcgtcgggcggcccgggcggaccggctggccggtgccgccctggccccctacgtggtctggacgatgttcgcgaccgccctgaacacggcgatcgtacggctgaacggaaacggctccggtgtcaggacacggtcaggttga

SEQ ID NO: 318 - DNA, 1506 bp, Actinoplanes utahensis
atgagcagtgaccgcattcgcgcactcgccctgtcctgcctcctgaccgtcggcgccttggttccagcggcgccggcgctggccgacgccggtcaggacggcaacccgggagcatccgtgaccgatcctgatatgccgacgctgggaagccggctggacgcggtgcgcaccgcgaaaacgatgaactactatccgtccgcggccggctggaccgcgatgtggacccgtttcgacccgattcaggtggacagtgacctggagcggatcgcggcactgggcgggaccaccgtgcggctcgtggtgttcccgaaggtgttcggcttcccgcagccggaccccgactacctggccgagctcagcgacatcatcaacctggccggcctccaccgcctcaccgtgaagttgacgctgttcgattggtggtcccggtacagcagtgtcaatggcagcgttacctgggcgaacgcggtcctggcgccgtatgtggacgacccgcgggtgatcgcggtcgaggtgaagaacgagatgtcaccggatgacgcggaggcgatcggctgggcacggcgggtgatcccggcgatccgcgagttcgcgccgtcgatgccgctgaccgtgtcggtcgacgggcacgccggcccgtccgggctggcccggctcaaggacgtgctcggcgacgacatgctgaactactgggacttccactactacgggccgtctgagcaggcgctgaccgagatccggcgggcacaggagatggtcgcgccggatccgatggtgatcggcgagaccgggctgagcaccgccggcagcagccagggtgcgcaggccgtctatctggcccgggtgttccgggccgccgccgaggccggcgtgggttcggtggcaccgtggacgctgaccgatttcgccccgggggcgataccggccggctcacaggtttccgcacagccggcgcagtaccggttcggcctgttccgggccgacggcacggcaaagccggcggccgcggtggtgcgcgacgcgtggagcggcacgacgcccggcgacgacctgctggacatgagcttcgaacgcgacagcgacgactcgccgtggcaggacaacctgccgggcgccggggtggcgacgcagaccgacgagacggcgcacgacgggatctactcggtgcggttctccggcaccgggcgggacccgcgcgggctgccctcgctgcggatctcaccgctcaccccggtgcacggcgggcagacctggtcggcctcggcctgggccaaggggctcgacctgaccggcaccaccgagatcgccctgagctggttcgacgcccagggccggtggatcagccaggaccgctcgctgcggctgccgccgggcaccaccgactggacccggctgagcgtcggcgcgatcgccccgccggacgccgccgcgctgcagctgcacctcaagtccggggacaacgccggcgcggcctggttcgacgacgtcaacctgaccgtgtcctga

SEQ ID NO: 319 - DNA, 126 bp, Actinoplanes utahensis
gtgaacaagcacttcgagcggacgcgggggatcgacgacacgatgaccagggaatcggctcaactgttggcgagcttcaaaggggcgaagcaccgcccggcgcctcgcccatcgccgtcagattga

SEQ ID NO: 320 - DNA, 1050 bp, Actinoplanes utahensis
ttgcccgccgatccacccaccccgtacgtcgccgtcgacgccgagatcctcgaccgcaacctgcgcgcgatggccggtcgcgggctgccgctgcgcccgcacgccaagacccacaagtgtgtcgagatcgcccgccgccagctcgagctcggcgccgacggcctcaccgtggccaccgtcagcgaggccgagatcttcgccgacggcggggcggacgacctgttcatcgcttatccgatctggccatccgggcagcgcgccgaccggctgcgcgcgctcgccgcccgggtggcgctgcggatcggcgtcgactcggcggagagcgcggcggccctcggccgcgcggtgcccgggctggaagtcctggtggaggtcgacagcgggcatcaccgcagcggtgtcgcacccggctcggccggggagatcgcggcggccgccgaccgggccgggctgacggtccgcggagtgttcaccttccccgggcacgcctacgggccgggccggatggcggcggccgtgtgggacgaggcggacgcgctgaccgaggcggccgccgcggtggcggccgccgggctggacgccggcgtccgcagcggcggctccaccccgaccgcggcgctgaccggcgccggaccgctcaccgagatgcgccccggggtgtacgtgttcggtgacgcccagcaggtcgaactcggcacctgcggctgggacgaagtggccctgaccgtggaatccaccgtggtcagtcgctccgggcgccggatcatcctggacgccggcagcaaggtgctcggcgccgaccagcaggcctgggccaccggcggcggccggctcctcggccacccgcaggcccggatcaccgccctctccgagcaccacgccacggtgctcttccccggcgactccccgcttcccggactcggcgaccggctctgggtcgtcccgaaccacgtctgcgccacggtcaacctggccgacgagctggtcgtgacgtccggcggcgagctgatcgaccggtggcgggtggccgcccggggcgccaacacctga

SEQ ID NO: 321 - DNA, 423 bp, Actinoplanes utahensis
gtgctgactttcgatcccttccgggagttcgaccggatgatgggcgccggtgccgccggtctggcgatgccgatcgacctgtaccgctccggtgaccacttcatcctgcactgcgacctggccggcatcgacccgggctcggtccaggtggacgtcgaccggcgggtgctgaccatccgcgccgagcggtccgcgcgcaccgacgacgacgtgcagtgggtgcgccgggagcgcccgaccggcaccttcgagcgacggatcaccctcggtgacggcctggccctcgaccagatcagcgcgacctggcaggacggcgtgctcacgctgaccatcccggtcgccgaggcggccaagccgcgccgcatcccgatcagcaccggcgaccggcacgagtcgccggcaccggccctgaccgagtcatag

SEQ ID NO: 322 - DNA, 1611 bp, Actinoplanes utahensis
atgtccttgacgtgcaccaatctgtccttttcctggccggatgacaccccggtcttcgacgatctgaccctcgcggtgccgcccgggcgcaccggtctggtggcggcgaacggatccggcaagagcaccctgttgcggctgatcagcggcgagctgcgaccgaccggcggcagcgtcgtggtcgacggcgtgctcggctatctgccgcagcatctgccgttcgccgcggagcggagcgtcgccgaggtgctcggggtcgaccggatcctggccgcgctgcacgccatcgaggccggcgatgccgccgaggagcatttcaccaccgtcggtaccgactgggacatcgaggagcgcacccgcgccgagctggaccggctcgggctcggcgggatcgggctgggccggcggctggccaccctcagcggcggccaggtggtctccctcgggctcgccgcccagctgctgaaacggcccgacgtgctgctgctcgacgagccgaccaacaatctggacggcccggcccgggaccgcctcaccgcggtgctgcgcggctggtccggcacgctgctggtggtcagtcacgaccgggcgctgctcgacgggatggaccggatcgcggccctcgaccacggtgagatccggtggtatggcggggacttcaccgcgtactccgcggccgtccgatccgaacgggaggtcgccgagcgccaggtccgcactgccgagcaggacctcaaacggcagaaacgcgagatgcagcaggcccgggagcgggccgcgcggcgcgcgtcgaccgcggcgcgcaccctgggcgacgccgggctggcccggatcgtggccggtggcctgaaacgggatgcgcaggtgtcggcggcgaaggcgaacgagacgcacgcgaaccgggtcggcgacgccagggcccgtctcgaccaggcgtcgcgcgcggcgaagcaggacgacaggatcgtcgtggagttgccggacaccaccgtcccggccgggcgcaccgtcttccacggcgaaaatctgcaggtggcgtacgacggggtgccggtgttcgccgcgcccggcgtcgatctggacatccgcggcccggaacggatcgcgctgatcggcccgaacggcgccggcaagtccaccctgatgcgtgtcctcaccggtgatcagcggccggatgccggcgagctgacccgggccgacggccgggtggcgtatctgtcgcagcgcctggacctgctcgatcaggatcgcaccgtcgcggagaacctggccgcgtgggccccggcgctgcccgacgccgaccggatgaacctgctggcccgcttcctgttccggggtgcccgggcgcacctgccggtccgggcgctgagcggcggcgagcggctgcgggccacgcttgcgtgcgtgctcttcgccgaaccggcgccgcagctgctcctgctcgacgagccgaccaacaatctcgacctggacagcgtcgggcagctggaggccgcgctcagtgcctatcggggagcgttcgtcgtggtcagccacgacgaacgcttcctcgacgagatcggcatcacccgccggttgcgactcgacggcgggcggctcgcggaactatga

SEQ ID NO: 323 - DNA, 264 bp, Actinoplanes utahensis
atggacgccgagcaggagttgaccgaccgggtggtggcgtccttcgcggacactcccgacccgcggctgcgcgaggtgatgcggtcgctcacccggcacctgcacgccttcgtccgcgacgtgcggctgaccgaggacgagtggcgcgccgcgatcgccttccggacggccgcgacctcggtgatcgcccgtggagccgggtccgcttcgacatcgtgctggctccggccgccgaccctccgcttcgatgatcgagaagcatga

SEQ ID NO: 324 - DNA, 948 bp, Actinoplanes utahensis
atggaactccggcacctgcgctccttcgccgcgctcgccgaggagcggcacttcggccgggccgccgagcgcctgcacatcgcccagccggccctgtcccagcaggtcaagcagctggagcgggagttcggggtggagctggtcagccgcaccacccggcgggtcgagctgaccgaggccgggctgcgcttcgccgagcacgcccggaccgtgctggggtcggtcgaccgggccgccaccgacatggcgatggtcgcctccggccaggccggacgggtgtcggtcggcttcatcggcaccgcgacgtacgagctgctgccgctggccgcccgggaggtccgccgtctgctcccggaggtccgcctggagctgcacggcgagctgctcagcccggcactgctcgacggtctgctggacggcacctacgacctcatcgtcctgcgcccggacagcctgaccacgccgcgcacggaaacgcgcccggacaacccgaccacgccgcgcacggaatccccgggcgccgacatccgggtgctgcgcaccgaacggctggtcgccgtcctccccgactggcacgaccttgccgaccagccccgcatccacctgtccgacctcgcccccgaccccttcgtcatgcacttctccggccaccgctcgtccatgcacgagcacgtcctcaccgcctgcgccgccgccggcttccgcccgtcctcgatcatggaggtcggcgagaccgccaccctggtcgtcttcgtcgcggcgggcctcggcgtcgccctcgtcccggaggcggtccgcagcctggccctggagggcgtcgtctaccttccgctggatcaggcgccgaccatcgacctggccctggccacccgttccggggagacctcccccgcggtgcggcaggtcgccgagatcgtgacccggtgcaccgggatcggatggcgttaa

SEQ ID NO: 325 - DNA, 1176 bp, Actinoplanes utahensis
atgaactccgcctacctgtacgccgcggcccggaccccgttcggccggttcggcggcgccctcgccgacgcccgtcccgacgatctcgccgcggccgccctgagcggcgtgctggccaaggcccccggcctggacccggccgggatcggcgacgtggtgtggggttgtgcgaaccaggccggcgaggacaaccgtaacgtcggccggatggccgtgctcctcgccggcctgcccgtctcggtgccggccaccacggtcaaccggctgtgcggctcctcgctggacgccgcgatcatcgcctcccggaccatcgagtccggcgacgccgacgtcgtggtggccggcggcgccgaatcgatgacccgggccccctgggtgctgcccaaaccgtccagagcgttcccggcgggcaacgtgaccgcggtgtccaccacgctcggctggcggctgatcaacgagcggatgccccaggagtggaccatctcgctgggcgagtgcaacgagcagctgggcgacaagttcggcatctcccgcgagcggcaggacgagttcgcggcccgctcgcaccgcctggccgacgccgcctgggccgccggcttctacgacgacctggtcgtcccgcaccccgctctcacccgcgacgagggcatccggcccggctcgtcggcggccaccctcgccgggctcaagccgtcgttccggccggacggcacgatcaccgcgggcaacgcgtcgccgctcaacgacggcgcctcggccgtgctgctcggctcccggtccgcggccgaccggatcggcgtcgccccgatcgcccggatcgccggccgcggcgtctccgcgatcgagccgaccctgttcggcttcgccccggtcgaggcggccgaccgggcgctcgcccgggccggcatcacctgggccgacgtcaccgcggtcgagctcaacgaggcgttcgcggtgcagtcgctggcctgcgtcgacgcctggggtgtcgacccagagatcgtcaacgccaagggcggtgcgatcgccatcggtcacccgctcggcgcctccggcggccggatcctgggtacgctcgccgcccgcctgcgcgagtccggcggccgctacggcgtggcggccatctgcatcggcgtcggccaggccctcgccgtcgtcctggagaacgtcgcgtga

SEQ ID NO: 326 - DNA, 660 bp, Actinoplanes utahensis
gtgaccgcccggatcgtcgcgaccgccgccgaagcggtcgccggcatcgcggacggctccaccgtgctgatcggcgggttcgggatggccggcatgccggtgcacctgatcgacgcgctgatcgagcagggcgccaccgacctcaccgtggtctccaacaacgccggcaacggcgacaccgggctggccgcgctgctggccaagggccgggtccgcaagatgatctgctcgttcccgcggcagtccgactcgtgggtgttcgacgggctctaccgggccggcagaatcgagctcgaggtggtgccgcagggcaacctcgccgagcggatgcgggcggccggcgccgggatcggggcgttctactgcccgaccggggtcggtaccccgctcgccgagggcaaggagacccgggagatcgacggccggacccacgtcctggagttcccgatcaagggggatgtcgcgctgatcggggcgtaccgctccgaccggatgggcaacctggtgtaccgcaagaccgcccgcaacttcgggccggtgatggcgaccgcggcgacactggtcatcgcccaggtccgcgaggtggtcgacaccgggcggctcgacccggaagtgatcgtgaccccgagcatctacgtcgaccgggtggtggcggtatga

SEQ ID NO: 327 - DNA, 645 bp, Actinoplanes utahensis
atgagtctcgacaagcacgagatggccgccctggtcgcccgcgacatcgagcccggctcgttcgtcaacctgggtatcgggcagcccaccctggtcgccgaccacctgccccccgaggcgggcgtggtgctgcacaccgagaacgggatgctcaacatgggcccggccgccaccggcgaccggatcgacccggagctcaccaacgccggcaaggtaccggtgaccgagctgcccggctcggcgtatttccaccacgcggactcgttcgcgatgatgcgcggcgggcacctcgacgtctgcgtgctcggcgcgttccaagtgtcggcccgcggcgacctggcgaactggcacaccggcgaggccgacgcgatcccggcggtcggcggggcgatggatctcgcggtcggggcgaaaagcgtctacgtgatgatgacgctgttcgccaaggacgcaagcccgaaactggtgcccgactgcacgtacccgttgaccgggctggcctgtgtcgaccgggtctacaccgatctggccaccttcgcgatcaccccggccggtgtggtcgtccgggagaccttcgggatcaccttcgacgagctggccggtcggctgacgattccgttgctcaggatgtcctcatcggagtga

SEQ ID NO: 328 - DNA, 930 bp, Actinoplanes utahensis
atgcggctgggcgtgaaccttccacagaccgaccggtacgacctggcgcgggacgtgaccgtgttcgcccgggccgcggaggagatcggctacgacagcctgtgggcgtatgagcggatcctcgccccggtcgacaccagcgggccgcacgggctctacggggtgcccgacctgccgtggccgccgagctactcgcacaccaccgacgcactggtcaccttgagtctcgcggccgccgtgaccagccgggtcgagctcggcaccagcgtgctcgtgcccgggttgcacctgccgttccggctggcccgcagcatcgccgcgctcgacacggcatccggcggacgggtcatcgccgggctcggcagcggctggtcgatcgacgagttcgcggctaccgcaccccggccgatcgaggagcgcggggcggcgctcgacgaattcctcgacatcgcggccgcggtgtgggggcccgacccggtgtcgtacgcgaccgaccggtaccggctcgcgccgagccgggtcaacccgaaaccggcgcggcgggtgccgatctacctggccggcggcaaccggaccgccctcagccggatcgcccgccgcggcgacgggtggctgcccaccggggtgccgccacagcaggtcgggcggatcctgggtgaactgcgggccgaggcggcggccggtgggcgtgatccggagtcgctgacctgcatcttccagctcggggtgcgcgggctcgccgaggcgccggacgaggggcgccagccgtacacgggcagcctgcgccagatcgtcacggacatcgcggccctggaggaggccggagtggatcatgtcttggtgacgctggcttcggtcgccggtgacctcaaggaactgatcgccctcgccgagaccctgcaccgcgaggcgcgcgccgccggcctctga

SEQ ID NO: 329 - DNA, 1020 bp, Actinoplanes utahensis
gtgaagagatacgttccgctcgtcctgctactgctcgccgcggcactgccgtactcggcgatctcgctgcccggcctcttcgaggggccgctcaactcccccggcacgctgcagctgctcgccgtctgcctggtcttcggcgggctggcgctcggctacgacctgctgttcggccgggccgggctgctgtcgttcggccacgccctcttcatcgcggccggcgcgtacggcgtcgacatcctgatcggccactacggctggtcgctgtggggcgcggcggcggtgaccgtggcggccgcggcggtgctcgccgggctgctcggctcggtggcgctgcgtacctccggcatcgccttctccatggtgacgctggccttcgccgaggtgggccacatcctggtcaaccgggatccgggtgggctgaccggcggcgaggagggtctgccgatgcggacggcgggactgccggaccggctggtcggggtgagcaacacggtcaacctgtactggctggcgctggcgtccctgatcgtggtcgtcctggtggtgcacgccatcgatcgggcaccgctgggacggacgctgaccgggctgcgcgacgacgagcgccggatcgcggtggtcgggctcgacccgtaccgggtcaagcttgtcgccttcgttgtcgcgggtgcactggcgggcctgggcggggtggtgtacgccctggtcacggcgggtgcgtcgccacacgtggcgtcctgcgacctcaccctgacgctgatcgtgatggcggtgctcggcggagcggggacgagatggggcgcgctcgccggcggcatcctgtacgcgtacctcgaccagcgtctggcccggctgggcgggcggctgcccgggccactcggtgagccgctgttcgtgctcggcatcctgttcatcctggccgtctacttcgtgccgggcgggctggccgggttgcgcgcccgcctggaaccgctgcggcgggcggtccgccgccgggaggcgctccccaccccctga

SEQ ID NO: 330 - DNA, 867 bp, Actinoplanes utahensis
atgtccaccgtggtcctgctgaccctgaccgggctcggtctcgcggccctgtacttcctgatcgcctccggtctgtccctggtcttcggcctggccggggtcctgaacttcgcgcacggcctgttcctgtcggccggcgcgtacgccacctggtgggccgccccgcactgggggctgccggccgcggtggtcttcggcatcgccgtggccgccgccaccggggccctggtcgagctgctgatgatccggccgctctacacccggcacaccgagcaggtgctggtcaccgccggcctgtcgctggccggggtggcgctgttgcagtcggtgtggggcgccgacgcccgggtgttcccccgcccggcgtgggccgcgcacgtcaccggggtgctcggcgcgaccgtgccgaacgaccggttcctgctgatcggcgcggccgtgctggtcgtgatcgcgctcaccatgttcctccggtacacccggtacgggctgatcatccgggccggcgtcgagaaccgggccatggtccgggccctcggcatcgacgtgcgcatcgcgttcaccctggtcttcgcgatcggcggggcgctcgccgggctggccgggatcctcggcgggatgtacttcaccgcggtctcccccggccagggcgcctcgctgctgatcttcgcgttcatcgtggtggtgatcggcggcctcggctcgatcaacggttcggcggtcgccgcggtcggggtcggcctgctccagcagttcgtgaactactacggcgcggccggggccggcgacgtcagcgtggtggccctgctcgccatcgtgttgctgatccgcccggccgggatcgccgggacggcggtggccgcgtga

SEQ ID NO: 331 - DNA, 714 bp, Actinoplanes utahensis
gtgagcacgccgatcctgcgggtcgccgacctgtcggtacgcctcggcggctcgcacatcctgcagggcgtcaccttcgacgtggcgccgaccggggtgaccgccctgctcgggcgcaacggggtgggcaagaccaccacgctgcgcgcgatcctgggcgaggtgccggccgagggtgcggtcgcggtcgacggcaagccgatcctgggccgggccacccaccggctggtccgggacgggctcggctacatcccggaggaccgctgtgtcttcgccgggctgaccgtggcggagaacctgcgactcgccgagcgcaccccggagccggactaccctctggtccacgacctgttcccggagctggaacagcgggccgcgcagcgtgccggcacgctctccggcggccagcagcagatggtggcgatcgcccgggtgctgctgaacccgaaccggctgctgctggtcgacgaacccaccaagggtctggccccggcggtggtcaccgcggtggcgaccgtgctggcacgggtggccgaacgcgtaccggtgctgctcgtcgaacagaacctcgccgtggtccgcaggctggccggcgacgccgtggtgctcgaagccggccgggtcgcctggcgcgggccggccaccgacctgctcggcgacgccgcggcgacgaagtcgctgctgggcgtcggcaccaccgcggggagtcgctga

SEQ ID NO: 332 - DNA, 747 bp, Actinoplanes utahensis
atgacggccctcaccgtcgaggacgtgtcgtggcggatcggcgccgtgccgatcgtcgacgacgtgtccctgcacctggcgccggacgagttcgtcgccctgatcggcccgaacggcgccggcaagacgtcgctgttcaacctgatcagcggcctgcgccggcccagctccggccggatcctgctcggcagccgcgacctgaccgcgctggctgcgcacggccgggcccggctcggcctgggccgcaccttccagacctcggccgtcttcggaacgctgtcggtcaccgagaacgtcgcgctcgcggtgcaggcgcggcgcggtggcgcgatgcgggcctggcgtcaccgcgccgaccgcgacatcgcggtccgcgctgccgagataatggcggaggtacgtcttgagcaccgcgccgatcgcatcgccggctccctggcgcacggcgagaaacgcaagctggagatcgctctgctgctcgccggcgacccggccgtgctgctgctcgacgagccgatggccggggtcagcaccgaggacgtaccgaccctggtcgaggtgatccgcgggctgaccgccggcaccggccgcagcgtgctcatggtggaacaccacatggacgtggtgctcgacctggcggaccgggtggccgtgctgcaccacggcgcgctgctggcctgcgacaccccggccgcggtgatggccgacccgttcgtccagcgggcatatctcggggagggccggtga

SEQ ID NO: 333 - DNA, 1191 bp, Actinoplanes utahensis
atgcggtctttgtcgacatcccggcgtgccgtgctcggcgccgccgtgctgtccgccgtcgtggtcaccacgagcgcgtgcggcagcccgaaagacgcggccggcaacggctcctcgatcaacgtgggcgtggtctactcccagtccgggccgctggccagctacggcgcgcagtatgtggagggtttcaaggcgggtctcgcgtacgccaccgacaacaccggcaaggtcggtgacaagacgatcaccgtgacctacaccgacgacgcgggcgacccggtcaaggcggtgtcggcggccaaggacctgatcggcaaggggtaccgggtgctggccgggtccacctcctccggggtggcgctgcaggtcgccccgatcgccgccgagaacagggtgctgttcgtctccggtccggccgcctcggacggcgtgaccggcgcgaacaggtacaccttccggtccggccggcagtcgtaccaggacgtgctgaccgccagggcgtacctcggcgacggcaggaaggtgctggtcttcgcacccgacacggcgttcggcaagtcgaacgtggacgcggtcaccagggtgctcggcggggccggcgcgaccgtctccaccatcgccgtcccggccggcgccaccgacttcaccccgttcgccagccagatcaaggccgccgagcccgacctggtcttcgtggcctgggccggtaccacggcgggcgccatgtggcaggcgctcgaccagcagggcgtgctcgcttccaccaaggtggtcaccggcctggacctccgggccggctgggccggtttcggggccggcgcgagcaagctgaacctgctggcgcactacttcgacggggccaccgacaaccccgcctaccaggcactcaaggccgcggtgccgggcggccggaccgacctgttccacccggacggcttcgccgccgcgcagatgatcgtgcacgcgctgcaggccagcccggacgacaccgccaagatgatcggcgcgctggagggctacagcttcgactcggtgaagggcaggctgaccgtccgcgccgcggaccacgcgctgctgcagccgatgttccaggcccggctgaccggcgccggggacgcggccaccgcgacgctgaccggcaccgtctccgccgcggacaccgccccgccggcggccgcgatgaagggctga

SEQ ID NO: 334 - DNA, 822 bp, Actinoplanes utahensis
ttgtgtggctcgtccacatattcgcggtcgtcgctgatccgtacggtcaccggcatgacgacggcacgtgtggtcgacctcgacctgacaggacggaccgcgctggtcaccggcgcgggcagcggcatcgggcgggcctgtgccgaacggctggccgcggccggggccgaggtgcttgcggtggacatcgacgagcgtgcggccaaggagaccgcgacgtcgaccggcgggcgggcactggccgccgacctgtccgacccggacgccgtcgacacgctgccgggcgcggtggacgtgctggtcaacaacgcgggcctgcaggtggtggcaccgctgccggagttcccgccggacaagttcacgttgatccagcgggtcatggtggaggccccgttccggctcatcaggctggtgcttccgcacatgtacgaccgcggctgggggcggatcgtcaacatctcctcggtgcacgggctggtggcgtcgccgtacaaggccgcctacgtgaccgccaagcacggtctcgaggggctgtcgaaggtgaccgcgctggagggcgccgcgcacggggtcacctcgaactgcgtgaacccggccttcgtccgcaccccgctggtcgaccggcagatcgccgaccaggcgctggccaacggcatcccggaggcggacgtggtcgagaagatcatgctggaccgggcggcgatcaagaagctgatcgagccggaccaggtggccgaggtgctggcgtatctgtgcagtcccccggccgccttcatcaccgggtcgtcgatcatcatcgacggcggctggaccgcgcactga

SEQ ID NO: 335 - DNA, 801 bp, Actinoplanes utahensis
atggacgaggtcgacatcccggtagccggcggcgccctgcgggcggtgagctggccgggcgacgggccgctggtgatcgcggcgcacgggatcaccgccaacgcgctgtcctgggcggcggtcgcccgtgccctggggggcaaggtgcacctggtggcgcccgatctgcgaggccgggggttcagcgcgcagctgcccgggccgtacgggatggatacccatgccgacgacctcgtggcgatcgccgactatttcgggatttctcgggtgccgctggtcgggcattcgatgggcgggttcgtggtcgccgcgactgccgggaaacatcccgagcgggtgggtccggtgctgctcgtggatggtgggattgctctgggtgtgccggccgccatcgacgtcgacgtggccctggaggcggtgatcggcccggctatgcgacgactttccatgaatttcgactctgaagattcttacgtcgcttatttccgggcaaatccggcattgggtcgctactggagcgcggacctggaagcgtacattctgcgcgacttcaccggcaccggctccacctgcaacctcgcggcggtccgcggcgacgccgccgacatgctccgcaacccgcgcccggccccgttccccctgctctgggccccgcgcggactggccgacgaggacaccggcctctaccgcgccgaccagctcaccggcgtcgacgccgaacccgtcccggacgtcaaccactacacgatcctcaccgccggcgccggccatgtcgcctcacgcctgctcgccctgctctga

SEQ ID NO: 336 - DNA, 1383 bp, Actinoplanes utahensis
gtggtcgccgaacaccgcggcggcggcggtcaccgggaacagctccagcaccggccccaccaaggcaacgacacgatgcggcatggcgtgaatgtactcaatgttggcgggcccggcccctgcgccgccccacccccgccgaccaggatcctgatcatggatttgtgcgtgaccagcgctccgccggcgctgtggaccagggacttccggctgtacttcaccgcgcgggcggtgtcgctgctcggtgacgcgatgatgccggtggcggccgcgctcgcggtcggcgcgctgtacggggtggccggtgtcggctatgtgctggccgtcttcaccgcgccgttcgtgctgttcatcgtggtcggcggggtgttcgccgaccggatcggcgcacggaccatgatgatcggcgcggacgcggtgcgcgcggtcagccagggcgtggtcgcggtcgccttcctgaccgggacgccgccgctgtggctgctgctggccgcgtccgcggtgtccggggtgtcggcggccatgttccagcccggggtcaacggcatggtgccgctgatcgcccgggatccgcagcgggccaatgccaccctgaaggtcgccgacgccgccacccagctgggcggcccggtgctggccggcatcctgaccgcggtcgccggggcggccccggtctacgcggtggacgccgccaccttcgtgatcagcgggctctgcctggccctgatccggatctccccggtggccgcccgcgggtccgccaccctgctgcgcgacctgcggcacggctggaccgagttccggtcccgcatctggatgtggtcggtgatcctgatctggatgctgttcgggctgctcgtcttcggcccgtacatcccgctcgccgcgcagctggtcggcgggcggctgggcgacgcggcgtacggcacgacgatggccgccctgggcgccggcaccgtgctgggcggtctcgccgcgatccggctgcgtccgcgccggccgctcgccgccggggcggtcgcgctgatcggattcgccgcgatcccgttctcggtggcgctgaccccgccgctgccggtcctggccgccgggcacctgatcggcggcgcggcctgggcgttctggtcggtgatgtggtcgaccagtgtgcagacccgggtgcccggggaggtgctgaaccgggtcaccgcgtacgagatggccgggtcggtgtccggggtggcggtcgggcaggcgctggccggcccgctcaccaccgtggtgccaccccgggacctgatgctgctcgccacgctggtcacgctggtggtggtggcgctgctgctggcgatccgcccgatccgcggcctgcgtcgtgggtcagagcagggcgagcaggcgtga

SEQ ID NO: 337 - DNA, 948 bp, Actinoplanes utahensis
atgccgcatcgtgtcgttgccttggtggggccggtgctggagctgttcccggtgaccgccgccgccgcggtgttcggcgaccacgggcccgacctcccgcggcactactcgttccggatgtgcgccgagcggcccggcccgatccccaccacgctgggcaccgagatcgtcgtcccggacgggttggcggcgctggacgacgccggcaccgtgctgatcgccggctggaccccgggcccgcacttctccgccgagctgggcgacgcggtgctggccgcgcacgcccgcggcgcccggatcgtcgcggtgagctgcgccgtctacatcccggcccggctcggcctgctcgacggccggcgcgcctcggtccactgggagtgcaccgacgacctggcccggcgctacccgcagctgttcgcggacgggtcgatcctctacaccgaccacggtgacgtcgccacggccggagcgaccgcggccaccgtcgacctgtgcctcgcccaggtcggccgggagcacggcgcgggcctggcgatccggatcgcccggcagctctccgccggcccgccgcgcaccggctgccagcgtcagggccccgccccggcgtcgcccggcccggcgccggattcgctggccccgctgctcgactgggtggtggccaacctcgaccggccgctcaccgtccgggacatggcggcccgctccgggatgtccgagcgcacggtgacccggcacttcctggagcagctcggcgtcccgcccgggcggtggctgctcgaccagcggatcgcctcgacccgggcgctgctggaggagaccgacctgccggtcgagacgatcgccacccgggtcggcctctcctcggcggtgaacctgcgccggcgcttccggaacgccctggcgaccaccccggcggcgtaccgccgcatgttccggacccgggtgtga

SEQ ID NO: 338 - DNA, 1074 bp, Actinoplanes utahensis
atgtttccgcggcacgggatacgccccggggcggacgccgcaccggcccgcccggcggaagatcggggtcatgccccaccggcgcaccaccctgctgttgccggccgcgatcatcttcggtctcgtgctcgcgttgccgtacctgagcctggacccggcccgcagccggatcccggtccccggcgacctgccgtacgcggtcctggtggcgcacatcctcaccgccacggtcgcgctcgtgatcggcccgctgcagttcgcccggcggatccgggcgcaccggacgctcggccggatctatctgctcgccggggtgctgccggccgcggtcaccgcgatcccggtcgcgctctggttcggccgcccgctcacccgggtcagcctggtcaccgcggcgatcctgatccgccgcaccccgacgcccaggacgggaagtccccgatgaccacggttctcctcatccacggcggcctcggcgaggacatgaacgccgaccgcttctggcaccggcccggcgtcgtcaccgccctgcgacgccacggcgtcgacgtcgtcgcccccgaccgcctccgccggccgaccgactggaccgccgaggccgaccacctgaccaccctgctgcccggccacccggtcaccgtcgtcgccggctccaacggctgctccgccgccgtccgcctcgccctcgccgccccgggccgcgtcgcacggctcctgctggcctggcccgcgacggccggtgacccccgggtcgaccaccatgaccgccgcggcctcaccgaccgcggcacggacccggccgtcatcgacagcatgctgaccggtcagaccctccgcggcgtcaccgacgacgagctcgcggccgtcaccgcgccggtcggcgtgctggcgtcgatccccgccaatccgttccaccagcgccgcacggtcgacgccctgatggtcatcctgccgacggcagtcgaactgcccggctgcccggaaccaccccacccggccttccccgcccacgccggccgcttcgtccacaccgtcgtcgagttcggcaacctttcgggagccgcgcggagctga

SEQ ID NO: 339 - DNA, 621 bp, Actinoplanes utahensis
gtggccacttccccgcacgcgctgaaccatcccaccgtcgtcttctacggcgactcgatcgtcaccggctggcgcggcaccacacacccgcgcgcccggtggtccagcctggtcagcgacgagctcggctggcgcgaggtgaacctgtcgatcgacggcatgggctacttccgccgccgcggcccgcgcggcggcgacgaccggtacctgccgtcggccaccgacacgacgctcctcgacgccgccatccgtctcgacccggacgccgtcatcgtgtgcctggccgccaacgacatccgcatgctccccgagcacgccgacgaggtccgcgccgccatcgaccgcgacctgacccggctgcgcgacgagcttcccggccggccgatcctcgtcgtcgtgtactacacgggtctcgacctttccgagcgcgccatcctgatcaacagctggatcgccgacaccgcgaagcgtctcggtctgccctacttcgacaccttcccgcaggccatcgactacaactacgacctgctctgcgacgaccgctcgcatcccaacgacgacggacaccgagcgctcgccgacgcgatcctgccgacctgccgttccctgctgccgggctga

SEQ ID NO: 340 - DNA, 1830 bp, Actinoplanes utahensis
atgcgcagaaaacgctctctcggactgctcgtcgccgccgcggtcagcctcgtcgccggacttctcgcggcgcccggcccggccatcgcggcagcctcgctgccgtgcgacctctatgccgccgcgggcacgccgtgcgtcgccgcgcacagcgtcacccgcgccctgttcggcgcctacagcggccggctctaccaggtgacccgggcctccgacggcgccacccacgacatcgggacgctcgccgccggcggctacgccgacgccgccgaccaggacgccttctgcaacggcacgacctgccgggtcacccacatctgggaccagaccagccggcacaacgacctgcagatcgcgccggacggcggggccggcagcggcgaccggggcgccgacgcgagcgagatcgcggtgaccgcgggcggccacaaggtgtacggcatctgggtctcccccggcgtgggctaccgctacaacggcgtcgcgtccggggtggccgtcaacggtcagcccgagggcgtgtacatggtggccagcggcacccacgtgggctccgactgctgcttcgactacggcaacgcggagtccaccccgtacgacaccggcaacggacacatggacgcggtcagcatcgccaccacctgctacttcgcgccgtgccagggttccggtccgtggatcgaggcggacatggagaacggcatgttccagggcgggaacggggccaacccgaacccgggcaacaactcggccttcgtcaccgcggtgctgaagaacaacggccagacgacgtacgcgctgaagggcgggaactcccagtccggaggcctgaccacctggttcaacggcgggctgccgaccgacaagcagggttaccgcccgatgcaccaggagggcgggatcatcctgggcatcggcggcgacaacagcaaccgcaaccggggcacctggttcgagggcgcgatggtcgccggttacccgaccgacgcggccgagaacgcggtgcaggccaacgtggtcggcgtcggctacgccgggcagaccaccatcccgaacggcccggccggcaccgtcaccggccccggcggcaagtgcaccgacgtgtcggccgacgacaccggcgccaacggcgccgcggtccagatctgggactgccagtccttctcggaggatcagcgctggacgcacttcgccgacaactcgctgcgcaccctgaaccgctgcctggacgccaccggcaacggcaccgccaacggcacgccgctgcaactctgggactgcaacggcggcggcgcgcagaagttcgtccagcaggccgacggctcgctgcgcaacccgcagtccggccgctgcgtcgactcgccgaacggcaccaccgccaacggcacccgcctgcaactgtgggactgcaacggcgcggccgcacagaagttcgcggtcaacgccggcggcgtggtcggcaccccgggcggcaagtgcaccgacgtcggcggcgacgacaccggcggcaacggcaccgcggtccagatctgggactgccagtcgtacgccgtcgaccagcactggttccaccagtcgaacggcgccctgcgcaccctgggccgctgcctggacatcaacggcaacggcaccgccaacggcaccccggtcgaactctgggactgcaacggcgtcggcggccaggtctggcagcagcaggccgacggctccctgcgcaacccgcagtcgggccgctgcctggacgccccgaacggcaccaccgcgaacggcacccgcctgcagatctgggactgcaacggcagcgcggcgcagaagttcaccctgagctga

SEQ ID NO: 341 - DNA, 708 bp, Actinoplanes utahensis
ttgttctacgatcgtggcgtgaccgacgagtggggtgtgcggctggccggggatcgggccctgctcgatcgggggagcacggcggagcgggtcgccgacatcctgcggcagcggatcaccgagggcgtcttcctgcccggcacccggctcagcgaggagagcctgcgcgaggcgctcggcatctcacggaacacgctgcgcgaggcgttccggctgctggcccacgaggggctgctggagcaccaactcaaccgcggggtgttcgtgcggctgctgagcaccggcgacatccgggacctctacgcgatccgccggattctggagtgcggggcgctgcgcaacctgggtgcggtgccgccggaggcggtggccgcggcgcgggacgcgatcgaggcggccgaggcggccgccgagcgcggggagtggggtgcggtcggcaccgcgaacatgcgctttcaccaggcgatcgccgacctggccggcagccggcgggtggccgaggcggtccgcgggctgctggccgagttgcggttggtcttcctggtggtcgccgacccgcggcagctgcacgaaccgtacctggtgggcaaccgcgcgctgtacgaactgctcgccgccggtgacgcgcgtgccgccgaggaggcgttgcagcgctacttcgacgaggcggaggggcagctgctggccgcctacgaggccgccaactga

SEQ ID NO: 342 - DNA, 858 bp, Actinoplanes utahensis
gtgaccggggcactggaggtggtccgggcggggatgcgcacgacgatccaggatctgggcaggccggggtatgcgcatctcggggtgccgcgctcgggggcggtcgacggcggagcgctgcggctggccaaccggctcgtcggcaatccggccggggcggccgggttggagatcctgctgggcggcgtgcggctgcgggcgacgcgggcgacgacggtggcggtgaccggggcgccgtgcgcggtgcgggccggtgagcgcgcggcggatcccgggctgccgatcgcggtgccggctggagctgtgatcagcatcggacaaccgtgggcggggttgcgggtctatctggcggtcggcggggggatcgcggtgccgcccgtgctggggagccggtcgaccgacaccctgtccgggctgggaccggagcagatccgggacggcgacgtgctgccgctcggggagacccggggcatgccgcccggcgtggatgtggcgccctatcccccgccgcccgttgagctgcgactgcgggtgtggccgggaccgcgggacgactggttcaccccggccgcggtccggacgctgggctcggcggaatatcgggtggcggccgacagcgatcgggtgggggtgcggttggccggccccgggctggcgcgggccgtccgcggcgaactgcccagcgagggcctggtcctcggcgcgatccaggtgccggcgaacgggcagccactggtcttcctggccgaccatccgaccaccggcggctatccggtgatcggcgtggtcgacccggccgacgtcgacctgctcggtcaggcccgcccgggcaccgcggtccggttccggccggcctga

SEQ ID NO: 343 - DNA, 615 bp, Actinoplanes utahensis
atgcgcatattccgggccgggccctcggccgtgctcatcgagtgggccgacgggtccggggtcgccgccgcctaccggctgctcgacgccgcccggaaacaggggcggctgcgggccacggagatcgtcccggcggcccggaccgtgctcgtcgacggcgtcgccggcactgatcagatcaggacactgctgaccgaggccaccaccgcgccgccgcccgccaccggcccgtcgcgggtcatcgagattccgaccgtgtacgacggagccgacctcgacgacgtcgcgcagtggtggggcaccgaccgggcgggggtggtggccgtgcacaccggcaccgcgttccgcgtggcgttctgcggcttcgcgcccggcttcgcctacctcaccgggctcgggcccgagcaccacgtgccccggcgggcgacaccgcggacccgggtgccggccggcacggtcgcgctcgcgggggcgtacagcggggtgtatccgggggcttcgcccggcgggtggcagtgcatcgggcgtaccgccgccgtcctgttcgatctggagaatgagccgccggcgctgctcacgcccggggcgaccgtccgattcgtggtggccgcgtga

SEQ ID NO: 344 - DNA, 1296 bp, Actinoplanes utahensis
atgatcgccagtcgacgtgtcatcctcgccagcctgatcggcacctccctcgagtggtacgacttcttcctgtacgcctcggccgccgccctcgtcttcggcagattgttctttcccggattcgagccgctcaccggcaccctgctggcgttcgccacctacgcggtcggcttcgtggcccgcccgctcggcgggatcctgttcggacatttcggcgaccgcaccggccgcaagggcgtgctggtcgccacgctgctgctgatgggcggcgccaccttcctgatcggcgcgctgccgacgcacgccacgatcggcgcggccgccccgatcctgctggtcaccctgcgattcctgcaggggctcgggctgggcggcgagtgggccggcgcggtggtgatgtccctggaacacggcgacccgcggcgccgcgggttgtccgcgtcgtggccgcaggtcggcgtcccggccggcaacctgctcgccgcgggcgtcctgtgggtgctgtccgcgaccctgtcggaggcggcctttctcagctgggggtggcgtgtcccatttcttctttctggcgtgcttgtgctggtgggcctatggatccggggcacggtcacggagtcgccggcgtttgcggaactcgctgcggagggtggccgggcgcgactcccgctgatcgaggtgctgcgccgtcacccgcgcggcctgctggtcgcgatggccgcgcggatcggcaccgacgtcgcgttctacaccttctcgctgtacgtgctgacctatgtgaccggcaccgtgggccgcccgcgcacggtcgcgctgaccggcgtgctggtcgcctccggtctgcagctggggctgatcccgttcttcggcgggctctccgaccggctcggccgccgccccgtctacgccgccggggcggtcgccgccgggatctgggcgttcgccttcttcccgctgctggacaccgggaacaccgtggtcatcgtgctggcggtggtggtcgcgctggccgcgcacgccgccatgtacggcccgcaggcggcgttcgtggccgagctgttcgccacccggttgcgctactccggcgcgtcgatgggctatcagatcgccggcatcctgggcggcgcgctcgccccgatcatcgcgatcaagctggtcgcgtcgaccggcggcgcgctcgcggtcagcgcctacgtcgcgggggcgttgctgctcacgctggtggcgctggcgttcgcgccggagacgtcccgggacaccgggaccagcgcgccgctctccatcgccacccacacctga

SEQ ID NO: 345 - DNA, 879 bp, Actinoplanes utahensis
atgcccgcacttccctcaggctggacgccgtacgcggtgaccggcgacgccgacggcaccgtctggaccacgctgctgaagcccgccggcctggtccgggtcgccggcgacccggagctcgagcccctcgacgggcgcccgatgctgctcgccgccgaccggaacacgctctggtacacgcgctccgacgaccggatcggccgccgcgatccgtccggcacgcacaccacgttcgcgacgccggccggctcgtccccctacggcatcgcggtcgcgccggacggcacggtgtggttcaccgcggccggcagcgaccggatcggccgcctccgcggcggcacgatcaccatgatcgacctaccgctgtccggcgcccggcccgcaatgatcacgacggaccgcgggggtacgccgtgggccgccctcaacggcgccgaggcgctcgccgtggtccgtccgggcgacaccgtggagctggtgcggctccccgagggcagcgccccggtcggtatcaccgccgccccggacggcgtctggttcgccgacatcgcccgcggcctggccggtcgggtcgccccgtcgggagcgatcgacgagttccggttcccggatccggcctgccgcccgcacgcgatcgcccccgacccggccggcggctgctgggtcaccctgtgggggtcgaccgagctggcccgggtgaccgcgtccggcgagatcacccgccaccgcctgcccggcgcggagccacacggtctctgggtctgctccgatcaggtgtgggtggcgatggagagcggcgcgctggtcccggtgtcccgggacgtctccggcgcgaacgccagcgccaccagcgtgagcagcaacgcccccgcgacgtag

SEQ ID NO: 346 - DNA, 570 bp, Actinoplanes utahensis
atggcggacgctacccagatccccggcgcggcccgacccggcggccgcaccgcccgcacccggcgacaggtcctcgacgcggtcgcggcgatcctgctggagcacggcttcgacggcctcaccatggacgccgtcgccgagcgttccggcgtgcaccgggcgacggtctaccgccgctggcgtgaccccggcggcctgctcgccgacaccgtcgatgccgcgcgcgagctgccctgggagccgccggacaccggctcgctgctcggcgacctgaccgcgatcaaccgggaggtggtcgccgcgctgaccgcccggccgtcgatcgcccaggcgctgatcgccgcctcgttccggtcgccggccgcggcccgggcgctgcgcgacttctgggccgaccggtacgcccgggccaccgtcgtggtgacccgggcgggcgtgcccggcgacccgcgggacgtgctggtcgccgcctgcgcgccggtcttccacgagctggcgctgatgcgcgagcccgagcccggcgacctcgccgagcgctatgcggcgatcgcggtcagagggtcgaggtga

SEQ ID NO: 347 - DNA, 3885 bp, Actinoplanes utahensis
atgcgtctcgtcgccgcggcggcccacgatgaacgcccagggctgcgagttcccggcggacggcgcccaccgggccgcctccacgagcagatcggcctgggcggtgtccacctcgaacaccgggtcgaacgtggtggggctccaccgggcggcgagcagcggatgcagcccgggcgcgctcagttcgtcgtgcatccggccagcgtgtcacagccggcatcggccggagccgccgccgtcggaaggcttgtctggcgtgtgaggtccgtcataggatcgatgaatgtcagtatgaaacgtttcatatacccgggagttcgcatgaagggttccttcgcggtgctggcggccgcgcttctcctgatgccggtttcggcgcccaccgcggcggccgagccggcagtcaccctcgacggggcacattggatctggtatccggagggcgatccggccaccagcgcaccggcggccacccgctacctacgccgcgccttcaccgtcgcggcgagcgacatcgcgaccgcgcagctggtcgtcaccggcgacgacacgatcgacgtctgggtgaacggcgtccggctggccggctcgccgcgcgccgccgactcctggaagcgggcggtccgcgtcgatctggccgggtcgctgcaccccgggtccaacacggtggcgctggccgcgcgcaacaccggtgggccggccggggtgctcggccggttgcacgccggctcggtggacctggtcaccgacggctcctggcgggcggccaccggcgtaccggagaactgggcggatccggcgttctcggatgtcgcctggaccaccgcgaaggatctcggcgcctatggcggcggcccgtggggcgccggggtggcattgcccgacccggccgccgcgtcgccggtgagcgtcaccgatctgacggtgaaccggcaggccgacccggtcggggtggacactccgcgattcggctggcggctcgccgccggcaccgggggccagatgcaggggcgctatcagctcacggtgggcagcaccgcgggtgcggccgacgtctgggacagcggcatcgtcgcctccaccgcatcacgggacatcggatactccggtccggcgctgggcgcgaaccggacctacttctggcgcgtccgcgtctgggacgcacagggacgcccgagcgcctggagtgcgggcgcccgcttcgacaccggcatcgcactcaccgcggccttcgtcggcgcaccaccggccggtgatctgagcggcgccgactggatctggtatccggagggcgacccggcgacgagcgccccggccgcgacccggtacttccgccggacggtgacgctggcgaccagcaccacgctggtggtcgccggcgacgacaccgccgacgtctgggtcgacggcacgcaaatctcggccagcccgcgggtgaccgactcgtggaagaccgcggccacggtgaccgtgccggccgggaccagaacgatcgcgatcgcggcgagcaacacgacggtgggcccggccggggtgatcgccaagctgggcgggatcgtcacggacggctcctggagatccgcgaccgcggcaccgggcggctggcagcagccgggcttcgacgactccgggtggctggccgcgaaggtgctggccgcctacggcagcggtccctggggaggtcaggtgctggtgccggcggccgcgccgtacctccgcaaaggttttgcggtgaccagaccggtggcgcgggcgcggctgttcgccaccgcgctcgggctgcacgacacgtatctgaacggcgcccgggtggggaccgagcggctggctccgggctggaccgactacaccaagcgggtgcagtaccggggttacgacgtgaccgcggcgctccggctgggcgacaacgccctggccgcgcagatcgggcacggctggtattccgggaacatcggtttcgccgggagtcggcgatacgggacgcagccctggtacgcggcccagctgatcatcgagtacaccgacggcacgtcggcgaccgtgcagaccgacggcagctggcggaccgcgccgggcaacatcctgggcgacgacctctacgccggcgagacgcaggacgcgcggctgatcaggagcgggtggaacaccgcgggcttcgacgacagcgactgggtcccggtgaccgtgcagaacggcgcccggccgacgctggtcccgcaggtcgatcccggggtgaccgtacagcaggagctgcggccggtcgccgtcacccagccgaagcccggggtgttcatcgccgacctggggcagaacttcaccggctgggaccggttgcgggtcagtggcccggccgggaccacggtcaccctgcggcacggcgagattctgaacgcggacggcaccctctacaccgcgaacctgcgggctgcccaggccaccgaccggttcaccctggccggaaccggcaccgagacgttcgagccgcggttcaccgtgcacggctaccggtacgtggagatcaccggcttccccggcacaccggacgcggacagcctgaccggactggcggcgtggaccggcggcgccgcgaccggcatgttcaccagctcggacagcaccctgaaccaggtgcagcgggcgatcctgtggggtgcccggtcgaacctgctgtccatcccgaccgactgcccgcagcgggacgaacggctcggctggaccggggacatcgcggcgttcgtggcgacctcgacgttcaacttcgacacctacggcctgctggccaagttcgccaccgacctgaccgacgcccagcacagcgacggggcgttcaccgacgtggcaccggatgtgctcggcggggccggcaaggcggggtggggcgacgcgggggtgatcgtgccgtacaccgtctggcagagattcggcgatctggcgcccgcggaccgcaacttcgcggcgatggcccggtgggtggactatctgcgctcgaccgcgggcgccgacctgatccgcaaccaggacacctacggcgactggctgaatgtggacgacggcaccggcaacgatctgaccagcacggcgttcttcggctggtcggcgcggctggtgtcgcggatggcggcggcgaccgggcggaccgcgcaggcggcgacctacgggaccctcgccgaccagatcgcggccgcgttcaccggccggttcgtgcacgccgacaacactgtcggcacgggcagcgagacggggtacgtgctggccctcgcgttcggtctggtgccgggcgaccgggtgcaggcggtggcggaccggctggcggcgaaggtcgcgtcccgcaacggtcacctgtcggtcggcttcatgggcgtggagaacctgctgccggtgctcgccgaccacgggcacgccgacgtcgcgtaccggatcctgcagcagccggactatcccgggtggggctacatgatcgcgcggggcgccaccacgatctgggagcgctgggacgggatccgcccggacggcagcctgcaggacccggggatgaactcgttcaaccactacgggctcgggtcggtcggcgactggctctaccgtgaggtgggcggggtggcaccggcggcgcccggttacgcccaggtgctgctcgcgccgaagccgggcgggtcgctgacctccgcgtcggccgagttgaccacgaccttcggccgggtccgcagcgcctggagccggtccgggtccgcggtgacgctgcaggtggtggtcgccacaggcacgaccgccacggtacgcgtccccggcaccgcggtgacctccgcgcccgccgaggcggtgccggtgggcggcacgtcctacgtggtgggggccggctcctacaccttcacctcgaccctctga

SEQ ID NO: 348 - DNA, 987 bp, Actinoplanes utahensis
atgacgcgtcgcgacgtggtcgtgatcggcgggtcggcgggcgcgcacaagcctctgacccagctgctgtcccggctacccgccgatctgccggcggccgtgctggtcgtcctgcatctggcgcccggcgcccgcagcacgctggccgagatgctgggctcggcctgcgcgctgccggtgcgcaccgcggccgacggggagccgatcaggaccggtcaggtgtatgtcggtgccgccgaccggcatctggtcgtcgacggcgacgtgctgcggctcagcgacggtccccggcagaaccgggtgcgccccgcggtggacgcgctgttccgggccgtcgcccgctggtgcggaccccgggcgatcggcgtggtgctctccggcagcctggacgacggggccgccggcctggccgcgatcgtcgccggcggcggcctcgccctggtccaggatccggccgaggcccggttccccggcatgccgcgggcggcgctgcgggtggtgccgcaggcggtgacggcctcggcgctcgatctgggcgatctggtggccgggtcggccgggcagccgaccggtgcgggggaggggccgcaggaagcgttgaggtgggagacggacatgatcgccgacggttcctccgacgcccgggaccggggcgagccggtcgcgctgggctgccccgagtgccacggcgggatgtacgtcgtgcggaccggccgggcggcgcactacgtctgtcacgtcggtcactcctattcaccgcagaccctgctggccgcccgggacaacgggctggaggaggcgctgtggaccgcggtcagcgtcctgcaggagaaggtgatgatcctgcgggagctgatcgaccaggccgagaaggccggtgaggccgaggtggcgcgtggctaccgggcggaggcggaccggacgagcgccgcggccgccctgctgcaggagcaggcggccgggtcgaggaggacggcggcgcgctga

SEQ ID NO: 349 - DNA, 414 bp, Actinoplanes utahensis
atgaatcttcctgaccactcgctgcgcaccgaggttcacctgccggatgagcccggtgacgcgcgcctcgtcatcgtcggtgagctggacggcgaggagaccgtcggcctgcacgacgcggtcagccggaccctgcgccacccggccacccgggcggtgcacgtcgacgccggtgacctgatcttcctcgattcgtccggcatccggtcgctgctggccgcccgccgccgggccgccgaggccggggtcgagctgtcgatcgtcgccgtgtccccgatcgtgtaccagatcctgcagatcaccgggctgctgccgatcctcggcgtcggcgcggggacggtcgtccgtcagcccgcggcgcgaggcagcgacagggccgcccagaccactttgccaccgtcggtcggcaggtga

SEQ ID NO: 350 - DNA, 993 bp, Actinoplanes utahensis
gtgaccaaccgtgacctcatcgccgtcggcgcctcggccggcggggtggaggcgctgcgcgccctggtcgcgggcctgcccgccgacctgccggcggccgtgttggtggtgctgcatctgccgcgcagcgccccgagcgcgctgccgcagatcctgacccggtcggggccgctgccggcggcgatcgcaaccgacggcgaggagccggccccgggccggatctacgtcgccccggccgaccggcatctgctcgtcctcgacggccggatccggctcagccacggccccgccgagaacggtcaccgcccggccgtcgacccgctgttccgctcggccgcccgggccctggccgaccgggtgatcgccgtggtcctctccggcagcggcgacgacggggcggtcggtgccgccgcagtggccgccgcgggtggcgcggtggtggtgcaggctccggaggacgcgttgcacccgacgatgccgcgggccgtgctgacccgggtgccgcgggcgcgggtggcggtcgcggccgagctgggcgtgctgctcgccgagctcagccgggagaaggtgcccggtctgcccgggccggacgacccgctgctggccggcgaggtggcgatcgacgcgttcggcgagccgacgacggatctgctgcccggcgagccgtccggtttcggctgcccgagctgcggcggcgccctgttcaccttctcggattcgccggtgccgaggttccgctgccgggtcggccacgcctggtcgcccgagagcctgctcgacgagcaggcggtggccaccgagggcgcgctctggcaggcgctgcgcgcgctggaggagaaagcggagctcggccggcggatggccggggccgcgggcggccggagctaccagctccgcttcgaacagatggccgtggacgcgacggaggccggcgcgctgatccggggcctgctcgaccggttggccggcagcagcgccacgcagcaggagtga

SEQ ID NO: 351 - DNA, 1851 bp, Actinoplanes utahensis
atggatgagctggatagcgagttcgaggcgctcctgacctatctgaaggagtcgcggggcttcgacttcaccggctacaagcggtccagcctgagccgccgggtgcaccggcggatgtccaccatcccggtcaccgggtacggcgactacctggattacctgcaggtccacccggacgagttcaccgcgctgttcaacaccatcctgatcaacgtgaccgcgttcttccgcgacgccgaggcctgggacttcctgcgctcggacgtgttgctcccgatgctcgccgccaagccggagggcagcccgatccggatctggagcgccggctgcgcctccgggcaggaagcctgcacgctggccatgctgctgggcgagatcctcggcccggagcagttccatgagcgggtcaagatctacgccaccgacgtggacgaggagcagctcaacgaggcgcggcacgccagctacagtgcgcgggacgtggagagtgtcccgcccgggctgctggagcgctacttcgaggtgatcggcaaccggtacgtgttccgcaaggacatgcgccgctcggtgatcttcggccgcaacgatctggtgcaggacgccccgatctcccgggtcgacctgctgacctgccgcaacacgctgatgtacttcaacgccgagacgcaggcgcggatcctcaaccggttccatttcgcgctggccgagggcggcgccctgttcctgggcaaggccgagatgctgttgagccacagcagcctgttcctcccgatcgatctgaagcggcggatcttccgcaaggtgccgacccggccgatgatgaccaccggcatcgcccgggccgatcagctcgccgccccggcgccgacgccgctggtcgggctcgaccagctgcgcaacgccgcgctgatggccgcaccggcggcgcagatcgtggtgaccgtggacgggctggtcgcgctcaccaaccaccaggcggagtcgctgttcggggtgtcgccgcgcgacgtcggccggccgtttcgcgacctggacgtctcctaccggccggtggagctgcgccgctatctggagcaggtccaggtggaacggcgcgcgctgcacgtgccggacgtcgagtggacccgcggccccggcgagacgcgctacctggacatccaggtcacccccctggtcgacggggacgccggcctgctgggcgtctcgctgatcttccacgacgtgagcgccgccaagcagctgcgggtcgacctggaacgggccaaccgggagctggaggcggcgtacgaggagctccagtcgaccaacgaggagctggagaccaccaacgaggagctccagtcgaccgtggaggagctggagaccaccaacgaggagctccagtccaccaacgaggagctggagacgatgaacgaggagctccagtcgaccaacgacgagctccagagcatcaacgagcagctgcacaacagcagcgccgacctggacggggcgaacgcgttcctggacgccatcctgtccgggctgcgcgccggcatcgcggtggtcgaccgggatctgcgggtcctggtctggaaccggcaggccgaggagctgtgggggctgcggtccggcgaggcgatcgacaagcacctgctgaacctggacatcgggctcccggtcgaccagatccggccgctgatccgggcctcgctcagcggggagaccaccgacaacgagatccggttggaggcggtcaaccggcgcggccggtcgatcaccgtgcgggtcgcctgcagtccgctgctggacgtggcgagcgtgccgaccggcagcatcatcgtgatggacgcggtcgccccctctgcctag

SEQ ID NO: 352 - DNA, 1008 bp, Actinoplanes utahensis
gtgaccgcgtcgacgacgagcacgcagacgacgagcccgccgaaaggcaccgatcagggcggcgggatcggctccctggaagtgctcgccctgctgctcgtgctgctggtgccggcccgcgggcggatcgccgggctgctctccggcgccgggctgcagacctgggcgacggtgttcgtctcggtgctgatgcaggcggtgccgttcctggtcttcggcgtcgtgttgtccgcggtgatcgcggtcttcgtgccgcgcggcttctgggcccgggcgctgcccagccacccggcgctggcggttccggcggccggggtggccggcgtgatcctgcccggctgcgagtgcggcagcgtgccgatcgccgggtcgctgatccgccgcggtgtgaccccggccgccgcgctcgccttcctgctcgccgctccggcgatcaatccgatcgtgctgaccgccaccgtgatcgcctttcccggccagccgatgatggcggtcgcccgcgggatcgccagcctggtcgtcgcggtggcgatgggctggttgtggctgcgggtcggcaagccggagtggatccgcctgccgcaccgccccgacctggacgacgagtcgaaggcgcgggcgttctgggcggcctgccggcacgacatcatgcacgccggcggtttcctggtgctcggcgccgccgcggccgccacgatcaacgtggtggtccccgaccggtggttgcagagcctcgcggcgtacccgctgctgtcgatcctggccctggcgaccctcgccgtgctgctctcgatctgcagcgaggccgacgcgttcgtggccgcgtcgctgacccagttctcgctgacgtcccggctggtgttcctggtggtcggcccgatggtcgacctgaagctgatctcgatgcagaccggtgtcttcggccggcgcttcgcgatgcggttcgccccggccaccttcgtcgcggcgatcctgctcggctcggtcttcgggctggtgctgctgtga

SEQ ID NO: 353 - DNA, 1062 bp, Actinoplanes utahensis
atgctcatccgtaacctgctgggactcggggtggccttggccgcgggcggcgcgctgctgttcggcgcaccggtacagaccggtgcgccgcagccggtggcgctcgccgccgcctggccggccgcgcagcgcggcagcgtcccgtcgaaactggccgacggcagcgagtacacgcccggcctgttcctcgacgcgaagacctcggccgggaccgtgcagagcgccgacaccaggcagttgcggctggtcatccgggacggcgacggcgctctgaccgagctgcgccgggtgccggcccagcaccgcaccccgttcaccgcgctgaccgccgccggcgacaccctggtctgggtggagggcccgcaggacaagccgcagctgtggtccgccgaccggcggcatccggcgagcgcccggatgctgaccgccgacctcggcgccatccagttcttcgactcgcagaacgacctgatcgtcgaggacggcagggtgcactgggcggcgagcgcggccgggaaccggaccgagttccgcagcgtgccgctggccggcggcccggtcaccgtgcagcgggagaacggcgcctggggcctgaccggctggccgtgggcggtcgacggccacgtcgccgcccggggcgccaccaccctgcgcaacctgacgaccggccagagcatcgccgtcccgacggcggcccgcacggtcaccgcctgcagcccggcctggtgccggatggtctcgatcaaccaggacggctgggcccggatcgacctgtcccacccggacggctcggcccgccgcaaggtgctggacggcaacgtggccaccgcgatcaccgacgtcgcggtgctcgaccgcttcgaggtcctggcccaggtgaccgcccagtccgagttgagcggcaaccagcagctgctgatctacgacctgagcaaccggcatctggtgatggtcagcccggacgccggcaacatctcctaccgggccggcgtcctctggtggtcgaccggcgaccagtcctccttcgtccgcaacagcctcgacctgcgcaccgtcggctag

SEQ ID NO: 354 - DNA, 1161 bp, Actinoplanes utahensis
gtgcctcagatcgtcaatgaacgcctgctcaactgggccagcctgatcgagccggagaccctgcagcaggccgagaaggcgtcccggctgccgttcatccacccgcacatcgccctgatgcccgacgcgcacctcggcaagggtgccaccgtcggctcggtgatcccgacccgcggcgcgctcatcccggccgcggtgggtgtcgacatcggctgcggcatggccgccgtgcgcacccagtaccgggtcgaggacctgcgcccggaccgcgccgcgctgcgcaccgccatcgaggccgcggtgcccctgtcggccggctcctacaactcccgggtgaccgcctccgcccagcaccgcatcgaccggctgaccgccgaggcgtcgttcgacccggcccgctacgcgaagaactggcagctgcagctcggctcgctgggcagcggcaaccacttcatcgaggtgtgccgtgacgagtccggccgggtctggctgttcctgcactccgggtcgcgcggcgtcggtaacaagatcgcctcgcaccacatccaggtggcccgcgacctgatggaccggcgcggcatcgacctgcccgaccgcgacctggcctacctggaggagggcaccgacgagttcgacgcctacctgaccgagctgcgctgggcacagaacttcgccctggccaaccgggacgagatgatggaccgggtgatcgagtgcttcgccgatttcgccggcgggccggtcgagcagcgcgaccgggtgcagtgccaccacaactacaccgagcaggagagccactacggcgagacggtgtggctgtcccgcaagggcgcgatcaacgcggccaagggcgtgcccggcctgatccccggctcgatgggcgatgcctcctacgtggtgaccggccggggcaacgccgaggcgctgaactcgtccccgcacggggccggccgggcgtactcccgctccaaagcccgcagaaccttcacccgggagcagctgcgcaccgccatgaagggcatcgaataccgggacaccgacgccttcctggacgagatcccgcaggcctacaagccgatcgacacggtcatgcgggacgccgccgacctggtcaccatccggcacacgctgcgtcagctggtcaacgtcaagggcgactga

SEQ ID NO: 355 - DNA, 312 bp, Actinoplanes utahensis
atggacttcggctgcacgatcgaacggcacggcgatcgggtcgtcatcgtgcccgagggtgacatcgacgcggagagcgccgcggcgctgcgccaggtgctgcgccaggccgtggagaccgacgggttcgcccacgtcgaggtcgacctgcaccgggtcagcttcctcgactcgatcgggctgggcgtctttgtggcggcacgcaaggccgcgcacgcgcgcgggctgaccttccggctgcgcgacttcgggccgatggtgaagatgctgctgcaggtcaccaacctggaggagacgctcgcgacggcgtaa

SEQ ID NO: 356 - DNA, 756 bp, Actinoplanes utahensis
atgcgcttcgccgttgccgacgcagccgagaccgaccacgccgtggcgctggtcgagaccccgcgggacgacccgtcctggccggtggtccgccaggacgcgatcaccgcgtggctgccgatggcccggcgcctggcccgccgctacgccagccgcggcgccgatctcgacgacctgaaccaggtcgcgacggtcggtctgatcaaggcgatcgacggcttcgagccggaccgcggcgccgacttcaccggctacgcgatccccaccatcctcggcgagctgcgccggcacttccgggaccggatgtggaacctgcgggtgccgcgccggctgcaggaactcaacatggcgatcaaccgggcgcgcggcgagctgatccagacgctgggccgggtgccgaccgtgaccgacatcgccgggcacctcggcgtcggcgaggaggaggtgctggaggggctggagggcgcgtacgcgtaccgtcccgcctcgctgtccgccccgatcgccgcggacggtgagaccgagctcggcgacaccctcggcgcccgcgaccccggtttcgagcagaccgagctgcacctgaccctgggcccggcgatggcctgcctgaccgagcgcgagcagcggatcgtgacgctgcgcttctacggcaacctgacccagagccagatcggcgaacaggtcggcgtctcccagatgcacgtctcccggctgctggcgcaggccctggacaagctgcgcactcacctcagctaa

SEQ ID NO: 357 - DNA, 1320 bp, Actinoplanes utahensis
gtgctcgacatccacgcagtgctcgaccagcgggccgtcaccccggtcttccagccgctggccgacctgacctccggcctgatcatcggttacgaggcgctgagccggggcccggcggggaccccgtgggaggcgcccatggcgctgttcgcggcggcccgcgcggccggccgcgagccggaactggactggatctgccgggccgccgcctaccgcgcggcgctgcgggccgggttcggcgctgaactcaacctgttcgtcaacatggagcccaccgcgtggcgggtcgactgcccggccgacctggtcccggtcgtcgagcaggcccgggaccggctgcgggtggtcaccgagatgaccgagcgggtgatcgcggacgacccggcggccctgctcgcggcgaccggcaactgccgggagaacggctggggtgtcgcgctcgacgacgtgggcgccgacccgatgtcgttggcgctgatgccgttcgtccaccccgacgtggtcaaactggacatggggctgctgcgcgcgccggaccacccggccaccgcccgggtggtcgccgcggtcgccgcgtacgccgaggccagcggcgcgatcgtgctggccgagggagtggagaccgccgagcagatggaggtcgcccggaccatgggtgccaccctcggacagggctggcacctggggcggcccggcccgctgcccggcgtgctgccgatcggcgccgccctgccgacgctgggccgtgcccggccggagacccgcacgccgttcgaggtcgtcgcgcggcagcggcggctcacccggaccaccaaagcgcagttgatgccgatgagccggcacctggaggccctggccggcgacggaccggagccgccggtgctgctggcctgtttccaggacgcccgcaacttcaccgcggcgaccgtgcggcggttcacccggatcgcggcgcacagcccgctggtcgccgcgctcggcgcggggctgccggcgacgccggcgccgggcgtgcggggcgcgcatctgggccccggggacccgctgcgcggcgaatggagcgtgctggtgatcggtccgcaccgggccgccgcgctggtcgcccgggatctcggtgacctggccccggagccggaacggcggttcgacttcgcgctcacccacgaccgtgatctggtcgtcgcggcggcccgcacgctgctgggccggctcaccccgatcaccgggcccgcatcgacccggaataatccgacgtcgccggggcacctctccggtcatgcgagcgttgacctggcagggcaccggcaaggtgtccgttga

SEQ ID NO: 358 - DNA, 1347 bp, Actinoplanes utahensis
gtgacctggccccggagccggaacggcggttcgacttcgcgctcacccacgaccgtgatctggtcgtcgcggcggcccgcacgctgctgggccggctcaccccgatcaccgggcccgcatcgacccggaataatccgacgtcgccggggcacctctccggtcatgcgagcgttgacctggcagggcaccggcaaggtgtccgttgagacggttcccgatccgacgatccacgagcccaccgacgcgatcgtccggatgacctccaccgcgatctgcggttcggacctgcatctgtacgacgtgctcggcatgtacctcgaccgcggcgacatcctcggccacgagccgatgggcatcgtcgaggcggtcggctccgaggtcacccacatcaagcccggcgaccgggtggtgatcccgttcaacatctcctgcggacactgctggatgtgttcccgcggatacttcgcgcagtgcgagaccacccaggtcaaggaccagggcaagggcgccgcgctgttcggctacaccaagctctacggtcaggtgccgggcgcgcaggccgagtatctgcgggtgccgcaggcccagttcggcccgatcaaggtgcccgccgagggcccggacgagcggttcctgttcctgtccgacgtgctcaccacctcctggcaggcggccaggtacgccgatgtgcggcccggcgacacggtgctggtcaccggcctgggcccgatcgggcagatgtgtgcgcggatcgcccggcacctgggcgcggagcgggtgatcgcggtcgacgaggtgccggagcgcctcgccatggccgcgcgcaacggcatcgaggtgctcaactcgggcagcgtcgacgacgtcccggcggccgtccacgagctgaccggcgggcgcggcgcggacggggtgatcgaggcggtcggcatggaggcgcacggctcgccgctgcagtccgcggcgatgaaggcggccgggatgctgcccgacgcactcgcccgcaaggccaccgagacggtcggcatcgaccggatggcggcgctgcggacggcgttcggatcggtgcggcgggccggcaccatctcgatcatcggggtgtacggcggcaacgccgacccgatgccgatgatggacctgttcgacaagggtgtgacgctgcggatggggcaggcgcacgtgaagcggtgggtcgacgacatcatgccgctgctcaccggcgacggcgacccgctcggcgtcggcgacctggtcacccaccggatgccgctcgaggaggcgccgcacgcgtacgacatcttcaagaacaagcaggacggctgcatcaaggtggtcctgcagccctag

SEQ ID NO: 359 - DNA, 975 bp, Actinoplanes utahensis
gtgggtgagcggttacgacgcagcgtgttgaccgggccggggatcagccggcgacgggccggcaagggcttccggtatctcggcccggacggggcggcgatcaccgacccgcagaccctggaccggatcaggagtctggtgatcccgcccgcctggcgggacgtgtggatctgcccggaaccgcgcgggcacatccaggcgaccggaaccgacgcggccgggcgcaagcagtaccgctaccacgacgcctggcggaccgcgcgcgacgagaagaagttcgagcgggtccgcgaggtggccggccggctgccgcggatccgcgaccggctctgcgccgacctgaccaccgggcgcggcctgacccgggaacgggtgctggcggccgtggtgcgcctgctcgacctgggcatgttccgggtcggcggggatcagtacgcggcccgggagcaggacccgtcgtacgggttgtccacgctgcggcccgagcacgtgcgctcgcgcggcggcgagacccggctggagttcgccggcaagtccggggtcgagcaccgccgtaccgtcgaggacggcgaggtggcggcggtcctgaccgcgctgaaacggcgccgccgggacatgccgcggctgttcggctactgggatccgtccgcccggcgctggcaggacgtcaaagccgacatgatcaacgactacctgcgcgagatcagcggcgccgagatgaccgccaaggacttccgcacctggcacggcaccgtgaccgcggctgccgagctcgccgcggccgggccgcagccgaccgaggcgaaacgccgcaaggtggtggcccgggcgatgcgcgaggtcgccgatcagctcggcaacaccccggcggtggcccgcgcgtcgtacgtcgacccgcgcctgctggagaagtacgagaacggcgaaggcccgaagcgcggcgacgagccggaggtgcgccgcctgctccggtga

SEQ ID NO: 360 - DNA, 825 bp, Actinoplanes utahensis
atgtcctacgcgctcgacgacgccaccatgcacgctctctgcgctgtggcgctgcgccagcacccctccgccaaccgcttcgtcgccctcgcgctcagccacgatgacccgctggccgacgtggcgcggaccgtggagcgggtggtcttcgaggagtcgttccagctcggcgagaccgcgatggtcgccgagtacaccgcatacgaggagcagagctacttcttcctggtgctcgaccgggagaccggcatgccggccggcgccgcgcgggcgatcgagggtggcgggaagacgctggatgacgcgcccgacctgatcggcaagccgctgtccgagatcgtcgacgtgcacggcatgcacgacggcggcaagatctgggactacgcgacgctcgcggtgctgccccggtaccgctcggaccgcagcgggctgaccgtcagcgtgatgctctaccgcgcgttcatcaacgccgggcaccgctggcaggtgcggcacgtggtctgcatgctcgaccaggccgcgttccgcaacctggacatgctgggctgccggttcatcccgatggccgggtccgagccgttcgaatacctgggttcggccgccaaccgggcgctgtacatcccgttcgacgagatcgcccggtcgatgggcgacaaggcggagctgctgctcagcgagctgaacgcgcccgacgagaacggccggcggcggcccggagcgcggcggatcaccgcccgcctggccgggcaggtgtcctccggggaggacctcgacccgcacatcgagctgccgggcttcgagcggcgccgtcagccgcggcgctga

SEQ ID NO: 361 - DNA, 354 bp, Actinoplanes utahensis
atgagggcgctcagcttcggcccggccgcggccgcctacgaacgctaccgccccggctatccgggcgagctgtccgacgtgatcgccgcctgtgcggatggtccgatccggacggcactggagatcgacgcgggcaccggcaaagccacccgcctggtcgccgggcggggtggtggcgaacttcggcagccccctccggccggccgacccgggcgtgcaggaggcggtgcgagcggcgcgggcgccgtccgtggcgacgcacgagatcccgtcgccgacggcaccggggtcgaggtcgcccgaccttcgctgcttcaccctgcctccgggtggttgaggatttacgcggtgtga

SEQ ID NO: 362 - DNA, 909 bp, Actinoplanes utahensis
atgggcgagctgatcgaggtacggccggggattcacgcctggctgcaggccgacgggtcgtggtggctgaacaacgcgggcgcggtcagcaccgcggacgggcagctcgtggtcgacacgtgcgcgaccgagacgcgggcgcggcggttcctggagacactgcgggcggcgaccgggcaggcgccgaaactcgcggtcaacacccaccagcacggcgatcacacgtacggcaactgcctgctgcccgccgcaaccgtgctgatcgggcaggagaacatgcgcgaagggctgcgggtcgatccgatcatcgacggctgcccgccgttctggtcgccggtgccggactggggtgacgtcacccggcggctgcccgacctgaccgtcaccggcgcgatgaccgtgcacctcggcgaccggcggatcgagctgcggcacccgggcgggcccgcgcacaccaccggcgacctgatcgcctgggtgcccgacgcccgcgtgctgttcaccggcgacctggtcttcgccgggctgaccccgctcgtcttcatgggctcggtgaccggcgcgctggccgccgtcgactggctggccggcctcgcaccggaagtgatcgtccccgggcacgggccgatcctggagggtgccgacatcgcccgggtcctcgacgaacaccgtcgctactaccacctcgtcctggacgccggcgcggccggcatcgccgacggccggccgccgctggacgcggcccgcgccgtcgacctgggagaattcgccggctgggcggacgccgaacggctggtgctcaacctgcaccggtactacgccgaccaccacgggaccgacctcgacctgatcgccgcgttcagcgacgcggtcgcctaccacggcgggccgctgcccacccgggtatga

SEQ ID NO: 363 - DNA, 1176 bp, Actinoplanes utahensis
atgcgccgcatttctcagcgagtttccgccattgccgaatccgccaccctggccgtcgacgccagggcgaaggcgttgcgggccgccggtcgcccggtcatcgggttcggtgccggcgagcccgatttccccacctcggagcacatcgtcgaggccgccgcccgggcgtgccggcgcccggagtcgcaccgctacagtccgaccgccgggcagcccgcgctgcgcgaggcgatcgcgcaagcttccccgttgccgctgaccgccgaccgggtgctcgtcaccaacggcggcaagcaggctgtctaccaggcgttcgccacgattctcgacccgggtgacgaggtgctggtgccggcaccctactggaccacctacccggaggcgatccggctggccggcggcgtgccggtcgatgtgccggccgacgagtccaccggttacctggtcaccgtcgataagttggcggcggcccgcaccccgcgcacccgggtgttgctggtctgctccccgtccaatccgaccggcgccgtccattcccggcaacaactggcggagatcgggcagtgggccgtacagaacaatctcttcgtcgtcaccgacgagatctatcagcacctggtctacggtgacgcgcaattccattcgctgccggcgctggtgcccgcgctcgccgaccggacgctggtgctcagcggcgtgtcgaagacgttcgcgatgaccggctggcgggtcggctggatgaccggcccgcgtgacctgatcgacgccgccgccaatctgcagtcgcacctcacgtcgcatgtgggcaacgtcgcgcaggccgccgcgctggccgcgctcaccggcggcctggacgcggccgagcggatgcgctcggcgttcgaccggcgccggcgcaccatcgtcgggatgctcaacgacatccccggcgtggtctgccccgagccgcagggcgcgttctacgtcttcccgtcggtccgcggcctgctcgggcgggagctgcgcggccgccgcccgcagacctccgccgagctggccacgctcatcctggaggaggcggaggtggcggtcgtgccgggggaggcgttcggcatgcccggctacttccggttctcgtacgcgctgggcgacgacgacctggtcgagggcgtcacccggatcgccaagctcctctga

SEQ ID NO: 364 - DNA, 1245 bp, Actinoplanes utahensis
gtgcgtgccgggccggctggtcagcgttcacctgtgaagatcctgacggcgatgctcggcgccgccctggccctgtccccggcggcgcccgcgcacgatgagaagatcgcctacacccggtggacggcgctgccggcctggccgcgaccggccgggcgcaccacctacgccggccgggcctgggagtcggcgagctggaccgggccggtgcaccggatcggtttcggcgcctcccagctggtcgcctcgtgggacgcgcggactccggccggtacctggttgcaggtcgacatgcgggggacctacaccaacgggcagaagacgccctggtacgtgatgggccgctgggcgtcgggtgaggaggcgatcaggcgtacctcggtgcgcgggcagcacgatccgtactcgtcgatcgacaccgacaccttcacgatcaccgacccggcccgcggggtgctgctcgccgactaccagctgcggctcaccgctttcaccgccccgggctccgcggtgctgccggaggtccgggaggtgggggcgatggtctccgacgtaccgccgcgattcgaggtgcggcgcagcgacggccacctcgcgtgggggcgggaactggcggtgccgcgccgctcacagaagatccatgccgggcagtatccgcagtacaacgggggcggggaggcgtggtgctcgcccacctcgacggcgatggtggtggaatactggcatcgtgggccgagccgggcggacctggcctgggtcgatccgtcctacgccgatccgcaggtcgacaacgcggcccggcacacctacgacgtcgcctacgacggcaccggcaactggccgttcaacaccgcctacgccgccggtttcgacctggaggcgatcgtcacccggctgcactccctcgacgacgccgagcatttcatcgcggccgggatcccggtgatcacctcccagtcgttcctgccggcggagctggacggggcgggttacggcaccgccgggcacctcatggtgatcatcggcttcaccaccaccggcgacgtgatcgtcaacgacccggcgtccgcttcggacgaacgggtgcgccatgtctaccggcgggagcagttcgagcggatctggcagcggacccggcggcaccgcgcggacgggaccgtgaccaacggcagcggcggcatcgcctacctgatcaaaccgtggacgacgccgtggccgcgggtgcctggcgccacgaactggtga

SEQ ID NO: 365 - DNA, 1770 bp, Actinoplanes utahensis
atgaccaccgtcgccgcgaggcccacccccacacggccccatccgatccgccggcaggtgcgaggatccgccctggcccgcatcgtgcggaccaccgacgcgaagcagatcgggatcatgtacatgatcacgtcgatcatcttctacgtgatcggtgggatcatggcgctgctgatgcgcgccgaactggcccggcccggcatgcagattctctcgccggagcagtacaaccagctgttcaccatgcacggcacggcgatgctgctgttcttcgccaccccgatcgtgttcgcgttcggcaatttcgtggtgccgatccaaatcggcgccccggacgtggcgttcccccggctcaacgcgttcgcgtactggctgtacctgttcggcacgctgatcgcgatcagcggcttcatcacccccggcggggcggccgacttcgggtggttcgcctacaccccgctgagcgactcgctgcactcccccgggatcggcgggaactgctgggtggtcggcctggccatctccggtctgggcacgatcctcggctcggtcaacctgatcaccacgatcctgaccctgcgggcacccggcatgaccatgttccggatgccgatcatgacctggaacatgctggtcaccgcactgctggcgatcatggtgttcccgttcctggcggccgcgctgttcgccctggccgccgaccgcgtcctcggcgcgcacgtcttcgacgtggccaccggcggcccgatgctctggcagcacctgttctggttcttcggccaccccgaggtgtacatcatcgccctgccgttcttcggcatcatcaccgaggtcatcccggtgttcagccgcaagccgctgttcggctacaagggcctggtcgccgccaccatcgcgatcgccgccctgtcgatgagcgtctgggcacaccacatgtacgccaccggccaggtgctgctgccgttcttcagcttcctcaccttcatgatcggcgtgccgaccgggatgaagttcttcacctggatcggcaccatgtggcgtggccagatcagtttcgagacgccgatgctgttcgcggtcggcttcctggtcaccttcctgttcggcggcctgtccgggatcatcctggcctccccgccgatggacttccacgtctccgactcgtacttcgtggtggcgcacttccactacgtgctgttcggcacgatcgtgttcgccgtgttctccggcatctacttctggttcccgaagatgttcggccggatgctcgacgagcgcctcggcaaggtgcacttctggctcaccatgatcggtttccacaccacgttcctggtccagcactggctcggcacccgcggcatgccgcgccgctacgccgactttctgcccaccgacggcttcaccggcctgaacacgatctcctcgatcggctcgttcatcctgggcgccgccaccctgccgttcctctacaacgtgtggcgctcgtacaaggtcggcaaggtcgtcaccgaggacgacccgtggggccacggcaactccctcgaatgggccaccagcagcccgccgccgctgcgcaacttcgaccggatgccccggatccgctccgaacggcccgccttcgacctgaaatacccgcacctcgcggccggcgagcagtcgctggccggtccgccggagggcggggcacgcccgctgacccgggaatcggacggcggcgcgacctacgccgaggacatcgccgccgaccgggaccgcaagcggaaacgctga

SEQ ID NO: 366 - DNA, 453 bp, Actinoplanes utahensis
gtggcaacgatcgtctactatgcgccgatgactgctgctgcggtgaacggggtgccggctctgtcccgccggcggaccggggtgtgggtgctgtccggcgcgcagtatgcgttggcggcgctgaccgccctgtgtgcctgctcggcgctggcgcgggccgcggacttcgccgggcactggtacgtgccctcccccgacgaccggtacaccgcgaacgccgacgtgctgaccggttggacgggcggctatttcgtgacgttcttcctgccggtggcgccactgctggccgggctgggcctggccgtctcggtggcgctgttcctgcaggggcacaccgccgggcgccgcgggctgaccgcgacgctggccgggagcgcggtggccatgctgctggtgctggtggccgccgtgtccccggccggcatgtcgctgatcacctggctgatcgactga

SEQ ID NO: 367 - DNA, 135 bp, Actinoplanes utahensis
gtgctcggcgttctcggggcgcacctgccggcctggtcgctggtggcggggctgttgctgctggctttgtggcagatcggctaccgccggctgacgaccccggtcaccccggtcgcgaccgaggcggcgccctag

SEQ ID NO: 368 - DNA, 921 bp, Actinoplanes utahensis
atgtcgcacgccaccactgaggaacggcacgccacctggctggagctcttcttcgacctggtcatcgtggccgctgtcgcccagctggcccacctgctgcacaccgggccggacggccggcagctgctgatcttcgcggtgctgtactacgcgatgtggagcgtgtggaccggcttcacgctgtacgccaacgtggcggccaccggcacccatctgctcaccatgctgtccgcgatgttcgggatcgcggtgatggccgcgtcggtgccgcagctggccgagcacgaccggccgcagccgttcatcatcgcctacgtcgcctgccggatgctcgccgtcgcctcatggaagcggtcgaacgaggtgatgaccgagtggcccggcgtgcaccaggcgatcggcctggtcccgtgggtcgcctcgctcggcttcgaggaaccggcccggtactggctgtgggtgctcggcatcgtcgtcgacctgggcttcaccctgcgcgcctccggctcccccgaccgggtgctggccgaacagatcagcgactacgagcgggaccagcgccgctggacgacccggctggtccgccggatcgcgccctggcacgaggccgacccggtgccgtcggcggccgccgccgaccggccgcacctgggcgaacggctcggcctgttcgtgatcatcgtgctcggcgaggcggtcgcgcagctggtcaatgaggcggccgggaccgagcaatggtcgtacgagatgtggatcctggtgttggtcggtttcggtctcctcgtcgcgctgtggtggctcaccctgcagtacggctcggccgccgccccggtcgccggcgcctggtcccgcgccctgcggctgaccatgccggtgcactacctgaccaccgcggcgatcgtggcgatcctagctagctag

SEQ ID NO: 369 - DNA, 537 bp, Actinoplanes utahensis
ttgaggttctacggtccccgggtggatctggacaccgagccccgcctggacgtcgccgaccgcatgcggggcgccttccgccgctacccgaccggggtcgcggtgatcaccgcggccggcccggacggccccgccggactgaccgcgtcgagcgtcgcctcggtcgcggtcgacccgccggccctgtcgttctcggtcctgggcacccggtcggcgcgcgccctgctcgactcccccagcctggtggtgcacctgctcggcgcgcggcacgccggcctggcccgggagttcgcccatacggccggcgaccggttcaccccggcgcagggctggcgcaccctgccgaccggcgagccgatcctgcccgacgcggtcgccgcgctgcgctgcgcgccgatgcaccggctcccggtcggcggctccaccctggtggtcgccaccgtcctggaggtcttccacggaccggacgacgacccgctgatccaccacgcccgggaattcacgacgctcgcccgcgacacgcggggcgtacggtga

SEQ ID NO: 370 - DNA, 573 bp, Actinoplanes utahensis
ttggcggcctcctgtgatgcgctgttcgcacaccgcgttaaggagaccctgttgaagcaccgccgcaccgctctcgtcccggtcgtcctgctggcgagcgcgggctgcggcgtgatcaacaacgcggacgccgcgccggcgccgaccgtcgcgccgacccccgcggtctccgcggcctccgtctcgccgacctccatcaaggacaacggcgacattccggatccttgtacgctgttgtccagggccgaggtgaccagcctcaccggtcgccggatcacccaggtcgaccgggacggcgccgcacccggtgacgtctcccgcttctgccaatggcagcaggacagcggccagctcgccctcttcctgagccgcaccaccgccgacgacttcaaggtcaccgtcgccgaggcgcacgacgtcgacggcgtcggccaggccgccttcaccgccaacggccacctgtacgtcctgtacggcaccgtgcaggtcgacgtctactcccgcggcggcagcgacgagcagaacctgggcgacgccaagaaggtcgccaaggttgtgatcccgcgcatctga

SEQ ID NO: 371 - DNA, 372 bp, Actinoplanes utahensis
atgaacaaggcgaaagggctgctcatggcggccgccggcgttgtctccggattcgccgtgggtgccgcgccggcccaggccgcggggaacccgccgccgggattcaacgtcgatgtcgccggatacttcggccagctgggcgactgccagtggaccggccaggccggcaagctggtcggacgctggctgaactacacctgtgaccggggcgacggcgtctaccgtgggctgtggcagctggtggtgcgccggggcggcagcggtccgtcgaccgcgggccggccggcgtatcccggcgcgaccgggcatcccggcggcccggacctgccgggctggccgcaccacgcgggcgggcccggtccgcgcggatga

SEQ ID NO: 372 - DNA, 648 bp, Actinoplanes utahensis
atgacactatggacgttcccggccgggtaccgcccccgatcgtcacggttcgacggtgacggatgtcagtgtcgcgggccgcccggggagtacggttcccctgtgaccgtggttgacattcgcaaagtgggtgaccccgtgctgcggcgggtcgccgagccggtgaccgacttcgacgccgagctggaccggctcgtgcgcgacctgaccgagacgctcctgcggtcccacggggccgggctcgccgccccgcagatcggcgtgagcctgcgggtcttcgcgatcaatcccgacctgccgggcaacgacctgcggctcgaccatctggtcaacccggtgctggagttccccgacgacgaggagcaggacgggccggagggctgcctgtcgattcccggcatctacctggacacccggcgccggatgaacgtcagcgcccgcgggttcaccaagcagggcgacccggtgcaggtggtcggcgacggcatcctggcccgctgcatgcagcacgagaccgaccacctggacggcatcctgttcctcgaccggcaggacgaggcgggtcggcagcggctgctcgccacgctgcgcgaggcggcctggttcgagggcctggcggcgcccgaggtgcgggtcagcccgcactga

SEQ ID NO: 373 - DNA, 954 bp, Actinoplanes utahensis
gtgtgcccggcgtccggtgggggtatcgcgtcggacgtggacgatgagcgcaagggcccggagaagggcgacagcacctggaccgtgatcgtggcggtcgccgccaacctggcgatcgcgatcgcgaagatcgtggcggcgctgctgaccggttcggcctccctctgggcggaggccctgcactcggtcgccgacaccggcaacgaggtgctgctgctgatcgggctgcgcaagtcgcagaaggggccggacgcccggcacccgttcggctacggccaggaacgctacttctggacgttcctggccgcgctcggcatcttcctgatcggcggcgtgctgtcgatcggcgagggcgtgcgcagcctgctggccccggagccggtcgactcgttctgggtgggcgtcggcgtgctggtcgtcgccgccggtttcgagagctactcctggtacaccgcgcacaagcagctgcgccgggaggccgacgagcgggaccggtcgatgcgccaccacctgcggcacgcctccgacccgagcgccaccacggtcttcctggaggacaccgccgccctgatcggcctggccgtggcgctgaccgcgctggtcctgcacgagacgaccggctgggccggctgggacgcggtcggcagcatcaccatcggcctgctgctgatcgtggtcgcgttcctgctggcccgccggtcgaaggcactgctgctggacgagtccgccccggccgacgtgctggacccgatccgggagcgggtggaccggcaggactgggtggcccgggtcggtgacctgcacgcggtctgggtcggcccgtcccagctgctggtcaacgtccgggtgaccccgaccgactccgacgagctggtcgaacgggtcacccggttgcgccgggacctgcaggacgacgacgtgatcgcactggtcaccgtgaccctcgaagcctga

SEQ ID NO: 374 - DNA, 1509 bp, Actinoplanes utahensis
gtgaagagaaaccgcatcatcgcggcggccgggaccgccgtcaccgccggggtcatcgccgtcgccctgccactcccccaggcgaacgccgcgacggccggcgccaccggttacgccggccagaacggggggaccaccggcggcgccggcggggcggtcgtgcatgccaccaccggcacgcagatccatcaggcgctgtgcagccgggccaccagcagcaccccgatcgtcatccaggtcgagggcaccatcaaccacggcaacacgaccaaggtctccggcgccggctgcaacaccgcggccgacaagatcgaactgaagcaggtcagcaacgtgaccatcgtcggggtcggcgccggggcggtcttcgaccagctgggcatccacatccgggactccagcaacatcatcatccagaacgtgcagatccagaacgtgaagaagtccggttcgccgacctcgaacggcggggacgcgatcgggatggagagcaccgtccgcaacgtctgggtggaccacgtgaacctgctggcctccggcggtgaggcccaggggtacgacagcctgatcgacatgaaggacaacacgcagtacgtgacgctgtcctacagcaccctgcggaactcgggccgcggcgggctggtgggctccagcgagagcgacctcggcaacggctacatcacgtaccaccataatctgtatgaaaatatcgactcccgtacgccgctgctgcggggcggcatcgcgcacatctacaacaactattacgtgcgcctgaacaagtccgggatcaactcgcgggccggggcgaaggcgcgggtggacaacaactacttccaggactcgcagaacgtgctgggcaccttctacaccgacgcggccggatactggcaggtcagcgggaacatcttcgacaatgtgacgtggacggcaccggacggcgagaccaacccggccggcccggacccggtctccaacaccagcgtgagcatcccgtacgcgtacacgctggacgccgcctcctgcgtgccggcgatcgtgcggcagaccgccggcgcgaacaccgggctgaaggtgtccgacggcagatgctcgaccacctccccgagcgcgaccggcagcccgacgccgtccgccaccacgccgccgagcgggacgaacctgagcctgggcgccggggcggacgggtccagcaaggcgggcggcaccagttacggcaacgtcaaggacggcgatgcgggcacctactggtcgccgagcgggtcgaccggggacatctcgatcaagtggggctcggcgaccacggtttcccgggtgaacgtccgggagatcggcagcgcggtcacgacgtaccggatcctcaacggcgcgaccggcgcggtcctcgcgtcgggcagcggatccggtgtgatcaccttccccgccgtgtcgctcaccaggatcactttcaagatcatcacggcttccggtacgccgcggatcgccgagttcgagacctacgcgtcctga

SEQ ID NO: 375 - DNA, 864 bp, Actinoplanes utahensis
atgacgacgaccaaggaagatcggcaggcggaggagcggcagcagcagccgcccgggcacaccgggctgatgaaccgcaagccggatcacggggaggattcctaccgcgggtcgggtcggctcatcgggaagaaggcggtgatcaccgggggtgacagcggtatcgggcgggcggtggcgatcgcgttcgcccgggagggcgccgatgtgctgatctcctacctgccgcaggagcaggacgacgcgcgggagaccgcggcgcaggtggaggcggcgggccgccgggtggcgctggcgcccggcgacctcaccgacccggcgcagggcgcgaagatcgtcgagcaggcggtgcgcgacctcggcgggatcgacgtgctggtcaacaacgcggcgttccagatgacccacgagagcgtcgaggaggtcaccgacgaggagtggcagcacaccttcgacaccaatatcaccgcgatgttccggctggtcaaggcggcgcttccgcatctcggcaagggcgcgtcgatcatcaacaccagctcggtgaactacgacatgccgaaaccgacactgctgccgtacgcgacgacgaagggcgcgatagccaacttcaccgcggggctggcgcagatgctcggcagccgcgggatccgggtgaacgcggtcgcccccggaccgatctggacgccgctgatcccgtcgacgatgccgcccgagcaggtcgcggaattcggcaagaatacgccgctgggccgggccggggagccggccgaggtggcgccggtctatgtgctgctcgcctcggacgaggccagcttcatctccggcgcgatcattccggtgaccggcggaaaacctatcctgtga

SEQ ID NO: 376 - DNA, 576 bp, Actinoplanes utahensis
atgcccccacgcaagcgaacggtcagcaacacgagcccgagctacaccgtgccgggcctcaagcccgacgtggccggcgagatcatcgcggtgctgcaggaccggttgaacgcgctcaacgacctggcgctgaccctcaagcacgtgcactggaacgtggtcggcccgcacttcatcgccgtgcaccagatgctcgacccgcaggtcgacgcggtccgggtgatggtggacgacgtggccgagcggatcgccacgctgggcggctcgccggtcggcacgccgggggcgctggtcgcgcagcgcacctgggacgactactcgatcgggcgcgccgacacgaactcgcacctggccgcgctcgacatcgtctacagcggggtgctggaggcacaccgggaggcgatcgagaagaccgacgagccggacccggtcacccaggatctgctgatcgcgcaggccgggcagctggagcagttccactggttcgtccgggcgcatctggaatcggcggacgggacgctggtgaccagcggggtccgcgacgagaagaccgccgcgaaacgcgccaagcgctga

SEQ ID NO: 377 - DNA, 216 bp, Actinoplanes utahensis
atggccggcaaggaacacgatgtgaaccgcagcgcgcgcagtgggcgcttcgtcaagcagtccaccgcggagcgcgaaccgcgcaccacgaccaccgagcgggtcggcaagaacagcggcgagcgtgaggtgcaccgcagtaccagcaccggccgcttcgtccggaagacgacggcggaattgcatccgtcgaccaccgagacgcagcacgtctga

SEQ ID NO: 378 - DNA, 843 bp, Actinoplanes utahensis
atgggttcattgccggaggtggacgatctacgcctggtgaccgcgatcgcgcggctcgggtcggtcggtgcggcggcgcgcgagctgctggtcagtcagccgtcggcgagtcagcggctggccgcgctggagcggcgggtcggtgagcggctcttcgaccgggatccgaccggggcgcgcccgaccggggcggggcgagagatggccgagcgggcggcgcacatcctgcagcacctggcgacgttggtggagcagacccgggcggcggcgcgcgagcgaccactgtcggtcggcacgttctccagcctggcgccgctgctgttcccggcgctggacccgccggtcacccaggtggccgaccacggggaccggctgatcgcctgggtggccgaggggtcgctggacgcggcggtggtcgcgatcgccgagcaggtggtgctgccgccgggcgtggtggcgaccccgatcggacgcgacgggcacgcgatgctgttcccggccggggtggcggggccggggcggggacggcggccgtaccgggaccggcaggtggtggtgtacacgttcgacatgtccgccgaggtgctgcgggcgcggctgaccacgctgggcgcggcaccgcgggccgcggcgacggcggagaccgcggtgcggctggcccggacgtaccgtctcccggtgttgctcccggggtgcctggcccgcatccacgcgcgcccggaggagacggtgaccgccgcgccggtgcgccacctgctgcggctcaccctggtgacgccggggccgccgccggccgccctggacgtcgcgtcgctcgccgggcgactcggaatcggcacatga

SEQ ID NO: 379 - DNA, 1275 bp, Actinoplanes utahensis
atgagggactaccgcgacctggccgcgctgctgctcaccaccttcgtcagctggttcgggcagcgcctgaccgcggtcgcgttgccactggtcgcgctggccgccacgggatccgcgggcagcaccggcctggtcgccggcgcggccggcctgccgctggtcaccgccggctggtgggccggcccgctgcgccgccgggtcaccaccgggcgatcgctgagcgtcaccctcgccgcgcaggcggccggcctgctgatcgtcccggtggccgcgctcctggggcgggtcaccgtcgtaccgctgatcgccggaggcctcttcgccggagtggccgccgccgtggccggccccgcccgccaggccctgaccgcggacctcgccgaccggatcggccccggcaccgcggcccgggccctggcctggcaggacctggcgcaccgggccagcatggtgatcgccccgccgctggccgccgcggcggtcgccgccggacacaccaacgccttgctgtggtccgaaagcgccggcatcgccgtcgcttccgcgctgctgtcggccgtacgcggtgacccggcccccgcccgcgccgcgacccctgcccgagtccgcgtccccgcggccgcctctgttcccgcccccgtgcccgcaccggaaccggcggcgtccctgcgcgcggtctggcgccgtcatccggacctgcgccgcgtcctggtgatgagcgcggccgccggcctggtctggttcgccttcaccctcggcctgaccgtcctgggtgccggctcgggccgccccggcgtgctgatcgccgccggcatgaccggttacggggccggatcgatcgccggtgccctgctcgccccgctgctcaccacccggctcccggccctgcccaccgccgccgccggctggatcatcctgggtctggccttcatcgcgatcgccgcggccgccggctccgtcccactcatcgccggctgcgcggcgatcggcggcgccgtcgtccccttcggcatcgccgccgccaacaccctgatcagcacccgcaccgcgggtgccgaacgccgggccgcgttcgccgcggagagcatcctgcacgacggctcggccacgctcggcatgctgctgggcggcccgctgatcgccctggccggcccccgccccaccctgctggccgccggcctgctgcagatcgccgtcgcgctaccggtcctgctcaccgcgcgccgcgaggtgaccggccgcggctgcccgccgccggttaccggtcccgcgtag

SEQ ID NO: 380 - DNA, 507 bp, Actinoplanes utahensis
gtgggataccggtttcaccccgtggtccggcggccgaaaatgaaggctgtggatgtcatcgtgcagcgagtccggaccacctggagcaagcagtcccgcggcaacccgggcgcggcgctgcgcagcgccgtccccgaggcgttcccgctgccggcggccggcgcgccgctcttccatgacatcaccgtcgccgaggacgaggatttcgtcccccgcgaggcgatcctcccgcagcccccggccgccgcgttcggtctgcgcctggtcggcaacgccctgcgcgtccagctgccgaacggccacggcgctccggcacgcgccccgcgcccggtgctgaccctgcgccgcggcgactggctgcgctggcacctgaacaaccggcacgccgagcagaccggctggtattacagccagaccacggtcagcatcgccttcggccccaccgccccggacaccttcctcggcgccccgccgcacaccatcgacgagcgcgcccgcctccgctga

SEQ ID NO: 381 - DNA, 1764 bp, Actinoplanes utahensis
gtggctgagataacttccgaggttctgatcgagcgactggccgcctggggtgtcgacaccgtgtacggcatcccgggcgacggcatcaacgggatcatggagggcctgcgccggcacgccgacaaggtccggttcgtactggtgcaccacgaggaggcggccgcgttcatggcggtcgcgcacgccaaggcgaccgggcggatcggcgtgtgcctggccacctccggaccgggcggcatccacctggcgaacgggctgtacgacgcgaagctggaccacgtgccggtgctggccatcaccgggctgcaggagagcagcgtgctgggcaccggctaccagcaggaggtggcgctggaccggctgtacgaggacgtggccgagtacaaccaggtggtgatgaacccggcgcagctgccgacggtcgtcgacgtggcgatccggaccgcgtacgcgcgccgcggggtcgcccacctgaccgtgccgaacgacgtgcagatcgcgccggcgcaccaggacccgtaccagtcggtggcaccggtccggccgccgtcgacgtcgccgatctacctcgcccccgcggtccggccggccgacgaggacctgcgccgagccgccgagatcctgaacgccggcgagaaggtggcgatcctggccgggatcggcgcccggggtgccggcgcgctggtcgaggaggccgccgccgcgctggacgcgccgatcgtcaagtcgctgatgggcaagatggtggttccggacgactcgccgtacacgatcggcggcctcggcctgctcggcaccagaccggccgaggagctgatggaggaggccgacaccctgctgatgctcggcaccaacttcccgtacaccaagttcctgcccgagccgggcagggcgagggtggtccaggtcgacatcgagccggcccgggccggcacccggatccccaccgaggtaccgctggtcggcgacgtcggggccaccctgcgggcgctgctgccgctgctgacccgcaagaccggcacacatctgagcggctaccgggagaggtacgcggactggcagcacgcgatggcggccctggaggcgcccgaccgcgacccgatcgccccgcagtacctggcccacctgctggaccggcacgcggccgacgacgcggtgctgacctgcgactcgggcaccgtcgccacgtgggcggcccggcactggcagatccgcggcaaccgggagttctacctgtccggaacgctcgcgacgatggcgccggggctgccgtacgcgatcgggatccagcacgcgttccccggccggcaggtgatcgcgtacgtcggtgacggcgggttcgcgatgctgatggccgagttccacaccgcggtccggtaccggttgccggtcaaagtggtgatcaacaacaacaacgcgctgggccagatcctctgggagcagatggtgctcggctaccccgagcacggcgtccgcttcggcgaaccgctgccggacttcgccgggtgggcgtcgggcagcggcggtcacggcgtgcgcgtcaccaagcccggcgaccttccgggcgcgctgcgggaggccctggcgtatcccggcccggcgctgctcgacgtggcggtcaacccggacgagccgccgctgcccgggaaagtcacctacgaccaggccaagaagttcgccaccgcgtggctcaagggccagccgcacaagtcgtcgatcgcgacgaccctgttcaaggacaagatccagcagctgaagggctga

SEQ ID NO: 382 - DNA, 1761 bp, Actinoplanes utahensis
atgacccacggacccgaacaggcgatgtcggcaccggcccggcggccggccgccttcacgccgcaggagctcggcttcaccccggcgaaaccggtcgcctggctgtcccccgtgcagttggccggcaccgggctgcgggtggcactggccggcatccagggcggctacctggacaagcgggagctgcaggcgtcgttcccgaacgacgtgcaccgcgaggccgggccggacggcgaggcgtggatcgacttcgtggccgacctcggcgacggcttccacgccacctactcgatcgcgtacctgctggcccagcccagcctcaaggtcggcgagcacgacctgccgcgtgggcgggcgctgatcctcggcggtgacgaggtgtatccgaccccgagcgcgcaggggtacgaggaccgtctggtcgggccgtaccacgcggcgatgcccggcaccccgcccggcgacggcgccggtccggccatgtacgcgctgcccggcaaccacgactggtacgacgggctgaccgcgttcctgcggctgttcaccggcacccggcggaccgggatcggcgggtggcggctgccgcagcaccggtcgtacttcgccgtccagctgcccggcgactggtggctgctggccctggacgaccaggactccacctacatcgacgacccgcagctcgcctacttcagccgggtcgccgcgaacttcggcccgcagacccgggtgatcgtggcgaccgccagcccgacctgggtgcagggcgacgacgtgcccgaggtgtacgcgtcgctggactacttcgtgcgggcggtgatcgagccgaccggggcgaagatccggctgatggtctccggcgactggcaccactacgcgcggtactccggcgcggagcgggagctgatcacctgcgggggtggcggcgcctacctgtaccccacccaccagctgccggagacgatcgaggtgccgccggccgacctgccctcgccgtcgccgcgcgtgaagtacagcctccgctcgcgtttcccggggaagttgcggtcacaggcgtacgcggcaagcattttcggtcgtctgcccaaggacaacccgagcttcatcggcatgatcggcgccgtgcacaccatgatgctgctcgccgcgagcggggtcctcaagagcggtttcggcagcccgttgcagaagttcgcgctggccccgctggtcgtgctgatggccctggtggtggccgggtcgtacgcgttcgcgcacctgagcaggtcggtccgcggcgggttccggcgccgggtgctgggcctgctgcacggcgccgcgcacctggcgctggccgcgctgggcacctgggcgtggtgggagctgccgctgcacgactggccgtggccgtggtcactgatcgccgagatcgtcatctacggcgtggtgtccgggctggccggcaccgaactggtcgcggtctatctgctgatcgccgcccgcttcgacgtgaatgtgaacgagctgttctcggcacaggggatcgtggactcgaagtcgttcctgcggttccacgtggccgccgacggcaccctgaccatctatccgatcggggtgcgcaaggtgtcccggcgctggcgcgcggtgccggacggcgctccgcacgagtcgtggctggctcccgacgaccggctgcgcccgcacctgatcgaggcgccgatcgtgctgaccccggacccgcaggcgtcgtccaccgcgccggcggctttccccgccgcggaatga

SEQ ID NO: 383 - DNA, 2016 bp, Actinoplanes utahensis
atgccggccagtgccacccgcagcccggtgccggccaactgcacgggggacagccaggcgaccggtttcgccggggtgaagccgagctcctgcggcgtgaaggcggccggccgccgggccggtgccgacatcgcctgttcgggtccgtgggtcatcagtgtcctcccctggggtgctgggaaaggagtaccagaacgcgaatcccggtcgcgcgggaggccttatacgctgggcggggcgccgcggaagggaccagctgagttgggcatcgaggacgatctgttcctgctgcgagcctacgagccggtggtccggttcaccgagggggagtggttcttcccggtctcggtcgacaggtacgtgagccgcgccggcctgtggcgggccgagcccggcgccagtccggtgcaggtggcccggcccggcgagctcaccctggaccggctggccacggccggcggcgccgagcagggcctgcggtattcgctgtccgggatcggcggggacaccacccaccacgcgcacatcccgctgcgggaacgcccgccgcacctggcccgggccagccggctcgcccaggtcggcctgaccgcccggctggtcgacgcgatgaaccggttctcgctgctgttccgcggcagcgtcccgggcggcagcgccgcgcactcgttcctgctgcagcgcgaccacctggagccgcaccgccccacctactacggccgggtgttccgcgaggagccgtggatcgtcctgcagtactggttcttctactcgttcaacaactggcgctcggcgttcggcggggtcaacgagcacgagggcgactgggagcaggtcaccgtctatctcgacggcaccggggtgatcgaccaggacggtctgccgccggcccgctgggtggtgttctccgcgcacgacgaggtcggcgacgacctgcgccggcgctgggacgacccggacctggccgtcgccgaggaccggcacccggtggtgttcagcggggccggctcgcactccggcgcctacctgcccggcgattacctgatcacggtccgcccgccgaagctgcgcggcctggtccgggcgctgcgctggtcggcgcggctgctcgcgccgtggtccggggaggaccggcagacgctcggcatcccgtacgtcgactatgcccgcggcgacggccgggcgatcggacccgggcacgacgagggctggcacccggtcctgatcggcgacgacaccccgtgggtgcgtgacttccgcggcctgtggggccgcgacacccgggaccggctcggcggcgaacgcggcccggccggcccgcgctattcccgcgacggcaccgtgcggcaggcgtgggccgatccggtcggctgggccggcctgtccaaggtcgtcccgaaccaggccgcggagcggcagctggccgagatccgcgcccggcgcaacgacgagcgcctggacaccctggaccgggagatcgacgcgctgcggcacgacctcgcggtgtccgcggcgggcctgccggccggcgctcccgaggtccgcgccctcgccgccgacgagcagcggctgctcgccctgcggatggaacgcacccggctggccgacgagcagagccggatggcgaccgtctggccggtcgtcgaggacccgcacgcgcacctgctgcaccgccgcctgccgatggagaccgccaccggactgctgggccgggcccgctcctggtgggcggtgctgagcacgccgctgatcctgtgggcgctgggcgcggtggtctcgccgctgccgatcgccggcaaacagaccgcgctgatcctgctgctcaccctgctcaccgtcgagggcctggtccggcagaagttctgggcggtgctgctgcgcctgctgctggccttcgtcgcgttgctgctgctggccctgctctggctggacggccgttacctggtgaacttcgcgttcttcgcggccgccctgctggtcctgctggtcaacatccgggaagcctggcgccgctga

SEQ ID NO: 384 - DNA, 1740 bp, Actinoplanes utahensis
gtgctggccggcggcctgagcgaaacgctccgggtcacgctgccgctgcccgagcggtacgcggtcgtgcccaccgtgctggccgccgcagccgcggcggccggtgccaccctcgcccgccgccgcaccggcgggctggaggcactgatcccggcgctggcggtagccgggtgcggcatcgtcgccgcggggatctcgacccggcagaccgtcccgttggcgatcggcatcgtggcggtgctcgtgctgctcctgcggccggccgcggcccggacgctgccggccgcggccgtggtgctcctcatcgcggccgccgccctggtccggctgcccgcgacgccggacgccggcacggccgatccgcggcggtacttcgtcgcgccgcagcgggccaaccggagcgccgacctgctggaccaggtggccggctggctgtccacaccgacgcttccgctgttcaccgccaccggcgatccggtgtcccggtggcggctggcggtgctggacacctacgacggtgtgagctggtcgtccggggccgccttcgtaccggcgggcctgggcgtgccgccctatccggcgggcggcccggagccgggcgtccggcagcacgtggtgctgggcgcgctgaccggaccgtacctgccggccgcggaccggccggcccgggtgaccgagccggtcaccgcggtcgacccggtcgacggcgtgctgctcaccgaccgccggccggccaccggcgccgcctacgacatcggctcggtgccgcacaccgcacccgccgagccgatcgtcgccccggccgcggccggcgacgccgcggagacggcggtgcccgccgagatccgcaccgccctgcggaccttcctgcggtccgtcccgctccagccgggcatgacggcggcggcgcgggcccgcacggtcgagtggtatctgagcacccatcgccgcaatgtcaccggcgccgccgcgaccgccggcaccggctcggtggtccggctgctcgggccgcgcggcatcggcaccacggtccagttcgccaccgcgttcgccctgctcatgcgggaactcggcattccctcgcggctggtggtcggcttccagccgcacacccccggggccgtgtacggggcggacgccctggtctgggcccagctccgctacgccgggcccggctgggtcgactaccagcccaccccgcccgccgtccggcccggtgacacggtgccgccaccggcgggcgccccaccggacgaggtcacccgggacgtcccgacgcagaccccgccgccggtggccgagccggctcccgcaccggcccggcggaccgtgaccctgctgctggccgcggcggtgacggtcggcggatacctcgccgtcaccctcgtgctgccggtgctgcgccgggcctggcggcgccgcggcggaccgcccgccgaccggatcgcccgggcctggcacgacgtgctggacgaggcggcccacggcgcgctcgcgccggcccggatccgcacgatgacaccgttcgacgtcagtgccgcgctcgccgccgccggcggccgggacaaccgggcgctggccaccctggccgcgctggccgacaaggcgttgtacggcacccagccgtgcaccgcggccgaggcggcccaggcctggcggtgcgcccggccggcccgtttccggctccgccgctggcgcaccctggtgtatccgagccgcctgcgcacccgcgcgcggtga

SEQ ID NO: 385 - DNA, 996 bp, Actinoplanes utahensis
atgaccccgaacggtgtgctggtcgccgtgggcggcgccgccgggacggccggctggctcctgctcggctaccccgccgccctcgtcgtcgccctgctcgccgcggtcctgctcgcggccggtgtgctgctccgactgaccgccggcgggggcgcccgggtggagctgggctgcgcggtgacacgggccgagcgcggcgaccggatcatcgtctcggtcgccgccgaccggcgcgcgctcgtccggctgcgcatcgaccccccgggcgagcgggtggatctgccgatcggccgctccccgcggcaatggaccagtccgccgctgccccggggccgtctcctcatcgtcgccgaggcggtcaccgtgcacgatccgttcgcgttgtggcggcggcagctgccgttcaccagcgaggcggtccacgtcaccgtgatgcctcggctgctgccactggaggccgcgccgcccttcgtcgaccggcaggaggacggccgggccgcgagcctgtggggtcccggcgtcgcgttcgccggcctgcgggaatacgaacccggggacgacgtccggcacatcgactgggccgcgtcggcccgcgccggcgacgaccggctctattcccgccagttcgcgcccacgctgaccgacagcctggtcgtcgtcctcgaccaccacgcgccggccgggcaggccggcggtttcgaggatgccgtcgacctcgccttctcgttctgccgcgcgggcgcgagcctcgccctgtccacctccggacgcgtctggccggccggtgccgaggccgacgcacagctgctggccgtccagccgaccaccgacgcccgggtgctgcgcccggcggcccgggccgggacgaccgtcgtcgtcacgccggacccggggcgccgagccgccctgcagccgctgttcgcgcaggacgacctgatcctcgtggcggccgacggccgggcgccgctgcagtggcgccgatggctgcgccgatga

SEQ ID NO: 386 - DNA, 1032 bp, Actinoplanes utahensis
atgcacctcgacgggcagacgccggccatcgccgatgacttctccccgcgattcgccgcgttgaccgccgaggtgcgcagaacggtgtacggcaaggccgaggtcgtcgagaaggcggtgatctgcctgctcgccggcggccacctgctgctcgacgaccgccccggggtcggcaagaccaccctggcgaaggccctcgccgggctgctcgcgggcggcacggtcaaccggatccagggcaccccggacctgctgcccagtgacatcatcggcacctcggtgtacgagcgcggccgggacgacttcaccttccgggccggcccggtgatcgcgaacatcgtcctcttcgacgagatcaaccgatgttcgccgcgcacccagtccgcgttgctggaggccatgcaggagcgacgggtcaccgccttccggcacgagcaggacctgccggagttcttcatggtgatcggcacccagaacccgctggagagcctgggcacctatccgctgcccgaggcgcagctggaccggttcctgatgagactcagcctcggctacccggatcggcaggccgcgcgggccctgctcaagacccacggccggcccgatgccgcgccgcccgaccggccggaggacgcggcgtcggcctggccggtgtcggtcttccgggagatggcccggcaggccgccgcgctgccggtcagcgacgccgtctacgactacctgctcgccgtcgtcgaggcgacccgcacgcaccccgcggtggtgctcggcgccagcccccgcgccagcgtggacctcctccgcgcggcccgcgtctcggcgctggtccggcggcccgcgggcaccccggagcagcccgcgcacctgcgcccggaagacgtccgcgacgtcgcggccgacgtgctggcgcaccggctgatgctgaccggccccggcggcgcgccggagcagcgggcgatcgtggagagcatcctcggcaccgtcccgaccggccaggtcccggtcacccgaccgcggaacgcccggcgatga

SEQ ID NO: 387 - DNA, 1653 bp, Actinoplanes utahensis
atgacccatcaggaccgtcgcccgttccgccgtgcccaggtcacgccggccgcgctgatcgccgcgctcccggtcgttctgggcgcggcggtgttcgtgcacgggccggccgcacgcccggtgccggtgaccgaatcggcgaccatgtggctcgcgtccgcccggggtgcgctggtccgggccaacggcctggtgtcccggccggccgagcagatcatcgacaccgtgccgtacgccccggcggcgcacggcgtccacctgtccgcagaggtccccggcgcggtcttcgccacgaccgcgggacaggtgtcccgggtggacgtccgggccgggcgcgccgagcgggtcgccggtgacccggtgatcgccgccgggcccgacgtctatcaggtcggcgcggacaccgtcacccggctcgatccggccacgctgcgccccaccggcagctggacgctgggccggacggtcgccgtggccgccgggccggacgcggcgtacgtggcgacctccgccgggctctcccgggtcgacgccaccggcgtgtcccccgtcgcggatgagcacgccggcggcccggtcctgatggacggcgtcgccgacggtgtcgccgtctaccacccggaacgcggcgggatcaccgtggtgcgcggccggtcggccgcgaccgccgggacactcacccccgggccggccaccaccttcgccgccgcgccggacggccgggcgttcgcggtcgtcgccggccgcgaggtgcgggtgtgggccgccggccggccgtggagcgcgccgctcgccttcacccccggaaccggcgcgctcgccgacggccggctgtacctggccgatccggcggccggccgggtgcacgtgctcggcctgtcggccggcctgccggagcaggacgtgctcgacttccacgcgccgggccggatggagctggacgtgcaccggcgcgacggattcctgtggctcgacgacgtgcgcgggccggaggcctacgtcatccgggagggtcacgcccggcagatcgtcaagtatgtgacgccctcggcgccacccaccagccggtcggcggcggccaccaccgcacccccgccgaccacgacgccgccgacgaagccgccgcgctccccggatccgccgcgtccgtcgcggtcccgccacgacccgaagccctcggcatcgacgcacccctcccgccggcccgccacgccgagccggcccagcacgtcaccggccacccacccgagcacgcagacccccgacccgcgggcgaagtgtggtggccacgacgcctcgatcaccgtcgacgatgcggatcggaccgggccggacccgcgcgtgaccgtccgggtctgcgtcaaggccggtggcgaccagtactggatcgtcacccgcagcgagggtaagtggtacgcgaagcgtccggtcagtggcgcggtgggccggcagtcctacgtcgtgcacctgctgcacggctccggaacccccggccagcaccggcagttctccgtggtcgcggcccgctccccggaggcgcggcaggccctggccgcgaaccgggatgcggacatccagaacgccgactatccccgtgatgagctgcccagcggcgtggacaagatctccgcaccgtgcgagagcacatcctga

SEQ ID NO: 388 - DNA, 540 bp, Actinoplanes utahensis
atgacgcatcgccggatcctcgccatcgtgaccggtgcggccctgctggtcgccgtcaccgcctgcgacgacaaaaccgagggggacgaccggcaggcccggccaccggccggcccggccaccaccgagctaccgaccggcacggccaaactgctcagcccggcggacggggcgcaggtcaaccagtgcgccatcttcaccggacaggcgaacctgccgggcgacaagacactggtgctgggcgtgcgcaacaccgacaacgggaacgccgagcgctacttcgaggcggtgaagaactgggagtaccccggcgacctgaaagcgtggacgggcgcccagtacttcgggtccaaggacagctcggtgggtcagcacttccgggtggagctgctcatcgtcgacctggggctggccaccaaggcgctgcggaacgcgaagacggagggctggcacgcgccggacaacccggccggcagcacgatcgcggcgcacatcaccctggcccgggtggccgggcccggtcccgccgagtgctcgtga

SEQ ID NO: 389 - DNA, 2511 bp, Actinoplanes utahensis
ttgccgtcaccgacaaggccggcgagtagcgcgcccgactcgatcatcgagatcgcggagcggcaggtgctcggcgacgggtcgttccgggcgacggtgcggttcagcggctacgacggcgtctcctccatcaccgtgaccgaccggcggggcgccgccctggaggaggcgctcgactggtacttcgagtcctaccagaccatgccggtcgactccggcgggcgccgggaacgcaccgaacgggccctcgtcgactacggtgtcgacctcttcgagcagacgttgtccagccgggtcaacgacggcgagatcttccgccggtacgccgagcaccgcgacaaccggttcgccggctgtcgcctgcggatctccgggacggaggccttccatcgcctgcgctgggaagccctgcgggagtcaccggacgacgagccgctctcggtacagatgcccgtcgagcggtacgcccaggagatgaagccgccgttccggttgcccagtcccgggccgatcctcaacgtactgctggtcgcggcgcggccggacggcgcggcggacctcagctaccagcggatgtcccgccggctgctggagttctcctggaccgccggcatcccggtgcgcgtcgggctggcccggtccggcacctggcgcggcctggtccggcatctcgacgatcccgcggtcctggaccggcagcgcggctaccaggtcatgcagctcgacatgcacggccggatgctcagcgacgagcagctgcgggagggcatggccaccggccggctccgcccgcacgagccgatcgcgccgttcaccgggcggggcgccttcctgctcttcgagaccggcaccaccggggtcgccgaccccgttcccgccagcaaggtcgctcagctgctggaacgtcaccgcgtcgcggtcgcggtgatcaacgcctgccagtcggcgcagggctccgacaacgaggccgggctggcgcagcgtctcgcccaggccggcgtgccggcagcggtcggcatggcgtactcgatctccgccgaggcggccgagcaggcggtgacgacgatctaccgcgggctcgccgccggcatgcgacccgaccaggcggtccaggcggcccgcaagcagatgtacaacgacaacgcacgcaccgcgctgcaccagtcgttcgcgttgcaggactggctgctgccggtgctgttccagcagcgtgaggtgaacctcgagctcgaggagatgaccgacgagcaggcacagtcctggttcgcgtcactgacccacgcgggtgaggagcccgacgtcctcgggcgcgacgtcgacgtggtcaccgtggaacggctgctcctcgacgccggcgcgccgaacagcctgctgctgcacggcgcggccggggtgggcaagacggcgttcgccgggctgctcgcctggtggtgggtgcgcaccgacctggcccgccgcgccttcacgtactcgttccggaaacgccggtggtcggcccgggacatcgtgcacgacatcgggcgcaagctgtacccggaggccgacttcgagcgattctccgccgcaccgtgggacacctggctcggccgggtgtccaaccggctccgtgccgagcgtttcgtgctgatcctggacgccggtgacgacccgatcgacgcggacgcggacctgtccggcctgctcgcgctcctgaaacagggcgcgacgctggtggtgatcgtctcccggttcgaggagccggagctgaccgcgcgcctgaggtccgcgcggtacgaactgcggccgatccagccggccggcatcatcgtcgccgcgcgccgtccgtccgcgccgccggactcgccaccggcggacccgccgtcgccgggcgtgccgaagccggcaccgccggctgtcgagaggccggcgcggccgggaactcccgtctcgcgaatgcggccgcttctggcatcggtcgcggccgtcgccgtcgtggccggggtggtcgcggccatctcgctctggccgcacgacgacagcggagcgcagccgccgcccggcacgacgacgacggccgcgaccgcgggcaccacctcccccgccgtggccgccaccggtgacccggactgggtcaccggcccgctcaccggcgccgcgacggtcgccgcgccgaaacccggaacgccgatcggccagtgcgtcacgctgaccgggacctcgtcgctgcccgcggaccggaccgtcctggtcgcggtccggcgtgccgaccggtatgcgggcgagctcttcacctatttccggatcgccgactgggaccagccgcacgccgcggaccggtggagcgcgctcgtgccgctcggcaacagcggcggacagctgtacaccctggtcgtgctgaccgccgacctggaatcggtccgcaaggtgtgggccgcggccaagcgcgacccgaccagcgcgaccccggtggcgggactgcagcgggccgcgcagatccagatccggcagacccgcgccgatcaactctgctga

SEQ ID NO: 390 - DNA, 393 bp, Actinoplanes utahensis
gtgagccaccccacggtgggcactatggacggaacggcccaccaaggaggcagcgtgccgcaagcgaccatcgtgttcacgcccggattcccgatcgatcccgccgtggtggccgaggcctggtccgccgacgccgaggcccgggagctgctcgccgagggcgagaaaccctatgccgccgacgtgcgccccaccggctaccacctcgatccgctgcaggccgtggtcatcccgctgaccgtcaacgtcgccgccgacctgctggtgctgctcatcacccggctcctggaccggctgctgcccgagggcggcgcacaccggccgaaggtggacgtcctgccggccgaaggtgaggatcggatcattgccgtcaccgacaaggccggcgagtag

SEQ ID NO: 391 - DNA, 2265 bp, Actinoplanes utahensis
gtggagcctcaagacggcaaaggtccggccgaaaggaacggggtgcggcgatcggtggtgtggcggtggtggctggtggcgggggtgtccgtcaccggcggatgcgcgctgctgcccagcagcgggctggccgccaacctcggctacaacgcgatcggcctgctcgccgccctggccgtgctggccggcgtccggctgcaccggccggagcgggcccgcgcctggtactggctcagcgccgggcaggccgccaccgtcaccggtgacctgctctgggagtatttccagtacatcgcgcaccaggacccgttcccgtccgtcgccgacgtcttctacctgtccgcctatccgatgctggcggccgggctgtggctgctgttccgcggccggtcccgcgccggtggggtggtcaacgcgctgatcgccgggctcgggctggggctggtctactggatcctggtggtgcacccgatcgccgccgacaacgccgggtccgggctggccggggtgatcgccaccgcgtacccggccggcgacctgctgctgctggtcatggtggccgggctggtcaccagccgggccggtggcacggccgccgtgcggctgctggccgccgccgcgtcgctgctgctggtgaccgacggtgcggacgcggtggcgaccatgcacggctacccggaaggcgcgctcttctcctccgggtgggcgatcgcgtacctcttctggggtgccgccgcgctgcacccgtcgatggccgccgcgccgcaacccgccgccgcacgccccccgcgcgccggcagcgtccagtacgtgctgcccaccgtgtgtgcgctgctgcccccggcgatgctgttcctgccttgggtgggcggcaatcggctggaccgggtcgtgctcggcggcggctcggcggcgctgaccgtgctggccgcggcgcaggtcgccatgctgatgcgccgggtgcgcgggcaggccgccgagctgcgccagcaagccctgcacgacgatctgaccgggctgcccaaccggcgccggttcgagcaggcgctgcaccacgcggcgcggaccgggacactccgggtgatcttcctgggcctgaccgggttcaagagtgtcaacgacgagttcggccgtccggtcggggaccgggtgctgaccgtcgtggccggccggatcgccgccgccagccccgccggggccctgctgagccggctcggcggggacgagttcgcgctgctcgcgccggcggacgtgccggtcgaggagatcgcccggcggatcgtcgcggcgctcgccgccccggtcccggccggcgggcacgagctgctggccggtgcgaacctgggcctggccgaggccggtgagccggtcgaggcgctgcgccgggcggaggccgcgatgcacgcggcgaagagcaccggggagccgttccggcactggtcgccggcgctcgacgagcgggccggcgaggcagcgcggctcggcgcggagctgcgcgcggccctgcagggcgaccagttccgggtgttctaccagccgatcgtgcgggtgccggagggccgggtgaccgcgctggaggcgctggtccgctgggagcacccggtgcagggcatggtccggccggaccggttcatcccggtcgccgagcagaccggcctgatcgtcgaactgggcgcgtgggtgctgcgcaccgcgtgcgagcggctggtccgctggcgcgccgaactcgggccggacgcgcccgaccggatcagcgtgaacgtgtcggcgcgccagctggcccgaccggagttcccggacaccgtcgccgggatcctcgccctcaccggactgccggccggctgcctgaccgtcgaggtgaccgagaccgcggtgttcggcggcgggcaggcggtgaccgcgctgcaccggctgcgcgagatcggcgtgcggatcgcgctggacgacttcggcaccgggcactcgtcgctcgggctgctgcagaccgtgccggtcgacgtgatcaaggtggacaagtcgttcgtcgaccgggtcaccgagcccggccggcactcggtgatcgcccgcgcgctgatccaggtcagcgacgggctcgggctgaccgcggtcgccgagggcgtggagaccgcggagcaggccgaggccctgcgtgagctgggctaccacctgctgcagggctacttctacggccggcccgaggcggaaccggacctgctcagccggccggtgacagctgttccgctgtccgcgacgccggcgccgtga

SEQ ID NO: 392 - DNA, 204 bp, Actinoplanes utahensis
gtgcagttcagtgacaatgggaccgccgatcaccactggcagccgattccggacgggaatgtcaagctgcgggtgacgcattcgcagcaggcgccggcgatcaacgacatgtcgaccgcgaacggcgcgcagtcgccgcggggccggtggcccgacccggggctcgcccatccgcgctggcggatcatccccgcggcgctatga

SEQ ID NO: 393 - DNA, 339 bp, Actinoplanes utahensis
gtggccgaagctgatgtgcagagttcgctgacacagatcagtaaggccgcggagctctacggcgtcaccgaccaggacgtcgaccgctggcgggccgacatcgaggaccgtccggcctgggcgcagcgggcccacgtctcgggaatgctggcccagcgcctggtgatgaccgcgatggagcaccgccagcagtgcacggtggaggcctgccgcacctgtgcggggctgcgcgagatggtggtgatcgcgctcgccggggtgcgcaccgtggtcgacgaccggctcgccgagctgtaccgtcgcccggcccgctggccgtggcggcgccgccgcttgtga

SEQ ID NO: 394 - DNA, 1407 bp, Actinoplanes utahensis
atgtccatcgacaagttcggataccagcagcagttgcggcgggaactgcgtatccgcgacctgatcgcatacggtctggtcttcatggtggtgatcgcgccgttcggcatcttcggcggcgtgttccaggccagtggcggcatgatcgccctggcctatgtggtcggtgccgccgcgatgatcctcaccgcgtcgtcgtacggcgtgatggtggagaagtacccggtcgccggctcggtctacggctacgcgggccgggccatcgcccccgcggtcggcttcctcaccggctgggccatcctgctcgactacgtctgcatcccgctgctgctgtcgctggtcgccggcgccgccatgaactcgatcgtgaccagcgtcccggtctgggcctgggtcatcatcttcgtgctggtcaacacggtcacgaacgtgctcggcatcaagaccaccaagctgctcaactggctgttcctcgcggccgagctggtcatcctggtgatcttcctgatcttcggcctgaaggcgctggccgacggcaagggccacggcttcagcttcgacccgttctacaacggcaccagcttcacctggtcgctggtgctcggcggcgtctccatcggcatgctgtcctacctcggcttcgacgccctgggcctgctcgccgaggacgccgcggacggcgcccgcacggtgcgccgcgccatgtacctctcgctcgtcgtggtcgccgccctgttcgtcgcgcagacctgggtcgccgccctgctcgtgccggacccggccggtctgatcgccaacggtgacccggccggctccgcgttctacgacgccgccgaggtcgccggtggccactggctcggcaagctgaccgcgctggccaccgccctggcctggggtatcgcgaacaacatggtcgcccaggtggccaccagccgcctgctgatggcgatgtcgcgcgacggccagctgccgcgcttcctgtcgcgcgtctcgccgacccgctcggtgccgaccaacgcgatcgtcaccaccgcgatcatctcgctcggcatcggcctctggatggccaaccgcgacgacggcatcacgctgatgagcgccctggtcaacttcggcgccctgatcgccttcgtggtcctgcacgtctgcgtgatctgggagtgggcgaagaacggccggcggggcagcgtgctgcgcaacgtcctggtcccgctgctcggcgcggcggtcctgatcgcggtgatctggaacggcaacatcctcgcccagaaggtcggcctggcctggctcggcgtcggcgtggtcgtgctgatcgtgctgctggccaccgggcgcaagcccagcctgcccgaggtgcccggcgacgacgagccgctggtcgccccgaaagcggtcgagaatgtctga

SEQ ID NO: 395 - DNA, 990 bp, Actinoplanes utahensis
atgtctgacgcgctgcacatcccggccgatcccggccagtacgggtacacgttcggcggccgcgaggcgatcgcctcgatcaagccgggcgacacggtcaccctgcgcaccctggactgcttcggcggcaaggtccgctcggtcaccgacctgcccagccaggtctgcgagttcccctacctcaacccggtcaccggcccgctccacgtcgagggcgcccagccgggggacaccctcgcggtgcacgtggtgtcgctgaccccggcctcgccggtcggcatctcgtcgacgttcccgcacttcggggcactcacgtcgaccggatacacgcgtacgctgcaggcgccgctcgaggagcgggtctggttgtacgacatcgacctggccgcgcagaccgtgcggtaccgggcgagccgcagcgacttcacggtcgacctggagctcgccccgatgctgggcacggtcggcgtcgcgccggccgcccacgaggtgcgtcagaccatcgtgccggacgtgcacggcggcaacctggacaccccgctgctcggcccgggcgccaccctctacctcggcgtgaacgtgcccggtgcgctgctcgcgctcggcgacggccacgcccggcagggtgacggcgaggtctgcggcgtcgcggtcgaggtggccatggacgtcaccatccgggtcgacgtgatctccggcgtgccgaccggcaccccgcgtctggagaccgacgcccagctggtgtcgctgggcgccgcccggccgctggaggacgcgttccggatcagccaggacgacctggtccggcacgtggccgccctgaccggactggacctgctcgatgcgtaccagctggtgtcgcagacgacgagcgcccgcgcgggcaacgtcgtcgacccgcagtacgtgatgagcgccggcatcgacaagaagtacctgcccggggtcaccgcgtacagcgggatccacgagcgactgcggaacggctga

SEQ ID NO: 396 - DNA, 681 bp, Actinoplanes utahensis
atgcgacgccccggactcgaccccaccctcgtccgcgagcagctgttcatcctggcgcacgacgagaccaggcacatgcggccgcgcctgcacgtgccggccctgtcggccggcctggccggcgcgacggtgatggacctgctgatcgcccagcgggtgatgatcgagtccgggacggtgcaacccgactggtatcagcgggagaccacgttcgacccggtcaccgacgacgtgctcgcgctgatcatgcagaaggcgcccggcccggcgctgcccggcctgatccgcgcgatcgcacccagcatgtacgagcgcaccgccgccgccctgatccacaagggtgtcctgctggagtccccggcgcggcgctggcgcaagaaggagtatgagatcgccgaggagggcatctcggtccgggtccgggcgaaggtgggttaccggctcgacggccgggacggcccctccccggacgccgactgcctgtgcaccctggtctcggcgctcggcctgcacgcggcgctgctgcgcggcacccgggccgagctcgaaccgctgatgcagcggatcagccgtgacctgccggaccgtgcccgccccacccggcacccgatcggcggcgccccggcggtcgccgcggccgtgctcgccctcgtccaggatctggccacctcggcgatgtga

SEQ ID NO: 397 - DNA, 660 bp, Actinoplanes utahensis
gtgccgcggtcgccgggacctgggtgtccaagcggtacgacctgcacagcacgcacttcttcacggtgtccggccggaccttcgactgggccgtggtcggtgtgcaggtcggcatcgcggtgctcggcgtgggaatcgccgcgatgctggcgcgggcgttctccacggatcaccaccacgactgactaccgtgtcagcatggcggagatcctgacactcaccctgaccctggagaaacgtggcccggcgggcgcgttcctgctctccgacgagcaggtcgcggccgtcggcgacgggaggaaggcgttcccggtgcggctcacggtgaacggggtgacgctgccgctgcggctggcccggatgggcggcgagaacatgatcggcctggccaaggcggcgcgggcgcaggccggggtggagatcggcacggcgtacgaggtgacggtggccgccgacgccggcgaacgcaccgtggaggtcccggcggagctggccgccgcgctggccgcggacggggccgcgcagaccgcgtacgaccgactggccttttcgcatcgcaaagagttcgcgcgctggatcggtgaggcgaaacgggaggcgacccgcgcgcagcgggtcgccgagaccgtcgagatgctcaaggccggccggcaccgctga

SEQ ID NO: 398 - DNA, 462 bp, Actinoplanes utahensis
atgaacgcacgtctggaccaccgtggcagccacgtcagcggccaggtcgccaagcacctgttcgcggcatcccgcgcgatcgccgagtcgccgctgccggaaaccgtgcggcacctggtggagatccgggccagccagatcaacggctgcgccttctgcatcgacatgcacaccaaggacgccaccaaggccggcgagtcgccggtgcgcctgcacctggtcgccggctggcgggaggcgaccgtcttcaccgacgccgagcgggccgccctggagctggccgaggagggcacccggatcgccgacgcggccggtggggtgggcgacgaggtgtgggcggccgccgccgagcacttcgacgccgagcaactggcggcgctgaccgcacagatcgcggtgatcaacgcgtggaatcggctgaacgtcatcacccggcagccgggcggtgactaccaggcttga

SEQ ID NO: 399 - DNA, 963 bp, Actinoplanes utahensis
atgtctcgcttccgcaccctgatgctgtccgcgctcctcgcgaccaccgtcggtgtcccgccggccaccgccgcctcctaccccgatccgggcgtggtcaccggctcgacggccgcccacgatccatccatggtgaagacgccgaacgggggctacctgctggccaccaccggcgacgggatcaccttgaagacctcctcggaccgcaccaggttcgtggccgccggcagggccttcccgaccgggacgccgtgggcgaacgactacaccggcggcagcgccacactctgggcgcccgatatttcgtaccatagcggtaggtatttgatgtactacgccgcctccacgttcggctcgagccggtcggcgatcttcctggccgccagcccgaccggtgcagccggcacctggaccgaccatggcaaggtgatcgagtccacggccggcgggaactggaacgccatcgaccccgatctgaccgtcaccccgtccggcgagtggtggctcaccctcggttcgttctggtccgggatcaagagggtgaggctggacccggccaccggcaagcgcgccgacagcacgatggacgccgtcgccgagcgcttcgtgaacagcaagtcggtggaggcgccgttcgtcttccggcacggcggctactactacctcttcctggcgttcgacttctgctgccggggtgcgtccagcacgtaccggatcatggtggcccggtccacgtcgatcaccggaccgtaccgggatcgggccggcacgctgaccacggccggcggcggcaccgagatcctcgcctcgcacggcgcgatccacgggcccgggcatcccgccgtcctcaccgacagcgactccgacgtgctgctctaccactactacacgtcggccggcgacgcccggctcggcatcaacctgctgggctgggactcgtccgcctggccgtacgtccactga

SEQ ID NO: 400 - DNA, 105 bp, Actinoplanes utahensis
gtgcggcgccgcgtgaccgctgtctggtggtccccggacccggccctgctgctcggcctgatgctgaccgagccgcgtcagctggtcagcacgaccagccgctga

SEQ ID NO: 401 - DNA, 2067 bp, Actinoplanes utahensis
gtgcatgttttcgatctccgtaggcatccggcgaaggacgacccggatctgatcggtgcggacgagaagcatttcgccgcgatcgccgggagtctcggcgcgtcgatcgccgatctgcagcagcggctggacgccgagcgcaaggctccggccggcaaggggcgtcaggccgtggaccgggacgacgcggtgcggcggatggcgtcgcggttgcgggcgctgcgccggttcagcctggatctgtgcctgggccggatggtgcacgagtcgggtgaggtggtctacatcggccggctcgggctgaccgacggggagggcggccgactgctggtcgactggcgttcgccggccgccgagccgttcttcggcgccacgcacggcaatccgatgggtctggtcagccgccggcggtatcgctggcgggagggccggatcatcgacttctgggacgagatctaccgggcggacgccctggacggcgcggtggccctggacgatcagtcggcgttcatcgcgagtctgggcaccagccgttcgccgcggatgcgcgacgtgctcggcaccatccaggcggaccaggatgcgatcatccgggccgggtcgcgcggtgcgctggtcgtggacggcgggccgggcaccggcaagacggtggtggccctgcaccgtaccgcgtacctgctgtacaccgatccgcggatgagtgcgcgccgcggcggggtgctgttcgtcggcccgcacgagccctacctggcgtacgtgtcggacgtgctgcccagcctgggcgaggacgatgtgcagacgtgcacggtgcgggacctggtgccggagggcgccgccgcggccgaggagtccgatccggaggtggcccggttgaaggccggcctggtcggggcgatggaggcggcggtcgcgttctacgaggagccgccggcccggcccacggtggggagccgcgcggattgggcggccgcgttcgacgccccggatccgggcaccccgcacaacgaggcccgggagccgatctgggcggagttgctggccgtcctggacgagccggacaccgagacgcgccgggagctgcgcacggcgctgaaccgggcgtggccgctgctggacgccgccgatctggtcgccgacctgtggtcggtaccggcgtatctacgcaggtgcgctccctggctgggcgccgaggacgtccggcggctgcagcgggccgacccgcgggggtggacggtggccgacctgccgctgctcgacgcggcgcggcagcggctcggtgacgcctcggccgacgagcgggcgcgccggcagaaggccgccctggccgccgggcgccgcgacatggaccgggtggtcgaggatctgatcgcgtcgaacgagtacgacgacggcgagggcctgatgaccatgctgcgtcagcaggatctgcgggaggtgctcgacgagggcggcacgctgccgccggccgatccggatctgctggccggaccgttcgcgcacatcgtggtcgacgaggcgcaggagctgaccgacgcggagtggcagatgctgctgctgcgctgcccgtcgcggagtttcaccgtggtgggtgaccgggcgcaggcccggcacggcttcaccgagtcgtgggaggagcggctgcgccgggtcggtttcgaccggatcggcctggcctcgctgaccatcaactaccggaccccggccgaggtgatggcggaggcggagccggtgatccgggcggccctgccggacgccaatgtgcccacctccatccgggagagcggtgtgcccgtcgtccacggacacaccgccgagctggacggcattctgacgcagtggctggcggcgaacgacgagggcgtcgcctgtgtgatcggcccgtccggattccccgggcagcggcgcgaccgggtccgctcactgaccccggccctggccaagggtctggagttcgacctggtcatcctgatcgatccggatgatttcgggagcggcgtcgagggtgccgtcgatcgctacgtcgcgatgacccgggccactcagcggctggtcgtgctgaccagctga

SEQ ID NO: 402 - DNA, 366 bp, Actinoplanes utahensis
atgatcatcgtggggaacgtcctgaccgggctcgtggcgctgatccacatgtacatcgtcgtgctggaaacggtcctgtggacgaaaccgcagggccgcaaggcgttcggcctgactcccgagttcgccgagcagacccgggtgctcggcctcaaccagggtctctacaacggcttcctggcggccggcctgatcgccggcctgatcgccggcggccacacgggcttcgccgcgaagatcttcttcctggtgtgcgtcgccgtcgccggcatcgtcggcgcgaccaccgcgagccggaggatcctgtacgtacagaccgtccccgccgcactggccctgctgttcgtcctgctgggcggctactga

SEQ ID NO: 403 - DNA, 1566 bp, Actinoplanes utahensis
atgaggcgggaccggcgcggctactttcgaaaggtggacgtcaaacctgccgaccggaaacctgccgaccggatcgtgccgctgggacatcggttcgccgacgagctgccggagatggcggtcgcctggcgggccgcggaggcgccggagccgcggctgctcgtgctcgacgaggaactggccggtgagctgggcctggacccggactggttgcgcggcgaggccggtctgggactgctgaccggcaccgtgccgccggccggggcgaaaccggtcgcgcaggcctatgccggtcatcagttcggcgggtactcgccgcgcctgggtgacgggcgggccctgctgctcggtgagctcggcgaccgtgacctgcatctgaaggggtccgggcggacgccgttcgcgcggggcggggacgggttcgcggcggtcgggccgatgctgcgggaattcatcgtgagccgggccatgcacgcgctcggcattccgaccacccggtcgctggcggtggtcgcgaccggccggaccattctgcgggagcagccgcagcccggggcggtgctggcccgggtcgcggccagccacctgcgggtgggcagtttccagttcgcccgggcgagcggggatccggggctgctgcggcggctcgccgaccacgcgatcgcccggcaccatccggcggccgcgggtgactatccggcgttcttcgacgcggtggtggcggcgcaggcgtcgctggtggcgcagtggatgctggtcgggttcgtgcacggggtgatgaacaccgacaacatgacgatctccggggagacgatcgactacgggccgtgcgcgttcatggaggcggtggacccggccgcggtgttcagttcgatcgacaccgccgggcggtacgcgtacggcaaccagcccgggatcgcccagtggaatctggcccggttcgccgagtcgctgctgccgctgctgcacgacgacgaggagcaggcgatcgagatggcagtggccgcgctgcgcgggttcgggccggccttcgacgcggcgtggtcggccgggatgcatgccaagctggggttgtccgggggcgcggacgcgctggtggccgatgttgcggcgctgctgcgggcgggccgggtcgactacacgggcttcttccggacgctggccggcgcggcccgcggggagacggacccggtgctggccggcgcggcccgcggggggacgaacccggtgctggccggcacggcccgcggggggacgaacccggtgctgggcggcgcggcccatggggaggcggagccggcgccggccggtttcgagtcgtggctggagcgctggcgggcggccggccccgacccggatctgatggaccgggtcaatccgctctacatcccgcgtaatcacctggtcgaggaggcgctggccgccgctgccgacggcgatctgaccccggtgcaccggctggtcgaggcggtctctgatccgttccggtcacggccgggcctggaacgatacgcggagccggcgcccgacgacttcggaccgtaccggaccttctgcggcacctga

SEQ ID NO: 404 - DNA, 1035 bp, Actinoplanes utahensis
atgacggaaatccaggtcagcggtgcggttccacgccaggcgcgggccagggccaccttcctcgggtacgccatgaaggccctgcgcagcctgccccgcccggttcagcgggcggtcctgaacggtgccgccgcgggtgagctgcccccggtcgccgacttcgtgcggatgctggagatcgccggtgacctgccggagaccggccccacccacgccgaactgctcgcccgcttcccggccctggccgccgtcgaggtgaccgacccggccgtcgacggcgtccccgcccgcctctaccggcttcccggccaccccgccgaagcggcgctgatctgggtgcatggcggcgcgttcgtccgcggcgacctggcgatgccggaggcgcactggaccggcctgaccctcgccgcccgtggcatcccggtgctgtccctggactaccgcaaggcgctgcacggcgtccgcttcccggccccctccgacgatgtcctcaccggctggtcgtgggcggtcaaccacccgtcgctgatcggggtgccggcggcgaagatgcacctcggcggcgccagcgccggcgcgagcctggccgccggtgtcgccaagcgtctccgcgacggcgagggccgcccaccggccacggtcgtgctcgcctatcccgccgtccacccggagctcaccggctgggacgagccgggcctggccgcgatccgcgacaaccactccgcggtgtacttctcgccgggctggatccgcgacctgagcgcccactacgccggtccggaccggctcaccgacccgtacgcgttccccggcctcggcgacctgaccggcaccccgcccaccctgatcgtcaactgcggcgccgacaccctgcgccgctccggcgagctctataccgagcagctccgcgccgccggtgtcgcagtgacgtcccacctgctgccggacgccccgcacggcaccctcaacgatccgttcagcgacgccggtgtccgcaccgccgacctcatcgccggctggctcgttccgaaatag

SEQ ID NO: 405 - DNA, 801 bp, Actinoplanes utahensis
atgtcccaccccagccccgccgacccctccggggcccccgccactcccgcggccgccccggcctcggcagcccccgcggccgccccggcctcggcagcccccgcgtacccgggtggcttcgccgcccccggtgcgctgttcgcgaccgaccccaccacgggcgcgccggtcggcttcccggccccaggtcagcccgcaccgggcgcctacgccgcaccgggcgcctacccggccgcgcagcccgtgcagaccatcccggccccgtacgccggccagccgggcgcctaccccggtgcgcagcccgccgcctacccggccccgcagccgggccagcacatccccgccccgtactccggtcagcacccgggctacccggcggcccagcccggtctggcgccgcagggcatgctcgcctgccgtttctgcggttcggtcccggccgcccaggtcaagttccgcggtcaccagggcctgctggtgatcatgcggtttctgcacacgaccggcccgttctgccgggactgcggcctcggtgtcttccgccagatgacctcccgcaccctcgtgcagggctggtacagctacggctccttcgtgatcaccccgatcaccgtgctggtcaacctgttccgccgcaacacggtcgccaacctgccagccccgcagccgaaccctcacggccccagccgcccaccgatggacccgggcccgcgcctgctggagcgcccgatgacctggctgggcctgctgatcccgttcgccctgatcgccttgctgatcttcgcggcctcgcagaactga

SEQ ID NO: 406 - DNA, 138 bp, Actinoplanes utahensis
ttgtacaagcagcggcacgctgtcgagtgcggcatcaaccgactcaaacgcaaccgtgccgtcgccacccggtacgacaaactcgccgtccgctacgagaccaccgtgacaatcgccgcgatcaacgaatggctttaa

SEQ ID NO: 407 - DNA, 228 bp, Actinoplanes utahensis
ttggggcggtctcggggtgggctgaccacgaagctgcatctggggtgtgagcagggccagaaaccgctgtcgattgtgctgaccgctggtcagcgtggcgacagtccgcagttcatcgcggtcttggaaggcgtccgggtgccgcggccggttggccggccgcggtcacggcccgaccgggtgctggccgacaaggcttacacctctcgggctaacctagctagctag

SEQ ID NO: 408 - DNA, 444 bp, Actinoplanes utahensis
gtggacaccttagcggtgacgcggcggcacgacctgaccgaggcgcagtgggcggtgctggagccgttgctgcctgccggtcgcaggcctggccggccgtcgcagtggacgaaacggcagctcattgatgggattcggtggcggatccgggtcggtgccccgtggcgggacataccgtcggtgtacggatcctggtcggcggcgtacgcgttgttccggcgctggcagcgagagaggacttgggcgcggctgctgaccgcgctgcaatcgctagccgacgaggcgggccggatcgtctgggacgtgtcggtggactccaccgtcgctcgcgcgcatcagcatgccgctggtgcgcgtaaaagggggatctgcagggtgaaccgccgggtgggatcggcgccgagccggccgatcatgcgttggggcggtctcggggtgggctga

SEQ ID NO: 409 - DNA, 804 bp, Actinoplanes utahensis
ttgccggtcggcgctaaggcgccttgccggtcggggctaaagtgccgagccgtggatgtcgcccgcacctttctcgcggaagtcgatgctcgccagcccggtgcgctcgccgggctgttcctgcacggttcgctctgctggggcgagttcttcgccggcagcgatgtggacttcgtcggcgtctgggcccggccacccgaccatgacgccctcgccgcggctcaccacgcgaccagggcgcgacaccccgacgcgacgttcgacggtttccactgctcgccggaggacctggccgtctcggcgttgacggtggggcgtcggccggccttcttcgacggcgcattcgacccgctgggcaagggtgacatcaacccggtcacctggcacgagctggccgaacgcgctgtcgtgatccgcggcgagctgccgcccgtccacaccgaccccgcggtgctgcacgacttcacccgcgacaacctggacacgtactggcgtgccgccatcccgcagatcgaacaggcgggattcgaggcggtcggcggacacgaaccgtccgtcgcgtgggtggtgctcggtgtcgcccgactgcatcacctgctcgccaagggctcgctgacctcgaagagtggcgccggccgctacgtcgtcggggagttggacgcacgatggcaccggctcggtctcgacgctctgcgcatccgggaacgcccgcaggcgcccgcgctctacgacgatccggccgagcgcggccgggcgacgtacgacttcctgcgctgggcgatcgaggacgggatgggccgttag

SEQ ID NO: 410 - DNA, 534 bp, Actinoplanes utahensis
gtgatcggtcgtactgtcgtgcgcatggacgacatcacggcgctgatcatggaagatcaccacaggttccggctcggattcgcgcggctcgacgacgcctccggtgaggcggagctgcgggcggtgtgggagccgctcgcgctgcatctcgacattcacgccgaggccgaggaggagatcctctacccgcacctgctcaccgacagcggcggtgacgacgcggaggaggagaccgacgacgcgatccgcgaccacaacaagatccgcgacgggatcgccgaggcggcccggcacccggtcggatccgacgagtggtggggcggggtgtggcaggcgcgcacggagaacagcgagcacctcgccgaggaggaggacgaggtgctgcccgacttccgcagacacgcgagccgggagctccggctggaactgggggcgcgatggttgcggttcttcgccgagcacccgcagggcaaggggctggacttccacaacaaggacccggaaaaatacatcgccgcggtcgaggagtcctga

SEQ ID NO: 411 - DNA, 171 bp, Actinoplanes utahensis
gtgaacgcccaggccacagacaccgtgcggacctcgcccttcggcccggagacgccggagttcaacccgatgcgggtgctgcgcaaccgggtggtcgcggaattcccgcaggtgatcgccgacatcaccggacaggccaccgagctgatcaagcggtacgcgggcgcctga

SEQ ID NO: 412 - DNA, 939 bp, Actinoplanes utahensis
atgcgtatcggatatttcctgtccagtgaggaatacacgccggcccagctcatcgagcaggcggagctggcgcaggacgccggattccaggggctgtggatctcggaccactaccatccgtggaacgacgcccagggacagagctcgttcgtctggtcggtgatcggggcgctcagccaggtggcgacggtgccgatcaccaccgcggtgacctgcccgatccagcggatccacccggcgatcatcgcgcaggcggcggcgaccagcgcggtcatgcacgaaggccggttcatcctcggcgtgggcaccggggaggcgctcaacgagcacgtcaccggcatgcggtggccgatgacgagcgagcggctggagatgctcgaggaggccgtcgcggtgatgcgcgagctgtggaccggcgagttcgtcacccaccggggccggcactacgaggtggaccaggcgcggatctacacccggccggcgcaaccgccgaaggtgtacgtgtcggcgttcggcccgaaggcgatcgacgtggccgcccggatcggcgacggctacatctcggtgatgcccgacggcgacctggtcaccaggttccgcgaggcgggcggcggcgacaaacccgtgcagggcggcttcaagggctgctgggcaccgaccgaggagcagggcgtcgagatcgcgcaccggctgtgggcgaacgccggcgtacccggcgaactgtcccaggtgctgccctccccgcggcacttcgaacaggccagcgagctggtcacgccggagatgacccgcaagtcgatcgtctgcggtccggacccggccgggcacgcggcgcagctcaaggcgtacgaggaggcgggcttcgacgaggtgtacgtggcgaacatcggaccgaactaccgcgagctgatcgacatgtaccgcagcgaattcctctga

SEQ ID NO: 413 - DNA, 771 bp, Actinoplanes utahensis
atggtggcgatccggagcaggaccgaggggcagcaccggccgggcgtgcccgaggtcgtcgtggtgcacgggctgggcgtgtgcgactacctggagccggccacccgcgccctggccgggtggacccgggcacacctgatcgacctgcccggctgcggcggcagcgacgacccgccgcacgagctcgacgtgccggagtacgccgacctcgtggcggcctggctggacgagcaccggaccgggccggtcctgctggccggccagtcctccggcgcccaggtggccgccgaggcggcgctgcgcagcccctcggtggtcgcggtggcgctggtctgcccgttcccggacccggccgcacgaagtctgccgaggctgctgcgccgctgctggtccgacctgtggcgggagtcgccgagcctggcccgggtgcacctgcgcgacgtccgacggaccggcccgcgccgctaccggcatctgctgcgcgtgcacctgcggcacgtgctgggccggccggtgcgccgcctgacggtcccggtcctggtcctcggcgcgagcctggacccgatcagcccgcccgcctggggccgccacctggccgcactggcaccgcgcggctcctacgccgaggtgcccggcccgcacacgttctgctggtccgacccgcgggcctggtcggagccgctgcgggcactggcccgggcggccgacgattcggcgggcggcgccggggtatccggacggcatgcgtatcggatatttcctgtccagtga

SEQ ID NO: 414 - DNA, 345 bp, Actinoplanes utahensis
atgacagcaacgttcgcggtcagcaagcacgacgagggtggcggcgtcatccggctcgcggtacgcggcgaaatcgaccacgacgtcagcgacgcgctcgccgccatcgtggcgaacgccgccgcccagcccggcgtcagcagcctggtcgtggacctggaacgggtcccgttcctggccgccgccggcatccgcgccctggtcgagggccgggccgcggccctgcagcagcactgcggctaccaggtggtcaacgcccgcggcgtggtgcacggcgtgctggccaccaccgggctgctcggcctgttcgacacgagggtgcgccgctcccccgcgcaccgctga

SEQ ID NO: 415 - DNA, 849 bp, Actinoplanes utahensis
atgccgatcctcaaccgcctggaagaagcccgccggctcgacggcgtgagcgacaagctgcagtccgcggtcagcgccgcggtccgcccgcaacggctgcgtgacctgctgcacggcacctggctgggtcatccgctgcacccggtgatggtgcaggtgccggtcggggcgttcgtctcgaccgcgatcctcgacctgctgcccggcgtgcggcgggcgcagcagaccctgctggccgtcggtgtggcgaccgcggtcccggccgcggtggccggctggacggactggtcgcagatgacccgggaccgccgccgggtgggcctggtgcacgccggctccaacgcggtcgcgatcggcctgtacgccgcctcgctggtggcccggttgcgcggccggacggcccggggcaaggcactgagcctggccgggctgagcgcggcggggttcggggcgtatctgggcgggcatctcgcgtacgcgcagagtgccggaaccaatcaggcggcgccggacctggcgcgcctgcccgaggagtggaccgaggtctgctcgctggcctcggtgccggagcggcggaccgtggtgcggctggccggcgacgtgccggtgctgctgtaccggatcggcgaccgggtgtcggcgctggtcgagcggtgcggccacgagaccggtccgctgggcgagggcgacgtgaccggtgccggctgggacgcgtgcgtggtgtgcccgtggcacggcagcacgttccggctcgccgacggcgccgtggtgcacgggccggccgccaacaaccagccggtgatcccggtccgcgtccaggacggccgggtcgagatccgccggccgtga

SEQ ID NO: 416 - DNA, 396 bp, Actinoplanes utahensis
atgcccacccgcgacgagatgccgtcgacgctgcggcgttccccgaagaaggcgcaggacacgtacgtcgcggcccacgactccgcggtcgatcagtacggtgagggggaacgcgcgcaccgcaccgcgttctccgcggtcaagcactcgttcgagaaggtcggcgaccactgggagccgaaggcgaagaagggcccgagcgacgcgaaggccgccggtggccgggacacccgggccgagacggccggtggggtggatgccaacgccagcaaggagcacctgctcgacctcgcgaagcggctcgacgtcaccggccggtcccggatgaccaaggccgagctggtcgacgcgatccagaaggcgaacgaccggagcacccgcaaggcccgctcctga

SEQ ID NO: 417 - DNA, 1110 bp, Actinoplanes utahensis
atgcgggacctggaccggctggaaccacttgaagacctggacctgatggccgacaggtacgcccacgcatgcgaacgcgccgactgccgggaacagcggcgactgagagaacgcttcgtccgggaggcgctgccgttcgccggacggctggcccgccgctaccgcggacgcggcgagcccaccgacgacctggtgcaggtggcgcggctggggctgatcaagacggtggaccggttcgacccacagcggggatcgttcaccgcgtacgcgatcctgaccatcaccggggagatcaaacggcacttccgggaccacacctggggggtgcacgtgccgcgcggacagcaggaccgggtgctcgaattcgtgcacgcccgcgccgagctgaccagcgaactggcccgcacaccgacgttggccgagttggccgaacgcctcggcctggacgagacgcaggtgcgcggcgcgcagacgtccgcggccgcgcacaacaccgaatcgctgaacgtgccgctcggcgacaccggctccgaggccggcgacctgatcggcgacgtggacggcgacctgtccctggtcgacgaccggaccaccgtcgaaagcctgctctgcgagctgccggcccgcgagcggcggctactggcgctgcggttctggggcaacctgagccaggtcgagatcgccgacgaactgggcatctcgcagatgcacgtgtcccggctgctcagccgcaccctgtcctggctgcgcgaggcgatgctgaccgacgtgacgccgccctgggccggcgccggcgccccggaacacctggtgctggccaccgccgtgccggacggggtgcgggccgacgtgcgcggcgagatcgaccgggacaacgccaaccaggtgcgccgcgatctgatgaccgcggccggcacctgcgggcggggccgccggctgaccgtcgacctgtccggggtcccgctgctgagcgcggccgggatcgggatgctgaccgcggtgtacgaggtggcccggcagcgcgaggtgcggatgctgatcaccggggtgcagccgtacgtggcccgggtgctggccatctccggcctgggcgagctgctggtcccctga

SEQ ID NO: 418 - DNA, 1293 bp, Actinoplanes utahensis
atgcccgaagagtctgacggcgccgaggtccggcgtcgtcacctttcagggggtatcgccgctttggcaccgatgttcgcaccgctccgggagcgcaactaccgcctctgggccaccgccgacctggtgtccaccgccggcacgtggatgcaggtcctcggcctgaactggctgatcctctcggacaccggctcggccgccaccatgggcctggtcgtcatgctgcaggccctgccggtcctgatcctgggcacctggggcggggcgctcgccgaccggctgccggcccgcccgctgctgatcgcctcgcaggcggtccgcgcgctgctcgccctggccctggtcgcgcacggcggccacccgctgatctacgcggtggcgctcgcctccggggtgatcagctcgttcgagggcccggccctgggccggttcggctccgccctggtcccgccgtccgcgctcggctcggcgctggccctcggctcggtgctcagttcggccggccggatcgggggcatggccctgggcggcatcctggtcggcgtcaccggcccggccgccctgttcgtgatcaacgcggtctcgtacctggcggtgatcggcgccctgtccgcgatgcgcaccggcgagctgcgcgacctgcccaccgccgctcccggcgagcgcggcatccgctccggcctgcgctacatcgccggtcagccgatcgtcctgatcgtgctggcgctgtccttcgtcctcggctcgctgggccgcaactaccaggtcagcatggccgccatgacggccggtccgctgcacgccggttccggcgcctacggcctgctgtccaccgtcttcgcggtcggcgcggtcctcggcggcctgctgctggccggctccggccgctccaccctgcgggtgctgctcggcaccggcctcaccatcagcctgctgcagctcggcgccggcctggccccgaatctcacctcgttcgccgccctgatcctcccgatcgccgccggcgcggtcgtcttcgacaccgtcgtctccacccggatccagctggacacccgcgaggacatgcgcggccgggtgctggccgcggtcggcatcgtctcctccctgtccgggatgttcggcgccccggcggtcggctggctctgcgacaccgccggcccccgcggcgcgctgctgctcggtggcgcgatcaccaccgccgccgcgctggccggcgcggcggccgtcgcccgcgccaccggccgtgggctgcacctgccggagcccttcaccccggcggagcagatggcctga

SEQ ID NO: 419 - DNA, 831 bp, Actinoplanes utahensis
atgtccgtgatcaacgcccaggacgtcgaaaccgacgaggtcaccgtggtggtcgccacccgcaaccgcgccgaccggctccgcgacaccgtcccgcatcaccgagcgccgacgatcatcgtcgacaacgcctcggaccagcccctggacttccccggcgtggtccggcttccggagaatctcggggccgccgcccgcaacatcggcgtcgagctggccaccaccccgtacgtcgcgttcgccgacgacgactcgtactggcagccggactccctggcccaggccgccaagatcttccgtgcccacccccggacggccctgctgacggcccgggtgctgatcggtcccgaagcccgcgtcgacccgatctcggacgagatggcccgggctccgctcggcaccgcgccggacgcccccggccccgcggtcctcggcttcctgtcctgcgccacgatcgtccgacgcgacgcgttccttggggtcaacggctttcaccccaggctcttcgtgtacggcgaggaagccctgctcgcgatggacctcgccgccgcgggccatcatctcgcctacgtgcaggcgctgaccgtccgccacttcccggagccggccggccgtgacccccgggcccgcctgcgccgcgaagcccgcaaccgggccctgaccgcgctgctgcgccgcccgccacgagtggtcgcgacgaccctggccgaggtcgcccgcaccgagccggcagccctgctggacgtcacccgggacctgccgtgggcgctcacccatcggcgtccgctccccggcgaggtggaggcggccctgcgccgcctggaaagctga

SEQ ID NO: 420 - DNA, 1137 bp, Actinoplanes utahensis
atgggcaagccggtcgccgacgcccgcgactcggtgctggccggggtcggcacgctgcggcagtacgccgaactcggcccggtgcaccgcgggcggacgctggccggcaacgacgacgcgatcgacctgatggcgtacgggccgcgcggggtggtcgcggtgatcacgccgtggaacgacccggtggcggtggcctgcgggctgctcggggcggcgctggtgaccggcaacacggtggtgcacaagccgagcgagcggacgccggggaccgggcaccggctgatcgagctgttcgccctgcacttcccggccggcgtgctgaacatggtcgccggggacggcgcggtgggtgcggtgctggcggcggcccgggtcgacgtggtggcgcacgtggggtcgacggcgaccgggcggtcgatcgccgcggcgtgcgcgcggaccggggcgaaggcgctgctggagaacggcggcaaggatccgctgctggtcgatgccggggtggatccgggatgggcggccgggcaggcggcgctgggcgcgttcgccaactcggggcagatctgcgtcgcggtggaacgcatctacgtgcaccgggcggtggccggggagttcctggcggcgctggagtccgaggcggaggcctgggggtcgcggatcgggccactggtggaccggcggttgcgggcggcggtggacgaccaggtgcagcgggccgtgaaggacggtgcggtggcgctgcgcggcggggcggtaccggccgggccgggggcgttctatccgcccaccgtgctctccgactgcaccgacgacatggcggtgatgcgcgacgagacgttcggcccggtggcgccggtgatggtggtggactcgttcgccgacggcctgcgccggtccggtgcctccgactacggtctcgcggccaccgtcctgacgccgtcgatgagcaacgcccaggcggcatggcgtgccctgccggccgggaccgtgaagatcaacgcggtgttcggcggggcgccggggggcgcggctcagccccgggggttctccgggagcgggttcggctacgggccggagttgctcgacgagatgacctgcacgaaggtggtgcacctggccgcgccggccggcggatggtag

SEQ ID NO: 421 - DNA, 138 bp, Actinoplanes utahensis
atgcgtgaggtcacccagctcatcggcggcgcgtggcgcccgggcggctccggccgcgaactgaccgtttcgaacccggccgacgacagtctcgtcacccggaccgtggcctccgacgagggggacgtggtggcctag

SEQ ID NO: 422 - DNA, 1629 bp, Actinoplanes utahensis
atgcgagtcctgggaatcaacgcgatcttccacgatccggcggctgctctgatcgtggacggtcaggtggtggccgccgccgaggaggagcggttcagccgccgcaagcacggcaagcgcccggtcccgttcgccgcctgggagctgcccgaactctccgccgcgtggtgtctgcaggaggccgggctgacccccggtgacctggacgcggtcgcctactcgttcgaccccgggatcacccgggacgccgccgacctgggcctcgacgacccctgggaccacctgcgcgtcgactatgcccggcgggccccgcagttcctcgccgccgcgctgcccggcctcgacccggaacaggtccgcttcgtgccgcaccacgtcgcgcacgcggcctcggccgggctgtccgtgccggacgacaacgcggtgctggtcctcgacgggcgcggcgaggtcgccgggcacctggccggcgcctaccgcgacggcgagctgagcgtgctgcgcacccaggaactgccgcactcgctcgggctgctctacgaggacctgacccgccacctcggcttcctgcactccagcgacgagtacaaggtgatggcgctcgcgtcgtacggcaagccgaagttcctcgatcttctccgggagctggtccgcagcaccggcgacggcgggttcaccgtcgagcgcatcgactggggcgcgctggccaagccgtgcgcgcccggcgcggaactctcggacgtgcacgccgacctcgccgccagcgtgcagaaacgcctggaagaggtgatcctcgacctggcccggtggacctacgaggcgtccggtggcctgcccactctcaccatggccggcggcaccgcgctcaactgcgtggccaacggccggctggccgccgagggcccgttcgaccgggtctgggtgcagccggcggccggcgactccggcaccgcgctcggcgcggccctcgcggtacacgggcagagcatcccgttcaccaccgccgcgctcggccgcggctggtccgacgaggagctggaagccgacctgaagcgggccgcactgccctacacccggcccgcgtcgatcgccgccgaagccgccgaggtgctcgcccgcaacggcatcgtcgcctggtaccaggggcgcagcgagtacggcccgcgcgcgctcgggcaccgctcgctgctcgcccaccccggcgacaaggacacccagcgccggatgaacgacgtgaagggccgcgagcagttccgcccgatcgccccgatggtccgcgccgaacggttccacgacatcttcgaaggcgtctacccgagcgagcacatgctgttcgtgcaccgggtcaagccggactggcgggatcggatcccggccgtcgtgcacgtcgacggcaccgcccgggtgcagaccgtgcacgccgacaccgagccggtggtcgccgagatgctcgccgagttcgagaagcggaccggcctgccggtggtggtcaacacctcgctgaacaccgccgggcgcccgatggtcgacacgccccgcgaggcgatggaactgttcggatcggcgccggtcgatctgctcgcgatcggcccgttcgcggtccaccgggccggggcgttccgcgcgtga

SEQ ID NO: 423 - DNA, 747 bp, Actinoplanes utahensis
gtgatcaccgtcgtggtgccgaccctcggccgtcccagcctgggcgcgctgctcgccgcgctaccccgcgacctggacatcctggtggtcgacgaccgcccgttcccgcccgatccgctgaccgttccggaccacgtcacggtgatcccggggccggcctgcgggccggccgcggcgcgcaacgccggctggcgggccacccgcgccgagtgggtggtcttcctcgacgacgacgtgctgcctggcccggactgggcggggcggctcgccgacgatctggccgacgcgaaaccggacgtcggcggcgtgcagggccggctgcgggtgccgctgcccgggcaccgccggccgaccgactgggagcgggtcaccgccggcctggccgacgggtcctggctgaccgccgacatggcctaccgccgggcggccctcgaagcggtcgacggcttcgacgagcggctgccgcgcgccttccgcgaggacgcggacctggcctaccgggtgcgcgcggccggctggcggctgacgacgggggagcgcacgacactgcacccggtccgcccggagagcccctgggtcagcctgcgcacccagcggggcaacgccgacgacgccctgctgcgccggatccacggtccggactggcggcggcgcctggagatcccgcccggccgccggtcccggcacgcggggatcaccgggctgctcgccgccgcgctgatcgccggggcggccgcggctagctag

SEQ ID NO: 424 - DNA, 1965 bp, Actinoplanes utahensis
gtggcgctggcgatcagcggcacccaaagcagcggcggcattgacagcagcggcccccgaagcagcggcggcattgacagcagcggcccccgaagcagcggcggcgttgacagcagcggcatccaacgcagcggcggcacccgaggcggcagggcggcacgtaacggccccggaggcagcggcggcggcaccgagaccggcggccgggtgatgtcgcggctctacgacgccgtcctgttcgaccgggacggcacgctgatcgccgacgtcccctacaacggtgacccggaccgggtccggccgatgcccggcgcccgggccgccctcgaccgcctgcgcgccgccggcctgcgcctcggcgtcgtcaccaaccagtccgggctggcccgcggcaacttcacccccgggcagctcgcctccgtccaccaccgggtcgaggagctgctcggcccgttcgacacctggcagatctgcccgcacgacgacaccgccggctgcgactgccgcaaaccgcgaccgggaatgatcgtcgaggccgcgcgggcgctgggcaccaccccgcagcgctgcgtggtggtcggcgacatcgggcgggacatggccgcggccctggccgccggggccgccggcatcctggtgccgaccccggtcacgctgcccgacgaggtcgacgccgccccggccgtggtgcccgacctgaccgcggccgccgagctgatcctgcaccgcgaagccctggtcaccccggcgccgcggccccacccggccggcacggtgctggtggtgcgctccgactcggccggcgacgtgctggtcaccgggccggcgatccgggcggtcgcgcacggcagtgagcgggtggtgctgctctgcgggccccgcggccgggcggcggccgagctgctgcccggcgtcgacgaactgatctcgtggaagctgccgtggatcgacccggaacccgatccggtggcggcggccgatctcggcgggctgaccgagcggatccgggcggccggggtggacgaggcggtggtgttcacctcgtaccaccagtcggcgctgccgctcgcgctgctgctgcgcaccgccggggtgcagcggatcaccgcgatcagcgaggactatccgggctccctgctggacgtgcggcaccgggtaccgcccggggtgccggagccggaacgggcccgcagcgtggccgcggcggccgggttcggactgcccccgggcgacgacggcggcctgcgggtacgcggcgacgacggcttcccggcccgcgccggcggcggcccgcgagtacgtgacggtaagggcccacgactgcgtgacggcgaggacccgcgagtacgtgacggcgaggacccgcgagtacgtgacggcgaggacccgcgactacgtgacggcgaggatccgcgggtgcgggagagcggcggcccgcgggcgggtgtcccgcgacaggtcgcgggtggcgggcacgtggtggtgcaccccggggccagcgtcgaggcgcgctcctgcccgccggacaacctgcggcgcatcgtgcgcgaactcaccgcggccgggcaccgcgtcacggtcaccgcggggccgggcgaggagaacctggcggcgtacgtcgccgatgccgtggcggacctggtggcgccgcccaccctgaccgatctcgcccacctggtggcggccgcctcctgcctggtggtcggcaacaccggcccggcgcatctggccgccgccgtcggcaccccggtgatcagcctgtacgcgccgaccgtcccgtacgcccagtggggtccctaccgggtgccggcggtccggctcggccgggccggcgccgcctgccgtgacacccgggccacccgctgcccggtgcccggccatccctgcctgtccaccgtcgaaccggcccaggtgctcgacgccgtcgagcggctcggcgccgccagccttgaggacgtcgcgtga

SEQ ID NO: 425 - DNA, 927 bp, Actinoplanes utahensis
gtgaacatcctgctctggcacgtgcacggctcctggaccacgtcgttcgtccagggcaagcatcgctacctgatcccggtcaacgacgcccgcgacgcgtggggccgcggccgggcccgcaccttcgactggccggacagcgtcgaggagctgccgctggaccagatccgcgacgcggacgtggcgatcgtccagcggcccgaggagatcgacctggtgccacccagcctgccggtgatctacgtggagcacaacaccccgaagggcgacgtgccgaacacccggcacccgatggccgaccgggacgacctgatcatcgcccacgtcacccacttcaacgacctgttctgggactgcggcggcacccggaccacggtgatcgagcacggcatcgtggagccgaaggcccgctggaccggcgagctcgaccgtctcgcgatcgtcaccaacgagccggtacgccgcggccgggtgaccggaaccgacctgttcgagcggttcaccgcggcggccccgatcgacgtgttcgggatgggcgtcgccgatctgcccggcgaccggatcaccccgcacgaggacccgccgcagcacgccatgcacgacctgctcgcccagcgccgtgcctacctgcatctgtgccgatggacctcgctcggcctcagcctgatcgaggccatgcagatcggcatgccggtgatcgcgctggccaccaccgaggcgatcgccgccgtgccggacggcgccggagtgctctccacccgggtcgacacgctcgtcgaggccgcccactggctcatcgaggaacccgacgaggcccgccggatgggcgaacgggcgcgccgcgcggcgctcgcccggtacgggctggaccgcttcctcgccgactgggaccaccttctggagggacacacatgcggatcgcgatga

SEQ ID NO: 426 - DNA, 1200 bp, Actinoplanes utahensis
atgcggatcgcgatgatctcggaacacgccagcccgctcgcggcgctcggcggggtggacgccggcgggcagaacacgcacgtggccgacctggcctcggcgctggtcgcggacggccacgaggtgcgcgtgtacacccggcgcgacagccccgacctgcccgcgacggtgccggtcgaggccggcttcgaggtggtgcacgtcccggccgggccggagcggacgctgcccaaggacgacctgctgccgttcatgggcgacttcgccacctggatggcgcgggactggctggcctggccgccggacgtcgcgcacgcgcacttctggatgagcggcctggccgcggtcaccgcggcccgccgctgcgacgtgccggtggtgcagaccttccacgccctcggctcggtgaaacgccgccaccaggggaccgacgacaccagcccggcgcaccgcgtcgcctacgagcggcagctcggccgggtcgtcgaccgggtgatcgtgcagtgtcaggacgagctcgacgaactgctgctgctcggggtgccccgggcccgcaccacgctggtgccctccggggtcaacgtcgaacggttccgcaaggacgggccggtcgccccgcgcgacagccggccgcggatcctgtcggtcggccggctcgtcccccgcaagggtttcgaggacctgatccgggcgctgcccgaggtgcccggcgcggagttggtgatcgccggtgggccgccggccgcggcgctcggccaggacccgtacgcccagcggctgctgcacctggccaaggagtgccacgtcgaggaccgggtggagctgctcggcgcggtgccggccgcccggatgccggcctggtaccgctcggccgacgtggtcgcggccaccccctggtacgagccgttcggcctgactccgctcgaagccatggcctgcggtgtcccggtagtcgcgaccgccgtcggcggcctcaccgacaccgtcgtcgacggggtcaccggcgacctggtgcccgcccacgacccgcacgggctcgggctggcgctgcgccggctggtcaccgaccagagccggcggctcagctacgcggccgccgcggtcgaccgggccgtgcacgcctacgcctggccgcacatcgccgcccggatgagcgcggtctacgcccgggtcgcctcgctgtcggcggcggtcgcctga

SEQ ID NO: 427 - DNA, 1314 bp, Actinoplanes utahensis
atggaccccctggacaagcacctcgccgccctggccgcgtcgctcgccccgttccggaccgtcggggcccgcctcgccgactggggtgccgacctggccgcacacctcggcggcggcggccggctgctggtcgccggcaacggcggcagcgccgccgaggcacagcacctggccgccgagctggtcggcaaactccgcgaggaccgcatgccgctgtccgcgatcgcgctcaccccggactcctcggcggtcaccgcgatcggcaacgactacggcttcgacgaggtcttcgcccggcaggtgcgggcccacgggcggcccggtgacgtgctgctggtgctctccaccagcggccgcagccccaacctggtcgccgcggtgcgggccgcccgggactgcgggatgcgcacctgggcgatggtcggcgccgggtccagcccggtcggcgacgcctgcgacgaggtgctgcactgcccgtcccccgactcacaggtggtccaggaactgcacctggtcgcggtgcacatcatgtgcgaacacatcgacctcaatctttcgcagccgacggctggaggcacccgcgtgaagaagccactgctggtcgtggtcggggacaccctgctggaccgggacgtcgagggcacggtgcgccggatcgcgccggacgccccggcgccggtcctcgacgaaacggaggtcagcgagcgtccgggcggcgctggcttggccgcgctgctcgcggccggccgcgaggactacgacgtcgcgctggtcaccgccctggcgggcgacgccgccggcgcacggttgagcgagcttctcaccgccgccgggattgcggtgtacgccttgccgctgcccgggtcgaccccgcagaagatccggatgcgcgccgcgggtcaggtgctgctgcgcctggaccggggcggggacgcgcggatgcccggtgaggcgccggacgggcttctcgacgtgctgaacgaggcatccgcgatcctggtcagcgactacgggcgcggggtggccgggcacccggcggtgcgggccgcgctggcggcggcgagcgcgccgatcgtctgggatccgcaccccaacggcgccaccccggtgccgggagtcgcgctggccaccccgaacctggccgaagcgaaagggttctccggcgacgccgggaagggcaccatgctgaccaccgcgcagcggaccgggcaccacctcctcgaccactggcgggcccgggccgtggcggtgacctgcggggccggcggggcggtgctcagccaggccggcccgaccccgctggtcatcccctag

SEQ ID NO: 428 - DNA, 570 bp, Actinoplanes utahensis
gtggcggcggccaccacctatgtgctgaacggtggggtgaccgcggccctgtccccggccgccgccaccccggccgttcccgccccggaacgcatcggcgccgacgcggccgggcggctcgccgccgaggtccgcgaccggggcggggtcgtggtcgccaccggcggctgcttcgacctgctgcacaccgggcacctggccaccctgcgcgccgcccgcgggctcggcgactgcctgatcgtctgcctcaacagcgacgagtcggtgcgcgggctgaaaggaccggaccggccgatcaacgcgcaggccgaccgggcccggctgctcgccgccctggactgcgtggacgccgtggtcatcttcgacgagccgacgcccgaggcggtgctcagctggctgcggcccgacgtctgggtcaagggcggcgactacgccagcctgcccgaagcggacctggtcaaacgctgggacggccagaccgtgatcgtgccctacctcgacgggcgctcgaccacccggaccatcgacgcggcccggtccctgaccgcggccgccgacagcaggaggtaa

SEQ ID NO: 429 - DNA, 684 bp, Actinoplanes utahensis
atggacgcagtgatcgtgaccggcggatcgagcgggctcggcgccgccgtcgtcgacgccgtgatcaaggccggcggacagccggtggtgatcgaccggcaggcgcccgcccgggagggcgtcccgtggatcgagtgcgatctcgccgacacgcgggccgcggaacgggcgacccgggaggcgatcgccgccgtcgacgcgacggtcagcggggtggtcaccgccgccggcttcgacgtgccgggaacgctgctcgacgtgccgggggagacctgggaccggatcgtggcggtggacctgctggccaccgcggcggtggtccgcgcggcgctgcccgcgctcaaggaatcccacgggaccgtcgtgacggtggcgtcgaccctggggatcaaggcggtgtcggacgccacggcgtactgcgcggcgaagttcggggtggtgggattcacccgggcgctcgcggcggaactggccggcgaggtcggggtgaccctggtgatccccggcgggatgcggaccagattcttcgacgagcgtgacgacaggtacaagcccgggccggacgcgctgctcaacgatccgtgcaacgtggcggacgcgatcctgttcgcgctgcagcagccggccggatgcgcggtgcgggaactggtgatcgcggcggagacggagacgtcctacccgtga

SEQ ID NO: 430 - DNA, 930 bp, Actinoplanes utahensis
gtgatcctggtgttgcgcgccctcggagtgggcgacctggcgaccggggtgcccgcgctgcgggcgctccggtccgccttcccggggcgggaactcgtgctggcggcgccgaggtggttgacgccgctggtggacctgatcggcggagtggaccgggtgctgccggtcgacggactcgacggggtgggcgcacccggtctcccggaggcggtttccggggcggagctcgcggtgaacctgcacggcagcgggccggagtcgcatcggatgctgcgcggagccgggcggttgtgggggttccggtgtgccgcggcggagcatctcgacgggccggagtgggtgcgggacgagcatgaggtgcatcgctggtgccggatgctgcggtactacggcgtcgccgcggacgaatcggatttgtcgctgatgaagccgttggtggggtcggcttcggtcaccgtggtgcacccgggggccaagtcggcgtcccggcggtggccgcccgagcggtacgcggcggtggcgcgcgagctggccgggcggggacaccgcgtggtgatcaccgggagcggggcggaacgggacctgaccgcgaaagtggcggcggacgcgggcctcgggccggaggcgctgccggacaccgacatcgggtcgctggccgcgctgatcgccggcgcccggctgctgatcagcggggacaccggggtgtcgcacctggccaccgggttcgggacgccgtcggtgacattgttcgggccgatgtcgccggcctactgggggccgccgccgggacgggcgcggcaccgggtgatctggcacggcacgagcagcgagcgcggcgaccggcccggcccggacgtgcacccggcgctgctcgccgtcaccgtcgacgaagccctggccgcggcggaccacgcgctcgcggcaccgtga

SEQ ID NO: 431 - DNA, 1803 bp, Actinoplanes utahensis
atgccccctgacggttgcgcccggtggcgtgggcacatcatcgtgtgcgggctggacgacgtcgggctgcggaccgtggagcagctctatcacgccggcgtccgggtcgtcgtggtggaggacatcgcggatccgcggctggtccgggtggtgcgtggctggggcgttccggtcgtggtcggcagcccgcggctgcaggagacgctggacgaggccgggctgcccggcgcggtcgcggtgatctgtgtgctcgccgacgacctgcacaccctggaggccgcgctgttgatgcgcgagctgcgcccggacgtgcgggtggtggtgcagctgcggaatccggcggtcgggcgggcgctgtcggcgatgcaggtcagcgtgctggacgtggccgggctgtcggcgccgtcgatggtcgaggcctgcctgcgcagcgggacgcacgagctggatctggacgggcagccgttcgtggcggcgcaggtggtcgccgagcagtccgggacattgcggacgcggtacgggtcgttggcgccgctcgcggtgatgccggcggcggccgcctcggacgacgacgtggtgatctgtcccggtcgggaccatccggtgcggcccggggacctggtgaccctgctgggcacgccggaggaactggcggcggcgcggctgctggacaaggcgcgcggtccggcgcacgccggacccggacggtgggcgcggtcgctgcacctggccgggtccgtgctgcgggcgctggacaggcggatagcgtacgcgtcgatcgccctgatgctgctgctcaacctctccatcgtggtgctgcaactgggctaccgggagccggacggcacccggatgacgctgctcgacgcggtctacttctcggtcgagtcgatcgccaccgtcggctacggcgactacaacttccgccaccagcaaccctggctgcgctgcttcgcgatcggcctgatgatcctcggcgcgtgcttcgccgcgacgttcatcgcgctgctcaccaacgtgctggtctccatcaagatccaggaagcgctcgggaaccggctgctcgaccggctcaccgaccacgtcgtggtgatcgggatcggctcggtcggcacccgggtcgtcgagggcctgcgggccagcggcacccgggtggtggtgatcgagtcggacgaggacaaccggtacatcgaccaggtccgcgacagcggcgtgccggtgctgatcggcgacgccacgctgccccgcaccctggaccgggtgcagctcgggtcggcccgcgcggtcgccgtgctgaccagcgacgacctggtcaacctggagaccgggctggcggtccgggaccggctcggcgagcgctggggatcggtgccggtggtgctgcggctcttcgaccggacgctggccgcgaccgtcgagcacaccttcgggctgggtctggcccgctccacggcggccctggccgcgccgtggttcgtcggggcggcgctggggctggacgtgctcgccacgttctacgtcgggtcgcagctcatgctggtcgggcggctcaccgtggccgccggcggcgggctcgacgggctggccatgcaggacctgtcggcgcgcacccgggtggtggcgatccgccgggccagcgggcacggcgagctggaacacccgccgcggcgcgacacccggttcgcggccggcgaccaggcgcacctgatcgggccgtacgaggagctgctccaggtgctgcgccgggacgcgctgtcgacctcggaactcacgccgtcggaaaatgtcgtacccggtcgttag

SEQ ID NO: 432 - DNA, 318 bp, Actinoplanes utahensis
atgtaccggcagggtgatgtgctgatcgttccggttccgccggccggggtgccggcgtgcgcgccggtgccccgggacccgcgcgggcggatggtgctggcgcgcggtgaggccaccgggcacgcccacgtggtcggcgggcccggggtgcggctggtcgccgacctcgacgacccggagcggatgttcgtcgaggtgccggcgcacgggcgggtgtcccacgaggagcacgggccgatcgcgctgccctccggggtctaccgggtgatccggcagcgggaatatgttccgggcgcgttccgtccggtcgcggactga

SEQ ID NO: 433 - DNA, 135 bp, Actinoplanes utahensis
atgttccgggcgcgttccgtccggtcgcggactgagacgggggagcggatcgtgcgactcacgcatgagcaggaggcgctggcggccgccgtcgaggaccggtggctggccgccgcggtggcgctagctagctag

SEQ ID NO: 434 - DNA, 705 bp, Actinoplanes utahensis
atggtggccgggcggctgcggcagcggctcggcgaggatgtggccgccctcgggcgggagttccagcggccggtgctcgacgcgatctacgggcagcacgacggcgcgtggctgagcaccttcgacgcgggggaccggctgctgcccggggccgggctgatgggcgggctggccgggctcgcgcaggtcgcggggaacgccggctggtggtgggcgcacgagcgggtcgccgtgctcaccgagcgtccggtggcgctgacccgcgacaacgtggggcggctgcaccggggcgacgggcccgccctggagttcgccgacggctacggattgtgggcctggcgcggtatgccgatcccggccgggctcgccgctgagctgccccggctcagcgtggaccggatccggggcgagtccaatgccgagatccggcgggtgatgctggaacacttcggctacgagcggtatctgcgggaggccggcgcccgtaagcgggatgcggacgagaccggggtgctgtggtggctggacctgccgggggacgagccgctggcgatggtcgaggtggtcaacgcgacgcccgagccggacgggagcagccgggtgtactggttgcgggtgccgccgcagacccggaccgctcgggagggggtggcctggacgttcgggctgaccgcggacgaatatcagccgttgatccagacctga

SEQ ID NO: 435 - DNA, 1314 bp, Actinoplanes utahensis
gtgagccgcctcgccgtcgtcggcaacccggagaaccgccgggtcggccgattcgtcacggccgccgaccgcgccggcctgcccacgccggagatcttcccgtggcgcgaggtcctgctcaccggccgggtccccggccccgacaccctgacccggatcgattcgccgggcgagaacgccgaggtcgacgccctgctccgcgccctgggcaccaccgcaccgccgccgctggaccccggacaccggccgcgccaccactcgggccgggacggcggacaccgcccggacccgcccttggagcacgacggggcggcgaccttcgccgggccgacagcggagcacggcgaggccactgtctccgccggaccgacagcggagcacggcgaggccgctgtctccgccggaccgacagcggagcacgaccaggccgctgtctccgccggaccgacagcggagcacggcgagatcgtcggtggggcggcggccttcgccgggttggcagtggccctgcaccggatcgaggccggtggcggcatcctgctgaaccggccggcggacattctgacgatgaccgccaagccccgctgccacgccgtcctgtccgccgccggagtccccgtgccgcccgcgctggagatcgcggtcaccgggtatgccgcgctgcgatccgcgctggacacggcgggatggagccgggtcttcgtcaaggcggcctacggctcgtcggcgtccggcgtcctggccctcgcgctcggcggccggcgaccgggcggccaccgcccgatcatggcggtcacctcggtggagctggccgacggaaagatcttcaacaacctgcgggtacgccgttacgacgacgaggcctcgatcgccgcgatcatcgaccggctggcaccggacggcctgcacgtcgaacgctggttccccaaggcggccctcgccggcagagtcctggatctgcgggtggtcgtgatcgccggtcgggcgcggcacgtcgtcgcccgcacgagccgttccccgatgacgaatctccacctgggcaacgcccgcggtgacgtcgccgccgtccgcgcggcggccggcggcgcggcgtgggccgcggcgatgcggacctgcgagcgggccgccgcctgtttccccggcacgctgcacgccggcgtggacctgatgttccacgcgaactggcgctcgcacgccgtcgccgaggtgaacgccttcggcgatctgctgcccggcatcctgtccgacgacggcctcgacacctacgaagcccagatcgccgccctccagaacggctggctccccaccccctga

SEQ ID NO: 436 - DNA, 426 bp, Actinoplanes utahensis
gtgatcaccatcctgctggtgcggcacgcggacatcgacctgccgccggtctcggccgatccaccgttgaacgaggcgggccgccgccgcgccgaggccctggcgcacctgctcggcgcggccggcgtcagcacggtgttcacgtcggcgttccggcgtacgcgggagaccgtcgaaccgctcaaaatggcgtcgcgggagatgccgagcgcggctaccgtggctcatgaggcgcgcgccggcagatacggcgccgtcgtgttgatcgccggccacagcaacacggtgcccgaggtgattgccgccctcggcgccccgcccccggccatcggcgagaccgatttcgacaacctcttcgtggtgacgaccgcggacgatgccgagcccggcctgctgaggctgaaatacgggatttccctctcctga

SEQ ID NO: 437 - DNA, 1074 bp, Actinoplanes utahensis
atgacgtacgcccaccggatcagctgcatcaccccacccttcattctgaccaggctcctggacagcgacaacgtcgacatccgccaggcggccctgtccactctggtgtcgaccgcgcacctgcgcggcgagcgcagcgtccgcggcctgatcgccggcgcgctggcctcgccgtcggacggccggcgcagtgtctacgactgccggcacagcacgttcctgccgttcgccacgctggtccgctcggaggacgacgccgccgtctcggacgcctcggcgaaccgggccttcgacggtttcggcgcgacccgctcgttctacgccgaggtgttccagcgcaactctatcgacgaccgcggcatgcggctcgagggatacgtgcaccggggtcgccggtacaacaacgcgttctgggacggccaggagatggtcttcggcgacggggacggccaggtcttcaccgacttcaccgggtcgctggacgtgatcgcccacgagctcacgcacggggtcaccgagcacaccgcgggcctggagtaccacggccagtccggcgcgctgaacgagtcgatctccgatgcgttcggttcgatggtcaagcagtggtcgctgggccagaccgcggaccaggcggactggctgatcggcccggaggtgttcaccccgcacatcgacgccgacgcgctgcgctcgatgaaggcgcccggcaccgcgttcgacaacaagctgttcggcaaggacccgcagcccgaccacatgtcgcgctacgtcgacgcgccggacaccgacgagggtgactggggtggtgtgcacaccaactcgggcatcccgaacaaggcgttctacctggtcgccatcgggatcggggggaagagctgggaggccccggggcacatctggtacgagtcgctcaaggcgtcgacgtccaaggcccagttccaggacttcgccgacaccacgtatcgcaaggcggagcagctctacggaacggacagcagggagcagcaggccgtcaaggcggcctgggacggggtgggtatccaggtgaccacgacaccgacgctcgcgcgctag

SEQ ID NO: 438 - DNA, 300 bp, Actinoplanes utahensis
atgcgggtgtccctggcgtcgcacggcgggatggcggccgcgatcacctcgcggctgccaccccgggtgctggacgccgatcgcctgccgcgggacgcggcccaggagctgcgccgcctggtcgcggccgccaccgcggatccgggtggcgcagctccgtccccgcgcgcccgcgacgccatgacgtacacggtcacgatcgacgacggcccgcgttcgaccacgctgaccgcctccgacacgacgatgtcagcggccttcggcgagctggtcgcgtggctcgaccagcggatcggttga

SEQ ID NO: 439 - DNA, 1224 bp, Actinoplanes utahensis
atggaagaaacgggctatggcgtgctggcacgccgcacgctggtcgtgctgggcgtgacgctgtccacgctggcggtgctgtatctggcccatgaggtgcgccgggtcctgacctggatcctgatcgcggccttcttcgcggtggcactgcatccggcggtgaactggatgacccgccgggtgacattctgcaggcgttggctcgcgaccctgctggtcttcgtcgcggcgctggcgctgctggccggtctggtcacggtgttcgtggcgccgctggcccgggagggcagccaggtcatggcgaacctgcccggcctgctcgacgacgcccggcacggccggggcccggccggaccgctgctcgaacgcttccacgtggtcgagtacgcccgggccaacgccgggcggttccgcgagtacgccagcgggctgggcgccccgaccctggcgttcctgcgctcggtcgccaccggcatcgccggcaccgtgaccatcttcgtgctgtcctacctgatggtgctggaggccccgaagatcgtggacgggttcctggccctgttcgcgccgcgccgggccgaacggatccgccgggtcggccacgactgcgccaagacgatcaccgggtacatcaccggcaacctgctgatcagcgcgatctgcggcgcgctgaccttcgccgtcctcacggtcctgcacgtcccgtacgccggattgatcgctctgttcgtcggtatcgccgacctcgtgccgctggtcggcgccacgctcggcgccgtggccgccaccatcgcggcattcgtccagtcgaccaccgccggaatcgtggtgatcgtcttcttcgtcctctaccagcagttggagaaccacctgctgcaaccgctgatcttcgcccggacggtgcagctcaacccgctcaccgtgctcgtcgcgatcctgatcgcggtcgagctggccggcatcctcggcgcactgctggccatcccggtcgccggcatcgtgcagatcatcctgcgcgacgtgtgggacagccggcacggtcgccccaaagccgagccgaccgtcggcgagaatcgcgtcccggtctcggccgtgcacgacgaggcacggggccgcgacgccgggaccgctgacgtgcacggcgcgtacgccggacagctcaccgaccgggccgcgtcaaccgatccgctggtcgagccacgcgaccagctcgccgaaggccgctga

SEQ ID NO: 440 - DNA, 654 bp, Actinoplanes utahensis
atgccagaccgccgatcgggcgagaaagccggcctgagcagggccaaggtgctggacgccgcgctcgactacatcgacgcgcacgggctgccggcgctgtccatgcgcaaactcggcgcccggctcggggtcgaggcgatgtcgctgtaccggcacgtgccgaacaaggacgccctgctcgacggcctggtcgaccgggtgctggagaccgcgttcggcagcctcggcgaacccacctccggcgactggccggactggctgcgggagttcgcgcacgccctgcggaagaccctgatcgcccaccccggcgtgctgccgctggccgccacccgcccggtcaactcgcccgacgcgctgcgctggtcggagtcgtggctggcggcgatgcgggcggccggggtgccgctgggccgggcgatggacatggtgaacgtgctggccacgttcaccatcgggcacaccctggccgaggtcgggcagacgccggggcacgagggcgccggacccgacctggaccagcgctcggacgaactggacccggccgagttcccgaacctggtggaggtgatccggacccgggccgggctggacttcgactcccgcttcaccgaggcggtcgacatcctgatcgccgggtacgccgccgcgcaatga

SEQ ID NO: 441 - DNA, 477 bp, Actinoplanes utahensis
atgaccgccctggcgttgaccctgatcctgctcgccgtcggctatcacgcggtgatgacgctggtcgatctgttcccgttcaacaacgtccgcgacgcgaaacgcgccgagcgggtccgggaggtcgcgacgaacgcaccggtgatggcgctgcccgcggtgctgctcgccctcggctcggcatccggcctgccgatcctcggctgtctcggcggcgtcgtcgagctgctcgcggtgctcggcgggctgctgctgtggtggtcgccctacctggccggggtgaccatgccgtgggccaccgccggcaccggcgtcagctgggccgacctgcacgcccgcacctacgcccgcaccatcatggtgctgccccggatcggtgggcggccccgccccaatctggagcacatcctgctgcactcgctgatgttgagcgccgcgatcaccaccctggcggcggcttcgggccggcacgggtga

SEQ ID NO: 442 - DNA, 1281 bp, Actinoplanes utahensis
gtgagatggcgtggattgaccggtgtgctgagttcgcaggcctgcacgctgtcggcgaaccggctgctcaccgtcgcggtgccgtggctggtgctggagcgcaccggcagcgccgcgcagaccggcctggtggtggcctgtcaggtgttgccgtacgcgttcacccagtggctggccgggccgctgctggaccggatcgacccgcggcggatcagcgcggccggggacgtcgtctcggccggcgtgctgatcgtcccggccctgtccggcgctccgccgatctggctgctcaccgtgatgctgctgctggtggggtgcgcggacgggccggcgagcgccgcgaagcggctgctggtgccgttcgccgcggcggatgccggccagtcgacggtgcgcggcgtgggtctggccaccgcggtcgagcgcaccgccaccgcggtcgggaccgcgctggccggttggctggtcgccacgatcggcggggaccgggcgctgttcgcggcggccgcgatgctgggcgtggccacgctcatcgtgacgctgacggtgaccgatccggtgcgtgaccgcggccgggacgacgagacctatctggatcggctgcgcaccggcaccgcgttcctgcgcgggagtgcgccgctgcgcgcggtgaccgcgatgttcgtggtgaccaatctgctggatcaggcgctgatggcggtgctgctgccggtgtgggcgcgggccggcgggcacgacgcgacggtggtcgggctggcgctgagcacggtggggctcgcgtcgatcgcctcggcgctcgcgtcggccggtttcggcgcgcggctgccgcggcgggcgacgtacctgatcggggtgttgaccagcgggccgacccgcatcgtcgtcctcgcgctgggcctgccgccggaggcggtcatcgccgtctatgcactggccgggatcggctcgggcctgttcaatccgctgctggagacgctgcaggtggagctgatcccggcggcgctgcgcgggcgggtgcagacgctgatcaacgcgtgggcgtgggccggcatcccggtcggcggcctgttcggcgcggtgctgctgagcaccggcggcctgcgcaccgcgctgtggatctgcggcaccggctatctcgcggcggtgctctggccggtctggcgggtcgactggtcgcttacggtcagcacgtcggagcggcaccggaatccgctcaccgtgcgcattccggtgccgcggcgccgggtcgcggcaccggtcccggtccgcgaacattcatga

SEQ ID NO: 443 - DNA, 228 bp, Actinoplanes utahensis
ttgacaggccccgagcgagggagggacccgatgccgatccaccatcagcagtccgatccggaccgctacccgccgctggacccgggcgcaccgattcccgacgatccgggcgaactggatccgaccaatccggacctgccgccggcgcccgcggaaccgatgccgccgatctcgccggtcccggcccggcccgagccggccacccagccggaacccgagcccgcctga

SEQ ID NO: 444 - DNA, 669 bp, Actinoplanes utahensis
atggacaatgcacgcgttcttgtcgtcggtgggcacgggaaggtggcgcggctgctgctgccgctgctggtcggggccgggcacgaggtgaccgcggcgttccgggatcccgggcacgagggcgacgtggccgcgaccggtgcccggccggtggtcgccgacgtggagacgctggacgccgacgggttcgccgagctgatcgccgggcacgacgcggtggtctggtcggccggtgccggcggcggcgatccggggcgcacgtacgcggtcgaccgggacgcggcgatccggtcgatggacgcggcgctgcacatcggcgtacgccgctatctgatggtgtcgtacttcggtgcgcggatcgaccacggcgtgccctccgacagcggtttcttcccgtatgcggaggcgaaggcggcggcggacgcgcacctcgcgtcgagtgatctggactggacgatcctggccccgagccggctgaccgacgacgcggcgaccggccggatcgagacggccagccagggtgcgacggccgggtcggtcagccgcgccgatgtggccgcggtcgtcgcgcacgccctgggtgagccggcgaccatccaccggatcgtccggttcaacgccggcgccaccccgatcgccgacgccctgagcgaggacgacctcgtttga

SEQ ID NO: 445 - DNA, 939 bp, Actinoplanes utahensis
gtgagcatccggctcggttatcagattccgaatttcacctaccccggagtccccgacgagaacctgttcgacacggtcgtggcgcaggccagggaggctgaggcggtcgggttcgacaccgttctggtgatggaccacttctaccagctgccgggtatcggcgcgcccgaggcgaacatgctcgaggcctacacgacgctgggcgcgctcgccacggcgacgtcgacggtgcagctgtccacgctggtcaccgggaacacgtaccgtaatcccaccctgctggcgaaaacggtcaccaccctggacgtggtgtcgaaggggcgggccatcctcgggatcggcgccggctggttcgagcgggagcatcacgatctgggcttcgagttcggcaccttcacccagcgtttcgagcggctggaggaggcgctgaccatcatcgccccgatgctcaagggtgagccggcgacttttgagggcaaatggtatgtggcgcgcggggcgatgaacaacccgcgggtccggccgcacatcccgatcatgctgggcggctccggtgagcagaagacgttccggctggcggcccggttcgccgaccacatgaacatcatctgcgatgtcgacgacgtgggccgcaaggtgtccgtgctgcgggagcggtgcgaggagatcgggcgggacccggccacgctggccaccagctacctggccatgggcctggtcggggagaacgagcaggaggtcaaggagttcagcgcgctggtcccggaggaccgccggaaccgggcgttcctgggcaccgccgagcaggtcgccgagcagctgcacgagaaggtgctcggcgcggggatcggcgggatcaccatcaacctcatcaagaacggccaccgacccggtgtcgtgaccgccgtcggtgaggccttgaagccgctggtcaagtga

SEQ ID NO: 446 - DNA, 591 bp, Actinoplanes utahensis
gtgtcacgggagcgggcctaccaccacggtgacctgcgggctgccctgatcaccgccagcttcgaacagctcgccgaggccggtctgcgccggttctcggtcgccgcggtcgcccggcggctcggcgtcagctccgccgcgccgtaccgtcatttccccgaccgtgaccacctgctctccgcggtctccgcggccgccgcccacgacctgcggtccgcgatcctcacggccgccgacgaagccggcgccgacccgtccgcccggttggccgcggtcgcgggggcctatttccggtacgtggtccgcaccggcgccggtttccacgtcatctacgcccccgagctgtacgcgatcccggacaccccccgccgcgaccacacccgcgccctgatggacacgctgatcgacctggccgccgccaccgacgtccccacctaccagcaggcggtgagcctggtggaagcggtcatcgcggtcgcccacggctacacgtcgctgtacgccgacggattcttcacccgaggcgcccgctccgtcgacaccaccgccacccgggccaccgacgccgcccgcgccctgatccacgcctga

SEQ ID NO: 447 - DNA, 261 bp, Actinoplanes utahensis
gtggacagggaactgtgggctgcggcctaccggccgccggtcgacgtcgcgtcgttcgcccggcgggcgatcgacgtgttcgctgcccgcgatgtggcgctcggcaggaccggcgagaggcagaaggacctcgaactgttgaccgccctgctggccgagggacgcctgaaccccgaggcggagatcgcgaacgatcatgaccggcgatgggccgaccgtcgggctaccgactctccgaacccgcgcgccccatccgcctga

SEQ ID NO: 448 - DNA, 648 bp, Actinoplanes utahensis
gtgcgcgtgggatacacgggcgtcatcgtggtgggtcgttcggcgcggctgttggttcacgaggagggcatggacgacttcgggtaccagcatcgttatgtacggccgctcggcgatgggtggcagttggtggagaccggcggccacctcgagacgctggagcttcgggaaccgtgccgtcgactggcgatgtcgacggggcggccggtgctggccgcccaggtgttcgacagtgatcgggcgctgctgtgtaccgctgtcgggcacaccaccgggctggtgacgtgtcggtacgacgtcctggcggcatgcggtgacgaggacggggcccggacgccgcccggtgcgaccggtcgcccggtgggggacgtggtgagcgggctgctggcctggagcgcggcggccggcctgcccgccgacccggcggcggtgcgcacggtggtgaccggggatcagctggccgacgatgccgtcttcgctctcgtgggtgccctcggcgtggccgggatcggccggacgctaccgcgcgcttttccggtggagagctggcctttctcgccgctctccacgttggcgtacctggcacggatgtcggctctcggccgggcgagggccggcgaggccgagccgatggcgtcctgggagtag

SEQ ID NO: 449 - DNA, 1422 bp, Actinoplanes utahensis
atggcttccccgctgtccgactcatcgcagatccagggcaacatcctgcggccgttccgcggcgaccaccaggcctttgtcttcctgtccttccgcagcgaccggcccggcgcgcgggcctggctgaccggtgcggccggccgcaccaccggcaacgacgaagttccgcagagccgacccgcgccggacggcaccccggcgcgggccctgctgaacgtgggcctcaccggcaccgggctcaccctgctgcacccggagaccgccggcgacctggccggtcacaccgccttctggcaggggccgctcggcacccgcctcgacgacgccggtctgctcaccaccgcgccggccctgctcggcgacctcggccccggcgacccctcgcagtgggtggtcggcggaccgggccggccggtcgacgcactgctgaccgtcgccgccgacgagtacgacgacctcgccgtcgccgtcgagcgggaactcctcgaggcggaacggcacgcgctggccatcctgtccgtgcagtggggcggtgtgctccgcaacgagcacggcaagcgcatcgagcacttcggtttcgccgacggcatctcccagcccggcgtccgcggcttcgccgacacccagaagtccggcgcgccggtcatcgccgccggcgagttcctcctcggccaccccggcgaacgtcgcccgccgtcctggacgccgcggccgaccccggcagcgtggatgcggaacgggtccttccaggtgttccgccgcctgcggcaggacgtggccggctggtgggagcacatgaacgcgctcagcgccgccgacggcggatccccggaggacgccgccgcacgggcgctcggccggcacctcgacggccggccgctcgccgcgcccgaccgggtcaacgacttcacctaccacggtgacgacgacggcgcccggacaccgcgctacgcgcacatccgcaaggtcaacccgcgcgaggacgccgtcttccgcgaccgtggccacaagatgctgcgccgcggcatcccgttcggcccgcggctgcaccgccaccagccggacaacggtgaggagcgcggcatgctcttcaacgcgtacatggccagcatcgacgaccagttcgagtacgtgcagcgccggtgggccaccgaccccggcttcccgtcctcgaccctggcccgctacggccgcgcgggcgccaccgacggcccggccgtcgacggtctcgacccggtcctcggcggcaacgcccggcaggccggcgagaccctcgccccggaggtggtccgcggcatcccggccgccgccttcggcggcttcgtcaccaccagcggcgcggtgtacgccttcaccccgtccctgcgcgccctgcgccagctggccggcgacgccccactggacgccctggccaccgcctga

SEQ ID NO: 450 - DNA, 4050 bp, Actinoplanes utahensis
atgactatgcaacgtaccgataagatccggaaggcggatacaccaggagtgactgacgactccagtcccacgtcacagatcgcggctgaactcgccgctacctggcgctcctacctgcctgatcatgccatcggtctactcaggaccggcgaaagtgtcggcaatctgcccctttccgagcggaccgacgcggtcatcctcttcgccgacgtggccggcttcaccgccatggccgaaagcctggccggctcgggcagctatggcaccgagcgcctcacctccgtgatcaatcgctggttcgcggtgaccgcggaggccatcgtcaccgcgggcggcagcgtggtcgacttcgccggggacgcgctgatcgggttgttccgctacaccccggacaccgcgttgacggtggcgcgtcgagcggtgcgatgtgccgagatcatccgcatggccaccgcgtccgtcgacccggtgccgacccccgaaggtcaacgctccctggcgatccgggtcgggatggcttcgggcccggtactggtcatggtcctcggcgaccccggcatccgcctgcaacacctggtcgccggcccggcgctggatcaggcggtcagcgcgctgcaccgtgcggagcggggggagatcgtcgtggaccccggtctgctggacacggccggacccgaactggacgtacccgtcccgccggcaaccgccgtctcgccgatcgccgatctcgaaggtcttctgaccccctttctgcaccccgccatccgcgaccggctccggtcgggccgacacgaactcgtgaacgagcaccggaaggtgaccaccgcgttcgtccggttgccggacctgtcggtggacgatccgcagaccgtccggacgttgcagcgattcctgcgagccggcgtcgccatcatcgatcagtacggtggccatctgcgccatctgatggcggatgacaagggcaccgtgctggtcgcggtgttcggcaccccggtcagctacgaggacgacgaggagcgcgccctgcgctgttgtctcgaattgctggcactcccgggcggtccctaccgcggaggcgtcaccaccgggcgggtctactgcggtgaggtcggctcagacatccgccgggagtacgccgtggtgggcgacgccgtcaacctggccgcccggctgatgcaggcggcacccgccggccacctgctcatcgatcaggtcacgcacgaccgcgtcggcgacatcgcgctcaatgcgcggcaggccgcggtgtccgcgaagggcaaagccgagcctgttccggtctggatcgtccgcgaagcacaggaagcggggccgccggccgccagatcgaaggcggcgcccggctcactggtgggccgagcctcggaactgggccttctggacgccttcgccaagcaggtggagaagggccacgggcacctggtctggctgcacggcgaagccggcatcggcaagacccgggtcgctgatgaagccctccgggcggcccgagcgctcggcttcgccgaatacgcggggggaagccgatcgcacggaaagcggaccagctacctggtctggcgctccattttccgcaagctcctcgacatagatcccgcactgtccatctcgatgcagcagacggtgctgaccgaacgggtctcccgctacgacacgtccggtctgcgcgcaccgctgctggccacggtgatcaacctgccgatggaggacaccgacctcaccacgcagctggaaccggccggacgcgacgagttgctgcgggcgaccctgctggcctgcatccgggaccgggccgaggagggcccgatcgttctgctgctggaggactgtcactggatcgatccggcgtccctggcccttctcgaatatctggtcccgcacatcgccgacctgccggtcctcatgatcgcgacctcgcgcgaggcgataccggaacggctgatcggtccggcccacgtcgctgacctgcacctgggacagatgaccaggggtgacgccgaacaactggccacccttcgacttcgtgaacgccacggagtggtggccgacatcgcccctgaggtactccggcagatctccgagcaggcgggcggcaacgccttctacatcgaggagatggtcagctacctgcacggccgcggtgtcgacacggggaatccccgcgctctcgccggcgtgcccgtaccggagaatctgcagcgcctcgtgatggcccgcatcgatcaactcagtgacgacgagaaggcgaccatcaaggtggccagcgtgatcggccgacgcttccagccgccctggatagcgtcgatctacccggccgccggcagcgcacccgaggtggcggatcacttgaatcgcctgcacgccctggacctcacgccgcgcatcgcgccgggacccgaaccggaatacgaattcaagcatccggtcacgcaggaggcggcctaccagagcatcacctacgacacccgagcggcgctgcacgaacggatcggccggttcatcgaggaggagtacgccgatcggctctcccagtacgtggatgtgctggctcatcactacgcccgcaccgaacgggtcgacaagcaacgcgcatggttccgcaaggccggggatcgggccagggagatcttcgcgaacgagaccgcgacctactactacggcctcctgctgcccctgctcgccgatccggaccgcgcccaactgcacgtcgagatcggcagcgtccatcagcacaccggccagtgggcggaggccgaggaccattatctgcaggcgatgcggctggcccgggtgaccggacgacgtgacgtcctcgccgccgcccagcgccagctcggcgatctgctgacctacacccgaaccgacgacgagccggtcacctggctgtcacgcgctctcgcggagttcgagcacctgggcgatgccaccgggcagtgccggacgttggacaggatcaccttcgccctctaccgcgtaggcgcctacaacgaggccctcagcatggcccaacgacacctggaactggccaccgagatcggcgacctggccgcggtgagcgccgcgctcgagcacaccggattggtctacctgcacaccgggcgaccggaggccgccttcgatcatctgcagcggtccctcaccaccgccgagcagtccggcgaccggcagcgcatgctcaacgccgcctgcaacctcggcttcgcgtcggtcctgggatccaaccacgtccaggccatcgcctccttcatgaacgcgcttcaggtggcacaggacatcggagcaggccagaccgccaacatagtggtcgggaacatcggcgagatctaccgggacgaaggcgagtaccggcatgcccggatctgcgccatgcgctcgctgcgcgtcgcactcgaactcggcgattcgttggcggtggccgtgcaggtggccaacctgggcgccgtcgccgccgccgaaggcgacaccgacgtggcacaggacctgctggagcgggccatcgagctgatccggccgcacagtgcgccgttctatctctgcgactggctgcaccggctggcccggctgcatctcgcggcggaacggctggcggaagcggagcagctcaatgccgaggcgctgcggatcgccgaggagcacgacgagcgggacgcccgggtgagtgcctacatcctgtcgatccggctgcgggtgcgggccggccgcctggagtccggggatgccaccgacatgctgcggaaggcgaccgacgagtggaacgagccgcacgaggtggccgcgctgctcgacgcggtgcgtcagctcgatccgcatgacgaacaggcccggacgacggccgccgacatctaccgcaccttgtacgagcgggcgccgagcgtcgaataccggcgcgcctaccgccggctcaccggcgtgctgctgccgcccggcccgccgctgccggaactgccgggctggatcgccgccgaggacggcgccgacctggatgagctgctgcaacgcatcgaccgctcagcccgcgagccccggccctag

SEQ ID NO: 451 - DNA, 600 bp, Actinoplanes utahensis
atgcctattgcagtaagcgacgctgccttcgaactggtcggcgcgtgcgctcatgcgcttcggtttgccctcgccgctcctctcgactatccgtatgccgcggccggcatctcgacgaccactccgccgccggcgttgttccggcgggtgcaggtggcgtcgccgccgccggaccgtggtgccgagccgtggcacaccggcctcactctggacgacaagccgttccaggctgacctgcccaccgaccggctgggtgaggtgcgacttgaggatggcattccttcgctcgatctgccggatccgtccagcatcgtactggatcgatggttcagcgttccgcgtcgcagcagcacgattgctttcccgggccgagatttcgggcagtatctcctgtccgttcagtactggaaccctgtcccgccgggggagccggcggtgaccagggacgtcgcctaccacgggacgtaccggttcgagttcgagcggccgccggccggggactggatcgcggtgagcttcgagggcttctggccgcccgagcgggacagcgccgacctgctgattccgctgggcgagtgtgacgacaactgcccgacctga

SEQ ID NO: 452 - DNA, 276 bp, Actinoplanes utahensis
atgacattgaggcccgaggaggtggcgatgatcatcgtggtgatgttgtggctggccgcgctcgccaccggggtctgggcggtgtggccggccaaggagaagaaggttgcggccgtcgcgccgccccggcccgagcccggcagtctcgaaggggtactggtggcgcagctcgtgcgggcggagatcagcgcggcgcagtatcggcgggccgtcgaggggatcgcggcgcgcgacgagcagcggcatccgatgtccgtgccgggggaggaagcctga

SEQ ID NO: 453 - DNA, 447 bp, Actinoplanes utahensis
gtgaaacagtttctggtatcactcgcgctggtggtggcgagtgtcgtgctcgggcttatggtgccgaccgtcgcccggcacagccaggccgatttcgacgatgcgcagcgggtcggcaccgggaccgtgtacctgtgtaccgaatacggacctctgacgttcgccggattcggctacacgagcaagtgccgggtggacgtggtctggcgggacggcagcaaggagatggtgaacccgaaccggtacggtttcgccgacgcgtccgagctgggccggacgatcaccatcggggatctgggcaacggcaagtacgcccgccccgaccgcccgttccgcccgctgatcgtggtcaccgcctggctgatcgccctggtcgcggtcgccgccctgctcctcggtctggccggcctgcgccgggcgctccgggaacgggtctcgttccgctga

SEQ ID NO: 454 - DNA, 159 bp, Actinoplanes utahensis
atgtccacgtggcggatcaccatcgccgaaggcacattgcgtaccctcgatgaggcgtcgttctgccatgcggccggcatcgccgccggccggatgatcgaggatcaggccatgcggatcctccaactcaaagcccaggtgtacggagagccgaagtga

SEQ ID NO: 455 - DNA, 759 bp, Actinoplanes utahensis
atggaaagcggcatccagacgattcttgttggcgctcaattcgccggccttcttgtagttgcgatagccgaagtcgtgtcgccagcaggggaggcggaagtcgaatccgagtggccggtcggggctggccgaacagtagtcggtgccccagtcgaaatggtattcgtcgggcgcctgccgggcggtgttccaggccgcgaaactggacgcgtccggctgggtgtaggacgccagcacggcctcacgatcgggaacggtcatgcccatggtggctaccgcggcggtgatcagggcggtcagggtgggcgacatccgggcctccagagggggacgggtcgctcagtctggtccgcacgccgtacgcgtcaatcggttgtcgtcgttgtttctgatcggtgtgcaaagcggcacttccggtactttgccagcatgatcgtcgttcgctcgctgctgttgttcctgctcgcggctctcaccgagatcggcggggcgtggctgatctggcagggccggcgggagcaccgcggcccgtggtgggtggtggccggggtgctcgcgctcggggcgtacggtttcgtcgcgaccctgcagcccgacgccggcttcggccggattctcgccgcgtacggcggcgtcttcgtggccggctcgctcgcctggggtgtgctggtcgacggcttccggccggaccgctgggatctggccggcgccgtcatctgcctgatcggcgtcaccgtgatcatgtatgcgccgcggtga

SEQ ID NO: 456 - DNA, 1251 bp, Actinoplanes utahensis
atgtttccgcgcagcacccccgccccgtccctcctgcgcggcgcgaccgggcgacgactcggccggcgtgacgcgctgcggctcggcgggctgtccgcgctcggcgctgcgctggccgcgtgcggggtgccgggccgaggcacgcccgcggccgttgtggacgccgacgccctggccacattctggcagggtaaagcgaagaacggcagactcgatttcgcgaattggccgctctacatggacccgaagcaccccgagctgacccgtttcaccgcggagaccggcatcaaggtgaactatcaggaggtcatccaggagatgggcccctggttcgccaaggtgcagccgcagctctcggcgaaacagtcgatcggttacgacctgatggtgatcaccaacggcatccagttcggccagttccgggcggccggtttcctggcgccgttggaccattcccggctgccgaacttcaccgcgaacgccggcccgaaatacgccaccgagacgttcgacccgggcaatgtcttcagtgtgccgtgggcctccgggatcaccggcatcgcgtacgacccgaagaagaccggccgggagatcaccagcttggccgatctgtgggatccgaagttcaagggcaaggtcggcatgatgtccgacagcaccgaactggccaatttcggcctgctcgccgccggtgtcaagccgggcgagtcgaacgaggcggattggaggaaggcggcggcgaaactcaagcagcagcgcgacgccggcatcgtccggaagtattacgagcaggattacgtcgacgcgctcggcaaaggcgaggtgtggctgacccaggcctggtccggcgacgtcttccagaagaacctgtccgacggcacgaacctcaagttcgtgatcccgcaggagggcggcacgatctggacggacaatttcgccattccggtgaccgccgccaacccggtcgacgccctcatgatgattaacttcttttaccgggtggagaacgcggcgtcgctggcggaatacatcaactacgcctgcccggtgccggcggcgcaggcgcagatcctcaaggacgcggccaagctgtccggaaccgatcgcagcgacatggagctggtcgcgaagagcgacctggtcttcccgagcgagaccgactacgcgaagctgcactattacgtgaacttcggcaccgccgaggagcagcagcgattctcctcgatcttcgagccgatcgtgctgggctga

SEQ ID NO: 457 - DNA, 513 bp, Actinoplanes utahensis
gtgctagctttcgtttccatgcgcgtcgacgacgctcgcggaaaggcagatcccatgcatccggacgtacgcgtggcgcaggccggcccagtcgacctggacaccgtgaccacgctgttcctgggctatctcgatttctacgaggcgcccgcggaccgggccgaggcgcgtcaattcctcagcgaccgcatgacccgcggcgaatccaccgtcctgctcgcccggatcggtgcccaggcggccggtttcacgcagctctacccgtcattcagctcggtccgccgggcgccgatctgggtgctcaacgacctgttcgtcgacccggcgttccgcggcagaggcgtcggccgcaccctgctgcgcaccgccgccgacctcgccgaacagaacggcgtcgtccgcatcgaactgtccaccgacgaatcgaacagcacggcccaggcgctgtacgagtccgagggctaccgcaccggcttcccggtccgccactaccttcgccgcatcggcgcctga

SEQ ID NO: 458 - DNA, 1479 bp, Actinoplanes utahensis
gtgacgacacgacagcgaactctccggaagtccgccgccgcggcgatcatcgcgctgacggccgccggttcggcgatcggcatgccggcaccggctcaggccgcggtgccgaaggtggcggccagctggtcgagcctgatgtaccgcagcctcacccacgacacgcagcttgcggcgatgcgcacctcgctggccggccagcaggccgcggtccgcacctggaacgccgaggcagcggccgcgaaccgggcggaccggacggcactggccacggtggcgaccgccaccaccgcggacaccagggcccgcgccgatctcagcgccgcccgcaccgccctgaccggcgcccagcagaacctggtgaccgccaggcagaccctgaccaccgcgaagcagaccctggccgccgccggcatcaccgtgaccgccgcgaagcgcggcctcaccaccgccgaccggaacctgaccgccgcccggcagcgcctggtcgccgccaagcggaatctgaccaccgccaagcagaacctggcttccgccaagcagaacctgaccctcgccaagcggaacctggccgcggccgaccggcggaatccgcgcaacgccgtcgcggtgaagcgggcgaccaccgcggtcacccgggcggccaccgcgctgaaccacgcgaccgccaccgttccgcgggcgaccaccgcggtcacctcggcgaccaccgcggtcgcccaggccggcaccgcggtcacccaggccggcgccggtgtcacccaggccacggccggggcggaccgggccatcacccgcgtcacccgcgccaccaccggggtcatccgtgcgaccaccgcggtcaccgcggccaccaagacggtcggcgttcgcaaggcgcagacccagacgaccgccgccgacctggccgccgccgccaaggccgagcgtgccgctcgcgcccggatcgccgaggccaccgccggcgcggcgaccggggcgaccgctgtcacccgcacccagcaggcgatcaccgcgctgcccaccgccgcgtcgctggccggtcaggccgccgccctcagtagggacgtggtcacccaggtccgggccaacttcaagatcgaggacaccacccaggtgtacggcgtgaccgtgcaccgcagtgtcgccttcgccttccagcacatgatcgacgcggcgaaggcggacggcgtccagctttccgggggcggtttccgcaccacccagcgccagatcgagctgcgcaccatcaacggctgccccgacgtctggacggcgccgtcgtcgtcgtgccgggtgccgaccgcgatcccggggcgctccctgcacgagctgggcctggccgtcgacatcacgtcgggaggcaggaccatctcgtcgaagacggccgcgttcaagtggctgacggcacacgccaagacgtacggcttcgtcaacttcccggtcgaggcctggcactggtccatttccggcaactga

SEQ ID NO: 459 - DNA, 207 bp, Actinoplanes utahensis
gtgcagtccggcccgcgccgtgcccgggcccgtcccgggctgcgccgcccggtgcgccttgcgttggcagccggcttgcgctccggtgcggtttgccgactggtgttctatgaggctcgccgagcggccgagtgggccgtgcaggccgagtgggccgtgcaggccgagtgggccgtgcaggccgagtgggccgtgcgggccgtgtag

SEQ ID NO: 460 - DNA, 378 bp, Actinoplanes utahensis
atggcgttcctgctcgatctctgcaacatcctcggcggcctgctgctggcgatccccctgttgcgccgcctgccgaacgtgggcgacaacttggagcgcttcaccgaccgggtcgcccgctgggcctggctgatcggcatcgtggcgctgatcgcggcgggctacttcctgatcgtgcacctcttcgaggggcacatctggcacttcgaggtggtcggaatcgccgtggggctgctactgacctgggaaaagttcaccgggcgccgaattctggaggctccgggaccggccgaacccgcaggccgggcactggtcatcgcgatcttcggcgtgatcgccatcatcgtcggcatcgaaggcctcttcacccccaactaa

SEQ ID NO: 461 - DNA, 882 bp, Actinoplanes utahensis
gtgagcaccttgaccccccgcgtggtgatcgtgtcgcggcgcagcgagctcgatgagctgctcgcccggcacggcacccgcggcgccgcggcctacttcctgaaacagcgcggccgagacctcgacgaggtgtccacccggcacgaggcgctgcgggaggcactgacccaggtcggggccgccatcccggccgactggcggcgcggccacgtcgagcgcgccgacctgccgcgcttcctgttcgccccggaggacgtggtcatcgccgtcgggcaggacggtctggtcgccaacgtcgcgaaatatctcgacggccagccggtgatcggcgtcgacccggagcccggccgcaaccccggtgtcctggtccgccaccccgcgacggcggtcggccggctgctccgcggcagcctgccccgccagcagcgcaccatggtggtcgcccggctcgacgacggacaggagctggccggcctcaacgagatctacatcggtcacgccggccatcagtccgcccgatacgtgatcaccaccccggacggcacccgcgagcgccagtcctcctccggcctgatcgtcggcaccggcaccggcgccaccggctggtgcgcctcgatcgcccgcgaccgcgccaccgcccctcccctgccagccccggccgacccggccctgtgctggttcgtccgcgaggcgtggccctccccggtcaccggcgtcagttgcgtctccggccttctcaccaccggtcaggagctggagctgaccagcgaaagcgaacgcctggtcgtcttcgccgacggcctggagtccgacgccctggagctctcctggggccagcgcgtccgagtcagcctcgccccgcgccacctctcgctggtctga

SEQ ID NO: 462 - DNA, 111 bp, Actinoplanes utahensis
gtgctgcaggcgctggccctgcgcgagctggcccagcacctcccggcgatcggcgagctcaccgtcaccccggacatgctcaccaggctcctcggccgcatcggctcctga

SEQ ID NO: 463 - DNA, 108 bp, Actinoplanes utahensis
gtgctgggccagctcgcgcagggccagcgcctgcagcacctcgggcggcaggtcccggtaggccgcgaggcgggccgcctcggcctccgcctcggcctagctagctag

SEQ ID NO: 464 - DNA, 786 bp, Actinoplanes utahensis
atggccgacatcaagcgccgcctgcacctgcgccacctgcgctccgccccgaccagctgggtcagctacaccgtgcggggccgggccaagcgcgccggcaccgggctcgccttctggtatcggccgctcaccgcggtcctctccgaggtgccggtcgacgaccgcgagctgcccctgctgttccacgcccgcaccgaggacttcgccgacgtgaccgtgcaggccacggtgacctaccggttcagcgacccggccgccgcagcgtcccggctcgacttctccatcgacccctaccggggacagtggcacggtcagcccctcgaccaggtcgccacactgctcgccgagctggcccagcagcccgcgctcgacctgatcgcccggctgccgctcgccgagacgctgaccaccggcatcgccccggtccgccagggcgtcgccgacgcgctggccaccgacccgcggctggccgagaccggggtgaccgtggtcagcgcccgggtggtggcgatccgtcccgagcccgacctggagcgcgcgctgcagacccccacccgggaaaaggtgcagcaggacgccgaccgggccacctacgcccggcgggcgcacgccgtccagcaggaacgctccatcgcggagaacgagctgcagagcaagatcgagctcgcccggcaggagcagcacctggtcgagcagcacggcgccaacgcccgccgtggcgccgagctggacgccgagtcgcagctggtggcagcccagggcgaggccgagcgggcgcggctctag

SEQ ID NO: 465 - DNA, 693 bp, Actinoplanes utahensis
atgacccttaatgcgatggcggtcacggtcgacctggtcctgctcaccatccggcagcagcggctgcaggtgctgctggtccgccgcggtatcgagcccttccggggcggctgggcgctgcccggcgggttcgtcctcgacgacgaggacctcgacgacgccgcccgccgcgagctgcgcgaggagaccggggtcgacgcggtcgccggtcacctggagcagctcgggacctatgggcggcccggccgcgacccgcgcgggcgggtggtgacggtggcctatctcgcgatgctccccgacctgccggccccggtcgccggcagcgacgccgccggggccgcctggcggccggtcgacgaggccggcgacctcgccttcgaccacgaccggatcctggccgacggcgtcgagcgggcccgtgccaagctggagtacacaccgctcgccacggcgttctgcccgcccgagttcaccgtggccgatctgcgggtggtttacgagtcggtctggcaggtgcagttcgacccacgcaacttccatcgcaaggtgaccaccgcggaggatttcatcgagccgaccggccacagcgtgacccgcgagcgcggtcgcccggcccagctgttccgccgcggccacgcgccgctgctgcacccgccgctgctgcgcccgggcagtctcggccaaaagtcgtag

SEQ ID NO: 466 - DNA, 2205 bp, Actinoplanes utahensis
atgacgatggtgatggaacggacggctgaggtgcggccgctgccgcagcggtgggtgcgcccgccgtcgtcgcgtcgtgtggtggcacgggtcgtgcagttcgtcggcgcggtcagcgcggtgtcctcggtgctgcccccacggcaccaccaggtggcgctgctggccggcatgatcccgacgaccgggctgctcaccgcgcgggtggcctccggggtggtcggcgtgctgctggtctatctcggttccgggctgcgccgcggcaagcgccgggcctggcaggtcgcgctcaccctgtcgctgatcgcgatcggcctgcacctggtcaagggcgggctgatcccgatggcggtggccggcgggatcgtggcactgctgctgtcgcgccgccacgagttcaccgccgagggcgatccgcgcaatcggtggcgggcggcgcgcgcctgtgccacgttcctctccgcgggcttcgccctcggtttcgccgagatcgccgtacgcgtcgatcacctcaccggccgccccggcgtgctcagctgggcggcccacgcgctgctcggactggtcgggatcaccggcccggtccacttcgtctcgccgctggccgatctcacggtgacggtgaccaccggggcgttcgggctgctggcgttcgcctcggccgcgctcctgctgctgcggcccagcaccggggcggccgcgtcgcccggtgacgacccggcgcggctgcgcgccgtgctcgaccggcacggcgacggcgactcgctcggctatttcgcgctgcgcagcgacaagcagctggtctgggcgccgtccggccgggccgcggtggcctaccgggtggtcaacggggtgagcctggcctccggtgacccgctcgggctgccgtcggagtggccgcaggcgatcgggcagtggctggccgactgcgcccggcacggctggaccccggccgtgctggcctgcggcaccgccggtggccgggcgtatcagaagaccgggctcgacgtcatcgagctgggtgacgaggcgatcgtcgacgtggccgggttctcgctggacgggcggccgatgcggggggtgcggcaggcggtcgcccggatccgccgggccggctacacctgcgccgtgctgcgccagcgcgatctgccggcggagacgctggccgaggcggtggcgtgcgccaacgcgctgcgcgacggcaaggtggagcgcggcttctcgatggccctgtcccggctcggcgatccgggcgacggcgactgcgtgctggtcctctgccgcgacgaggagggcacgctgcgcgggctgctgcagctggtgccgtggggacggcgggggctgtcgctggacctgatgcgcggtgaccggacggcgccgaacgggctgaccgaactgatgatcgtctcggcgatcgaggcggcgcccgggttcggggtggcccgcatctcgctgaatttcgcggtgctgcgctcggtgttcgcccgggccgaggagctgggcgccgggccggtgatccggctgtggagccgggtgctcagggcggcgtcgcggctgtggcagatcgagtcgctgtaccgggccaacgccaagtatcagccggactggcagccccgcttcctctgcttcccctcggcccgcgacctgccccggatcgcgatcgccgccctgcgtgccgagtcgttcctccccaccggcggcccctcctcgatcgcagcctgccccgccacaccgccggcccaggtcgccgagggctcggcgacgcagaaggcgcaggtcgctgagggctcggcgacgcagaaggtgcaggtcgctgagggctcggcgacgcagaaggtgcaggtcgctgagggctcggtcgacggatcggccacaccgcccgccgaccccgcggggggagcggccaccccacccgggcccgcacccggacctgtcccccggcggccccgccggggacggctcgtgagactgaccggcctgccgctgctgctgctcaccgccctcctgctgatcgtcgtcgccgccgccaccgcgcgctggtggcgctcggcggcggtccggatcaccggcctgatcctggccgaggtgctggtggtggccggtgcgggcctgatcgccaaccgcagccagaacttctatccgacctggcaggcgctcgccggccacgtcccgccggtggcggtggcggccagcaccggcgcctag

SEQ ID NO: 467 - DNA, 336 bp, Actinoplanes utahensis
gtggcctccccggagtacacccgggcccccgaccgcctgttcccggtcgtcgtggtgctgtgcggggccgccggcgtaccgcgggtgcaacagtgggccagccgggcggaccgggtgctgaccgtcatcctggtgccgacccgcgcgacctccggcagcgcgctggcgagcctgcccagcagcctgcgccgcgacgcccgtgccggaaccgacgtgatcaccctgcacgacccggatccggccgatctggacgcggccgtgcgtgaccttccggagccgctggcggcgccgctgtacctgccgccgccgcggctggcgcacgaggtgcggccgtga

SEQ ID NO: 468 - DNA, 987 bp, Actinoplanes utahensis
gtgaggatcgacgcgcccgccacggtcctggtcaccgtggccttcaccctgctcgcgacggtgtcgctgggcctgctctggaggcgggcccggctgctcacccggatcgggctggccgctctggtgctcgtgctggtgaccgggtcggccgggctgcagctcaaccggatgaccgagacctatccgacctggggcaccctcgccggtctgccgagtccggagatgcacatcggcgaacggctggtcagctatccggtgcggggcccggccagcggcctcgacatgaccatgaccgtgtatttcccggccgcctaccgggcggatccgcggcgccggttcccggtgatcgaggcgctgcacgggtttcccggcacgccgtcgacctgggtacgccggctcgacatcgtgcggcatctggatcaggagatcgcgtcgggtcggatggcgccggccgtggtgctgctgccctatctgacgccgcggcggctgttggacaccgagtgcaccaacctggtcggcggcccgcagacggagacctatctgacccgtgacgtgcccgagtggacgatggcgcacctgcgggtccgggcggaccgggcggcgtggggcctgaccgggtattcggcgggcggcttctgcgcgatgaacctgctgctgcggcacccggaccggtacgcggcggcggccagcctgtccggtttcgccgatccggggatcaaggtgggcgaccacagcgaggcgaccacgaacaacgtcgcgtggcgcctggaacacctgccccggccgcgggtggcgatgtggatcggctgggccgccgacgaccacctggcgcgcagcggctcccgggaggtggtgcaggccgcgaaggcgccggtcaccgtggtcaccgcggtggtgccgcacggcggccacagccatgcggcctggcagcagatggagggcccggctttcgactggctctccgcccatctggcccgcgccgaatag

SEQ ID NO: 469 - DNA, 1914 bp, Actinoplanes utahensis
atgatgcggcgcggtgtggcggcacttgttccagcgatcctgctcattccgggcccggcggtggcggccgtggggcggcccggtggcggggaaccccgggcgcgggtgtgggtcaccacggtggaccgctcggagttgctgcacgagcggtcaccggtcggcttccgccgggggagcagcgcactgaccacgatcacggtgaacccggagcggaccttccagcggatggacggcttcggggcggcgctcaccgatgccgcggcgagcgtgctctaccggctgagcgcggcggaccgtgccgacgccgtacaacaattgttcgatcctgaaaaggggatcggggtcagcttcctgcggcagccgatcggctcgtccgacttcaccgccgcggccgcgcattacacctatgacgacgtgccggccgggcaaaccgatttcgggttgcggcatttcagcgtggagcacgatcgggcgcagatcctgccgctgctgcgcgcggcgcgccggctgaatccgcggctgaccgtgctcgccacgccgtggagcccgccggcctggatgaagaccggcggctcgctgatcggtgggcgactcagggacgacccgcggatctacgacgcgtacgcgcggtatctggtgagattcgtccaggcctatgccgccgcgggtgtcccggtcgactacctgaccgtgcagaacgagccgcagaaccggctgcccggcggctatccgggcaccgacatgccggtgcgccaggaggcggcggtgatcgagcggctcggcccgctgctgcgtcaggtcagcccgcgcacccggatcctgggatacgaccacaactggcagacccacccgggtgatgtcgggtccaccccgcccggcgaggacccggagaccgactacccgtaccggctgctggactccccggccgggaagtggctggccggaacggcctaccactgctattccggcgatccgggtgcgcagaccgccctgcacgaggcgcacccggacaagggcatctggttcaccgagtgttccggttcgcacggcgccggcgacaccgacgagcagatcttccgcggcaccctcacctggcacgcccgcacgctggccatcggggtgccgcggaactgggcgaagtcggtggtcaactggaacatcgcgctggacagcggcggcggcccgcacctgggtggctgcggcacctgcaccgggctgctgaccctgctgccggacgggacggtgcgccgggacgcggagttcttcaccatcgggcacctgtcgaagttcgtccggcccggcgcggtgcggatcgccagcacctcgttcggcaccaccggctggaacggccagatcatggacgtcgcgttccgcaatccggacggctccaccgcgttggtggtgcacaacgagaacgacgagccgcgcagtttcgcggtcgcggtcggcgcccgcaccttcgagtacacgctgcccggcggggcgctggccactttcgtctggccgcgctcggtaggcgcccgccccggcgagatcccgctgaccggggcgaccgcggtcgccgtcccgccgggcgagggcgcgccgctggccgtcgacggcgacgcgtcgacccggtggtccagcggggcggcccaggcgcccgggcagtatctgcaggtcgatctcggcgccgaccgggtgttccgccgggtggccgtcgacagtggggacaacctcggcgattacgcccgcggctggcagctgtcggtcagccgggacggggccacctggaccacggtggccgccggcgccgggaccggtcagctgaccgaggtggcgctgcggccgacccgggcccgctacctgcgcatcacctcgaccggcggcagcggcagttggtggagcgtggccgacctgcgcctgtaccgctga

SEQ ID NO: 470 - DNA, 432 bp, Actinoplanes utahensis
atgacgcgactcctcgcccccgtgctcctgctgaccctcgtcgccgcctgcgccgccgcccccgccggcggctcgacgccgcaggtcagcggcgcgcccgaccgggtcttcccgctggacttcagccgcagcggcggattcgccggccgcagcgaccgcctgcacatcgacgccgacggccggatgacggtcacccggcagggtgccggcagcagcggcccggtcgccgtcgaccggaccgtcctcgacgcactccggcaggtcctcgccaccgccgacccgatcccgtccgcatcgtccggaatctgcgccgacggctaccgctaccggatcagcacgccgtcctggtcggtgagcaccgacgactgcgccgagcaccacgagagcctggaccgggcgctcgaactgctggtgccgctgctgcggccctga

SEQ ID NO: 471 - DNA, 507 bp, Actinoplanes utahensis
atgcccaccgccgttcgttccctgttcgccgccgccgtgaccgccaccgccgtggtcgccgtcgccaccccggccgccgcggcccccgccgacaagctcagcgtcctgtccggcttcacccagaccagcgcgggcagttacaccagctggctcgccgcccgcaacaaccagggcgcctggtcggactacgggttcgactggagcaccgactactgcacgaccagcccggacaacccgctcggcttcgacttcaagctgtcctgcgcgcggcacgacttcgggtaccgcaactacaaggcggtcggcacgttcgacgccaacaaggaccgtctggactcgatgctctacgccgacctcaagcgcaagtgcgccacctattcgacgctgtcacaggcggcctgcaactcggtggcctggacgtattaccaggcggtgcacaacttcggttcgctggcggcggtcgatcaggccgacatccgctccgccgcggcgctcgagaagtcctga

SEQ ID NO: 472 - DNA, 843 bp, Actinoplanes utahensis
gtgggcatccaggctcctcagtcggtcgggctgccactgagggaaccgaaatgctcttgcgatcatctatatctaccggaggtagggttgatcatcgtgagcgcatcgatcaacgacagacaacgccggcagcacgccacgtcgttcggagccgccgcccgcgagtaccggcgcggccggccgccctacccgcgggaggccgtcgactggctgctcccgaccggcgccgccaccgtcgtggatctgggcgccggcaccggcaagttcaccgagctgctggtcgcccccggccgtgaggtgatcgccgtcgagccgtccgccgggatgcgcgagcagctggccgacgcggtgcccgccgccaccgtgcacggtggcaccgccgaacggatcccgctaccggacgcgtccgccgacgcggtgctgatggcccaggcctggcactgggtcgaccccgaactcgcggtcccggagatcgcccgggtgctgcgccccggcggcaccctcggtctggtctggaacatccgggacagccgcgagccgtgggtcgccgagctcgacgacctgctgcaccaccacagccgtcaggacctcgacaccgcgccggaactgcccgccccgttcgccgccgccgaacgcgccgagttctcctggcggcacaccctgacccgggacgcggtgctggacatgatcgcctcccgcagctacgtgatcgtgctgcccgagccggaacgcgccgaactgctcggcaacgtcaccgaactcctcgcctcgcaccccgatctcgccgaccacgacgacatcgtgctgccctacgtcacccgctgcacccgcgcgacccgctga

SEQ ID NO: 473 - DNA, 771 bp, Actinoplanes utahensis
gtgatagaactcaagtccaccggcgagatcgcccggatggcggtgaccggccagttcgtcggcgagttgctcgccgagctgagcgggaccgccgccgtcggcgtcaacctgatggatctcgaacaccacgcccgccgccggatcgagcagcgcggcgccgagtcctgctactgggactacgccccgtcgttcggccgcggcccgttccgcaacgtgctctgcctgtcggtcaacgacgcggtcctgcacggcctaccgcacgactacgtcctgcgcgacggcgacctgctcagcatcgacatggcggtcggcatcgacggctgggtcgccgactcggcggtctcggtgatcgtcggcgagcccgaccccgacgacctggcactgatcgagtccaccgaggtcgccctggaagccggcatcgccgcggcccagcccggcggtcgcctcggcgacatctccgcggcgatcggcgaggtcgcccacgcgtacggcctcgcggtgaatctggaattcggcgggcacgggctcggccgcaccatgcacgaggccccgcacatcccgaacaacggccgcgcccgccgcggcatgcgcctcgacccgggcctgaccatcgccatcgagccctggttctgccgcggcaccgacaagatcaagttcgatgcggacggctggaccatccggtctgccgacggctcgcgcaccgcccactcggaacacaccgtcgccatcaccgaatcgggaccacaggtcctgacccggcgcccggcctga

SEQ ID NO: 474 - DNA, 267 bp, Actinoplanes utahensis
atggtgcgccaaccactgacccccgagcagatcgccgcgggccggcgtctcggggccgcgctgcgggccgcccgggccggtcgcggcctcgtcgaggtggcactggcggccggcatctcaccggagacgctgcgcaagatcgaggcgggccggctgccggcgcccgcgttcggcacggtggtctgcctgagccgggccctcgacgtcccgctgggtgacctggccgacgtctggctcgccgacaccgcggtcagccgcgcgtcctga

SEQ ID NO: 475 - DNA, 1392 bp, Actinoplanes utahensis
atgaccacctggtcgatgctgcagatcagcgaatacttcaccgccgtcacccgggccggcgacgaggccagcgtcgcccgggtcgcggtgcagcgggccaccgaggccaccgacgcggaactgggcgcggtggtctgcggcgacaccctgaccgcgtcggtcgggctgggccgctcccccgacccggcgctgttcctcgggttgcgctcggagaccgcggccttcccgggcgtcggcgaggcgtacgtgagcatgcacgcgctggccggcgacaacaccgaacggctggtggtggcccggaccgacgagccgttcaccgccgaggaacgccagatgctgcagggcatggcgaaggtgctcgggctggccctgcgcagcctgcgcaccctcgccgccgagcagcagctgcgccgggaacgcgagcgggaggccgaggaccggctggtcctggtgcgggcgctggaacgccgggaacggctgctggagacgctgctgcggatccagcgggcggccggccagggcaccccgctgcacgagcagctcgacacgatcaccggggaggcccggcggctgctaccggacgcggcggtcgtcctggtgctctccgacgccgacgacccggcgtcggccgccggaccctacgaccggtcgtcggtgctgctgctcgccgagcggacgatggccgccggcgagccggtcgtcgacggcgacctgaccggggcgccggtctaccggggtgaccggctcgccggcgcactggtgttcgccgggcacggcggtgacgtgcgcgagtcggagcggcgtgacgtgctggccgccttcagcgagcaggccagcctggccctgaccggcgcgcacaccgcggccgcggtgcacgaggcgcaccacgacccgctgacccggctgccgaatcgtgcgctgttcctgcgccggctggagaagtccctggcggagaacgcctcggccgccctgctctacctcgacctggacctgttcaaacaggtcaacgacacgctcgggcacgccgccggcgacgagctgctgcgcggggtggcggaccggctggtcggcgcggttcgggacaccgacatggcggcccgcttcggcggtgacgagttcgcggtgctgctcgaaccgatcaccggcgaggcgcaggcgtgggagatcgcgcagcgggtggtcgacgcgatcgcgcggccgttcgacatcgccgggcgggcggtgctgacccgggccagcgtggggatcgcctacaccgggccggggcgcagcgcggcgcacgtcctggaggacgcggacctggcgatgtaccgggcgaagaagacgatgccgggcacctgccgggccttcgacccgcggatgcgctcggaggagctgcgcccggcctgctga

SEQ ID NO: 476 - DNA, 1167 bp, Actinoplanes utahensis
atggacgcagagcgttggttcggggtcgggcgcagcctgctggccgacccggccgaggccggaagccaggcctgccgcgaggcgctcggcggccggcgcgccagcctggtgatcgtcttcgcctcgctgacccacgccacaccggagatggccgccgcggtgcacgccgcggccggcggtgacgtgctgatgatcggctgctcgacgtccggggagtacacgtcggacggtggcggcgccggcgtggtggtcaacgcgctcggcggctacaccgcggcggtgcgcgcggtgccgcacgacagcgtcgacctgtacaccgccggcgagacggtggcctcggcgctcgacgacgtggacgccgagcaccgggtgctgctgatgctcggcgacgggcgcagcggcgaccagcaggaggtggtccgcggtgcctacgcggtcagcggcgcccaggtgccgctgatcggtggctgcgcgggcgacaacgtgacgcagaccggcacgttcgcgttcttcagcgacggcggtccggtgcaggtgctgccgaacgcggtgctcggcgcggcgctcggcgcgccgtcgccgttcgggatcgggatggcgcacggctggcaccggctcgacgagccgatggtggtgacccgcagcgagggcggcaagatctacgagctggacggggagccggcgctcgacgtctacctgcgccgcaccggggcgccggaggggctgtccgccgacccgtcggcgttcctgcagttcgccacgatccggccgctcgggctggcccggcgcaccggcgaggacatccggatcatcttcgcgtgcgacgccgcggagcgctccatctccggcctggccgacacgcccgagggcgcgatggtctggttcatggccggcgagaccgacgaggtggtcggcgcggcggcggccgcgggccgcgccgcgatggagtcgctgtccggcgcggcaccgctcggggtcctggtcttcgattgctgtgtacgtccgatcgcgctgggcgaggacagcaccgagctggccaccgagcgcctgcgggacgccctgaagccggtgccgttcggcgggttctactccaacggcgagatcatccggcaggccggggcgaaggggatgcatcacctgaccgtggccgccctcgcgctgagctga

SEQ ID NO: 477 - DNA, 1203 bp, Actinoplanes utahensis
atgatggggcgcatggattacgaaaccgcggtgggctcgctgttccaggccgaggggcgagaagatccctacccggcgtacgacgtgatccgcgcccacgcgccgatcttcccggtcggcgacgaccaatggttcgtgacctcgcacgcgctggtcagccggctgctgcgggatcccgggctgcgggtggccgaccgcagcgactacgaccggcactggccggactggcgggacaaccgcggcgtcgcctcggtggtgctgtccatgctgcagaccaatccgccggaccactcccgggtgcgccgggccgccgcggccaccttcaccgcgcgccgcgtcgccggcctgcgcgacgtgatcacccggcaggtcggcgacctgatcgacgagatgccggccgaggccgacttcatcggcgccttcgcctatccgctgccgatcgcggtgatctgcgcgctgctcggcatcccggacggcgagcgccgctggttccggcagcgggccgccgacctgaccgtggtcctggagccgatcagcacaccggaggagatggcccgcgccgacaaggccggccgggagatcgaggcgtacttcaccgggctgatcgccgaccgccggcacaccccgcgcgaggatctgaccagcgcgctggtcgccgccgcggagaccgacctgaccggcgaggaactgctggccaacctgattctgctgctggtcgccggcttcgagaccaccaccaacctgctcggcaccgggctgaagatcctgctcgagcatcccgatcaggctgatcggttgcggtccgacgcggggctcgcgcccgctttcgtcgaggagatcctgcggtacgactcgccggtccagctgacctcccgcttcccgaccgagccactcgacctcgacggggtgcgggtgcccgccggcccgatgctgaccatgctgctgggctcggcgaaccgtgatccgcagcgctaccccgacccgcaccgcttcgacccggaccggccgaacatccagccggtgtcgttcggcggcggtgcacactactgtctgggcgcgccgctggcccgactggaggcgcaggtggccttcccgctgctgctcagccgcctgcccgggctcgcggcggccggcgcgccggtccgccgcgaccgtctcgtgctgcgcggatacgccgccctgccggtcaccaccggccgctga

SEQ ID NO: 478 - DNA, 948 bp, Actinoplanes utahensis
atgcgtatcggatacaagctgatggccgagggcttcggcccccaggagctgatccgtcaggcgatccgcgccgagcaggccggtttcgacttcgtcgagatgagcgaccactaccacccgtggctggaggagcagggccattcgccgttcgcctggaatgtgctgagcgcgatcgcggcccgcaccgaccggctcggcctggccaccggcgtgacctgtccgacggtgcggtatcacccggcgatcatcgcgcaggcggccgcgacgctggcgctgatctcggacggccggttcacgctgggcatcggctccggggaacggctcaacgagcacgtggtgggccggggtttccccggggtcgcggtccggcaggagatgctggccgaggccctcgacatcatcaacctgctctggcagggcggctaccggtcgtatcagggcaggcatctgcagctggaggacgcccgggtgttcgacctgccggacgagctgccggtgatcgcggtggcggcgggcgggaagcaggccgccgagctggccgccacgcacggctccggcctgttcgccaccgaaccccgggccgacctcgtcacgacatttcaggaaaaaggcggaacggggcctaggtacgcggagatcgcgacggcctgggcgcccaccgtggacgccgcggtcgccgaggcgcaccgcacctcccgctggtcggtcaccggctggaaggtgatgtcggagctgccgaacccggtcaacttcgacgccgcgtcccagacggtgcgccccgaagacgtacagcggcaattcgtctgcggcccggacccgcaggcctaccgggacgcggtgaagacctacagcgaggccggtttcgatcatctggtgctgatgaacgccggccccgacccggacgggttcctggacttcttcgagagtgagctcagcggccggtggtga

SEQ ID NO: 479 - DNA, 420 bp, Actinoplanes utahensis
atgacctctgcgatggagttgcacggtgatccgcatgtggcgcgttatctggagaccgacggcgaggacggtttccactggcgtaacggcaccgagatcctgatcctgttcaccaagggccgtaagtcgggtgagcagcgctcgcacgccctgatcttccgcgagcaccggggcgcctacctggtggtggcctccaaggggggcgccgcggccccgccggcctggttcgtgaacctcgaggccgagccgcgggtcgaggtgcagatccgcggtgaccggttcccggcacgggcccgggtcgccacggcgcaggagaagccggagatgtgggcgaagatggccgaggtctggccggattacgacgagtatcagaagaagaccgaccgggagattccggtggtggtgctggaacgcgtctga

SEQ ID NO: 480 - DNA, 270 bp, Actinoplanes utahensis
atgaccgacacgatggtggtggagctgggcctgcaggccatgacgatcgcggcgaagttgtccgcgccgatcctgctgaccgcgctcgcgatcgggttcgccatctcgctgttccagtcggtgacccagatccaggaggccaccctgtcgttcgtcccgaaggcggtcgcgatcggcgcggtgctgctgttcaccggcaactggatgctgcaccagatgatgacgtacaccacccagctcttcgacaaggttcccgagctgctccgctga

SEQ ID NO: 481 - DNA, 540 bp, Actinoplanes utahensis
atgcgcaagattccgacggtgttccagcgtgatcccgaggaccgcagacgggtgctgcccgaagcccaccccgactgcgcctgggtgctggccggcgagggcgtcgccaccaggaaatacgacgggacctgcgtgctcctcgacgaggacggcacctggtgggcccggcgcgaggtccgcccggcccgcacccggccgcccggctaccgcccggtgatgaccgacgagaacaccggccggaccgtcggctgggagccgatcgcccagtcctcctacgccgcctgccacctcgaggcggtcgcccgcggcacgtcctggcggcccggcacgtacgaactgatcggcccgaagatcaacggcaacccggagcgggtgcccggccacgaactcgtcgcccacgccgacgccgaacgcttcgacgttccccgcgacctggccggcctccgcgagtggattctggcccatccccggtacgagggcctggtctggcatcacccggacggccgtcgcgccaaactcaaataccgcgacttcgcctga

SEQ ID NO: 482 - DNA, 1065 bp, Actinoplanes utahensis
gtggtgcggatccacaaggctccactacatcgtcgattcagaggttgccctcttgtctaccggatcgccgccgccgacgctcaccgtgtgtcgacttctcgcgtgggcgatcttctcctgctggccgtcgccgtggtctggggcagcagctacctgacggcgaagaccctggtcgcggcgggcggcgtgctggtgctgctggcgctgcgcttcctgatctcggcggtggcgctgctgccggccctggcggtgcgccggtcccgcggccgtttcgaccgccgggagctcctggtcggcgtcgggctcggcgtcacccagacgtcggtgctgatcctggaaaccttcgggttgtcgatgaccagcgccaccaacgccggcgtgttgatcagcctgaccatcctgatgaccccgatcctggagggcttcacccggcggcgatggctgccgccggcattcttcgggggcgcggccgctgccacgctcggcgtggtcttcctggtcgccggaccaggcctgcgtacgccgtcagcaggcgacgccctgatgctggccgccgccgtggtccgcgccgcgcacgtgaccctgtcggcccacctgacccggggccggtcgcacgacaccgcgacgctggccgccctgcagaccctgaccggggcggtcgtgtgctcgaccgtggccgcccgggccctgcccgcggcggtcgccgcctacggcccggcgcagtgggcggcggtcacctacctggcgctgggctgcagcgtcttcgctttcgtcgtgcagctgtgggcgatccggcgcacctccgcctcccgcgccagtctgctgctcggcaccgagccggtctgggcggtgctgttcggcgtcgccctggccggcgaccgtctcacgccggccgccctgctcggcatcgcactggtgctcgccggcacctactacggccagcggctggagggtcgctcccgcgccgaacgctcgcccacgtacgcccgggggaacgacatcgtccgccgaacgccgcgaccccgcgtcggcgcccggtcggtcaggcgaagtcgcggtatttga

SEQ ID NO: 483 - DNA, 888 bp, Actinoplanes utahensis
gtggatccgcaccacctgcgactgttgcgtgagctcagggaccggggcagtgtcgccgccgtggcccgtgcgctgcacatcacgccgtccgcggtgtcccagcagctgaacacgctgcagcgctcggcgcgggtgccgctgaccgagcgggccgggcggcggctggtgctcaccgcggccgggcgggccctggccgcggccgcggtcgacgtgctgaccgcgctggaccgggccgaccgggcggtcggcgcccacctcgacgacccgctgtccccggtcaccgtcgcggccttccacagcgccgcgctgacctggttcccggagctgatccggcgggccccgcaggtccgctgcgccgacgaggacgtggcccgcgccgacttccccggtctggccggcgactacgacctggtgatcgcgcaccgggtggcgcacagcccgccgtggccggccgaccgggtgaccgtgctgccgctgatctacgagccgatccatgtggcgatgccggtcggctccccactggccgacaggcagcggctgaccgcggccgacgtcgccggccagccgtggatcagcgtgcacgaggggttcccggtcggcggggtgctcaccgcgatcgccgcggcggccgggcgacccctcgacatcgtgcaccgggtcaacgagttcaccgtcacggcggcgatggtcgcggccggtgccgggctggcgatcatgccggcgctcaccaccgtgccggatccgcgggtggtgctgcggccgctcgccgacctgcccgccgggcggcacatcgacgtgctgacccgcccggagacgctgcaccgggcatcggtccgggccgtgctcggcgcgctgcgcgagatcagccgttccggtggtgcttcttga

SEQ ID NO: 484 - DNA, 876 bp, Actinoplanes utahensis
atgcggaccgtgacgcgacgggtgacgctgtggcgagcggacctggaggggttggtctgcccggtcgcggaggagatcgccgaggcgctgatcggccgggatccggtgatggtggtgctggagcaccgggtcaaggggatcaccgcggtccgtgaggtgttcgagaccgccgtggagcgcgagcccacctggcggttcagcggcatcggatggccggccgacgtccagaccgggacggtcgtgaccgtcacctggcaggccgggcgggacgcggtggtggtgcggacccgggtgctcgacgacccgatgcggatcgacggcgtcaactactaccacgaatacgacccgctggtggtgacccgggatttcgatccccggccgtcgaaccgcgggcaggtgctcaaggtgatccgcgggctgggccgggtgttcgaggacggcagcgcggtgttcccggaggactcgctggccgggcaggccgggctgggccgcgggcagaagggcacgttcctgctgaaaaacgcggtggaccagctgatccgggagggttacgtgacccgggtgaccggcagcaccgacgcggacgggctggcctgctaccccgcggtcgacggacaggacccggtggacctgctgttctacgccccgctggtggagcccgcgccgcatccgcacgaggacgacgacgaggacgacgagcaccacgaccggcgcgagcactgggtgaaggggttcatccggaaacttccgcccggggcgcagccgtccgagaggcagatggccgcctaccagtgggcggtggagaacgaactgatcgacgaggacgcgatggggcccggttacacgtacgtcaagaagcaccaccggaacggctga

SEQ ID NO: 485 - DNA, 270 bp, Actinoplanes utahensis
ttgcggcttctccgcgccgaggcggaatatgcatcagtccggaaaaatccgcttatcgcgtacgtgctgtggtgcgtctgtggcatcttcggcggtcaccgcttctacctcggagacaccgcccgctcgatcgtcatgctgttcaccctcggcggcgtgggcgtgtggacactgctcgacgtcttcttcatcgcccgccgggtccgcaccgtcaaccaggaacgccgcgccgccatcctcgcccgttacggcatcctcgacgccccctga

SEQ ID NO: 486 - DNA, 795 bp, Actinoplanes utahensis
gtgacgatcgacaagctcgacaccggggtgccgcacccggcccgccgctacaactactggctgggcggcaaggacaacttcgccgccgaccgggagtccggcgacctgctggcccggtcctaccccgcggcccggatcgccgcccgcgccaaccgcgccttcctgcgccgcgccgtcggccacctggccggcgaggccggcatccgccagttcctggacatcggcaccggcctgcccaccgccgacaacacccaccaggtcgcccagcgggtcgccccggacagccggatcgtctacgtcgacaacgacccgatggtcatggtccacgcccgagccctgctcaccagcacccccgaaggccgcacccgctacctggagcaggacctgcgccggcccgaggagatcctggccgccctcgacatcctcgacctgacccggccggtcgcgctgatcctggtcgccgtcatccacttcctccccgaccacgcccgcgccaccgagatcgtccacaccctcgtcgacgccctcccggccggcagctacctgacgatgaccagcgccaccaccgacttcctcaccccggaactgaaggcgaactgggacgagtcgctgcgcaccggccgctccgacgtccacccgcgcacccgcgccgcgttcgaggactatttcgccggcctcgacccgatcgcgcccggcatcacggcgatcggcgactggcgccccgaccccgccgacccggaacaccccaccccggtcgacgcctccctcttcggcgccgtcgcccggaagccctga

SEQ ID NO: 487 - DNA, 924 bp, Actinoplanes utahensis
gtgcagcgttaccgagttggcatcctggctgtcgcgacggtcgtggtcctcggcggtggcggcctgatctacgcgggcctcgacggcgggtccggcggtggagtcgtgtccagcgccctgagcctggacgggtcggacacctcgaccaagggcgcatccccgtcgccgaccggcccgagccccgaggagctggcccgggccgcgcgggcgcagcaggccaaggcgctgaccgccgcgctgacgaagctttccgcggcctcgccggagttctcggtcgccgtgctggacaagacgaccggtgagtccttcgccttccggggcgacgagcactatgacacggccagcatcgtcaaggcgcagattctcgcctgcatgctgctcaaggaccaggacgccgggcgcgatccgagttcggccgagatggccctggccaagccgatgatccagttcagcgacaacaatgcgaccacctcgctgttcggccggatcggcggcaaggcggcggtcggcagatgcaacaagcgtctcggcctgaccgcgaccgaggtcgcctcgtcctggggtttcacccggaccaccgccaacgaccaggtcaagctgctcgccaagttcgtcgacgtgaagggtccgctggacgcggattcccgcaagaccgcgttcaagctgatgaacaccgtcagcaaggggcagacctggggagtgccgtcgatcgcgcgcagcggcgagacgaccaccgtcaagaacggctgggacacccgctcggccgacggcggcctgtgggcgatcaacacgatcggccgggtcaccgggggccgggtggacgtgtcggtggccgtcctctcgcacaacaaccggtcccagccggccggtcaggccctggtggagaaggtcgccaagctgacccggcagtatctgaagtactga

SEQ ID NO: 488 - DNA, 417 bp, Actinoplanes utahensis
gtgccccgccgctgccggtggcccgcgggacgggtcgagtccggaaaccgatggccgggtgcgcaccgggcgtgtcaggctgccggcgtgaccgaacgcgagccgatcgtgatgcaggtgtactgccgggtgaaggtcgtcgtcgacgacccggccgcgatgaccgaggtggccgtccgccggctgcgcgaggccgacatcgactggtccgccgaggccgacaccctcgccgaggcggaggcggagatgcgcaccgacctgccgcaggccctctcctcgctggtggacccggcggcgctgctcgccggcgtgcccggcgtcgagatcagcggcggccggtggtgggcggagcccggcgagcccgcgcccggcttccagccgggcttccccgggccggcccctcgtcgcaccgtctga

SEQ ID NO: 489 - DNA, 1128 bp, Actinoplanes utahensis
atgcagagcgcgccgcgactggcgatcgactacggttccgcgtgcacccgcgcggtgctggcctggcccgaccgcccctggcagccgctgctcgtcgagggcaccgcggagccgtccagcgcggtccacgtcggtgcggacggcgccctcaccgcgggcgccgcggcctggcggctcgccgccgacgacccggccggtttcgtggagtcgccgctggccgccggggtcgggacggtccgggtccgcggccgcaacgtggagatcgccggcctcgtcgccgccaccctgcgcctgatcgcggccgaggcggtgcggatggccggcgtgctgcccgccgacgtccggatgagcgttcccgccggctgggacccggcccgccgcacctggctgcggcaggccgcccaccaggccgggctcaaccgtccgcagctcgtcgaggcgccggtcgcggcgctggtcgccacccgctgcaccgcacggccgatccccgttctggatccgccgtccgccgccggaccgccgtcgtcccggccgtccggcggcggtacgacgtatgccgccacgaccgcccccagccggttcgtgctggtctgcgatgtcggcgcgaccgccgaggtcagcgtgctgcgcgccgacctgtccggcgccgaggtgatgtccacggtgaccggcgtcgacgccggtggccgcgccatcgacgaccgcctcgtcagcatgctcctgcaccgcgaagccaccgccgcacccacccgcccgtcgcccgccacgaccccggtcggatccaccacgacccgccgggtccccgacctggacacgacccgccgggtccccgacctggacacgacccgccgggtccccgacctggacacgacccgccgggtccccgacccggacaccaccggccgagccgccgtcggccaccgtcgccacggtgtccccggtcgccgggtcgagcacgtcgaaccggttccccgaggacgcgggcacccatgtgccgccgatgaacagttcggtttccacaacagctcctcttgccaaggtccggttacgcccccagcattccccgcatccggtcgtgccgccacgcttccgggattggccccctccggagcgggccggggcggttag

SEQ ID NO: 490 - DNA, 1002 bp, Actinoplanes utahensis
atgaacagttcggtttccacaacagctcctcttgccaaggtccggttacgcccccagcattccccgcatccggtcgtgccgccacgcttccgggattggccccctccggagcgggccggggcggttagcgtgagcagcgtgaccgtgggatttctcgggctcggcgtgatgggccggccgatggcgctcaacctggtccgggccgggaccgacctggtggtctggaacaggtccgccgcggcgcgcgacgagctgcgggcggccggggcggcggtggcctccggggtcaccgacctgttcgcccgggccgatgtggtgctgatgatgctggccgacgaccgggtcgccgacgaggtgctgggccgggacggcccgggcttcgcgggcatgctggccgggcgcaccctggtgcacatgggcacgaccgcgccggcctggtcgcgcggactggccgagcaggtggccgacgcgggcgggcactacgtggaggcgccggtctccggctcccgggtgccggccgagaacgccgagctggtcgcgatgctggccggggccggcgccgacctggaccgggtgacgccggtgctgggcccgatggtccgggagacggtccgctgcggcccggtgccgaacggtctgctgatgaagctgtcggtgaacacgttcctgatcagcatggtgaccggcctggccgaggcgttccacttcgccgagcggcaccggctggaccgggccaccctgctcgccgcgctggacgccggcccgatggccagcccggtctcccggctcaagggccgcaagctgctcgacggcgatttcgcggtgcaggcctcgatccgcgacgtcctctacaacaaccacctgatcgtcgaggccgccgagacggccgggatcccgtccccgctgctggacacctgcctggagctgtacgcggagaccgcctcggccgggcacggcgccgaggacatggccgccgtcatccaggccctgcgggcccgctga

SEQ ID NO: 491 - DNA, 1005 bp, Actinoplanes utahensis
gtgtcccagcaggtcggcctgctcataggggagcaggccggcgcgggagaccgccggggaggcgtccggatagaaggcggcgaagaactgttccgcgccgacgaagcggcggcctttccacaccgtgtcgcggtcgacgtcgacgtgctccggcaggatccggtccgggtcgaggccggtctcctcggtgagctcgcgacgggccgtctccaggggtgtctcgccggggtcgatgccgccaccggggggctcccagaggcgtaccccggaaaggggatcctgccagtgcatcagcaggatccggccgtcggcgtcgaagcagagcacccggacggccgggcggtgggcgacctccatgaccacaagcctaagctgagccgagtggcgaagtacttcgacgtgcacccggacaacccgcaggcgcgcagcatccagcagatcgtcgagctgatcggtgcggacgggctgatcgcctatccgaccgactcgtgtttcgcgctgggctgccggatgggcaacaaggacgggctggaccggatccgggcgatccggcacctggacgacaagcaccacttcaccctgatgtgtcacgacttcgcgcagctcgggcagttcgtgcagatcaacaatgcgctgttccgggcgatcaaggcgagcaccccggggccgtacacgttcatcctgccggccaccaaggaggtgccccggcggctgctgcacccgaagaagaagaccgtgggggtacggatcaccgggcacaccaccgcgcaggcgatcctggcggcgctgggtgagccgctcgtctccagcacgctgctgctgcccggcgagccggagccgatgacccagggctgggagatcaaggaggcgctcgaccacgcggtggacgcggtgatcgactccggggagtgcggcaccgagccgaccacggtgatcgacctgtccgagggggtgcccgaggtgctccgggtgggcgccggcgatcccggccggttcagcgggtga

SEQ ID NO: 492 - DNA, 1242 bp, Actinoplanes utahensis
gtgctgatcgccgtgcccggcaacgccgggccgaagtacgccgcccgcgtcgccgcgccctggaccgggacctggagcaccgggccgaccgaggcgacaccggacaccgcaccgctgcccgcggactgcaccgtgcgccaggtcgtgcacctgagcctgggcggcgccgcgccgcgggtgcacctgaccaaccggtacggcccggaacggatccggttcggcgaggtctggatcggggtgcgtgccggcgacccggacagcaccgcgatgtggccgggcacgatccgcccggtcaccttcgacggccgcaccgagggccggctgccggcctggggtgacctggtcagcgacccggtgccggacctgccgctggcgcccggcgccgacctggtgatcagctttcacctgcccgaacggacccggaccggcaccctcagcccgcactccttccagcacggccgggtgttgacgggcaacgtcgccgccgcgccggccccgcccgccggcgctgtgatcacccgctacgtgctgctcggcggggtcagcgtgcgtaccgccggaccgagctccgcggtggtcgccttcggcgactcgatcacctgcgggacgcagacgacgctggacgccgaccggcggtggcccgacctgctggccgcccgggtccgggccgccggactgccgctcggcgtgctcaacgccgggatcggcggcaaccgcctgctcaccggcgccgaggtacgcggcgcggcaccggtcggcgccctggcccaggccacgccgcccaccgtccgccggcagtacggcccggccgggctgcgccggttcgacccggacgtgctggaccagcccggggtgtcgcacgtgatcacgctgatcggggtgaacgacatcggctccggcggggcgaccgcggaggcgctgatcgccgggcaccgggcgctcctgcggcggtcccgggcggccgggctctcggtggtcggcggcacgctgctgccgttcggcggcagcatgtacgacgagccggcacaccgcagcgcccggctgacgctcaaccggtggatccgggagggcggcgagttcgacgcggtggccgatttcgacgcggcggtccgcgacggcgccgacccggaacggctggcggccgcctacgactccggcgaccacctgcacccgaacgacgccggcatgctggcgctggccggcgcggtgccgctgaccgcgctctcgcccgtcacccgctga

SEQ ID NO: 493 - DNA, 1074 bp, Actinoplanes utahensis
atgaaactcgcccgtctggtcgcggcagccgtcctggctgccgcggccggggccctcttcgtcccggccacggccgaggcgcacggggccatccaagtgcccggcagccgcacctggttctgctaccaggacggccgcaacccgaccaccggcgcgatcgagccgaagaacccggcctgtgccgcggcggtcgccaagagcggggtgacgtcgctgtacaactggttcgccgtgctccgctcggacggggccgggcgggtctccgggttcatcccggacggccagctgtgcagcggcgggaccggtggaccgtacgacttcaccggttacaacctggcccgcgacgactggccgacgacccacctgacggccggcgccaccatggagttccactacaacgactgggccaagcaccccggcaccttctcgctctacatcaccaaggacgggtacgacccgaccaggccgctcgcctggagcgacctggagccgaccccgttcgacacggtgaccaacccgccggccgacggcgggccgggcaccgacgccggacactactactggaccgggaagctgccgtccggcaagagcggcaagcacctgatctactcggtctggtcccgctcggacagcacggagaccttctacggctgctccgacgtggtgttcgacggcggcaacgggcaggtgaccggaatcggcaccccgccgagctcaccgccgccgtcctcacccagcgcgtcgccgtccaccccgggcggcggcaccggcagcgggtgctcggcgatgtacaacgtcacctcgtcctggaccggtgggttccaggcgcaggtgatggtgcacgccggcaccaccgcggtgaacggctggcacgtctcctggacctggcccggcggtcagacgctggcctcgctctggagcggtagggcgaccagcaccggatcgttggtgtcggtgaccaacgagacgtggaacggcacgatcgcggccggcgaccacaccacgttcgggttcctcggctcgggcagcgcgccggccaccgtaccgaacctgacctgcacttccggctcttga

SEQ ID NO: 494 - DNA, 2922 bp, Actinoplanes utahensis
gtgagacagtccgcacaccgcctgcgacgcaggctcgccgtcctcggcgtcgccgttctcggcgccggcgcggccttcgcggccggcggcccacccgcctacgccgcggccggctgcgccgtcgtctacaaggtgcccagccagtggcccggcgggttcaccggcgacatcgccatcaccaactccggcgacccgctcacctcctggaagttggagtacgacttcccggacgccgcccagaaggtcacccagggctggaacggcacatacgcgcagagtggcagacacgtcacgatcaccagcgcgtcctggaacggcacgctgggcaccggcgccaccaccggcaccgggttcaacggcacgttcggctcgaccaacccggtgccgacctcgttcaccctcaacgggcagccctgcaacggctcggccgccgcgccgacggtggcgatcagcagccccgccgcgaacacccggtacaccgggccggcggccatcccgatcgcggccaccgcgaccgcggccggcgggcagaccatcgccaaggtcgagttctaccacgacgggctgctgctgggcagcgacgacacggcgccgtacacgtacacctggagcggtgtcccggcccaggccgctgcctaccacctgcaggcggtggcgtacgacggggccggcaccaggagcagcaccgccgacgtaccggtcttcgtcgacgcgtcgaccaccccgtcgatcgtcgccgacgccacctcggccaccctggagccgggccggagcgggacgttcaacctggcgctgagcgcggcgccgaccgccgacgtgacggtcacggtggcccggtcggccggcaccaccgcggtcaccgccaccccggccacgctcaccttcaccccgcagaactggcggaccggccagccggtgacggtcgcggccagcacctcggcgaccgccgggtcgaccgccaccatctcggccaccgccaccgggtacacggcggcgaccgtggcggtcagcgtggtcgcggccgggtcgaccgacgtccggttcacccagatgtacaacgacatcaagaacccgtcgaacggctacttcagcccggagggcgtgccgtaccactcgatcgagacgctgatcgacgaggcgcccgaccaggggcacgagacgaccagcgaggcgttcagctactggctgtggctggaggccgagcacggccaggtgaccggggactgggcgccgttcaacagtgcctggtcgacgatggagaagtacatcatcccgtcgcacgccgaccagccgaccaacgccaactacaacgcgtccaagccggccacctacgcggccgagcacccgctgccgtcgcagtacccgtcacagttggacagcagcgtctcggtgggttccgacccgctggccgccgagctgaagagcacgtacaacaccgacgacatctacggcacgcactggctgatggacgtggacaacgtctacggcttcgggcactgcggggacggcaccacccgggtcgcgtacatcaacaccttccagcgcggcccgcaggagtcgacgttcgagacggtgccgcagccgtcgtgtgacacgttcaagttcggcggtccgaacggctacctggacctgttcaccaaggacacgtcgtacgccaggcagtggaagtacaccaacgcgccggacgccgacgcacggtcgatccaggtcgcctactgggccaaccggtgggccaccgcgcagggcaagcagtcgcagatctccggcaccgtggccaacgccgccaagatgggcgactacctgcggtacgcgttctacgacaagtacttcaagcagcccggctgcacgtccaccgcgtgcccggccggcaccggcaagaacagctccagcaacctgctgtcctggtactacgcctggggcggcgcgtacgacaccagcgctgggtgggcctggcggatcggatcgagcaccagtcacttcggctatcagaacccgatggcggcgtacgcgttgtccagcgtcgccgcactcaacccgaagtcgcccaccggcaaggccgactggcaggccagcctgagccggcagctggagttctaccggtggctgcagtccagcgagggcgccatcgccggtggtgccacgaacagctgggacggcagctactcggcgccgccggccggcacgccgaccttctacgggatgtcgtacgtggaggcgccggtgtacggcgacccgccgtccaaccagtggttcgggatgcagacctggtcgctggagcggctcgccgagtactactacacgaccggtgacgccacggccaagaccatcctcgacaagtgggtgacctgggccctcgccaattccgacatcaccgcgggcagcttcgccatcccgtccgacctgggctggtcgggcgctccggcgacgtggaacgcggccagcccggccgccaacacgaacctgcacgtcacggtgaagagcaggggcaccgacctgggggtggccggctcgttcgccaagctgctcgcctactacgccgccaagtccggcaacacggcggccaagaccgcggcgaagaacctgctcgacgcgatctggacgcacaaggacaccaagggtgtctcggtcaccgagacgcgtgaggactacaagcggatggacgacacctacgacgccaccacgggccagggcatctacatcccgaacggctggaccggcaggatgcccaacggcgacgtgatcaagccgggggtgtcgttcctcgacatccgctccttctacaagaaggacccggacttcccgaaggtccaggcgtacctgaacggcggtgccgcacccaccttcaactaccaccggttctgggcccaggtcgacgtcgccaccggctacgccgactacgcccgactcttcccggaggggtga

SEQ ID NO: 495 - DNA, 2619 bp, Actinoplanes utahensis
atgagatggtcccccggcggcgcgctggtcgccgccctggtggtcgccgccacctcggtggtcgtcgtcgcccagccgccctccgccacggctgccgcggccgacccctacacctggaagaacgtccggatcgacggcggtggtttcatccccggcatcgtcttcaaccccggcgagaagaacctgatctacgcccgcaccgacatcggcggcgcctaccgctggaaccagaccggccagagctggacccctctgctggacggggtcggccagaccgactggggccacaacggcgtgctgagcatcgccgccgatccggtcgacaccggccgggtctacgccgcggtcggcatgtacaccaacagctgggacccgaacaacggcgcgatcctgcgctccaccgaccggggcgccacctggcagcagaccgatctgccgttcaaggtcggcggcaacatgcccggtcgcggcatgggggagcggctggccgtcgacccgcacgacaaccggaacgtgtacttcgccgccgaggggggcaacgggctgtggcgcagcaccgaccacggcgtgacctgggccagggtgaccgccttcccgaacgccggcaactacgtgcaggaccccgccgacaccagcggctacctcgcccagaaccaggggctgacctgggtgaccttcggggccgccgggcaggtcttcgtgggggtcgcggaccgggccaacccggtctacatgtccgcggacagcggcgtcacctggtcgcggatcgccgggcagcccaccggatacctcgcgcacaagggcgtggttcagggcgactacctgtacatcgcgaccagcgataccggcgggccgtacgacggtggcgccggcgcggtctggaaataccggatcagcaccgccacctggaccgacatctcgccgaccgcggtcgccgaccggtactacggctactccgggctgaccgtcgacacccagcacccgggcaccctgatggtcgccacccagatctcctggtggccggacgcgatcttcttccgcagcaccgacaacggcgccacctggacccgggcctgggactggaccggctaccccagccgctcccggcgctacgccctggacatctcggccgacccgtggctggacttcaacaacgccccggccgccccggaggagagcccgaagctcggctggatgaacgagtcgctgcagatcgacccgttcgactcgaaccggctgctctacggcaccggcgccaccctgtacgggaccaccgacctgaccaagtgggactccggcggcaccatcaccatcaagccggtcgccaagggcatcgaggagaccgcggtcctcgacctggccagcccgcccagcggcgccccgctggtcagcgcgctcggtgacgtgggcggtttctaccacgccgacctggacaccgtgccggcgagcttccacgacaccccgagcctgggcagcaacaccagcctcgacttcgccgagctcagcccgtcgttcttcgtccgggtgggcaacgccgacgcggcaccgcacatcggcgtctccaacgacggcggcaagacctggtaccaggggcaggagccggccggggtgtccggcggcggcaccgtcgcagtcggcgccgacgcgaacgcggtggtctggtcgccggccggcaccggggtccactactcgaccacgcgcggcagcagctggacggcgtccaccggcgtcccggccggggcgatcgtcgagtcggaccgggtcaaccccgagaccttctacgcgtacgccggcggcagcttctacaccagcgtcgacgggggcgccagcttcaccgcgtcgaccgtggcgctgcccagcgccgggcggctgcacgtgaaggcggtgccgggcgtggccggcgaggtgtgggtggccggcagcaccgggctgctccgctcgaccgactccggcaagaccttcacccaggtgtcggcggaggtgaccgcgggcgtgaacgtggccttcggcaaggccgcgccgggcgcgagccacccggcggtcttcctggtcggcacggtcgacggggtggacggggtgtaccgctccgacgacaccggggcctcctgggtgcggatcaacgacgacgggcaccggtacggcaacgccggcgacgccctggccggcgacccccgcatctacggccgggtctacctcggcaccaacggccggggcatcctctacgccgaccggaccggtgcaacgccctccgcacccgcgtcgccgagcccgagcgcatccccgtcgaccagtccccgtcggcccacggccgggtgctccgcctcgtacaaaacaatcggctcttggtccggcggttttcaaggcgaagtcacggtggccaacaccggcgcgtccgccaccaccggctggaccgtcaagtgggcctatacggctggacaggccgtcacgcagagctggggcggcaccgccgcgcagtccggctccgcggtcaccgtcaccaacgcgtcctacaacggcgccctcgcgtccggggcttccacgaccttcggattcctcggcagcaccaccggcaccaccgaccccgtcccgtctcccgtttcctgctcccgcgtcccctag

SEQ ID NO: 496 - DNA, 1365 bp, Actinoplanes utahensis
atgaaggtttgcgttgtgggtaccggctatgtcggtctgaccaccggcgtcagcctcgccttcctggggcacgaggtgacgtgcgtggatctcgaccagaacaaggtcgacatgctgcgtgccggcaagtgcccgatctacgagcccgggatggaggagctgctcgccgaggcggcacccaacctcagcttcaccaccagctacgacgagggcgtgcccggcgccgacgtggtgttcgtggcggtacagaccccgtcggccgcggacggcagccccgacctgcggtacctccgctccgccgcggagagcgtggcccgctcgctgaaccacgacttcaccgtcgtggtgaacaagtcgaccgtgccgatcggcagcggcaactgggtggacgcgatcctgcgcgagtcgttcgcgcagcgtgacgaccgcccggccggcgtcgagttcgcggtcgcctcgaacccggagttcctgcgcgagggcaacgcgatcgccgacaccctgttcccggaccggatcgtgatcggctcggacaacccgcgcagcctggaagtgctcaaccggctgtaccggccgatcatcaaccagaccttcaccgcgccggccttccagccccggccggaggatgccagcgcggtcccgctggtctccaccgatctggcctcggccgagctgatcaagtacgcggcgaacgcgttcctggccctcaagatcagctacgtgaacgagatcggccagctcgccgcgaaggtcggcgccgacatcaccgaggtcgcccgcggcatgggcctggaccagcggatcggctcccggttcctgcagcccggcgtcggctggggcggctcctgcttcggcaaggacaccaaggccctggtcgccaccgccagcgagtacaacctcgagatgccgatcgtcaccgcggcccgcgacgtcaaccagcggcagcgcgcgatcgccgtcgagcgcctgcagaacgagctgcgcatcctcaagggccgcaagatcggcctgctcggctgcgcgttcaagccgaacaccgacgacctgcgcgactcccccgcgctggacatcgccaacctgctgctggcccggggcgcccgggtgcggctgcacgacccgatcgccggcgagcggttccgccgcgagcagcccgagctcgcgccgtacctgagcgagaccctggacggcgtcttcgacgactgcgacgcggtcgtgctggtcaccgagtgggcgcagtacctggagctggactggggcaagttcgtcggcctgatgcgcaacccgctggtgctggacgggcggcacgcgctggacgccgagcggatgcgccggctgggcttcaagtacgttgcggtggccggctga

SEQ ID NO: 497 - DNA, 1374 bp, Actinoplanes utahensis
atgttcggtcacagtgggagttcgcgatcccgagtcgcgctcgccggtgccctcagcgccgggctgatcttcagcctggccgcgtgcggcaacgacaagaagagcgactcgaccggttcgaacgatgcggcctcggcgggcatcgactgttcggtgttcagccagttcggcgacatcaagggcaagacggtgtcggtctacacgggcatcgtcacgccggaggacaccccgcacaagaagtcgtacgagcctttcgagaagtgcaccggcgccacggtcaagtacgagggcgacaagtccttcgagacccagatcctggtccgggccaaggccggcaccccgccggacatcgcgtacgtgccgcagccgggtctgctgcagcagctcgtcgccaccggcaaggccgtcgaggccccggccgaggtgtcggcgaacgtcgacaagttctggaccaaggactggaaggcgtacggcacggtcgacggcaagttctacgccgcgccgctgggcgccaacgtgaagtccctcgtgtggtactcccccaagcagttcaaggagaagggctacacggtccccaccacgctggacgagctgaaggcgctgagcgacaagatcgccgcgaccggcagcaagccgtggtgcgcgggcatcggctccggtgacgccaccggctggccgctgaccgactgggtcgaggacttcatgctgcggatcaacggcgtggacacctacgacaagtgggtcaagcacgagatcccgttcaacagccccgaggacatcgcggcgtgggacgcggtcggcgcctacctgaagaacgacaagtacgtcaacggcggtctcggcgacgtcaagagcatcgcgtccaccacgttccaggacgcgggtctgcagatcctcgagggcacctgctcgctgcaccgccaggcctcgttctacgcggccaacttcgccaagggcaccgacatctcggagaacggcgacatctacgccttctacctgcccggcaaggacgcggccaccaagccggtcctgggtggcggtgagttcgtggtcgccttcaacaaccggcccgaggtcaaggcgttccagtacttcctgtccaccgacacctgggccaacctcaaggccaaggtgtcgagcggctgggtgagcgccaacaacggtctgaagatcgagagcctgaccaacccgatcgaccagctctccgcgaagatcctgcaggacccgaaggcgcagttccggttcgacggttccgacatgatgcccgccgcggtcggctcgaacgcgttctggaagcaggccacggcctggatcatcggccaggacacgcagaccacggtcaacaacatcgaagccgcatggcccaagaagtga

SEQ ID NO: 498 - DNA, 996 bp, Actinoplanes utahensis
gtgtttcacaccgcaaacgacacccctgaaaagcttcttcagatgctctccgcgctgctgctgttcgccgcagtgctgggcgtcattctgttcctggcgagccgggttcggggcaagcgctccgacaactgggtcggctacctctacctgctgccggtcgtgctgctgctggccgtcggcctggtctaccccggcctgcgcaccgtctacgagtcgttcttcgatgccagcggcggctcgtacatcggcctcgacaactacaagacgatcttcaccgacgacgacctgctccaggtgctgttcaacacgatcctctggacggtgctggtcccgctggtggccaccgccatcggtctgatctacgccatcctggtggacaagtcgcggttcgagtcgttcgccaaggctctgatcttcctgcccatggcgatctcgatggtcgcggccggcgtcatctggaagttcatgtacgagtaccgggtcgaccagccgaacgtgaagcagatcggcctgatcaaccagctcatcgtctggctcggcggccacccgctgcagctgctgatctccgacaacctgccgggtccgctcgggatgaacaccctgctgctgatcgtggtgttcatctggatccaggccggcttcgccatgacgatcctgtccgcggcgatcaaggccatcccggacgagatcatcgaggccgcccgtctcgacggcgtcaccccgtggagcatgttcgtcaagatcacgctgccgagtgtccggaccaccatcgtggtggtgctgaccacgctggccatcggcgcgctcaaggtcttcgacgtggtccgcacgatgaccggcggcaacttcaagaccagcgtcatcgcgaacgagttctacagccagctggtccgggccagcaaccaggggctcgccgccgcgctcgccgtggtgctgttcctcctggtcaccccgatcatcatctacaacattcgccaagtccgtcaggaggcatga

SEQ ID NO: 499 - DNA, 912 bp, Actinoplanes utahensis
atgacggtcaccccgctgacgaccacaccggacatcactccggtacagctgagcgccgccgctgtcgccaagaagaagctcagctcgccgtgggcctccctggccgcgatcgtgatcgcggtgctctggacgattccgaccttcgggctgctggtctcgtcgttccggcccgagctggcgatcaagcggaccggctggtggacgttcttcagtgacccgcaggtcacgctggacaactaccgcgcggtcttcgacagcgactccgggatctcgctcggcacgtatttcatcaactcgctgatgatctgcatcccctcggtgctgatcccgctgtcgctggcggccctcgcggcgtacgcgttcgcctggatcaacttccgcggcaagaacatcctgttcgtggcggtcttcgcccttcagatcgtcccgctgcaggtcaccctgatcccgctgctgaccatcttcggcaaggtcgggatcgccggcacgttctggccgctgtggctggcgcacaccacgttcgccctgccgctggcgatctacctgctgcacaacttcatcaaggagatcccggcgaccctcatcgaggcggcccgggtggacggcgcgggccacgtgtcgatcttcttcaaggtgatgttgccgctgctcaccccggccctggccgctttcggcatcttccagttcctctgggtctggaacgacctgctggtcgccctggtcttcgccggcggcggcgacacggtcgccccgatcaccctgcagctggccaacatcaccggcacccggggcacggcctggcacctgctggcgtccggcacgttcgtctcgatcatcgtgccggtcacggtgttcctgctgctccagcggttcttcgtgcgcggcctgctcgccggcagcgtcaagggctga

SEQ ID NO: 500 - DNA, 681 bp, Actinoplanes utahensis
atgagcgtcgtcgaggtgaccggggtcggtcgtgacttcggcagcggggaccgcgtcgtgcacgccctcgccggggtgtcgttcaccgccgagaagggtgagctggtcgccgtccggggccggtccggagcggggaagaccacgctgctcaacctgatcggcgggctggaccagccgaccgccgggcggatcgtggtggccggccgggaggtcaccggggccggcgagagggagttgctggagctgcggcgtgaccggatcggcttcgtcttccagtcgttcggtctggtgccgatcctgtccgcggcggagaacgtgagcgtgccgatgcggctcgctcgtcgcgatccgcgggaccgcgacgagcgggtgtcggtgctgctcgaactggtcgggctgggcgggcaggcgaaccagcggcccggcgagctctccggcgggcagcagcagcgggtggcgctggcccgggctctggccaacgatccggatctgctgatcgccgacgagccgaccgggcagctggactcggacaccgggcgggccatcatggacctgctgcgcgcggtggtcgacgcgcgcgggatgaccgcgctggtcgccacccacgacccgagcctgatggaccgcgccgaccgcgtcctgaccctgcgcgacggccgcctggaggccggcgcggcctga

SEQ ID NO: 501 - DNA, 954 bp, Actinoplanes utahensis
gtgacgaccgatctggccgatctggagaggcgggcggcggccgccgcggtggcccgcgccggagggcaggaccggctgcgcgggcacatcgtctgcgacggcctggtccggatcttccgcaccgagggtgtcgaggtgatggccctgcagggcctcgacctggtgatcgaccgcggggagttgctggcggtggtcggtgcgtccggctccggcaagtcgaccatgctcaacatcctgtccgggctggacgagccgaccgccgggatcgccacggtggccggattcgatctgctcgggatgaccgcgaaacggcgcctggaatatcggcggaagatcgtcgggttcgtctggcagcagaccgcgcgcaacctgctgccctacctgaccgcccgggagaacgtcgagctgccgatgcggctggccggcagacggcgccggaaacgggccgaggagctgctggagatggtcggggtggccgatcaggcgggccgccggccggccgagatgagcggcggcgagcagcagcggtgcgcggtcgcggtggcgctggccaacgacccggaggtgctgttcgccgacgagcccaccggggaactcgacgaggccaccgccgacgaggtgttcggcgcgctgcgcacggtcaacgccgagctcggggtgaccgtcgtggtggtcacccacgaccggaacgtggccggccaggtccgccgggcggtcgcgatccgcgacggcaagacggcttcggaggtacgtcgttccgcacgactcgccgcggacggaagcgaacaccacgtcagcgaggagtacgcggttctcgaccgggccgggcgcctgcagttgccggccgcgttcgtggaggcgctcgagctgcgcgaccgggtacgcctcaatctggaaccggaccacgtcgaggtgcgcccgggaaccgcggcggagcagggggagccggcatga

SEQ ID NO: 502 - DNA, 2646 bp, Actinoplanes utahensis
atgagtgtgctgcggcgcgtccgcgccttcgccgggcagctgctcctgctggcggtgctggccgggctgaccgccttcctggtggccggcccggtccggctcgccaacgggcgcaccgacgacggcctgcgcggcgacatcggcaggctggcgtacaccagccgcgatctgaccctgtccgcgattcagagggactacgagccgagtagggcggccggcgccggcgagctggccgcgctgcggcagaagctgcccgcgccgctgaccggcatgatcggcgggtcgtggtacatcgcggagagtggccgggcgtccgtggtgccggccgggacgacggccggctcctgcccgaacgcggcgacgatccgctacgagccggccgccgccgcggcgatcacgatggtcgccggccgccaaccggacaccacccggatccccgaggtgatgctcggtgagcacgaggcgcaggctctccggatcaggctgggtgaccggctcgacctgacctcgcgctggggcaccggcagggtccaggtcgtcgggctgtaccgggcgaacgatccggccgacccgatctgggacgatctgaagctggtgccgaacgtggcctgccccgacccgcgcgacggcacccggagtctcgccgtactgctcggcgaccagaccgcggcggccgaggccggcaatctcgtcggcgacttcggcgaccggtggcggttccggctcgacgagcggcggatcaccgccgaccgggtggacgcgctcgcctcggcggtcgcccggctgcggcacaacccgccgcccgagaccaccctgcagagcagcctggacagcacgctggccgcgttcgaccggcaggtgcgggcggtgcgggcgctgctcgccgtggtgcaggccgggatcctggccaccgcggccgggctgatcctgctcgccgcccggctgatggcgggccggcggcgggccgagttcgcgctgatccgggcgcgtggcggggcggtgcacacggtggccgggcggaccgtcctggagaccctggtggtggtgccggccgcggtggcgctcggctggctcggcggcgccctggtgagcggccggcccgacccggccgagccgtacctggtcgtggcggtgctcctggtcggcctgctggccgccccggcctacgcggcgttcgacgcgcggcgcccgtcgttctccgggcaccgcggtgacgtggcggcgctgcgcccgccgacccgccggctcaccgccgaggggttcctggtgctgctcgcggtcggcggcatcctgctgctgcgccggcgcggactcgacgccggggccggtgtggacccgtacctgatcggcaccccggtgctgctcgccctggccgcctcggtggtggcgctgcgcctggtgccgttcccgctgcgctgggccggacggatcgcggcccgggcccgcggcgcgatcgcgttcctcgggctcagcggcgccggccgggccccgatgcactccggaccgctcgccgtgctggtcgtggcgatcgccaccggcctgttcaccggcaccgtgaccagcacggtcggcggcgcccgggaccgggccgcggacctgtccgtgccggccgacgcgctggtcaccgggttcgcgttcaccccggacacggctgcccggctggccgcgctgccgcacgtcacccgggtcaccccggtgctgctcgcccccggcaccacgatccacggcgacaccagcccgatgatcctgcaggggcaggcgatggtggtcgacgcggccgccgccgggctcgacctgcccgccgcgctggtcgccgcgaaaccgggcacggctgcgatcccggtcgccgtctcgccgcacctggccgagcggatcggcacggccggctcggtcgacgtgcagggccggcggtaccggtacgccgtcgccgcgatcgtcgccaccgtgcccgggctcggcaccgacacacaggacttcatggtgctgcccgagcaggccatgccgatcccggacttcgcgccgatcgtgccgaaccggctgctggtcgacggcgccggcctggatgtggcgagactgcgcgacaccgccgacgcgggccaggtcgaccagctgaggaaggtgaccggacgggccgtgcaggcctgggagctcgcggtcccggccacggtgaccacccgcacggcgtaccgccgatcgctggagcaacgcggcgtcgacggcgcgctgagcttcaccttcaccgccgggatggtcgcggcggcggccctgtcgctgaccgcggtcgcgctggccgtgctgaccggcgctccggcccgcggccgcacgctgtcccggctgcgcaccatgggcctgtcccggcggcagggccgccggctgctggtcttcgagctggtcccgctggtcgcggtcgcggtgctggccggcggcctggccgggttcaccctgccggcgctgatcgggccggcgctcggcctcgacggtttcaccgccggggtgaccgccggcatcagtctcgatccgtggttcgccggtggggtcctggccctcgcggtggtcgcggtgatcgcggcgctcgccgtggagaacgtcgcgaaccgcaggctccgcgtgggctcggtgctgcggctcggagaggagcagtcgtga

SEQ ID NO: 503 - DNA, 2391 bp, Actinoplanes utahensis
gtgcgggaccggcggaccggcaggccggtggcccgcacggtcagcggcgtctggcggccacgcgacccggccgacccgtactggttgctgctgcccgacgtgacggccggccggctgccgcagacgtccacctacggtccgatcgtcagcaccgacccggcgttcttcgacaacgcgtcggcgggctggctggtccagccggatctgtcggcgccgacactgggctcgatccggcgtaccgcgcaatcgatgaccgcgaccggagcggacctgccggcgaagtcgggtctcggagcgtcggccacggtgaccaccggcctgccggacctggccggccgcctcggccgggcggacctggtccgccggtccaccctggtcaccccgatgctgctcgtcgtggtcctcggcggatacgcgttgtcgctggtcgcgctgctgctcgcggagtcgcgcaagagcgagaccgcgctgctgcgggcccgtggcgcatcccgccggcagctgaccgcgctggccgcgaccgaggccctcgccctggtcctgccggccgcgctgctcggtccgccactggccgtcgcgctggtcagcctgcacaccagggtccggctggacgccggggtgtggctgatcggggtcctggtcgcggtcggcgggatcctcgcgctgaccgccccggcgacccggcggggcggcacctacctcgccgagaccgccgggcgcaaacgcctgccggtgctccgccgcgccggcctggacctggtcgtcgtcgccctggccgcgctggcctggctgcagctgcggcagtattcggcgccgaccggggcgggcggcctgggcatcgacccgctgctggccgcggcgcccacactgggcgtgctgaccggcgcggtgctggccatccggctgctgccgccggtcgccaggtccgtcgcggcccgcctgggccggggccgctcgcaggcttcgctgctcggcgcctggcaggccgggcgccgctcgcacgccggtccgatggtgatgctcgcgctcgcggtggccgccgccaccgtctcctggtgtctggccgcgaccgcgcagcagtcccgggccgatcaggcggagcagctggtcggcgccgacctgcggctggtcgagaccggcggggtcgccccggccggtcgggaccggcagctcgccgcgctgcccggggtgcgcgccgtcgttccggcctggcgcgactcggtgcaggtggccgccggcagggagccggccgacctggtcgcgatggacaccgcgaccgccggtggggtggtccgggcccgcgcggacgcgaccggtggcgcgcccgccgatctgctggccgagctggccgcggccgcccgcaccggcaccgcggcgaccgcgaccctgaaggccggccggatcaccacctccgggccggcccgggtcaccgcgatcttcgccggggggcgccgggtcgagctgggcaccagcgacgccgaccggccgctgcggatcagggacggtgggcccgggctgctcggcttccgggtggagtcctcggggcaggtgccgatcacctgggacatcaccggccaggacgacgtctggtcgccgctgaccccgcaggcggtcggcgggtatgccgtggtccgctcgtccggcccgtggactccggtgccgatcgcgatcacccggccggccgcatccgccctgggcgacgtctcccacctgcagatcggtggcgtgtcggtgccggtcacggtggtcgccacggtcaaccgggtgccgggcaccaccgtaccggccgcgatcctgatcgaccggggcgtcgtcgactcgcggctgttccagggctacgggatcgtccgtgacaccggcgagtggtggatcagcgggcggcctgccgggctcaccggactgaccgggctccgcgtgctcgaccggcaggagctcgcctccggcgaggatccgttcgacaccgccggccgggtcgcgctgttcggcgccgcgctcggcgcgatggtgctggcggtggccggcatcgccgccgacgcccgggccaccgcccggcaccgctcggtggagctggccgtgctgcacaccctgggcgccggcccgcgcctgctggcccgctcgctgatcgtcgagcaggcgttgctggccgggctcggcgcggtcgccggcctggcggtcggcctgctggtggcggccgggatggtgccgcagatggtgctcaccccggcggccgcccggccggtgccggacgcgctgctgcgggtcctctggggacgcacggccggcagcgccgcgctgctggtggtgatcgccctggcggtcagcgcgatcaccgcgacctcggccacccgccggcttccggcggcccggctgcggctgggggaggaccgatga

SEQ ID NO: 504 - DNA, 540 bp, Actinoplanes utahensis
atgaacaccatggtcaatggtggggaacggcggggcggccggaatcccgccgacgggccaggggctcccggtgttgatcccatctggcaagatgcgccgcatgctcgaaccggggcgccgatggcgctgatcgtccggcgtgcggcggcagctcggggactgctcgccgcggcggccgcggtgatgctgtccgcggtgctcctgatgacggggctgaccgcgtacgccaccgcctcggccggcgccggggtgcgcgcggcggtcgccctcgccgatccggacgagcggtcggtgctggtgcgtggtgccgccggaacggatccgcaggcccgcgacaagaccattcggcaggcgtacgcgccggcccggatcagtggcgcgcggtacggctccggctgggcggtcgagggtgcccgcggcagcgcggtccccgactcgtccggtgtggtctacgcgtcgctggtccggatcgacgacctgccggcgcacgccgacctgctcgccggggcgtggccggccggcaccgggcaggtggcctag

SEQ ID NO: 505 - DNA, 219 bp, Actinoplanes utahensis
atggacgacgcactggtggcctacaacgccggtcgggtggacggggctgccgggcaccgggacccgcagatcgccgaggatccggaggtgggagcggactaccggatcgggctgctggacgggcggatcgcggcatatcacatgatcaacgaggtgcgggggatcctgggggtcaccgactcgctcttcgatcaaccggatgatccgcgaccggcgtga

SEQ ID NO: 506 - DNA, 588 bp, Actinoplanes utahensis
atgaacaggatcattcgcggtgtcgcgatgtccggtctggcggtcgccgcgggcctggccgtcgccgccgggcccgccgccgcatcgaccggcacgtcgtcggcgcccgccgccccgcagaagcccgcagctccgcaggcgcccgctgccccgcagaagcccgctgccccgcaggcccccgccgccccgcaggccaaggcgcacctgcaggaccggatcgtcggtttctaccgcagcccgatggcctgccacgcggtcggccgccgcggcgaattccgtcaccagtgggccagccacgactgcatcccggtgcggcacgggttccggcggggcagctgggcgctcaaggcgtactacgggtgggccgggcccggcgacttccaccacggtccggacttccaccacggtccggacttccaccacggtccggacttccacgacggcccggggttccacgacggcccggggttccacgacggcccggggttccacgacggcccggggttccacgacggccccggattccatgacggcccggatttccatgacggaccgcacgggggccccggcccctggaagaagaactga

SEQ ID NO: 507 - DNA, 1326 bp, Actinoplanes utahensis
atgaccctggtagccgaacgtcccaccctgcgggccaagtggatcgaccggtgggatccggaggaccccaccttctggtcgaacggcgggtcgcggatcgccaagcgcaacctgatcttctcgatcttctccgagcacatcggcttctcggtctggtcgctgtggtcggtcatggtgctcttcctcggcccgaaatacggcttcgacccggcgcagaagttcctgctcaccgccgtcccgacgctggtcggggcggggctgcggatcccgtacacgttcgcggtggcccgcttcggcggccgcaactggacggtgatcagcgcgtccctgctgctcatcccgtcgatcctggcggcgttcctgatcaggccggggatctcgttcaccacgctggtgctgctggccgccacggccggggtgggcggcggcaacttcgcctcgtcgatggcgaacatcaacgcgttcttcccgaaccgctacaagggctgggcgctgggcatcaacgccggcggcggcaacatcggcgtcgccgcggtgcaactggtcggcctggccgtgctcgccaccgccggcgccggccaccccgggatcgtggccggcatctacatcccgctgatcgtgctggccaccctcggctcggcactctggatggacaacctgtcgcaggcccgcaacgacaagcgggggatgcgcgacgcgatccgggacgggcacacctgggtgatgtcgctgctctacatcggcaccttcggctcgttcatcggattcgggttcgccttcggccaggtgctgcaggtgcagttcgccggccagttcaacaccccgatcaaggcggcgtacctgaccttcctgggcccgctgctcggctcgctgatccggccgctcggcggggcgctcgccgaccggctcggcggggccagggtgaccttcgtgaacttcatcgcgatggggctgggcgccagcgtcgtcctggtggccgcacagcagcggtcgctgccgctgtacatcgccggcttcatcacgctgttcatcctcagcggactgggcaacggatcgacgtacaagatgatcccggcgatcttcaaggcgaagtacccggacgacgccccgcaggccctgcggctgtccggtgcggtgatcggcatcgccggggcgatcggggcggtcggcggggtgctggtgaacctggccttccggcagtcgttcctgatctacaaggatgcggacgcggcgtacctggcgttcatcggcttctacgcgctgtgcgtggtggtcacctgggtggtctacctgcggcccggggcccggagggcgatcgcggtctga

SEQ ID NO: 508 - DNA, 306 bp, Actinoplanes utahensis
atgaagacactgaccactctcggccccgtctccgacatccccctcggcgaaggacgcacctacgccgtcggggacgacatgatcgcgatcttccgcctgcgggacggctcgctgcgcgcggtctcggcggtctgcccgcacaagggcggcccgctggcggacgggcagatcgacaacgcggtcgtcgtctgccccctgcacctgttcacctgggacctagccaccgggtgctccccgtccggccagcccccgatcgacgtctacccggtgcgggtcgacgacggccagatcgttctgggagagtga

SEQ ID NO: 509 - DNA, 2463 bp, Actinoplanes utahensis
gtgactcagaagcttgtcgtcatcggcaacggcatggcgggggcccgcacggtcgaggagatcctcgcccgcgacggggacttctccgtgacgatgttcggtgacgagccgtacggcaactacaaccggatcatgctgtccaacctgctcgccggggtggagacggaggagggcatcttcctcaacgacctggcgtggtaccgggacaacggcatcacgctgaacgccggcgtcaaggtcgagcggatcgacgcgaccaccaagaccgtcgtcgacagccgcggcgtggtcaccccgtacgacaaattgatcattgcgaccggcagctactcgtggacgccgccgatgaagaacgtgcacaacccgaagcgcggctaccaccagggcgtgttcgcgttccggaccctcgacgacacgcgcggcatgatccgctacgcccgggaccacgagcgggccgtggtgatcggcggcggcctgctcggcctggaagccgcccgcggcctgcagaaccacgtcagccaggtgaccctgctgcacgccatgggccacctgatggagcgccagctcgacccgaaggccggccggatgctgcaggccagtgtggagggcaggctcggcatccaggtgatcaccaacgcgatgaccaccgagatcctcggcaaggaccgggtcaccggggtcaagctggccgacggcacggtcatcgagtgcgacgtggtggtgatcgcggccgggatccggccgaacaccgagatggtggcgggcagcggcctgccggtcgaacgcggcatcgtggtcgacgaccagatgcgggtgcggggccaggccgacatctactcggtgggggagtgcgcccagcaccgcggcaacctgtacgggctggtcgcgccgctgtgggagcaggccaaggtgctcgccgaccacatcaccggccgtgatgccggcgcggcgtacgaggggtcgaagctctacaccaagctcaaggtggccggcatcgacgtggcctcgatggggctgatcgcgccggagtccgaggacgacgaggtgatcgtctacaacgagccgcgcaagggcgttcacaagcagctgatcatccgggacgacgtgctcgtcggcgcgaccctcgtcggggacaacggcaaggcgcagtcgctgatccaggctttcgagagcggagtccggctgccggaggagcgcgccgagctgatcttcgacatcggcgggccggcgggggaggtcccgcccgcggagatggcggatgacgctcaggtctgcaactgcaacggggtcagcaagggtgcgatctgcggggtggtcgccgggggctgcgcgacggtcagcggggtgatggacaggacccgggccggtaaggggtgtggcacctgcaagccgctggtccagcggatcgtggagtgggccaacggcggtgctgccgaggaggatccggcggcgtcctggtacgtgcccggggtgccgatgcccaagcccgaactcatggccgccatccgaggattcgggctgaaaagcgtatcgtccgtcttcgccacgctggtgcccggcggtgcggaggacgccaagagcaagatgggtctcgcctccctgctcaagatgatgtggggcgccgagtacgtcgacgagcgtgacgcccgcttcatcaacgaccgcgtccacggcaacatccagaaggacggcaccttctccgtcgtcccgcagatgaagggcggcgtgaccaccccggccgagctcaagcggatcgccgaggtcgccgagaagtatcaggtaccgatggtcaaactgaccggcggccagcgcatcgacctgctcggcatcccgaaggaacagctcccggccatctgggccgacctggacatgccgtccggctacgcgtacgccaagagtttccggaccgtgaagacctgcgtcggctcggacttctgccggttcggcgtcggtgactcgaccgcgctgggcatcgccatcgaggagcggttccagggcctcgaaggccccggcaagatgaaactcgccgtctccggctgcccgcgcaactgcgccgaggcgtacgtcaaggacctgggtgtggtcgccatcgacggcggccggtgggagatctacgtcggcggcgcggccggcgcccacatccgcaagggcgacctgctcaccacggtcgactcggccgcggaggtgatccggctgaccggccggttcctgcagtactaccgggagaacgccaactggctggagcggacgtacgcgttcgtcccgcgggtcggcatcgaccggatccgcgagatcgtcgtcgacgacgcggacggcatcgccgctgccctggacgccgccgtcgaggaagccgttcagtcctacaaggacccctggaaggagcgggccgagccggccacgcccggccagttccgtacctccctgcccctgatcgtcctcccccaggttccggtgcgcgcatga

SEQ ID NO: 510 - DNA, 657 bp, Actinoplanes utahensis
gtgcccactctgatcgccgtcgcgcacggcacccggtccgcgaacggccgccgccagctgcaggacctcgccggcgccgtggcccgccgccgccccggcctggacgtccgactctgctacgtcgacgtgcaggagccgaaggtcgccgacatcgtcccgatcaccccgaacgccgtcgtcgtcccgctgctgctgtcggccggctaccacgtgcgggtcgacatcgccgaggcggtcgccggcacgagcatcccggtcaccgccccgctcggcccggacccgctgctgctcgacgccatgatgcggcacctgccgccggccggcgccgtggtgctggccgcggccggatcctcggatcccgcctggcgcgcggacgtcgcccaggtcgccacccggctgccgggcccagcccgggtcggctacgtctccggcagcggcccgcgcgttcccgacgtggtcgccggcctgcgtgccgagggcgccgaacggatcgcgatcgccgcttacctgctcgccgacggcctcttctaccgctcgctgagcggcgccggggccgacgcggtgaccccgccactgtgccgggacgcggccgtcgccgacctcgttctgggtcggttcgacagcgcggtcctcacaacagcgggccgccgcttgtag

SEQ ID NO: 511 - DNA, 1101 bp, Actinoplanes utahensis
atgaccgagggcgcactggccgggttcaccgtggcggtcaccgcggaacggcgccgcggtgagatgaccgcgctgctggagcggcggggggctcgggtggtgagcgcgccggcgatcaccattgtgccgctgatcgacgacgacgcgctgcgcgcggcgaccgaggcgtgcatcgggctggagccgcatctcgtggtggcgaccaccgggttcggcttccggggctggctggaggcggccgagggctggggactcgccgagacgctgcgcgaggcgctgcgagccgcgaagatcatcgcccgggggccgaaaccgtgcggggcgatccgggcggccgggctctccgaggactgggcggccaagaccgaggcgtcggaggaggtgctcgaacggctgctgcacgacggggtggccgggcgcaagatcgtggtgcaggagcacggtgagccgcagaccgagttcgtgaacgcgctgcgcgccgccggggccgccgtggtcgaggtgccggtgtaccgctgggcgctgccggccgacaccaccccggtccgccggctggccgagcaggtggccgccgggcagatcgatgcggtcacgttcaccagcgcgccggcggtcaaggcgttcctgcagatcgccggggagaccggcgtggacgtgccggccgccttccgggacggcacgctggccgcctgcgtgggtccggtgaccgcggcgccgctggtggagcgggacgtgccggtggtgatgccggaacggttccggctcggtgcgctgatcaagacggtcaccgacgagctgccccggcgggcggtgcggctgcgggtcgccgggacgacgctcgaggttcgcgggcacgcggtgctgatcgacggggcggtccacgcgctggccccggccgccatggcgatcctggcgtcgctggcccgccggccgggcgcggtggtctccaaggaacagctcgcggcggcgctgccgcggggcaacgacgggcacgccgtggacgtggcggtggcccggctgcgggccgccctcggctccggcaggcacatcgagaccgtgatcaaacgcggctaccgtctccgggtcgacgaagcagcctga

SEQ ID NO: 512 - DNA, 894 bp, Actinoplanes utahensis
atgacagtgactgaccgggaccgcaccgccagccggctgctgcgctcctccgccgagcactcctacgacccggagatcgagatcgactgggacgccccgttcgtcgagggcaagtacttcgtcccggtgcaccgctccagcctgtacggcaccgcgctctgggaccggctcaccgagcagcagcgcatcgaactcaccaagcacgaggtcgccagcatcgccggcctcggcgtctggttcgagacgatcctgatgcagctgctggtccgcggctactaccggcaggaccccacctcgccgcacgcccagtacgcgctcaccgagatcggcgacgaatgccgccactcgatcatgttcggcaagatgatcgcccggctcgacaccccggtctaccgccccgacggcatcaaccagttcctcggcacctggatcgcgcacaccgccaccggtccgcgcatgttcgccgccatcctgatcgccgaggagatcctggacaccctgcagcgcgaggcgatggccgacgagaccgtccagccgctggtccggatggtctcccggatccacgtcgtcgaagaggcccgccacgtccgtttcgcccgcgaggaactggcccgccagatccgcctcgccggcaaatcccggctcgccttcgaccgcctggtcatcgcccgagccgcctacctcaccggcacccgcctcatcgacccgcgtgtctaccgcgccgtcggcatcgacccggaggagggccgccgcgtcgcccgcgccaacccctaccaccgggagacgatgcgctgggccggcgaacgcatcgtcggatacctgtccgacctggacctcatcggcggcggcccggccaaggcgctgtggaaggcgagcggcctactcccgcgataa

SEQ ID NO: 513 - DNA, 684 bp, Actinoplanes utahensis
atgaactcggtcaccccacccgtcaacaccgatggccgccgcggccgttgggacagtcatcgcgagcagcgccgcgccgagctcaccgccgccgcgatagaggcgatccggcagcacgggccggaggtcgggatggaggcgatcgccgcgcacgccggggtgagcaaaccggtgctctaccgctacttcagcgacaagtcggagctgtggctcgcggtcgggcagcaggccggcacgatggtgctggaggcgatgatcccggcggtcgcctcggtccgcgaggagcgggccgcgatcgcggcggcgatcgacgtgtatctgacgcacatcgaggccgatctcaacctgtaccggttcgtggtgcaccaaccggacatcgcccggcaccgggacgtggtcgccgacgtggtggacaccgtggccagcggcctggcccggatcttcggcgaccggctgcgggcccgcgggctggactcgggcgcctcgctgccgtgggcgtacggggtggtcggctacgtgcagtcggtcggcgactggtggctgcggcagcagcagccgatcagccgggaggcgctcggcgaatacctgacgacgttcctctggggtggcgtcgccggcatcagccgcgcggcggacatgcccggtggcctggcagcgcaagcggaagggtggttgcaggcatga

SEQ ID NO: 514 - DNA, 1458 bp, Actinoplanes utahensis
atgaaccacttcgacatgctgatcatcggcgccgggctctccgggatcggggccgcctggcggctgcaggaccagcggcccggcgacacctacgcgatcctcgaggcgcgggacgcgatcggcggcacctgggacctgttccgctaccccggggtgcgatccgattcggacatgttcacgctgtcgtatccgttccggccgtggcgggagccggagtcgctggcgtccggcgacaagatccggcggtacatcgaggagaccgcggcggaggccggaatcacccggcacatccggttcgggcgcaaggtcgtcagtgcgaagtggtcgtcggccgaggcccgctggacggtgcggaccgccggcggcgaggtttacaccgccgatttcgtgtacgcgtgtgccggctactacagctatgccgagggctatcagcccgacttcgcggggctcggggacttccgtggccgcgtcgtacatccgcaattctggccggacgatctcgatttccacgaccggagggtcgtggtgatcggcagcggggcgaccgctgtcaccctggtgccggcgatggccgcggacgccgcgcacgtcaccatgctgcagcgctcacccacctacgtgatcccgcagccgaaccgcgacgtggtcgcgaacgcggcccgcaggctgctgccgccgcacgccgcgaaccgggtggcccgggccaagaacgtgctggtcacgcagctgttctaccaactcgcccagcgacgcccgaagctggtccggcgggtgctgcggggcgtggccgggcgctatctgcgcaccccgggatacgtcgacacgcacttcaacccgcggtacgacccgtgggaccagcggctctgcgtgatcccggacggcgacctgttccgggtgatcgcggacggccgggcctcggtggtgaccgaccacgtcgacgcgttcgtgcccgaggggatccggctgaggtccggcaccgtgctggcggcggacgtggtcgtctcggcgaccggcctgtccctgctgccggtcggcggcgttcaggtgagcatcgatggaacgcccgtcgatatcggtcagcacgccgcgtaccgcgggatgatgctgtccggggtgccgaacttcgcgtactgcatcggatacgtcaacgcctcctggacgctgcgcgccgacctctcgcaccgctatgtgctcaagctgctcgaccacatggcccgccacaacctggccgtggccacccccgccgaacccggcgcggccggccggccgctgctcgacctgagctccggatacgtccagcgggccctcgacaagttcccgcgccagggcgaccgggacccgtggctggtccggcagaactacctgcgggacgtggtcgccaccccgcgcgccgacgtcacccaggacatgcgtttcaccccgcgctccgcccccgtccctgcttccaaggtggtctga

SEQ ID NO: 515 - DNA, 867 bp, Actinoplanes utahensis
atgccccgactcgatccctaccggttcgccggtcgcaccgccgtgctcaccggcgcggccagcggcatcggtgaacagctcgcctacggcctggcccagcgcggcagccacctgatcctggccgacgtcgacgccgcccggctcgacccggtcgccgcccggatccgctccgcccacccggcactctcggtcgagacggtcgtcgccgacctgtccgaccggtccgctgtcgacgccgtcgcggcccgggtgccggccgccatcggactgctgatcaacaatgccggtgtcgccctcggcgggcgcttcgaccaggtcagcgtcgaccagttcgagcatgtgatgaacgtgaacttccgcgccccgatgctgctgacgcacgcgctgctgcccgccctgaccgccaccccgggcggccacctggtgaacgtctccagtctcttcgggctgatcgcgccgcccgggcagagtgcctactgcgccagcaagttcgcgctgcgcggtctcagcgaatcgctgcgcggcgagctgttcgagaacggggtcggcgtcaccacggtgcaccccggcggcatccgcacccggatcgcggagagcgcactgatcggcgagggcgtgccggaatcggacatcgcgccgacccgcaaactgttcgccgcgctgctctccttccccgccgagaaggccgccgagcagatcctgcgggccaccgagaaacgcaaggcccggctgctgatcgcggccaacgcgaaaggccccgacctgctgcaacgcatgctcccggtcggctccggcaccatcatcagggcgctcaccgccgccacggtcaagaccgcggggcgcgccaaggcgggtgccacccgatga

SEQ ID NO: 516 - DNA, 840 bp, Actinoplanes utahensis
atgaattacctggacgtacgcggttcccgcatccgtttccacgagaccggcgacccggccgccccgccggtggtgctgctccacgggatcgggcgcagcctggaggactggtcactgcaacacccccggttcgactcggactatcgggtgatcagcatcgacatgccggggttcgggctgtcccggcgggtgccggccaccaccaccctgccggtgctggccgacgcggtgtgggcgacgctggacgagctcggcgaaactcgaccggtgcacctgatgggcaactcgctgggcggcgcggtgtcgatgacgatgctggccggcaccccggatcgggtgacgacgctgaccctggtgaacagcgccggcttcggcaaggaggtcacctgggcgctgcgcgtgatggccctgcccggcctgggtcgcacgatgctgcgcaacatcgacaagcgcaccgccccccgggtcgagcgaaccctgttccgcgaccgcgcgctggtcaccccggaacgggtggagatggccatccggatcgcccagcagcccgacttcgccccggtgtacctggaggtcgccaaggccctgggcggcctccgcggcgtagcagccccctggcggaccgcgctgctcgcctccatggccggcctcaccacccccaccatgatcgtgtggggcgaccgcgacatgatcctgcccagccaccacatggccgcggcccgggccgctttcccgcatgcccagtcgcacatgttcccggagaccgggcacatgccccagatcgaacgccccgacgagttcgcggccctggtccgccccatgctcgccgcggtccccgcctga

SEQ ID NO: 517 - DNA, 801 bp, Actinoplanes utahensis
ttgcggccgcaccgctcgccgcttcccctccgccgcccggatcccctccctccgcttgcggccgcaccgctcgccacttcgccctccgccgcccggatccccttcctccgcttgcggccgcaccgctcgccgcctccccttccgccgcccggatccgctccctccgcttgcggccgcaccgctcgccgcttccccttccgtctcccttcagcttccgcgccggacgcccctccgactttccacgccgggccacctccggcggctgtccaccttcctgtggcaatcacccgacggtggagttgcggaaccagattcacgcggttggatggaaccatgcgccgagcgatcctgttgttcgtcgcgctgatcgggggattgctcgcgggctgcggctcggcatcaccgaaagcgccggccccagccctgcccgccgtcaccggcacccacccggtgggttcggttcaagacctgcagaccgccgattcgtccgtgcgggtcaaggtcgccgccgccggcgcggccgccgaccgctacgtggtgcgggtgaccgtgcaggtcctccgcggcacctacgagttcaacccagtcctcctccatctccgcgacaccaccggcgccgacaccggcccggtccccggccggtcccggccagcgaccgctttcaccctgcaccccggagtcaccctgagctggcgtgtccccttcccgcaccccgcagccccggacgcccaggtcgtcctcaccagccgatccggcaccgccctggcggcctggaacacccgccccgccggcaccccgtaa

SEQ ID NO: 518 - DNA, 639 bp, Actinoplanes utahensis
atgaccactccccagccgcaggatctccgtctgctggaggcgttgcactccacgccggcccgccgctacctttccaccgagccgatcgccgacgacgtgatccgcgacatcctggacgccgcgatccgcggcccgtccggcggcaacagccagccctgggtctggatcgtggtccgggacgcggacaccaagaagcagatcgccgactggtaccgggagggctgggaacgccactacggctcccgccgcgaggagatcctcaacgcccccgacggcggcccgatgtccaagcgcagcttcctggccgccgaccatctggccgcccatctggaggaagcccccgtctggatcatccccgccatcctcggcgccgcgaaatccagcaacccccgcctgggctcctccatctacggcgcggtccagcagctcatgctggccgcccgcgcccatggtctcggctccactctcaccactctgcacatcggtcacgaagccgacgtccgcgacatcctcggtctgccggagaatgccctcaccatggccctgatcccgctcggctacccgagcaagggccgctgggcccagccgaagcggcgtcccctggaagaagtcgtcttcttcgaccgctaccagcagtaa

SEQ ID NO: 519 - DNA, 1254 bp, Actinoplanes utahensis
atgtcggagcagctcctcaccaccgatcaggtcgcccagcggctcggcgtcaaaccggcgacggtgtacgcatacgtcagccgtggcctgctccccagccgccgcaacgccgccgggaagggcagcctgttcgccaaggccgacgtcgacgccctgctcgccggccgcaaacgcgccacccccaacatccagaccggcatcaccctgatccgcgacggcgcgctgttctaccgcggacgggacgccaccgaactggcccgcacctcgacctatgaagcggtcgccaccctgctctggaccggcccgcacgacccggagccgggcctggacgggggcggcgctctggagccggcgccgttcgcggtcagtcgcgcatcgttggcgctggcggagcgggtgggcgcgctgctgccggcaacggcccgcctcaccgaccgcctgcgggtcacggtggccgccatcgccgccgccgatccgttccgcttcgacaccagccccgccgctgtcgtcaccaccggtcgcaccctgatcgccaccatggtcgcggccctgcctctccggtcagcccgggagccggtagacatcctccgatcggatccgtcggcgccgaccggggcggggggtcccgggtcgatcgccgagttgctgtggccgaggctcaccggagagccgatgaccgaggtgggacggcgggtcctggaagcggcgctgatcctgctggccgaccatgacatcgcggcttccaccctggccgcccgggtggcggcgtcgacccgggcgcatccctatgccgtggtcagcgccggcctggcggccctcgacggtccgctgcacggcgccgccagtgagtacgtccacccgctgctcgtcgaagcgctggccggcgcggacccggttgcgatcatctccgagcggttgcgggtctccggcgggattcccggtttcgggcatctgctttaccagaacggtgatccgcgcgccatcaccatcctccggctgctcggtgaccatcccgcccggcgggccgcgaccgcgctggccgacgcggtccaggcccgctcggggatccaccccaacatcgatctcgcgctcgccacgctgaccctccacttcggtatgccgtccgacgcgggcgaggcaatcttcgccatcgcccgcaccgcgggctggctggcgcacgctctggaggagtacgccaaccacccggtccggttccgtcccacgggccaatattccggccggccacccgcctga

SEQ ID NO: 520 - DNA, 1185 bp, Actinoplanes utahensis
atgttgaccgcatcaacattgacggcacatccatcaagtcgtcatgttgagagcatgttgacagtgaatccaggacttgccggtgtcgtcgccttcgacaccgagatcgccgagcccgaccgcgacggcggctccctgcgctaccggggtgtggacatccgttcgctggcgggaaacgtctcctacggcgacgtctggggtctgctcgccgacggcgacttcacccgcgcgctgcccccggccgagccgtccgccgtcccggtgcgctccggtgacgtgcgcgtcgacgcgcaggccgcggtgtcgatgctcgccccgcacctcaggctgcggcaactcatcgacatcgacgatgtgcaggcgcgcgacgacctcgcccggacctcatccatgattctttcgtacgtcgcgcaggcggcccgcggcgcgcacctgcccgtgatcccacagcggctggtcgacgcgggccgcagcaccaccgaacggttcatgatccagtggcagggtgagccggatccacggcaggtggcggcgctggaccggtactggatctgcgcggccgagcacggcatgaacgcgtccaccttcaccgcgcgggtcgtggcgagcaccggcgccgacgtaccggcctgcctgtcggcggcgatctcggcgctgtccggcccgctgcacggcggcgccccggcccgggtgctcggcatgatcgagcaggtggagcgcgccggggatgctcgggcgtacgtccgcggggttttggacagcggtcagcggctgatgggtttcggtcacgcggtgtaccgggccgaggatccccgcgcccggatcctgcgggatgcggcgttcgagctcggcgcgccgcgtttcgaggtggcccgggacctggagctggccgccctcaccgagctgcgcgaacggaaaccggaccgtgtcctggagacgaacgtcgagttctgggcggccgtgatcctcgacttcgcgggcgtgcccgcggagctgttcacgtccctgttcgcctgcgcgcgcacggccggctggagcgcgcacatcctggaacagaagcgcctcggcaagatcatccgcccgtccgccgactacgtcggcccggctcatcgcccggccgaagcgcttgccggctggtccgacgccctgcaccgcaaccgcctgcccgggaacgtgaccgcatga

SEQ ID NO: 521 - DNA, 849 bp, Actinoplanes utahensis
atgagtgcggacaccgccgatctcgggcagcccgtcgccgacttcggaaacgccaaggacttcggacaggccgcggcaggcttcggcgaaaccgtcgatttcggacggaccgccgccgactacgcccggcaccgggccggtttcccgcccgcgctgatggaccggatcgacgacgtcgccggccggaccgtgctggacctcggcaccggaaccggcagcctggcccgtcttttcgccgcccgcggcgcggtcgtcaccggtctcgacccggcggagccgctgctggaccaggctcgtcgcctggatcgggaggcaggtttgagcatccggtacgtcgtcggcgccgccgaatgcatccacctgccggacgccacgttcgacctggtcaccgcgggtcaatgctggcactggttccgggccggcgaggcagccgccgaagtgtcgcggctgctccgtccgggcggccggatcgtgatcgcgcacttcgactggctgcccctgccgggcaacgtggtcgccgccaccgaggagctgatcgtggcgcacaacccggcctgggcgctggccggcggcaccggcatccatccgcgctggctcaccgacctgcgctcggccggcttcaccgggctggagacgttctccttcgacgtggacgtcccgtactccccggtcgactggaccggccggatccgcgccagcgcgggcgtcgccgcgagcctgccaccgcccgctgtcgagcgcttctcggccgaactcacggccctgctggagcgcgacttccctgccgacccgctgctcgtcccgcaccgcgtatgggccgtcgtggcccgcaaaccggacgaccggtag

SEQ ID NO: 522 - DNA, 1935 bp, Actinoplanes utahensis
ttgctcttggcggaacgaccaggccggggcgcggcacgcaccgtgacccccgcggagagggcgcaggcccgatccgtctcgctgcgccgcatcggcgcgctcttcatcggtcaccggcggcagctcgccgtcgtggtggcgatcatcgtggtgtcatccgtgctcggtatggccacccccttcctcctccggcagatcatcgacgtcgccctgccgcacggcgatctgcacctgctgtcctggctggtgctcggcatgatcgtggtcgccgcgatcacctcggtgctcggcgtgctgcagacgtggatctccaccaccgtcggccagcgggtcatgcaccggctgcgcgtcgacgtcttcgcccacctgcagcagcagtcgatcgccttcttcacccggacccgcaccggcgaggtgcagtcccggatcaccaacgacatcggcggcatgcagaccgtggtcacgtcgaccgcgacgagcatcgcggccaacctcaccaccgtggtcgccaccaccgtcgcgatggtcgcgctgacctggcagctcaccctgatctcgctgctcgtgctgccgccggcgatctatctgacccggcgggtcgcccggatgcgccggcagatcaccgccgaacgtcagcgggaactcgccgagctcaacgtgatcatcgaggaggggctgtcgatcagcggcatccagctcagcaagacgatgggcgcgggcgcggcacaggtcgagcggttcaccggatcgtccggccggctgatcgacctggaactgcgctccgaactggccggtcgctggcggatggcggcgatgagcgtgatcttcgcgatcattccggccaccatctatctcgccgcgggcctgcccttcgcggccggcgggatgagcatcggcacgctggtcgccttcaccgcgctgcagggcaacctcttccgtccgctgatgagcctgctcgacgtcagcgtcacgatgaccagctcgctggcgctgttcgcgcgcatcttcgaatatctcgacctgccggtcgagatcgcgtcgccggcctcgccgatccggctgccggaggtccgcggtcacctccgcttcgagaacgtctctttcgcgtacgacaccgatgcctccaccgcgaccgatgtcaaccgcgatgcgccggttggcgtctccggcggaaccggcgtcgaccgtgacgtgccggtcggcatcaaaccggacgggccggcgggcaggtccgcgcggtctgaggtcaagcaggatgcgctcggcggccgagccgcgctggccgacgtcaacctcgacgtgcccgccgggacctcgctggcgctggtcggcgagaccggctcgggcaagagcacggccgcggcgctgatcgcccggcttcacgaccccaccgccggacgggtcaccatcgacggcgtcgacctgcgcgacctggacctcgccgacctgtccacgatcgtcggcgtggtcagccaggagacgtatctgctgcacaccaccatccgagccaacctccgttacgccaagcccacggccaccgacgcggagatcgaggcggcctgccgggccgcccagatccatgcgctgatcgagagtctgcccgaggggtacgacactctggtcggctcgcgcggccaccgcttctccggtggcgagaaacagcggatcgcgatcgcccgcacgctgctgcgcgacccgaagatcctggtcctggacgaggcgaccagcgcgttggacaacgagaccgaacgcgcggtgcagcgggcgttcgacgagctgtcccgcggccggaccacggtgaccatcgcccaccgcctgtcgacggtgcgtgacgccgaccagatcgtgctgatcgaccacggccggatcgtcgaatccggcacccacgactcgctgctttccgagggcggccggtacgcggcccttgcctcctga

SEQ ID NO: 523 - DNA, 405 bp, Actinoplanes utahensis
gtggaggaagagtcgctcaacgacgcgttctgggcggtcagtcgccggctgcgtgagcaggcccgcagcgagatggagccgtggggcgtcgcgccgtcgcagttccgcgcgctgagcgtgctactcgcccacggtgacatgcgactcagtgcgctggctgagcggctccggatcgccccgcggtccgccaccgaggtcgtcgacgacctgcaggagcgcggcctggccgagcgccgccccgaccccgacgaccgccgcgccaccctggtcaccctcaccgacctgggccgcaccaccggcgccgagatcaaagccgcccgctccgccgccggccagcgggtcttcgccgccctcacccccgacgaccaggcgcagctcgcccgcatcctccgccagctcacctga

SEQ ID NO: 524 - DNA, 846 bp, Actinoplanes utahensis
gtgcgaaccgagcccctcctctcccaggccgacgacctcctcgaccgcggtcgtgccgagaacgccgcccacctgctggcgccgatcgtcggccggcaaccggagaacgtcgacgcctggcaccggatggcccgggcgcacctggagatgggcgacctcgacggcggtctgcgcgccgccaaggccgcctggcacttcgacccgcacgggccggaaaccctgtactggctcagccgcgccgccaccgaactcggccggcaccgcgaagcgatcgaagccgcggccgcggcctgccgcgaggacccgggcaacccgcggctgcacaaccgcctggccgacgcccagctcgccgccggccacgtcggtgacgccctggacaacctgaagatcgccgtcgagctcgccgactacgacgccgacctgcacgtcaccttcggccgcgccctgttcgccgccggccgcccgctcagcgcccgggaatccgtcggccgcgccctggccctcgaaccggggcacgccgccgcgcaccgcaccctggccctgttcgagatcgccatggagccggtggtggacgccgcctccctggcgcaggccgccgacggattcgccgagtcactccgggtcgggccgaccggccgcgtcgacgagcgcgccgtcctggccaaggacgccatcggctacgtcgcgcgggtggccctgacctggtgcctggtcgccctgctggtcctcggcgtcctcgccgcgacatcgctggtcaccctgccggccggcctgtacctgaccatcctctgcctgggcgccgtagccggctgcggcgcgatcgccttccgccgctccctcctctga

SEQ ID NO: 525 - DNA, 504 bp, Actinoplanes utahensis
gtggaggacacgagagcgcccgacgaagcggacaaggcagaacgccagcgactccggtcacggcttgtcgacctgctcaactcctattccagcgaggccaaccacatcgggcacgccttcgccggacgccaccggctgcacgggcccgacctgcacgcgctcctcgccgtcatgcacgcggagcgcgccggggagccgctcacacccgggcggctcggcgagacgatgggactgtcctccggggcgacgaccgcgatgatcgaccgtctggagcggggcgggcatctgcggcgcagccgggagagcagcgatcggcgagtcgtccacctgcggtatgcggaggcgggaatggcgctggccgcggcgttctttcagccgttggcgccgcgcacggatgcggtcatggcccggttcgataccgaagagctgcaggtggtggagcgtttcgtgcgggggatggtggaggcgctgctcgcctaccgggacgagctccgcgcggaataa

SEQ ID NO: 526 - DNA, 1956 bp, Actinoplanes utahensis
atgagacgggcatgggtttccctgctcctggccctgctgctgggcggcctggtcatcggcctcgccggtgaaacccgggtcgacaacgaccccaccgcctcgctgccgtcctcggccgagtcgacccgggtcgcgcgggcgcaagcaggccgccccaccgcggccctggtggtggtcgccaggggcggccagccgctggccgacggcgacctggtcaccgtcaccccgctgggccagccgatcgtcagccaggaccgcagggcggcgatcgtctcggtgccgctgccgtccggcgtctcgtcggacgagaccatcaagcaggtccgcgatctgcgcaccagggtgcgggccggcctgccggccggggtgaccgcccaggtcaccggtggcgccgggttctccgccgacctggccgacagcttcaccggggcgaacacccggctgctgctggtcaccgtcgtcgtggtggcgctgctgctgctggtgacctatcgcagcccgctgctctggctggtcccgctgatcgtggtgggcctggccgaccgggtcaccaccggcctgatctcgctgatctcgcagcacaccagcctgccgatcaacggttccaccacgggcatcgtcacggtgctggtcttcggcgccggcaccgactacgcactgctgctgatctcgcggtaccgggaggagttgcacgccgtcgacgaccgcttcgaggcgatgcgccgggcgctgcgtggggccggtccggcgatcgcggccagtgccggcacggtgatcctgagcctgctcaccctgctgctggccagcctggagagcaacgtgtcactgggggtcacggcggccgccgggatcgcggtggcggcactgttcgcgctgctggtgctcccggccgcactggtggtctgcgggcgcggcctgttctggccgttcgtgccgcgggtcggccaggacggcgtcgaggcggagaagggtgtctgggcccgggtcggccgggcggtgtcccgcaagccggtcgcggtgacgatcgtctcgatcatcgtcctgggcgtactgtccgcgggcggtctcggcacccggctgggcctgtcgcagaccgagcagttccgggtgaagtcggagtcggtggccggcctggagaccctgtcgacacacttcccggccggcgcggccagcccgaccgtggtgctgaccggccccgatcaggcgcaggcggtgctggccacggtgtccggcacgcccggcgtggcgcaggcacgggtcgtggagcagggctccattcaggtgatcctgaacgcggcgccggacacgaaggaggcgttcgacgcgatccgcacgctgcggacgagtctggctggccgggccctggtgggtggcagcgtcgcgaccagtctggacacccgcgacgcgacccgacacgacctgcgggtgatcgtcccggtgatcctgctggtggtgctgctcgtgctggtcgtgctgctgcgcgcgctggtcgccccgctgctgctgatcgtcacggtgatcatcagtttcggcgcggcgctcggggccggatcgttcctgttcgggcacgccctggacaaccaggtgccgctgttctcgttcctgttcctggtggcgctcggcgtcgactacaacatcttcctggtcacccgggcccgggaggaggccggcaagcgtggcacccgggacggcatggtgcacgcggtcgcggtcaccggcgcggtgatcacgagtgccggcatcctgctggccgcggtcttcgcggtgctgggcgtgctgccggtgatcacactgacccagatcggcgtgatcgtcatgatcggcgtcctgctggacacgctcctggtccgcacggtgctggtgccggccctggccaccatcctcggtgaccggttctggtggccgggccggccgcacagcgccgcgccgaacgcgccggagttgatcagcgcttag

SEQ ID NO: 527 - DNA, 1173 bp, Actinoplanes utahensis
atgggttttctggataagctcccgggcatggacttccactggtttctgcccaccaacggcgacagccgggacatcgtgggtggcggtcacggcacaccggtcggctcggccggcggagtgcgcccgctgaccatcggctacctcggccagatcgcgcgcagcgccgaacagctcggcttcgtcggcgcgctcacccccaccggcgcgtggtgcgaggacgcctggctgaccaccgcgatgctcaccgaggtcaccgagcggctcaagttcctggtcgcgttccgccccgggctgatctcgcccaccctggccgcgcagatgtcgtcgaccttccagcggctctccggcggccggctgctgctcaacgtggtcaccggcggcgagtccgccgagcagcgccagttcggcgacttcctggacaaggacgcgcgctacgcgcggaccgcggaattcctcacggtggtccgcgggttgctgcgcggcgagaccatttcgtacgacggtacgcacgtcaaggtggagaacgcgcgcctcgcccgggtcccggacatcgcacccaccgtgtatttcggcgggtcgtcgaaagccgcgggcccggtcgcggccgaacacgccgacgtgtatctgacctggggcgagccgcccgcgcaggtggccgagaaactcgcctggatccggacgctgaagccggacatgcggttcggcatccggctgcacgtgatcacccgggacaccgccgaggccgcctgggccgaggccgaccggctgctgcagaacgtgtccgaggccgacatcgccggcgtgcaggccggcctgcgcaccagcgagtccgaggggcagcggcgaatgctcgaactgcacggcggcaaccgggacgggctgcttgtcgcgcccaacctgtgggccggcgtcggtctggtccgcggcggcgcgggcaccgcgctggtgggcagccacaccgaggtggccgaccggatcgaggagtatgccgcgctcggcatctccgagttcatcctcagcgggtacccgcacctggaagaggcgtactggttcggcgaaggtgtactgcccgagctccgccgccggggcctgtggcggcacccggcgggggagaaggacacggcgccggcggcgatcccgttcgccggggtgcccagcctcgctaagcgctga

SEQ ID NO: 528 - DNA, 237 bp, Actinoplanes utahensis
atggagcgcgccgcctcggggtaccagacagttcgacacgacttcaccacctggaggtatgagatggctttcgacgacaaggtggacaacaaggccgaggagctcggcggcaaggtcaaggagggcgtcggcaaggcgaccgacgacgagcagctcgaggccgagggtcacgccgaccaggccagcgcgaacatcaagcaggccggcgagaagatcaaggacgtcttcaagtcctga

SEQ ID NO: 529 - DNA, 1086 bp, Actinoplanes utahensis
atgccgtccaggaaggcacctgcaagaactttcatcaacaaggccggcagcgtgccagaaaaaatcgcaaaaggtggcaaaccgacgtcgagtgacgtggccgcggcggccggcgtgtcacggtccgcggtgtcgttcgcgttcaacaatccgcagcggatctcgaccgccacccgggagcggatcctggcggtcgccgaggagctcggctacaccccgagcacgctgggccggatgctgcaggccggcaccaccaactcgatcggggtgctgctgccgcagcggctggcgcaggtcatggagaacccgtacttcgcgcgcttcctgatgggtgccggccaggtctgcgaccgcgagggttacaccctgctgctcaccccgccgctgcaggactcggtgctcaaggccatcccgtacgccgcggtggacggcttcatcgtctgcggcctggagatcgaccggggcgaggtggccgagctggaccggcgcgggatcccgttcgtgctgatcgactcggaccggcacgagggtgccccgcacgtcgaggtcgacgatcgcggcggcgcccgcgaggtcgcccgccacctgctggaactcggccatcggcggatcgcggtgctctccctgggaccgcggtcggcggacgggcaccggggaccgctcgcgcgccggctggccgggatcaccgatgcgctcgccgaggtcgggctcaccctcgccgacgtgcagctggccgaggtgccggtgacccgcggcgacggataccgggcgacgaaggcgctgatgtccgacgcgaaaccgaccgcgatcctggccctttccgacgtcctggcctacggcgccgtggatgcgctgcaggagctcggcgtcgacgtccccggccaggtgtcggtgaccggtttcgacgacctggccgagtccgcctggttccgaccccggctgaccaccgtgcgccagccgatcgtgaccaagggccggatggccgccgagttcctcgtgtcggccatgcggggcgaggatcagcacccgcagcagacgctcgggacctccctgatcgtgcgaaattccaccgcaaaacccgcataa

SEQ ID NO: 530 - DNA, 1749 bp, Actinoplanes utahensis
ttgcaagaacttgctgaaagaaagcagccgtcaggctatgtaacacgtgttagttgcctgctaccgttcctcgccatgaccgaccaactgatcgcaccgcccactgtcgaggcgccgccggcttcctggtggcgcaacgcggtcatctaccagatctatccccgcagcttcgccgactccaacggcgacggcatcggcgacctgccgggcatcagcagccgcctgccgtacctgaaggatctgggcgtcgacgcggtctggctctccccgttctacgcgtcgccgcaggccgacgccggctacgacgtctccgactaccgcaccgtcgacccgatcttcggcaccgtcgcggacgcctccgagctgatcgccggcgcgcacgcgctgggcctgcgggtgatcgtcgacctggtcccgaaccactcctccgaccagcacgagtggttccagaaggcgatcgccgagggccccggttcgctgttccgcgagcgctaccacttccgccccggcaagggcgagaacggtgagctgccgcccaacgactggccgagcatcttcggcgggccggcctggacccgggtcgccgacggcgagtggtacctgcacctgttcgccccggagcagcccgacttcaactgggagcacccggcggtccgcgacgagttcaagaccatcctgcggttctggctcgacctcggcgtcgacggtttccgcatcgacgtggcgcacggcctggtcaaggaggccggcctgccggacgtcggctcgcacgccgaatggcacctgctgggcgtcggcgagagcccgtgcttcgaccgcgacggagtgcacgagatctaccgctcgtggcggcggatcctcgacgagtacccgggcgaccgggtcgcggtcgccgaggcgtgggcgccgaccctggcccgggtggccgactacgtccgcgacgacgagctgcaccaggcgttcaacttcagctacctgggcaccgcgtggaacgtgcacgagcagcagcagatgatcgaggactcgctggccgcgatgcgcgccgtcggcgccccgaccacctggacgctgtccaaccacgacgtggtccggcacaccacccggctgatgcagaccgcggacggcgaggtggccggccgcaaagcggtcgccgtcgacgaggcggccggcctgcgccgggcccgggcggccagcgcgctgatgctggccctgcccggctcggcctacctctaccagggtgaggagctcggcctgcccgaggtgctcgacctgccgccggaggtccgccaggacccggccttccaccgggcgaccgggcaggacggctaccgcgacggctgccgggtgccgatcccgtggagcggcgacaccgcgccgtacggcttcgggccggacggcggcggcagctggctcccgcagcccgcctcgtgggccgggctcagcgtctccgcgcaggccgggacgcccggctcgaccctggagctgtaccgtgccgcgctcgccgagcggcgggtcaacccggcgctgcagccgatcgacaacctgcgctggctcagcgcgccggccggggtgctcgccttcgagcggtccgtcgagggcgccccggtgttccgctgcacggtcaacatgggcgaccagccggtgaccgtcgcccgccccggcacgccgctgctggccagcggcccgatcgagctcggcccggacgaggtcgagctgccgccggacaccaccgtgtggtggtccgtctaa

SEQ ID NO: 531 - DNA, 2394 bp, Actinoplanes utahensis
gtgccggacatgcgaccagtgggacgaccggcccgcacggccgggcgcattctgctcctggcctgtgtctgggccgggctgagcatcgtgctcgggatcgccggcatgctcagcgaccacccgccggcctggctgctctggcccaccgggatcgcggcggccgccaccgcggcgtgggctgcccacaccgcggcggccggcaccgagggcgacgcgcaccggttctggcggcggctgaccatctcggcctgcgtgctgaccctcggcaccgtcagccacgccatccggaccaccctggccgggcatcccatgccgatgaacaccctgagcgcggtgtgctatctcggctcggtggccggaaccgcgtacgccatgatccgcctcccgcacccgccgcggacctggcgcgccaatctcgcgatctgcctcgacatcgccatcgtcggcgtcgcctcggccgtggtcatcacgcacttcctctggtcgatgccggtgcccggcggcccgccgacgggtggcccgatgccggccggcgacatgccgcccggcccgatgccgcagctcggcctggccgccggcctgatgctgatcgtcctggtcaccgcgatcaccgcggtggtcgcggtgatccgggtcgggatcaccggcgcgggcggcgtgcacgggccggccctgtggtacctcgccccgctcggcctgctcgccccgatctcctggctgatctacccggcggtccgcgactggccgcacctgtcggtcaccgcgatcgtgatgccgccgctcggactgatgttcgccctggccacccgcgcccagctccggcacgtcgaccaccccccggtccgccgggtcggcccgccctgggtgcagcgctggcgccgggtcagcgtggttccggtcgccgccgtcgtcgtcaccgtcggcatgctcgtcttcgtcaccctgcacctcggcttcctcccgcccggcctggccggcggctcggtggcgctgaccaccctggtggtgatccgccagctgaccgcgctgtccgacaacacggtgctggtcgaccggctggaggagcaggccaaccacgacgatctgaccggcctgccgaaccgccgcatgttcagtgcgaccctgcaggaccggaccgacccggtcaccgtggcggtctgcgacctggacggcttcggcaccctcaacgaccggctcggcgacgcccgcggcgacgccctgctgcgcgcggcggccgcccgcatcaccgcaaccttcgggccggacgcggtcgtcgcccgcctgctcggcgacgaattcggcatcctgctccccaccggcgcggtcctcccggccaccgggctgcccggctccggacccccggccccgctcgcctcgaccaccggcctgcccggctccggatcgctgggtgagcggctggtccgggcgttccggctgccgctgcaggtggacggccacgacctgctggtcacggtgaccgtcggggtggccgccggccgcgacgacgaggtccccgacctgctgcgccgggccgagctcgcgctcaaggccgccaagcgggccggtgccaaccggcacaccgagcacaccgacgagatggacagcaccgcccagcacgacgccgacctggccgccgcgctgcgccgcggtctggacaggggcgagttccgcctggtctaccagccgatcgtcgagctgcccggcggccggatcaccggcgtcgaggcgctggtccgctggcacccggcggacggcccgccggtctccccggccgagttcatcccggtcgccgaacagaccggcctgatcctcgacctcggcctctgggtgatcgagaccgcctgcgcggacgccgcccgctggcagctccggcacggcgtcgacgcgccccgggtcaacatcaacgtctcggcccgtcagctgctcgacccggacctgcccgaccaggtcgccgccacgatggcccgctaccacctggaccccgacaagatcaccctggagatcaccgaaaccgccgtgttcggcggcggcgccgccctgaacaccgtccgcgacctgcgcgacctgggcgtcggggtggccctcgacgacttcggcaccggccagagctcgctcaccctgctgcgcacctgcccggtcaccaccctcaaggtcgacaagtcgttcatcgacgaactcaacggcaccgccgaacaggaggcgatcgccacctcgctgagcacgatcgccgccacgctcggcctgcgcgcggtcgccgagggcgtcgaaacccgcgaacaggccatccgcctggaggcgctgggctaccgctacgcccagggctactacttcgccaagcccggacccgccgccctgatcgacgccgccctcgaccacaccccggccacgatctga

SEQ ID NO: 532 - DNA, 810 bp, Actinoplanes utahensis
gtgccctcggctgacatcggtctcgccgccggctccaccgccgctgtctccggcgccggggccgcggccgtgcggctcgacgcggtgacgcatgcctacggggacgtcaccgcggtcgggccggtcgacctgaccgtgccggccggtgagttcctggtgctggtcggggcgtccggctgcggcaagagcacgctgctgcggctcatcgccggcttcgagcagcccacctccggcacggtgcggaccgccgggtcgccaccggtgcccgggcgcggcgccggcctggtcttccagcagccccgcctgttcccgtggaagaccgtcggcggcaacatcgcgctcgccctgagatacgccgggcagccggccaccggcggccggatcgacgaactgctggaacgggtcggcctgcacgacgtcgccaaccggcgcacctggcagatctccggcggccagcagcagcgggtcgcgatcgcccgcgccctcgccgtcgacaacccgctgctgctgctcgacgagccgttcgcggcactcgacgcgctcacccgggaacgcctgcaggccgacctgcgcaaggtgagcgccgaatccgggcggacctgcgtgttcgtgacgcacagcgtggacgaggcggtcttcctgggcagccgggtcgtggtcctcaccccgcggcccgggcagatcgccctcgacctgccgatcgccctgccccgcaccggggtcgcggccgacgagctgcgcggctcgccggagttcgccgccctgcgcgccgaggtcggccacgccatccgcgaccgcgccaccgtctga

SEQ ID NO: 533 - DNA, 1032 bp, Actinoplanes utahensis
atgaagagactgctcgctgccgcctccgccctgtccctgctgctggtcgccgcctgcggcagcggcggcgccgccagcgggggcggcgacgcctccaagaaggccatccgcatcgcctaccaggcgttccccagcggcgacctgatcgtcaagaaccaggggctgctggagaaggcgctgcccgactacaagatcacctggacgaagttcgactccggggcgtcgatcaacacggcgttcgtcgccaagagcgtcgacatcgccgcgatcggctccagcccggtcgcccgcgggctgtccgcgccgctgaacatcccctaccaggtcgccttcgtgctcgacgtggccggcgacaacgaggcgctggtcgcccgcaacggcaccgggatcaccgacgtggccgggctgcgcggcaggaaggtcgccaccccgttcgcgtccacctcgcactacagcctgctcgccgcgctcgaccaggccggggtcaaggagtccgaggtgaccatcgtcgacctggagccgcaggacatccaggccgcgtggacccgcggcgatctggacgcggcgtacacctggctgccgtccctcgacgagatcaagaagaccggcaaggtgctgatcagcagtcgccagctggccaccgccggcaagccgacgctggacctgggcgtggtgtcgacgccgttcgccggagcccacccggaggcggtcgacgcctggcgcaaggtcgaggcgcaggcgctgaacaccatcgccaccgacccggccgcggcggccaaggcggtcggcgccgaactcaacctgtccgccgacgacgccgcgcaccagctgcagcagggcgtgtttctcaagccggcggacatctcgtcgccggactggctgggcaccgacggcaaggtgggcaagatcgcggacaacctggtgagcgcggccgagttcctcaagtcgcagcagaagatcgacgcggtgccgagcctcgacgcggcgcagaaggcgatctatgtgaagggtctgcccagtgccctcggctga

SEQ ID NO: 534 - DNA, 849 bp, Actinoplanes utahensis
gtgaccaccttgctcgctcctgccggcgccaccgcgccggtcgccaccacggcgctcgcgcccggtggcggactgcgccgccgcctcgttctccggctggtcgctctggtcgcgctgggcctgctgtgggagatcgcggcccgggtgctgaacaacccggccttcatcccgtcgcccggcgccgtctggcaccagctgatcctcacctccaccgtgcacgacggcgtccgtggatacagcggccacctgctcatcgaacacctcggcgtcagcctccggcggatcgtcatcggctcggccatcggcatcgccggcggcctgctgatcggcgtgctcctcggcacggtcggctggctgcgggtgatcgccgagccggtggtcaccttcgtccgggcgctgccgccgctcgcctacttcagcctgttcatcatctggttcggcatcgacgagaccccgaagctgtggctgctctcgatcgccgcgctgcccccggtcgcggtcgccaccgccgccgcggtgcacggcgcgccggccggactgatcgaggcggcccgcgcgctcggcgccggccgctggcagtcgatccgcgacgtggtgctgcccagcgcgctgccggagatcttcaccggcatccggctcgcggtcggcgtcgcatactcctcggtggtcgccgccgagacgatcaacggggtgcccgggatcggcggcatgatccgcgacgcgcagcgctactcgcagaccgacgtggtcgtgctcggacttttcgccatcggcctctccggcctgctcatcgacgccctgctgcgggtagccgaacaacggctgatcccgtggcggggcattagctaa

SEQ ID NO: 535 - DNA, 912 bp, Actinoplanes utahensis
gtgagcgtcctctccccaccgcgtccgaccgcacaggccggcgacgacacccgcgtggtgcccgctcggcacccctggcgctgggccggagccgccctggtgctggtcctgctcgcccagttcgtccacggtctggccaccaaccccggctgggagtggcacaccttcaccggctacatcttcgagaagtcggtgctgcacgccctgctggtcaccctcgagctgaccatcgcgggcgcggcactcggcttcctcggcggcatcccactggccgccatgcgcctgtcacccagcccgatcctgcgcaccgtcagctggacctacacctgggtgttccggtccgtgccgctgatcgtgcagctgctgttctgggccaacctgggctacctctacgagaaactgcagttcgggctgccgttcgggcccggctggtcgttcgccaccaaggacctgatcggttcgttcggcgccgccctgctcggcctggcgctgcacgaggcggcgttcgccggcgagatcatccgctccggcctgctcagcgtcgaccagggccagcacgaggcggctgcggcactcggcctgccccggcaccggcagttcttccggatcgtgctgccgcaggcgatgcgggccatcctgccgaacgccgccaacctgctggtcgacctgctcaagagcacgtcgatcgtgtacgtgctggccatcggcgagctgttctaccaggtgcaggtcgtctacggccgcaacgggcgggtggtgccgctgctgatggtcgccaccgtctggtacgtggtgctgaccgcgctgctgtcgatcctgcagttctacgtggagcgctatttcgcccgcggcgccgtgcggaccctgccgcccaccccgttccagcgactcaaggcggcgatcaagcgatga

SEQ ID NO: 536 - DNA, 768 bp, Actinoplanes utahensis
atgagcacccccgtggtcgagctcaccggcgtgcacaagtcgttcggcaccctcgaggtgctgcgcggcatcgacctgaccgcgcaggccggcacggtgaccgtgatcctcggcccgtccggctccggcaagtccaccctgctgcgcagcatcaaccacctcgagaaggtggaccgcggccgggtccgggtcgacggcgagctgatcggttaccgcgaggccggcgagaagctgcacgaactcggcgagcggcagatcctcaagcagcgcgcccggatcggcttcgtgttccagaacttcaacctgttcccacacctcacggccctggagaacgtggcggaggcgccgatctcggcgctgaagaagaacagggcgtcgacgtacgcgcaggcccgcgccctgctcgaccgggtgggcctggccgacaaggcggacgtctatccccggcagctctccggcggccagcagcagcgggtggcgatcgcccgcgcgctggccctggagccgcggctgatcctgttcgacgagccgacctcggcgctcgacccggaactggtcggcgaggtgctcgacgtgctgcgcgacctggccgcggcgggcaccacgatgatcgtggtgacccacgagatcggcttcgcccgggaggccgccgacaccgtcatcttcatcgacgagggccggatcgtcgaacagggcccgccggccgaggtcctcgacaacccccgccacgagcggaccaaagcattcctctcggcagttctcgtctaa

SEQ ID NO: 537 - DNA, 978 bp, Actinoplanes utahensis
atgcgtacaagagtcgccatcgtttttgccgcagtggcggcgctgggcctgaccgcctgcgccgcgccggacgagtccccggcggccgcggccgccgccccgggcgcgtcggccgggcccggcatcaacatcagccccgaccagaaccggatcgtcccggccaaggacgacgcgatcgcggcactcgtcccggcggacatccgggccaccggcaagctgacgatcggcgtgggcgcggccggttccggctcgccgccgctggcgttcaccgcgaccgacaacaagacgctgatcggcaacgagccggacatcgcctacgcggtcgccggtgtcctcggcctgcagccggagatcgagaacacctcctgggagaacctgttcatcggcctggacagcgccaagtacaacgtcggcatctccaacatcacggtcaccgaggagcgcaaggagaagtacgacttcgccacctaccgcctggacaacctggccttcgcggcgaagaagggcagcggctggaagatcgccggcccggccgacgtggccggcaagacgatcgcggtgagctccgggaccaaccaggagaagatcctggtcgagtggagcaaggaggccgagaagcagggcctcaagccggtcaacatcaagtactaccagaccaaccaggccacctacctggcgctgggctccgggcagatcgacgcctacctcggcccgaacccgagcgtcgcctaccaggtcgcggtcgatggcaaactggagatcgtgggcacctactcgggcgccggcgccaccctgcagggcaagatcgcactgaccaccaagaaggacgacggcctggtcaaggcgctcggcgcggcggtcaacaagctgatcgagaccggcgactacaccaggatcctgcagcgctggaacctgaccaacgaggcggtcgacaagtccgagatcaacccgcagggtctgcccaaggcgaacaagtga

SEQ ID NO: 538 - DNA, 699 bp, Actinoplanes utahensis
gtgacctccgcggtcaccgacgaccgggtgctggacaacccggcgtggctcgccctgcacggcgaccacgcccggttcgcccaggtccacggcctggcagcgcgctaccacagtgacgtggcaccgttccacgcgctgggcgcgccggaggacccgcgggcctggtccgacctgaacgccttcgtcccgcccggcgagccggtgatgctcgccgggctgggcgcccggcccggccccggctgggaaatcgaccgcagcatcgacggcgttcagctggtcgacgtgtcactgcgcgccgaaccggacccgaacctggtcgtgctcaccccggacgacgtgccggagatcctcgacctgatcgcccgcacccagcccggcccgtacctgcggcgcaccatcgaactcggcacctacctcggcttccgggacgagggccggctggtcgcgatggccggcgaacgcctgcggccaccgggctggacggagatcagcgcggtctgcacggacgccgcctaccgcggccgcggcctggccacccggctggtccgcgcggtggcggccggcatccgcgcccgcggcgccaccccgttcctgcacaccggggcggccaacacgaccgcgatccgcctctacgaggcgatcggtttccagctacgccgcacggtggacttcaccgcgtaccgccgagctggctcctga

SEQ ID NO: 539 - DNA, 846 bp, Actinoplanes utahensis
atgagcacgccgcgcccggcggacgacgccctgctgcagcggttccgggacgcccggaccgccgaggagcttctcaccgccctgaactggtaccgcaccgagcgcaaccgctcgcagcggcaggtggcggagaaggcggtgggaaccccgggactctccaagacccgggtgaacgatctgctgaccgggcgctactcgagcatcgacggccagctgctgcgcccgctggcgcaagcgtgcggcgtcgatcgggaggaactgctggaggcgctggacgaagcgtggcggcggatcgtccagaacgccgcacgggagcgcagccaccgggccaaccaacggccggcgccaccgccgcggccgagcccggacgcgcacctcaggacgctcagcgtgatggccgagatcgccggccggatgaccgacccggacacgctgccgctggcgcaggagatctacgagcgggtgctggagcagcgccgcctcctgctcggcgaggacgacccgctgaccctgaccacccagcacaacctcggcgtggtccacttcgcgcgggacaatctgcgggccgcgtacaacgcgttgaagatcgcctacgaggcgcggctggccaccctgggcgagtcggcgatggccaccctgacctctcaggagtcgctggcggtggtctgctccgagatgggcgagacgttccgggcggagcagctgctcgcggaatgtctcgcccaccgccaggagtggctggctcaggcgccgaccgaggccgagcgcgcccggctgcgggtggccgcgcagaagaccgcggacaacctgcgggcggtcaggagccagctcggcggtacgcggtga

SEQ ID NO: 540 - DNA, 222 bp, Actinoplanes utahensis
ttgggcgacacgtcgccgaggcacactgtgtggcgcaggagcgcccgttgcgggaccgggaactgtgtcgaggtcgcgaccgtcggggacaccgtgctgatccgggacagcaaggatccgtcggccggctcgatcacctgcaccgccggccagtgggccggtttcctctccgcgatccggtccggtgtcttcggtcccgcaggcgaccgtccactgtcctga

SEQ ID NO: 541 - DNA, 285 bp, Actinoplanes utahensis
gtgcgacctgctccttccctcgggcaagcgcctgttcgaccgagcgagccacccgccgaccccgcctccccgatccgcctcgcggtttacgccatctgcaccggggcgatcgctctcgggtcgggccgggcattcggatccacattcttcacgagcacctcggcgagagccgcggcgctcgccgtcatcgccttaccggtcagtgtcgccgccggcctcgcctgcgatccggtcctgcggcggtggcagcagttcatcgatggtcgtcgcggtcccgaggcctga

SEQ ID NO: 542 - DNA, 306 bp, Actinoplanes utahensis
gtgaccgagatcgaccgcgaactgcacatcgacccgcgcgcgccgcgcggccgccggcggggtggtggcctcgtgggggtgctgcatgccgccctggacctggcgaccggcatcgtgacgaaacccgagaacttcgtccgggcgctgctgctggtgtggtcgctggtgctgatcggcgccctgctgctgcgggacgtgcaaatgctcagcgtcgcggtggccgcgatggtggtgctgtcgacgtgggcggcggcccggctgatgcgggcccgggtcaggcctcgggaccgcgacgaccatcgatga

SEQ ID NO: 543 - DNA, 891 bp, Actinoplanes utahensis
atgggcgtaggggagcggcgagcggcggcactggaacggaaacgactgaccagacggctctaccggatccggctggagcgggggctcacccaggcgcaggtggccgagcggatgcgctggtcgcagtccaaggtgcatcggatcgagaccggcgagaacagcatctcgtacgccgatctcaaggtccttctcggcgtctacgaggtcgacgaccagctcgcggaggagttgacggcgatggccgacgcggcgcggcagcggagcctgccggagatgagtgacatccattcgaaggatttccgggattttctggagagcgagctcatcgccgatcgggagtacgagttcgagaactcgttcgtccccggcctgctgcagacccgggagtacgccgagaccgtggtgcgcaagctgctctacgccgactcctgtgccgagagcgagcgggaggccgtcctggagcaggtccgccggatcgtcagcctgcgggagatgcgccagcaggtcttcgccgaggggggcatctcgcaggcccggttcgtgctggacgaggcggtgctgcgccgggtggtcggcggcggcgcggtgatgcgccagcagcttgagcacctgcgcaagatgagccggcacccccgggtcgacctgcgggtgctgccgttctcgaccggcgcccacgtggcgatggccggccccttcgtgatcctggagttcccggatgccgaggaccgcccgttgctctacctggagaacgcggccggcgagttcctgaccaagcacgacgagcggctgctggcccgcttcgccgccaacttcgaggagctgcgggccgccgcgcacggagcggacaggttggacgcgctgctggacggcgcgcttgccgccctcggctga

SEQ ID NO: 544 - DNA, 1395 bp, Actinoplanes utahensis
gtggaagcgggcgagggcggccggcaggtcgtagttgccgagcaccgaggtggcgccgacggtgacccggccggtgaccaccgtggtgatctcgcccatctcgaggcgggcgccgtccaactcggcgaggatgcggcgggcccgggcgacgaacatctcgccggccggagtgagcgcgacccgccgggtggtacgggcgaacagggtcacgccgagctcggcctccagggcccggatctgtgcggagaccgccgactgggcgacgtgcagacgttccgccgcccgggtgaacccgccgtaccgggccaccgcctccacgtagctgagttgtcgaagctccacccgttcatcgtggcgcacgatgaatgccatcgggaacgtgtcttggacatatcaatcgtcggataccagtctggggtcatgcccaccgcgaagctcggcaccctgacctgctcggcgatcggcctcggctgcatggggttctcccaggcgtacgggccggccgacgacgattcctcgatcctcaccatacgggcggcgctggagcacggggtgaccttgctggacaccgcgatgagttacggcgccgggcacaacgagcggctggtcggccgggccgtcgccggccgccgcgaccgggtgctgctggccaccaagttcggcatcgtccgcggcgacgacggcgtgcgcctcgacgcccacccggaccgggtcgccggctactgcgaagcgtcgctgcgccggctcggcaccgacgtgatcgacctgtactacctgcaccgcgccgacccgcgggtgccgatcgcggacacggtcggcgcgatggctgagctggtcgccgccggcaaggtgcgccacctgggcctgtccgaggtgggtccggagcggttcgccgcggcccgcgcggtgcacccgatcgcggcggtgcagacggagtggtccctggcctggcgcgagccggaggacgacatcgtcccggcggcccgcgcgggcggcgccggcctggtcgcctacagcccgctcggccgcggcctgctcaccggcgcgctgccggccggcccgttcgcccccggcgacttccgggccggcgacccgcgcttcgccggccccgagctcaagggcaaccgcacgctggtcgaggctctccgggaggtggcccggtcgtacgacgtgacggtcggccagctcgccctcgcctggctgcacgcccagggtgacgacgtggtcccgatccccggcacccgcgatccggcccgggtcgccgagaacgcggccgccgcccggctcaccctcacgcccgccgacctggccaccctggagtcggtcgccccgcgcaccgcctggcggggcgaccgccgctcgttcgccgcgcacggcaccacccgcacccggtag

SEQ ID NO: 545 - DNA, 975 bp, Actinoplanes utahensis
atggtgacgacctatccgtatacggctagtgaggagggcgccgtgtggtacggcatctggcccggagtggtcgcggctgacctggtggacctgacgccgctggcgacaccgccggaggacgtggcgcgcacgagcgtcgccctcgaccggctgcagggtggcgcggcgtcgttctacatccgctgctatcggcactaccggggcgcggccgcctcggaaccgggcggggacccggcgccggccgaccccgggcggtacaccgggcgcgggcggctgatcgacctggtggcctgctatcgcgccaccgcgcccgacccggcgggctacgcggagttcgtccgccgggcggttcgcgacgtcgccgggtggggtggcggaaaggtgcaggtgggcgaggagctcaatgtgcccgctccgctggacggtggctttcccggttgcttcgaggcggtcgccgccggcgtggccgccgggctcgacgaacgcgatcgtctcggcgcggccgtggcgatcggcgtgaacggcgccggcgtcgccgacccggcgttctgggccaggatgaccggcgccctggggccggtctcgaccgctcggctcgacttcgtcggcctggacatgttccccgacgtcttccgtccgatcccggaggacgacatcggggccggcgtgcggttcctcgtccggactctgcgccgggtcacccgcgacgccgggatctccgggcgcacaccgctgcacgtgaccgagaccggctggcccaccggccgtgcccgggacgaggcgaagcaggcgcgcgtgctgcgggccgtcgccgaggcggtgctcgcgaccggtgaggtcagcgtgtacgaactgttctcgctccgggacgggatcagcgacggcggctggcagaacgggttcgggctgctgcgcgacgactatcgtccgaaaccggcctacgacgtggtacggcggctcatcgccacctcgtga

SEQ ID NO: 546 - DNA, 564 bp, Actinoplanes utahensis
gtggaccgggtgccgaccaacgcgctcgcgaacccgctcgtgctgcccatcctcgggctgctggccgagcgcccccggcacgcctacgccctgttcagcgagctgcggtcgcgctacacctatctcggcgtccggaactcgaccgtctacacgctgctgaacacgctcgtcgacgccggctggctgcgcccgacgccggtcgggaccgatcggcaggagttccggctgacccccgcggggcggcaggccctggccgagcgggtggagcgggagatccgggacggcgccctcggcgaccgcaccgccttcctgaccgcgctggcctacctcgggatcctgaccccggatgcggcggctgcgaccctggagatccgggccggccgcgtccaccatgaacaggaacggctcgcgcacgctctcgacgcggccacgggtgtcccggaactgcacatgatcgagatccacttctaccgcgaccagcttcagcgggagcacgcctggctggacgcgaccgcccggcgcacccgctccggggccctcgcgtggccgggtcaggaaagctga

SEQ ID NO: 547 - DNA, 873 bp, Actinoplanes utahensis
gtgtccgtgagcgaaacacgttggtggcagtcgggccgccgtgccggttggtgggcgcacctggtccgggccgggaagcggtacgacgaggcggacgggggccggctcgccgcggcggtcacctactactccttcttcgccaccttctcgctcggactgctcggcttcgcgatcttcggtttcgtgctcgacgaccaggcggtactgcacgcggcgcagcgatacgccgcacagaacctgccccacgtcgacgtgcagtcgtttcgcgacgcccgcaacaccgtcggcgtcatcgccttcatcggccttccggtctccggctggttctgggtggacgtgctgcgctcgtcgatccgccggatgtggcggttgccggagtacccggggcggctcgtcgtccgcatcctcgtcgacatgctggtgctggccggcctgggggtgctgctgagcgggtcgctcgcgatcgcctacgagacgtcggtgatcgtgaaccgggtgatcgtcgccgccggcgccggcaccacgccgtcgcgggtggtggtgtcggccgtcgggctgctctccggcctgacggtgaacgccctgctggccaccgccctgctgaccgggctgccccggatccggatgccgtggcgtcgcgtgctcggcccggccgtgctggtggcggccggattcgaattcctcaccacgctaggccgcgtctacgtcgagcgcacccagacgaatcccacctaccacctggtcgccggatcggtcggcctgctggtcttcctcaacgcggtcaatcagctggtcctgttcgccgcggcgctgaccgccaccagcgagaccggccacgccggcgatctggccgccgagcctcagctttcctga

SEQ ID NO: 548 - DNA, 417 bp, Actinoplanes utahensis
gtggtagttacccgcaagggcgactactatcctttggtaaccaaggaggccaggctgatgaccgcggtgtgcccgaccggcgagcacgacaagcacgacgtcttcgccgagctctgcccctgccgggggctgctcgacctgatcgccaacaagtggacgaccctggcggtcggcgcgctcgagggcggcccgctgcgcttcggtgtgctgcagcggcacctggaggggatcagccccaaggtcctcacccagacgctgcgccggatggaggatgccggcctgctcacccgcaccgtctatcccgcggtcccgctgcacgtcgaatatgagctgaccgcggtcggccgcagcctggtcaccccgctgcgcggcctgcgcgactgggccgagcggtacctgcacgagctgcagctctag

SEQ ID NO: 549 - DNA, 942 bp, Actinoplanes utahensis
atgcgcgtcgtcacgcagcacgagttcggggatccgtcggtcctgcacctggccgaggcgccgaagccccgtccgctgcccaccgaggtgctggtccgggtggtcgcggccggggtcaatccggtcgaccacaagacccgggagggcgccggcatggccggcgtgctcggcgcgccaccgttcatcctgggctgggacgtctccggggtggtcgaggagaccggcttcggcgtgcacaccctgcggcccggtgacgaggtgtacggcatgccgtggttcccgcggcaggccggcgcgtacgccgagtacgtgaccgccccgtcgcgccagttcgcccgcaagcccgcgaacctgtcgcacgtcgaggcggccggggtgccgctggccgcgctcaccgcgtggcaggcgctgaccgacgcgaccacggtcaccgccggtcagcgggtgctgatccacgcggcggccggtggggtcggccacttcgccgtgcagttcgcccggcatctcggggcgcacgtcatcggcaccgcccgcgcggcgcgccacgactggctgcgcgagctgggcgccgacgaggtgatcgactacacgaccacccggttcgaggacgccgtcaaggaggccgacctggtgctggacctggtcggcgacgaggacaccgggctgcgttcggtgaccgcgctggcaccgggcgggctgctgatcgcggtgccgggcggcgtggcgccggccgtcgcgcgggccgccgccgagcagggcaagcgcgccgtgccgttcctggtggagccggacggcgcggcgctgggcgcgatcgccgggctgatcgaggccggccacgtgcgggtggaggtggccggggtactgccgctggccgaggcgggagaggcacaccgccgcctggccaccggccgcacccgcggcaagctcgtcctggaggtctag

SEQ ID NO: 550 - DNA, 1116 bp, Actinoplanes utahensis
atgcccgtacccctgtcaatcctggacctggccccgctggtctccggcggcgacgtcggcgacgccctgcgccgcaccctggacctggcgcgcagcgccgaacagttcggctaccaccggtactgggtcgccgaacaccacttcaccccgggcgtcgcctccgcacagccggccctgctgctcggtcagatcgccgcggtcacctcccggatccggctcggctccggcgcggtgcagaccggccaccagaccgcactgtccatcgtggagcagttcgggctgctggacgcgctctacccgggtcggttcgacctgggcctgggccgctccgggcaggccaagaaggaagccctcgccggctctgcggaagagaccgctgaggaggtgaccgtcgtcgacgggctgctgatcccgaagccgttctcctgggcgccgatcttcgcctccgaacgcagcgccctgatcggccggctcctgcagcagcccggcgccgagccgctcggcctcggcgagatcctcgaccagatcaccggcctgctcgccggcccgtacggcgacggtaaaggcgccgaggtcaccgcggtgcccggcgccggcgccgacgtccagctgtggctgctgggcagcagcggcggcgagagcgcccgcacggccggcgcccggggcctgcctttcgtcgccaattaccacgtggccccggccaaggtgctggaggcggcggcggcctaccgggcggcgttccgcccgtcggccgccctggccgagccgtacctggtggtctccgccgacgtggtcgtcgccgaggacgacgagaccgcccgccggctggccgcgccgtacccgctgtgggtccgcagcatccgcaccggcgccggggcgatcccgttccccagcccggcggaggcggccgcgttcgagtggaccgaccacgaccgcaagctggtcgaggaccgggtcgccacccagttcgtcggctcgccggccaccgtcgccggcaggctggacacgctgcgccgggtgaccggcgccgacgaactgctggtgaccacgatcacccacgaccacgcggaccgggtccgctccttcgaactgctggccaaggagtgggccggctag

SEQ ID NO: 551 - DNA, 1014 bp, Actinoplanes utahensis
gtgaagttcctgctgctcagcctgatcacgcacttcgaccgggagaagagcccggcgcagcggctgcgcgaggtggtcgacgcggccgtgctcggcgaacagctcggctatgacggcttcgccgtcggggagcggcacgagcggcccttcctgtcctcgtcgccgccggtcgtgctcagtcacatcgccgcgaagacctcgacgatcgagctgtggaccggggtgaccacgctcagcctgctcgacccggtgcgcgccttcgaggactacagcaccctggacaacctgtccggcgggcgcctgcagctgatcgtcggcaagggcaacggcgccgcgcaggcccagctgttccacgtcaccgtcgacgaccagtgggagcgccagcgggagagctacgaactgttccgccggctctggcgcgaaccgaaagtgacctgggagggtaggttccggccctcgctcaccgatgcggagacctggccgcgcccgctgcagcagccgatcaccgtgtggcacggcagcgccaccagcagggcctcggtcgagctggcggcgcggtacggggatccgctgttctccgccaatgtcaccaatcccgtcgacccgtacgcccaattgattgatttctatcgggagaggtgggccttccacggccatgacccggcgaagatccggatcggggcgggcagcgccggcttctacgtcacccgcacctcgcaggaggcgctcgacgtgtaccggccgatctggcaggcccggatcgaccagttccgcaaggtcggcgtcgagccggtcttccccaccatcgaggacgcgatcgagcgcagctcggcgctgatcggcagcccccagcagatcatcgacaaggtgcaccgctaccacgaacggttcggccacgaggtgacccacctggccgccgacaccgaaggtctgaccgagaaacaacagcgcgccagcctggaactgttcgccagtgaggtcgcgcccgtgctgcgccagctgaaagggtggtaa

SEQ ID NO: 552 - DNA, 1269 bp, Actinoplanes utahensis
gtgcctaagcagatcatcctcgccgcccacttcccgggcgtgaacaacaccaccgtctggagcgacccccgctccggcagccagatcgacttcgcctcgttcgaacacctggcccgcaccgccgagcgcggcaggttcgacttcttcttcctcgccgaggggctgcggctgcgcgagcagcgcgggctgatccacgacctggacgtggtcggccgcccggacacgctgaccgtgctcaccgccctggccgcggtcaccgagcacctcggcctggccggcacgctcaacgccaccttccacgagccctacgaactggcccggcaactggccaccctggaccacctgtccggcggccgggccgcgtggaacgtggtcacctcgcacggcgccttctacggcgagaacttccggcgcggcggcttcctcgaccacgccgaccggtacgtgcgggccggcgaattcatcgaagcggcccgcaccctgtgggactccgacggcggcgacttcgccatccacagctcgcagttcggcatcgagggccgcttcggggtgccgcgcagcccgcagggtcacccggtgatcctgcaggccggcgactccgacgagggccgcgagctggccgcccggcacgccgacgcgatcttctcccggcaccacaagctcgacgacgcgcggcagttctaccgcgacgtcaaggaccggctgggccgatacggccgggaacgggactcactgaagatcatcccgggcgtctcctacgtgctgggcgacaccgacgccgacgcccaggagaaggcccaccacatccggcgccagcaggtcagcccacagaccgcgatcctgttgctggaacaactgtggaaccgggacctgtcggcgtacgacccggaggggccgctacccaccgccgacccggtcctcgacgaggacgactcgatcgtcaagggccgggccgggatgttccccgaccggatcaagaccgccaacgagtggcgggcgctggccgaggcgaagaagctgtcgatccgcgacctggtgatcgaggtgaccggccggcagaacttcatcggcaccgccgaccggatcgccaccgaactcaacgagtacgtgcagaccgaggcctgcgacggcttcatcctggtctcccacctgaccccgggcgggctcgacgacttcgtcgaccaggtggtcccgctgctgcaggaacgcggcgtgttccgcaccgagtacgagaccaccacgctgcgcgggcacctggggctggcgtga

SEQ ID NO: 553 - DNA, 930 bp, Actinoplanes utahensis
gtgaccctgcacgttgccgtcgggctcgacggcgattcgttcgccgcatcggattgggtggccgcggcgcggcaggccgacgaggcgcgcctcgacttcgccaccttcgaggaccggttcggccggcgcggcccggacgcggtcctggtcgccgcccgggtcgcgccggtcacccggcacctgggcctggtcccggtcgccaccaccacgcacaccgagccgttccacctgtccaccgcgctggccacgctcgatcacgtgagccgggggcgggccggctggcaggtgcgggtctcgtccgacccggccgaggcggccctgctcggccgccgtgcgccgctcggcttcgacgacctgttcgccgaggcggccgacgcgatcaccgtggtccgccggctctgggacagctgggaggacgacgcgatcatcaaggacgtcgccaccggccggttcatcgatcgggagaaactgcactacctcgacttcaccggcgcgtacttctcggtcaagggcccgtcgatcgtgccgcgcccgccgcagggccagccggtgatcgccgcgctcacccacaccgcccaggtcgcggagcgcctcgacgtcgacgtctacttcgtgaccccgcagaccctcgacgaggccgccgggatcgtcacccggctgcccggcaagctggtcttcgccgacctggaggtcaccgccgacgccggcccggccgaactggccggccggatcgcggcgtgggaaccggccgggatcgccggggtccggctgctgccggccaccccggacgcgctcacccggatcacccgcgacctggtccccgaactccgcgaccggggcatcttcaccccctcgaccgccaccacgctgcgcgaacgcctcgggctgccgcaggccgtcaaccacttccaggaggccgcccgtgcctaa

SEQ ID NO: 554 - DNA, 1533 bp, Actinoplanes utahensis
atgatcaacgttgaggatctgacggtcaccttccacctgccgcggcgcaccgtcgaggcggtgcgtggggtgagcttcgacatcgaggccggcgagtgcgtggcgatcgtcggtgaatccggctcgggcaagagcgtgaccgcccgcagcctgctcggactggccggtccgggcgcccgggtgcaggccgcccggctggaggtggacggccgggacgcccgccgcttcgcgccgcgcgactggcgccggctgcgcggcggcttcgccgggctggtgctgcaggacgcgctggtctcgctcgatccgctgcgcacggtgggtgcggagatcgccgaggtgctgcgcgtccacgggcagggttcgcgagcgggacggacgtcgcaggcccaccggctgttgcgcgacgtgcacgtgcccgagcccgagcggcgggccacgcagtatccgcaccagctctccggcggtctgcggcagcgcgcgctgatcgccaccgccctggccggtggtccgaaactgctcatcgccgacgagcccaccaccgcgctcgacgccaccgtgcaggcgcagatcctgaccctgctggccgaacgccgggcggccggcgagaccctgctgctgatcagtcacgacctggccgtggtgtcccggctcgccgaccgggtgctggtgatgaaggacggccggatcgtcgagagcggtccgacgaggcggctgctgaccggcgccgatcacgcgtacaccaggcagttgatcgccgccgccagcggccggaagcggaccgcggacaccgcgccgggaccggtggtggccgaggcgagggcgctgcgcaaggtgtacggcgaccgggcggtggtccgcgacgtggacgtcacgatcgcccgcggcgagatcgtcggcctggtcggcgagtccggctccggcaagaccaccgtggcccagctgctgttcgggctcgtcgaacccacctccggccaggtccgcttcgagggcagccggttcagtggggtgcccgagcgggcccgtcgcccgctgcgccggcgcctgcagttcatcgcccaggacccgctgtcggccttcgacccgcgctggacggtgcgccggatcgtcgccgaggcgctgccccgcggcgccgacgtggtgccggtcctggagcgcgtcgggctcggcgcggacgtgctggaccgctatccgcggcagctctccggcggtcagcggcagcgcgtcgcgatcgcccgggccatcgccccgcgaccgagcctgatcatctgcgacgagcccgtctcggcgctcgacgtgtcggtgcaggcgcaggtcctcgatctgctcgccgacatccgggagaccgacgggaccgccctgctgttcatctcgcacgacctcggggtgatccgcgacctggccgaccgggtgctcgtcatgcgggacggccgggtcgtcgagcagggacccgtgaagaccgttttcgaccagcccaccgacgactacacccggcagcttctcgccgccgtgcccactctggaggttctcccgtga

SEQ ID NO: 555 - DNA, 855 bp, Actinoplanes utahensis
atgaccgtcgcgctgacccggccccgggcggtccggccggccggcctgcgggcgccccggccgggggtcgccctggccgtggtgttcctgctgctggccctgaccgccgcggtggccccggccctgttcgccggcgacccgctggccgccgacccgctgcacactctgcaggcgccgtccggccggcactggttcggcaccgatcagctgggccgcgacgtgttcgcccgggtggtgcacggcgcccggcactcgctgtcgatcggggtgaccgccaccctgatcgcggtcggcgccggcatcctgctcggtctgctcgccgggctcagccaccgggtcgccgacgaggcgctgagccgctccttcgacgcgctgtcggcgtttccgctggtgctgctcgcgctgctgttcatcacgatcgccgggaccggcacggccagcctgatcgtggcgatcggggtgtcgctgatcccgcacttcgcccgggtggtgcgggcgcagacgttcgtggtgcgtcgcgccgcctacgtcacccacgcggtcgccttcggcgcctcccggccccggctggtgatccggcacgtgctgcccaacgtgctgggtccgatcccggtgctggcggtgatcggcctcggcgagacggtgctgctggcggccgggctgagctttctcggcatgggaccacagccgccctccccggaatggggcgcgatgatctccgacggccgcggctacctgcacatcgcctggtgggcgtcgatcctgccgggcctggtcgtcaccgccacgatcgtctcgctcaccgtcgtcggccgcttcctgcagcggcgtttcgaaggccgggagacggcatga

SEQ ID NO: 556 - DNA, 915 bp, Actinoplanes utahensis
gtgatcatcggcattctgcgccgggtggcggcgggcgcgctggtcctctgggccgccgcgaccgccgcctacctggcgctgctcctggcgccgggcagcgcggtcgacgcgatcatcggcgacggcgccgacactccggcgatccgcgcgcagatcatccaggagtggcacctggacagcccggccgtggtgcagtacctggatttcctggggcgcctgctgcacggtgacctgggccgctcctacctgctgcagcggccggtcgccgacgtgatcggcagcgagctcgggccgaccctgcaactggccgccgccgcggccggcttcgggatcaccctcgcgctggtcctggccctggtcgcccggcgtccgtgggtgcgtcggctcagctcgaccaccgagctggtgctggtctccaccccgccgttcctgatcgggatcgtgctgctcagcgtcttctcgttccggctcggctggttcccggtctccggggcgcgcgacgccgccgccctggtgctgccggcgatcaccatggggctgccgatcgccggcaccctggcccaggtgctgcgcgacggcctggaccgggccctcgacgagccgttcgcggtcaccgcccgggcccgcggcctgcgggagagcgcggtcctggtgcggcacgcgctcaagcacgcgctgctgcccgccatcaccatgctcagctggtcgttcggcgtgctgatcgcgggcaccgtgatcatcgagacggtcttcggccggccgggcatcggccagatcaccgtgaacgcggtcaactccagcgacctgcccgtggtgctcgccgtggtgatcctgtccgcggcggtgttcgtcgccatcaacacgctgaccgacctggcgtacctgctcatcgatccccggctgcgaaggagctga

SEQ ID NO: 557 - DNA, 1626 bp, Actinoplanes utahensis
atgcgccgcatgaccatcgcgaccgtcaccaccctgctgttgctcgccggttgttcctcgggtacctcgggcagcaccgccgacgccgggaagccggtcagcggcggtgcgctgacctgggccgtcgagaccgagccgatcaccttcaacccccaccagtacgcccaggccaaggctcgcctgctggtctggaacagtttcgaggccctgctcacccacgacgacaagggcggctacctgccctggctggccaccggctacgaggtgtcgccggacggcaggacgtacaccttcaagctgcgcaccgatgccagcttctcggacggcaccaagttcgacgccgccgcggtgaaggccaacatcgatcaactgctgaccccggggtacgcgccgggcgtcgccgccgtgcagctacgcaacctggacaaggtcgaggtcaaggacccggccacggtcgtcttccagctcaagcgtccggacgtgctgatcctggacttcgtctcgtcgccgcagggcgcccagatctccccgcagtcgctgaaagcggccaagaacctcaaggccggcggccccgagctggccggcaccggcccgttcgtcctggatcgctacacgcccggccaggaggtgcacttcacgaagaacccgaactacaactgggcgccggccaacgccgggcacaccggaccggcgtacctcaacgagatcacctaccggttcctgaaggaatcctcggtccgggtaggcgcgctcacctcgggccaggcccaggtgatcgaaggggtgccggccaccgacgagtcgctgatcaaggcgaacccggacctcaggttgcagcgcgggctgaactcgggctcggcgtacgcgtactacttcaacaccgcgcacgcgccgttcgacgacgtcagggtgcgccaggcgttccgggaggcgctcgacgtgcccgcggtgctgggcggggtgtaccggaacaccgcgacccgggcgtggagcgtgatcggaccgaccagtcccttctacgacaggtccctcgaaggcgcctacggcggcgatgccgccaaggccaaccagctgctggaccaggcgggctggtcggccagggacgccgagggctaccgggtcaaggacggaaagcgattgacggtacgcatcgtgcagtccgccccgttcgtccgggaccgccgtgacgtcctcgcccaggccgtgcaggccgcggtcaagcagagcgccggcatcgacctgcaggtgcagctggtcgaccagggcaccgccaccaaggcgctggccgacggcgcctacgaggtgttcgacaactcccgggccgacaccgacgccggcgcggcgctcaacctgctgctctactccaccggcgcgatcaaccggaccggcttcaagagcccggagctggacaggctgctcgacgacggcatcgccaccaccgatccggccaagcgggcgcaggcgtaccgggccctgcagaagctggtgatcaccgaccaggcgctggtgttgccgctctacgcgccgcaggaccagatcgcgaccgcgggcaccgtgggcggggcgcacttcgagccgaccgcgggcgttccgggcagcgcgtacaacctctggctccgcaagtga

SEQ ID NO: 558 - DNA, 1764 bp, Actinoplanes utahensis
ttgaaccatcctcggcggcaggccgtttcctcagacgtgcaatcgaatgacctcgccgacgaacagcccccggccgcgcccgaagcctcgcgcctgcggcggctcctgcgccggtccgccggcctgcggcagttcctgcgccggccggcgatcagccacggcgtcaccgtcctggcctgcctgatcgtcttcgtggagctgctcttcccgaacatcctcaaccggctcaacccgggcagcttcctgcgcatcccgatcgaggccgcgatcggcatcgccgtgctggtcgtgctgcccgggcgcccccggcggatcgccgccgtactggccggcgccggcctcggctgggtggtcatcgagaaatgcctggacatcggcttcttccaggtgctcaaccggccgttcgacccggtcctcgactgggtgctcttcgacgacgcgtacgacttcgtggtctccacctacggcaccggcggcgcgatcggcgccgtggccgccctgatcgcgctgatcgccgtgatcctcggcggcaccacctgggcggtgttgcggatcacccggctgctcggccaggaccggcgcaaatcggctttcaccgccggcttcatcgccgtcgcctggggcctggccgtcgccttcggcatccccaccctgctgcccggcgtgccggtcgccgcccgcaccacggtgatgtacgcctgggaccgcgccgggcaggcccgcgccggcatccgcaacgaggccgcgttcagccgcgaggtgcaggtcgacgcgttcaagaacgtcccgtccgaccagttgctcaccggcctggccggcaaggacgtgatgctcaccttcgtggagagctacggccgcaacgcggtcgaggtgcccccgctctccgacggcgtcgacccggtcctcgacaccgccaccgccaagctcaaggcggccggcttcacctcgcgcagcggctggctgacctcacccaccttcggcggcggcagctggctggcccactccaccaccatgtccgggctgtggatcgacaaccagcgccggtaccggaacctgaccgccagcaaccggatcaccctgccgaacctgttccggcaggccggctgggacaccgtcagcgtcatgccgggcgccacccgggcctggccggaaggcaacttctacggcttcaaccggatctgggactcccgcaacctcggctacaacgggccccggttcagctgggccccgatgcccgaccagtacaccctgaagaagttcaacgaggtggagtacgccaagccgggacgccagccgctgttcgtcgagatgccgctggtctccagccacaccccgtgggcaccgatcccgtccttcgtcgactgggaccaggtcggcgacggctcgatctacaacgcgatcgtggccaaccagccgagcaaggcggaaatctggaaggcctccgacacggtgcgccaggaatacggcaagtcgatccagtacacggtcaccacgctgaccgactgggtggccaagtacggcaaggacaacctggtgatgatctacctgggcgaccaccagccgtccccggtggtgaccggcgacaacgccagccacgacgtgccgatcacgatcatcgccaaggaccccgccgtcatcgaccggatcgccggctggggatggaccgacggggtgaagccggccgcgaacgcgccggtgtggccgatgaacgccttccgcgacaagttcctcaccgcgatgggtcccggcggcgccagccactga

SEQ ID NO: 559 - DNA, 1899 bp, Actinoplanes utahensis
atgcggccggatgcggagcagcgtcagatcatggctgactaccggcagacgtacgagcgcagcatcaccgaccccgaggcgttctggcgcgccgccgccgccggcatcacctggtccgtcgcgcccacccggatcctggacgacagtgaggcgccgatcttccgctggtttcccgacgccgagctgaacacctgccacaacgccctggatcggcacgtcgaggccggtcacggggaccgcaccgcgctgatctacgacagtccggtcaccggcaccgtccgcacctacagctatgccgggctgcgtgccgaggtcgccctgttcgccggggcgctgcgccggctgggggtggagcgcggcgaccgggtggtgatctacatggcgacggttccggagacggtgatcgcgatgctggcctgtgcccggctgggcgccgtgcactcggtggtgttcggtgggttcggggcgggtgagctggccgcccggatcgacgacgcccggccgaaggtgatcgtcgcgacgtcgtgcgggatcgaggccggccgggtggtgccgtatcagccgatgctcgacgcggcgctgcgcgcggcctcccaccaaccgggccgctgtgtgtggctgcagcggcccgagcagcccgccccgctgctcgaggagcgggatctgacctgggcggaggcggtcgccgacgcggtgccggcggagtgtgtcccggtccgggcgaccgacccgctctacatcctttacacctcgggcaccaccggccggcccaagggtgtggtgcgggacaacggcgggcacgcggtggcgctgcactggtcgatggagcacatcttcgacgtgcggccgggcgaggtgttctgggcggcctccgacgtgggctgggtggtcggccactcgtacatcgtctatgcgccgttgctggccggcgcggcgacggtgctctacgagggcaagccggtcggcaccccggacgccggggcgttctggcgggtggccgccgagcaccgggtggtctgcctgttcaccgcgccgaccgcggtgcgcgcgatccgcaaggaggatccggacggcaaacacctgtccgggtacgacctgggcgccctgcgactgctgttcctggccggggagcggctcgatccgcagacctaccggtgggccggtgacctgctcggggtcccggtggtggacaactggtggcagaccgagacgggttggccgatcgcggcgagcccgcgcgggatcgaggcgttgccgaccaggccggggtcgccgtcgctgccgatgccggggtatcgggtgcgggtggtggacgcctccggcaacgatctgccgcccggggcggagggcgcgatcgtgatcgggttgccgctgccgccgggctgtctgccgacgctgtggcaggacgacgagcggtatgtccggtcgtatctgtcggcgttccagggaaacttctcgaccggcgacggcggccggttcgacgaggacggttacctgtacgtgctgggccgcaccgacgatgtgatcaacgtggccgggcaccggctgtcgacgggtgcgatggaggaggtgctggccgggcatccggcggtggccgagtgcgcggtgatcggcgtgcacgatccggtgcgggggcaggtgccgcgggcgttcgtggtgctcaagtccggggcgtcggcggacggtgtggcggcggagttgatcgccctggtgcgtggacggatcggtccggtggccgcgctgcgccgggtggacgtggtcgcggcgttgccgaagacccggtccgggaagattctgcgcggcaccatgcgggggatcgcggacggcgccgagcccgcggtcccctcgacgatcgaggatcccgcggtgctcgacgccctgcgcccgctactgcggtga

SEQ ID NO: 560 - DNA, 1086 bp, Actinoplanes utahensis
atggacggttaccaggccacgctgtcgccgcggtggcgccgagcgctgctcctggtcgccgccggcctgctcgcgcccgccctctggctgcccgcggccggtggcccggtcggccgggccaccgcgatcgcgctggccgccgcccagatcgtcgcgctgcgacggctggaccgcgcgccccgcctggccaccgccggcatcctggtcgccggcacggccctctcgttcgtcatccccggcctcgggccgggcctggccttcgtggtgctctccacctacgcctgggcccgaccggccccggagagcctgtgggcgctgaccgggacgatcgtcgcggtcggcaccccggccgccgcccagggccgctggccgctcgtcgccggctggatcggcgcctcgctgctggcctggagctggggtgcgctgggccgggcccggtccgcccggcacgaggccgaacgccgccgggccgtgctggaggaacgcggccgaatcgcccgggagctgcacgacgtgctgtcgcacacggtgtcggtgatggtggtgcaggccgcggccgccgacgacgtcttcgacctgaacccggcgcaggcccgggcggcgatccgccgcaccgaggcggccggccgggaggcgctcgccgagctgcgcaccttcctgcgcaccgtccgggacggcgacgccgagccgcacgacgccccgccccagccgtcgctggccggggtcgaacggctggtgtccacgatgggcaccggcgggctcacggtcgctctgcgtcgcgagggggacggggagccgccggcgggggtgcagctgtgcgcctaccggatcgtgcaggaggctctgaccaacacggtgcggcacgccggagcgacggaggccggcgtgctgatcaggatcggtccggccgaggtcgaggtggaggtgtccgacaacgggtccgctaccgggccggtcacggccggcaacggcatccgcgggatgcgggaacgcgccgtgctgaccggcggcaccctcaccgcggccccgcgccccggcggcggcttcctcgtcaccgcccgcctcccctggcaggccaccgcatga

SEQ ID NO: 561 - DNA, 663 bp, Actinoplanes utahensis
atgaccgtccgggtcctgatcgtcgacgaccaggcactggtccgcgtcggtttccgcatgatcatcgaagcccgcgacgaccttcaggtggtgggcgaggccggcgacggcgagcaggccctccgcctcgccgcccagacccgtccggacgtcgtgctgatggacgtccggatgcccggcatggacggcctggccgccaccgcccggctcaccgccctcccggacgccccgcgggtgatcatgctgaccacgtacgacctggacgagtccctctacgccgccctgcgcgccggggccagcggcttcctgctcaaggacgtccgcccgggcgatctggccgaggcgatccgggtggtcgcccgcggggaggcgctgctggcgcccaccgcgacccgccgcctgctggaccgtttcgtcgccgccgacatgacgccgcccggcgccgacgtccggctggaccggctcaccgcccgggaacgggaggtcctggagctgttgggccgcggcgcctcgaacgccgagatcgccacccggctgaccgtcacggaggccaccgtcaagacgcacgtctcggcggtgctgcgcaaactcgatgtccgcgaccgggttcaggcggtcgtcctggcctacgacctgggtgtggtgcgcccgcgctcatcctga

SEQ ID NO: 562 - DNA, 1074 bp, Actinoplanes utahensis
atgacgaagaagacggttgccgcgctgctcctgaccggcctcgcgatcagcctgctcggcgcggtgctgaccctgctgctgcacgccccgatcctcggctaccagcgcgcccaccagccgcacgccgatccggctgccctgtcccgcacgttgtggacccggccgctgaccgtgttcgtcgtcgcgatcctgtacgcccgcttcgtacgccaactgctccgtggcgatccgcgggccctgcgccgcgttcggatcgtctccgccgccggcctggcgggtgtctgctggctgctggtcagcgccgcgtatccggcctggctccgcgcgatccagatcggccagttggtggtgctcgccgccctcgtcatcacggtcaacctgcggaccgtccggtccgccttcgacgccccggtcccgcccgacccgcgcccccgcaacggtcgcgccgcctggaccctgatcctgctcaccccggtcgtcgccgagctgaccatgggcaatgtggcgctgcgtgacctgatctactttccgatcttcatcccgatctacggcgccggggcgctgctcatccgcgagaccacccggcgtctcggcggcggaacggccggcctgctgctgctcggcctggcctacggcatcctcgaggagggtctcgccctgcagggcctgaccagcccgcacctgtatcacgcggcggactgggcgcctcgcctcctgggactgaacacggcgtacgcagaattgaacctgatctatcatccggtgttcagcgtgctgatcccgatcaccctgaccgagcatctcttccgcactcacggtgaccggccctatctgcgacggggcgggttgatcagcaccgcggtcgtcgcggcgctcggcgccggcctgctccggatcgcggtgccgcccaccatggatcccggctaccaggtgccactgctcccggcggtcctttttctcacggtcgcggcgttgctcgccgccgccgcctatggtgtacgccgtaagcccgcccgccgcggccccgcccccgccgcggccgccgcaccggcccccgtccccgccgcggcctag

SEQ ID NO: 563 - DNA, 369 bp, Actinoplanes utahensis
gtgatcgccgggtggaccggtgccgccgccctcggcttcctggccctgatcttcccgttcgccggcgcccgccagccgttcttcacccacggcacctgggtgctgctcccgatggccggcgccgcggtcatcgtgctcctgatcgcccgcgccctgcgccggtggcgtgccgcaccgacctggaccgccgcccaccggctcgccgcctgcttcggcgcgctcaccgggcacaccgtgttcggcctgatcgccaacgccgacacgctccaggaccggctgttcctcggcgcgctggccgcgctcaccgtcaccctcggcgcccgggcgatccgccccgcacccggcatcccggcgggtgccgccgggtga

SEQ ID NO: 564 - DNA, 135 bp, Actinoplanes utahensis
atgggcaagaccgaagaccgcgacaagatgtacgagctgggcgcccgcctgttcaccatccacaccggcggccccacccccgacctcaccgaactccgtgagtttctcacctggcgcgaccagcgcaacgcatag

SEQ ID NO: 565 - DNA, 438 bp, Actinoplanes utahensis
atgggagttgtaggtgcggattgcctcggcgatctcctgccgggtgaactgctcgcgaacgaacgcaggggcgccgatgacgacagtcatcgacgctcggcgggcgtcgacaccgtactcgttgagaacggtgtggcgctgctcgtccaagccacgaaggtagttcatggcttggacgacagcctcgtggactggttcaccgacgacggctcggccccgatgagcaacgacaagtttcgcgatgcacgcgcgtttgatctcgacaccatgaagggtgccgtcgccgcggataagtgggatgtcgagctgatcgctcaacgacagcgctcgccgagcggcgacacccatgaattcgcctccgaacacccaggagtgctgctcaaggatgcgctgaatggctggctctcgggtgccgggatcgaggacaagacgtcgtag

SEQ ID NO: 566 - DNA, 3849 bp, Actinoplanes utahensis
gtgcgggacgcgctgatcgctgatctcgtgacccgggtccgtcactttcatacaaccggctccccggagccgcttctctccgacggcggtctggatgctgcagctgagcttctccggctggcgacccacgagataaccggccgcgaggacgtcgacgctgatgccctgcatgctgtcgcggcataccaatggacgcgtggtctggtctggcagtccacaaccgctacgcacgatcgtccgggcgaggacccggagggtcgggcggaggttgagttcgctggtgctctcgccacctacgaactgctgttcatggtcgatcaccgccgggtgccacgtgatctgtggccgtacctcatccgcgagaccggccacgatccctggcaagacccactggaccgcgccaaggatctgctcgttgatgcgaaagaggccagcgatccggctgctgtcgcgacggtcatcgagcagttgcagaacctcgacgagcccagcgacgccggcttccgtgacagccttctcggcgacgcccatctggtccggttcgacattgtccgggattccatcgatctcacgaacgccgtctcggcctaccgtgccgccctcgatcggttcgacgccggttcggcttcgtacacccacgcctgccagggactcggggcggcactcgggaggcagggccagctcgccctacacttcggagagcaggcgtcggtgctgttgacggaagccgtcggctggctgcgccgagccgccgacggcgacacgtcggttctgccgtatctgcagcgagtcatggctctgcgaatcgaggagaaggtccgcgccggatctgttcccgttgaggagcacccgctcgcagcggatggcgaggagcgtcggcaggctgtcgcgttgctgcagctcgccgatcacgtccggacccgagtgttgtcacaccaggaggcgacccggcacgccgccgatccgtcgttcccgctatccgccacggcgattgacctagccgtccacacatccgtggcgaacgtggaggtggcacggctcgccatggacgcggcggaacatcgttggggagccacccgcgacagcccgtggtggacggccgccgacgcctacgtcgaagcggtgagacacagcttgctcgacgacccggacgccgatcgtctcgccgccgcgcacgccgtggcgaccaggcagctcacgatgctcgtcgacgagcccgccgagcgcgccggcaccctgttcgccgcgggcctgctctacctgaccccgtatctaggaacaatgtccgggctgacgttcgatggcgcccaccaattgtggctggctcggcatcagcgccggctgaccgcccaccccgagggtgacccgacacccttgccacctcctgacgtcgccgccgaccgcgccgtcgaatatctgcggcaggcagccgacctggccgtcggccatgaccgcggccggattctcaaggcgctcgtcgaggcgtattcgtttcgagccgggatgcgccaggagtccgccgacgatgaggcactggcggggtgccggacggcgttcgacctgctggacccaacccgtgaccagctcagtttcctttacgtacttcgcgtgctgtatcgattcggcgagatcgccctgccccccgacctgaactcgctgttggcgatgcccctggccacggtgcgggaccggtacggcataccagaggcgtcgtcggtctttgccgaggcgctcacgctcgccggtgaggcgatgcgccccgatttggaggccgagctactcgccgctgccgacgaccacctgcccgtactggcgagtgacgcgcagcgacgggtccggtggcgcagcgaggtgcacctgctcgcggacggcgtcctgccctgctcgccggacctacgagtcgacgccgacttggtcgaccaggtgcgggcggtggcagctgggcctgagctggccgctacgtttattcacctcgccgcgcacaccgccttcggcgcaacaccggaactcatcgccaacgctctcgatctgctgtccgaggcacaccaggaagcgcctgagctgtggcgatggcacggcgacgccatcgactacctcgaagccggactcacctacgatctggccacccgctccgccgacgacggcacgcacccggagtcggcccgccgattcggtgccgccgcgttgcggtacgcgctctgccgccagcacgacctggcgctcgcgagcctcgacgccgggcggcttcagatgaccctttgcgacaacgatcagaccagctcggccgcaatcgtgctgctgtgggcagccgcgggcctcagcggtaccccaggtgagcctgtggcctgggcactgttcgagttctaccagcggatcttgtttcatctcgccgaccgtcaggtcgacgtcaacgccgtgatcatgctgcaccaggccgccaaaggccgctggctggcctcggcactgcattcccccgggccgttcactgccagcccacgtctgctgcgggaacttcgggaaatgccagtcgagcaaagcctgcccgacatcgacctgccaggcggagcagaaacggtcatgaccttgtacgccggatccggtgaagccgagaccgagaccggccctgacgcggtggcccgcaaccggcaacgtgcggccgaccgccggatcagcgcagaactctcctccgcccgcagttcatggcaaccaccaccgatccccctcgacgagctgcagtcgatgctgccaccggagacggtgttcgtgtcactgatgctcggtgaagcccgcaaaccgtctggcgatccatccggcgcgctgcacgccatggcggtcacccgcgatgccgtcgaataccgcacgttgctgatcccggacgctggtggcagcctgatccggctctaccgcggcagccaccacctggccctgtcccccttcggcatccgagtggcgcaactacgcaacagtgtcaccgccgacccgctgcaccgggccgtcagccgcgacgcccagcagcacctgtccgaacgacccgactcctatctcgccggtttcgccgaccgcatgccccagtggcacgccgaaggccgccgtcacctgtgtgtctgggccgacggaccgctgcactacgtccccttccacctgctcaccagcggaacaggaccggccgccgacgactggaccgtcacgcagatcgccagtcccgaaatgctccgcgaacagccaccgtcagttcggcgcggcttcgtcgcgttcgcttcaggtagcggcggcaccgctcacggcctacctgtcgaggacgccctggagagccacgccgcccaggtcgccacagcgatgggcggtgaggccgtactcggctccacggctacacccgaacgcttcctctccggcctgacccaggcacggtacgtccacgtcgccgcgcacggcagccacaacgaatgggcgccctggttccagtgcctgtacctctcgggcggccgggtcttcgcccacgacatcctgcgcaccgatctgcgcggcgtggaactggtcaccctgagcgcctgcgaatccgcgctcggccgcttcgacctcaacgacaatctgcgcgggctgcccgccgccctactttctgcaggcgccaccgccgtcatcggctgcctctggcccgtccacccgaccgtggccactgaattcttccaccacctctacgaacggctggccgtcgaccccgaccggcgttcggcgttccgggccgcccaacagcgcacccgcgacaggcatcccgcctaccgcgactggggcaccttcacgttcgtcggcaactggcgtaccactatccccgaggagccgcccaatgactga

SEQ ID NO: 567 - DNA, 687 bp, Actinoplanes utahensis
atgactgatctcgacacctcgatccacgaggtcgacctcctgctggaaccccgcctgcagtcaccgggagcagcaccccgaattagcggccgagtcacgctcggcacaccggtggtacgcccgctcgaagccggcaccatctccgccgacccgggctggcgcgaattccttgaggcccaggccgccgacaacgactacctcatgctgagcgtgttctgctcgttccgggccgtccccaacggcgacccgatcgttgacgcagccgtcggcgtcaacctgcaggctcccggcgaacccgccgaccgtcagccgatcgcctggtcgatcagccccaaacaccgcgtacgtacggtgccccgtaccgggcggatcgcgctcaccgccaacctcacagtcgccgaagccgccattgagtacgcgccacaaggcaaccgcgaggacctgttcctcgtcggcatgggcgaacgcgacagcgaccccgaatggaggttccgcgccgtcagcggccagccactgatcggcgacgaggaactgacgatcgtcgtcaagaagccggctggtgtcccggcccacgccgacatctccctcgccgccaccatccgccaccggcgcctcggcctgatcccttaccgcgccgacctgccctcggtcctccgctccgtcaagctcggcagcttggatggttaa

SEQ ID NO: 568 - DNA, 1662 bp, Actinoplanes utahensis
atgatccgccccgagcactggcggcccgcagacggcctgacgctggaaccgaatgcgctgaaagcggcgacagcggccgacctcaacgcggtggtcgccgccgggcccggcgcagggaagacggagttgcttgcccagcgcgcagacttcctgctgcgtaccggtcagtgtccgtacccgcgccgcattctggcagtctcgttcaaggtcgatgccgctcgtaatctggccgaacgggtccgccgccgctgcgggccgacgctcgcggaccggttcgacagtttcaccttccacgccttcgccaagcgcctcgttgacaacttccggccaacgctgaccggtgccaatgcccttgattcggattaccgcatcgatcggcaggaccggattgccagcaaacagatcacgttcgaagacttggttccgcttgggctggagatcgtccaggccaacatctatgcccggcggggcctggaccagacctacagtcacgtctttctcgacgagttccaagactgcacagcggaccagtacgagctgatcaaagcggtcttcgggccgtcgaccgccatcgtgaccgctgtcggcgacaccaagcagcggatcatgctttgggccggtgctctcgacggagtgctggagaccttcgccgacgacttctccgccgtgcgtctgccgctgtatcagaacttccgctccgcgccacgactgcggcgcatgcagaaccggatgatcgcccagatggaccccagtgccgtcagccctgcggaggatctggtcggtgatgatggcgtcatcgacgtcctcggcttctctgacgagtaccaggagtcgcgaacagtcggcgatcttctttccggatggctcggtcaaggcgtgcctccggccgagatcgctgtgctcgtacgcaaccagccgcacctggtcgcttcggtgcttggggacgaactgcgtgcacgcggcatcgccttccgcaacgagcaggagagtcaggatctcaccgcagagccgatcgcggccctcgtactcaatttccttcgagtagtcgctgacgatcggcaaccccacgcctacgccgacctgatgaggatcgtggcccgcacgaacgcctccgacgacgaggtcgcacgcttcgacagccaggtcaaacgaatcatcaccacggctcggatcgccgtacgggcttcaacattcacccccgacgactccgcaggatggcggaacctcgtcattggattcctgcgtctggtgtcccggccggtgttgaccgcattgtcggccagctaccagcagggcaaccgccttgacgaccttatcgtgcagacgatggctgctttcgaacgggaactcgccgtagacggcaacgccgtactagccctgcggcggctttctgaagccgacgccgtgagagtcctaactatccacaagtgcaagggcttagaattcgagaaagtcgtagtgctcggcgtggagactcagctcttctggagtaaagatttgacgacgatcatgtcggagttcttcgtcgcgatctcccgcgcgaaactgcacctcgtcctgactcacgtcgagcaccgcggccggccgagcgccgccacgagacgatgggatgagcggcgctcatcccatcagacattgctcggcttcgcagctgaggattaa

SEQ ID NO: 569 - DNA, 1944 bp, Actinoplanes utahensis
atgaagatcgttgcgttgaggctgagcaattttcagtcgttcggccccgagccgacaacgatcgatcttgatgacttgacctacattctcggcccgaatggctccggcaagactgccgctttggaggcgctttcccggttgttcagtccactggccgcgcagcgtcaaattcagccggaggactttcacgtgccggtcgatcggtccgccagtgaggtgcaggatgcccaaccgaccctctggctagaggtcgatgtgttgtgccctgaagcgggggccggcgggacacacgcgtcggtaccgccgttcttcgcgcacatgaggatcgatacggcggacgggatcccgcagattcgagttcggctgacggcacaactggccgcagacggagtcatcgacgagaagatcgagtacgtcctgcaggctgacgcggcaggggtgccgaccagctgcacccagatgagccgtttcgaccgcgcgcagatcgaggtgtactaccttccagcccgccgtgacccggtagatcacatcgcctatacagcggcctcgctgattggacgtagcctgcgagcagcggactggacgagcgagcgggaggtgcttggcgatctatctgcacagatcaccgacacactggtcgccaacgccgcggtggcaggtatcggcgtgcacctgaccaagcagtggcagaacctgcacagcggcggctacttccgagatccctcgattgccttcgggcgtggcgatcttgagggggtgttgcgtcaacttacggtgacgttttccccatcgcacggcggggcatccctgccattcgaccggctcagtgacggacagaagtcgttgctctacatctcgctcgtcctctcctggcaatcgttggtccggcgggttctgcgcggtgaggaaacttccctggatccagatcggctgcgccctcctgtgcacgtcgtgatcgagatcgaggagccggagaacagcctcgcaccgcagtatcttggccgtatcatccgtcaggtgcgcggcgcatgctcggccggcgacgtccaggcgctgatcgccacgcacgcgccggctctgctaagacgggttgacccggacacgattcgcttcttgcggctcgacgccgcccggcggacgactgtcgagcgcatcgttgttccggcggacgacgtattggccgcgaagtacgtccgcgaggcggtccaggcgtacccggagctgtacttttcccgccttgtcgtgctgggcgaaggcgacagtgagcaagtggtactgccccgagtcctcgccgcagccggcatcgccgaagacgacgcctccgtgtcggtggttccgctgggcggtcggcacgtcaaccacttctggcggctgctcaaccaactccacatcccgcacgtcaccctgcttgacctggacagcggccgttatcacggcggctggggcagggtacgcaacgccatgcggcagctcaatgcagtccaacccgatacgttcgcggaagcccagatcgaccagttgccgaagtgggatgacgactgcgattttccgcagcccggatgcggccccgacatcggcggtgggctcggcccgatcgatgtgctggagcagcatggcgtcttcttctcccagccagtcgaccttgacctcatgatgctggcggcctatccgaccgcctatgccgtcgaccctcccgcaaaaccggacccgcagaccgtcgtggccgtgcttggaaagagccacaaaaacgagatccgccttcgcagcgaggtccttgacctcttcgacgagtatcaccggaagtttgacctcggcagcaagcctgcgacacatctgagcgccctggctagcctcgacgaccaacacttgctcaaagaatcacccatggtgcttaccaggatggtcgagcatgtgcgcgcggtcctgggcggcctgccggaatga

SEQ ID NO: 570 - DNA, 771 bp, Actinoplanes utahensis
atgatcgacaggccggtccgcatcggacttcagctgcagccccagcacatggattacgccaccatccgccgcaccgccgccgaggccgaggacctcggcgtcgacgtgctgttcaactgggaccatttctatccgctgtacggcgagccggacggtctgcacttcgagtgctggaccatgctcgccgcctgggccgagtccacctcccgggtcgagatcggcgccctggtctcgtgcaacagctaccgcaatccggaactgctcgccgacatggcccgcaccgtcgaccacatctccgccggccggctgatcctcggcatcggctccgggtggttcgaacgcgactacaccgagtacggctacgagttcggcaccgccggcggccgcctcgacgacctggcgggcgcgctgccgcggatcgagtcgcgctggggcaagctgaacccgccgccgacccgcaagatcccggtgctgatcggtggcggcggcgagaagaagacgctgcgcctggtcgccaagcacgccgacatctggcactcgttcgccgacgcggaaaccctggagcacaagctgggcgtgctccgcgggcactgctccgacgtgggccgcgacccgtcggagatcgaggtatcggtggcgagcaagccggacagccgcgaccggatgcacgaactcggcgcccggctgttcaccgtcggcgtcggcggcccgaagcccgacctgagcgagctgcgcgaagccctcgcctggcgcgacaagatcaacggataa

SEQ ID NO: 571 - DNA, 789 bp, Actinoplanes utahensis
atggctgtgagtgaagccgggccggcgcgcccgccgatcatccgccgccggcgtctcgaacccgacgcccggcgcgaacagatcctgtccgtggcgatccgcctcttcggcgaccgcccctacgccgacgtctccaccaccgacgtcgcccgcggcgccggtgtagcccgcggcctggtgaaccactacttcgggacgaagaaggagctctacctggaggtcatccgggtgatgctgaccgtccccgaggtcgccctctcccgcctcccggacggcggccccgccgaacgcgccgacgccatcgtcacctggttcctcgacgtggtctcccggcacagcacgtcctggctggccgccatcaccgccggcgggatggccggcgaccccgacgtcgacgaggtcatcgccgaagccgtcgacatcgccgccgacagcatcctgtccgccgtcggcccggccccgaccgcgtccagcgccaccgctgcggccaccgggccggccggcccgtcaaccgtcgttgtccctccggcggtcccggccgcaggtcctgccggcccgtcatccggcatcacggccggtgccccgccggctgcctcggcgtccggctccccaccggccgctgagccgggagaggcgttgcgcggcatggcccgcgcctacgtcggcctggccacctacaccgcccgcgagtggctccagcgcgatgccctgacccgcgaccaggtgcacacgttgctcaccaccacgctgctgaccatggtcgagaaggtcttcccccgggcgacctga

SEQ ID NO: 572 - DNA, 1173 bp, Actinoplanes utahensis
atgccgacgcctggactggacggctacgccgagccgtggcgcatgccggaacacgacgacctggccgagatggcccgcaccttctttctcaaggaggtggtgccgcacgcggcccgcctcgaacagcagggccatcccgaccgggagcactaccgccgggccggcgagctcggcctgctcgggctttcggtcccgcaggagtacggcggcgggggcggcgacttcacccacgaggccgtcgtgctgcacgagcagcagctgaccggcgagggcagcctcggcctggccgtgcactgcgggatcgtgaccgggtatctcgccgcctacggcaccgaggaacagaagcgccgctggctgccgggcctgtgcagcggcgagttgatcggcgcgatcgcgatgaccgagccggacggcggttccgacgtgcaggcgatacggacccgtgcggtccggaccggcgaggacctcctggtgtccggttcgaaaaccttcatcaccaacgggtatctggcggacttattggtcctggcggtgaagaccgatcagtccgccaaggcgcacggcatctccctgctggtctgcgagctggacgacgacgcccccggcttccggcggggccgcaacctggagaagatcgggttgcacgcgaacgacaccgcggagctgttcttcgacgagttccgggtgccggccgccgacatcctgggcgggccggacgccgagaacaccggcttctaccagctgatgcagcagctgccccaggagcggctggtgatcggggtcggtgcggtcgcggcgatgcagcgggcggtggagctggccaccgcgtacgcgaaggagcggaccgcgttcggcaaaccgctggtcggtcaccagaacacccggatggttctcgccgaatgcgcgacccggacccgggtgtcccgagttttcctggacgactgcatcgcccggcacacccggggtgaactggatgtggcgtccgcggcgatggccaaactgttcctcaccgagggacagtgcgaggtggtcgaccgctgcctgcagatcttcggcgggtacggctacaccaccgagtacccgatcgcccggatgtacgccgacgcccgggtgcagaagatctacggcggcaccaacgagatcatgaaggagctgatcgcccgtgtcctctga

SEQ ID NO: 573 - DNA, 1233 bp, Actinoplanes utahensis
gtgtcctctgagcaggcctacctgtacgacgcggtccggaccccgcgcggacgaggcaaggacaacggcgccctgcacgggacgaagccgatcaccctggtgaccgggctaatcgacgcggtacgcgagcgcagtcccggcctggacccgcgacggatcgacgacgtggtgctggggatcgtcacgccgatcggcgagcagggcggcgacctggcccgctcggcggcgctcgtcgcggggctgccggacacggtcggcggcgtacaactcaatcgtttctgtgcttccggtctcgaggcggtgaatcaggcggcgtcgcggatccggtccgggtgggagcacctgatcctggccggcggggtcgagtcgatgtcgcgcaacccgatggggtcggacgggggcgcctggttcctcgacccggagacggcgctggccaccagtttcgtgccgcaggggatcagcgccgacctgatcgcgaccctggaagggttcacccgcgacgacgtcgacgcctatgcgatccagtcgcaggagcgggccgcgaaggcgatcgccgggggcgcgttccagcggtcgatcgtcgcggtgcgcgatccgagcgggctggagatcctggcggtcgacgagcatccgcggccggacaccacccgggccgggctggggaagttgcggccgtccttcgccgggatcggtgagcaggccgggttcgacgcggtggcgctgcagaagtaccactggctggagtcgatcgagcatgtgcaccacgccggcaactcgtccgggatcgtggacggcgcgtcgctggtcgtggtcggctccgagcgggccggccgggagctggggctgacgccgcgcgccaggatcgtcggggcggcggtgagcggcgccgaccccaccctgatgctgaccggcccgacgcccgccacgatcaaggccctgaaagcagcggatctcgaaatctcggatatcgacctcttcgagatcaacgaggctttcgccgcggtcgtcctcaagtacatccgcgatctgcaactggacccggacaaggtcaacgtcaacggcggagcgatcgctctcggacaccccctgggcgccaccggcgcgatgctggtcggcacggtggtcgacgagctggagcgccgcgatctgaaacgggccgtcgtcaccctctgcatcggcggcggcatgggcgtcgcgaccgtcatcgagcgcgttacggagttcgacaagtga

SEQ ID NO: 574 - DNA, 2031 bp, Actinoplanes utahensis
gtgatctcttacgacaaggacgaggccggcatcgtcacgctgacgatgaatgacccggaccaatcggcgaacacgatgaatgccacctacgtcgccgccatgagcgccgccctcgaccgcctggaggcggagcgggaccaggtcaccggcgtgatcgtgagcagcgcgaagagcaccttcttcgccggcggcgacctgcccacgatgagcagggcccgcccggaggacgccggcgccctgttcgacctgctgggcacgatcaagaaggacctccggagattggagacgtacggtcgtccggtcgtcgccgcgatcaacggcgccgccctgggcggcggtttcgagatcgccctcgcctgccaccaccggatcgccctggacgcccccggcacccgggtcggcttccccgaggtgacgctgggcctgctcccgggcgccggcggcgtgacccgcaccgtccggatgctcggcctggctcccgccctgaccgtctggctgctcaccggcaaacgcgtgaagccggccgcggcccgggaagccggaatgatcgatgaggtcgtctcatcgcaggacgagatgatggcccgggccagggagtggatcgccgccaacccggacgccgcccagccgtgggacaggccgggctaccggatgcccggcggcaccccggccaccccgaagctcgcggtccagctgccggccttcccggccaccctgcgcaagcagctcaagggcaaccggatgccggccccggaggcgatcctggccaccgcggtggagggcgcccaggtcgacatcgagaccgccttcaccatcgagacccgacggctgatcacgctgctcaccggccggatcgcgaagaacatgatcggcgcgttcttcttcgacatgcgcgcggtcaacggcggcgccgcccggccgcgggtcgacgtcgccccggccaccagaatcgccgtgctgggtgccgggatgatgggcgccggcatcgcctatgcgtgtgcgcaagccggcctggaggtcgtggtcaaggacgtgtcgcgggaggcggcggcccgcgcggtggccgagggtgacccggccgtgctggcccggatcacgccgaccgccgacgtcgaggacctgcgcggctgcgacgtggtgatcgaggcggtgttcgaggacccgaagctcaagcaccaggtgttcgccgaggtcgagccggtcctcgccgcgggcgccctgctcgcctcgaacacctccaccctgccgatcaccggtctggccgagggggtgacccggcccggcgacttcatcggcatgcacttcttctcgccggtcggcaagatgccgctgctggagatcatggtcggcgagcagacctcggacgccgcgatcgcccgcgccttcgacctgggccgccggatcggcaagacgccgatcgtggtgaacgacggccgcggcttcttcaccagccgggtgatcggccagttcatgaacgaggcggtcgcgatgctggccgagggggtgccggccgcgtcgatcgagcaggcggcgctgcaggccggctacccgaccgggccgctcgcgctggccgacgaggtgacgctgacgctgatgcacaaaatccacaaggcgtacgcggcggccgggaccaccgccggtccggcgaaggcgcacgcgctgatccaggagatgctggagcggcacgaccgacccggacgatcctccggcaggggcttctacacctacgagaacggccggcgcggcagactgtgggacggcctggccgggctcgccaccgacgagggccgcgccatccccttcgccgacgtgcaggaacgcctgctgttcagcgaggcgctggacgcgttgcgctgccgggccgagggcgtgctgcggaccgatgccgacggcaacatcggttcgatcctcggcatcggcttcccggcctggaccggcggcgtgctgcgctacgtcgagcagcaccccgacttcaagggccgggccgccgagctggccgcccggtacggcgaccggttcgccccggcatga

SEQ ID NO: 575 - DNA, 1068 bp, Actinoplanes utahensis
atgaccgcgctgcgcggggtgcgggtggtcgagctggccgggctcgcgcccggcccgttcggctgcatggtgctggccgacctgggcgccgacgtggtgctggtcgaccggcccggcggcaccggactggacggtccgctgcagcgcaaccggcgcacgctcaccctcgacctcaagtcgccggacggactggccggtctgctcgacctggtcgcgaaggccgacgtgctggtcgagggctaccgcccgggggtggccgaacgcctcggtttcggcccggaccgctgcgccgggctgaacccgcggctggtctacgcccggatgaccgggtggggacaggacggtccgctggccgcagcggccgggcacgacatcgactacctggcgatcgccggtgccctggagccgctcggccggtccgggcagccgccgcacgccccggtcaacctgctcgccgacttcgccgggggcggcatgctgctcgccgtcggggtgctcgccgcactgctggagcgcgagcggtccgggcgcgggcaggtggtcgacgccgcgatggtcgacggctcggcgctgctcaccacgttcctgcgcggtttgatcgacgccgggcagtggccgggcgggcggggggagaacctgctcgacggcggggcgccgttctacgacacgtaccggaccgcggacggcggctacctggcggtcggcgcgatcgaaccgcagttctacggcgcgctgctgggcgggctcgggctggacgacgcggaactgcccgggcagttcgaccgggacggctggccggagttgcgccggatcctcgccgaccggatcggctcgcgcacccgcgacgaatgggccgcggtcttcgcccggctcgatgcctgcgtgagcccggtgctgacgccggccgaggcccccgatcacccgcacaaccgggccaggtccgctttcgtcgaggtgggcggtcaggttcagccttccccggctccgcgattcgggcgtacgcccaatcaggcaccgcgaccaccggccaccgcgaccgtcggggaggttctggcgggctggcggtga

SEQ ID NO: 576 - DNA, 1029 bp, Actinoplanes utahensis
atgcgcatcggaaccgaccggctggacgactcactgatcgcccggcgccggatggtggagatcgccgcgctggtctgccgctgcatcggcatcgctgtcgtgctgtgcaccgcgctcggcgtccgggggttcgccgccgaatcggtgccgggtccggtgctctatctgtgcgctgctcttatggcgttgtcctctgtgatgtccggtttttcggcacggcaccctgcctcgccgcggtatgcgatgctcagcgccctgcagatcgctctggacaccgcggtcaccatcggctgcgtggtgttcaccgagcggcacaccggggcgaacacctggccggtgctgagcctgccgatcgccatcgccgcgatccggcaccagctgcccggcgccctcgcggtctgggcggtgacctcggcctcgctgctgctgatgccgctcgacccgggcgccgccgcgctcggcgtctcgctgaacctgatgatcgccggcatcagcggatcccaggcgagcgcgttccagcgccagctcagcaccctgcaggaggtccggcgggaactgcagcaccaggccacccacgacgcgctgaccgggctgccgaaccgggcgcacctggccgcctccgccgagcacgacccgggccggcccctcgcggtgctgctgctcgacctgaacggcttcaaacagatcaacgacacgcacgggcacgccgccggtgacgtgctgctgcacgaggtgggcaaccggctcggcacggtcctcggtcccggcgatctggccgcgcggctgggcggcgacgagttcgtggtgctgctgcgcgacgccgacgcggccacggccgggcgcaccgcccagcggatccggtcggtgatcgcgcagccggtcgggatcggtccggaccgggcggtgcgggtcggggtcagcgtcggcgtggcgatccgcccggccggggatggcgccgggttggacgcgctgatcgccgatgcggacgccgcgatgtaccgggagaagcacgccggacgcgcggcgtga

SEQ ID NO: 577 - DNA, 1560 bp, Actinoplanes utahensis
atgctcggcctggaaaacatcggtctggccaaacggctgggcatcatcgtcgccacgggtgcggtcgccctcggcggcatcggcacgatcgccctgatcggccaggaaagcgtggccagcaaggcgaacgaggtcagccggctgcagtgcggcctcgccgcgctgaaccacctgaacaaccggcagagtgagctgaaggtcgacgcgtaccgggcggcgggtggcgccgacgtcagccaggacgtcaaggatgacgtgcagtcgtcgtccgaggcgctcgacgcggtctccggctgcgacctgcccagctcgatcgccggccaggtgaacggctaccgcggcgacttcgacgacttcaacacgttcatctcggacttcgtcacggccggtgtggccgaccccaggtcggtgcgcgcccggatcggcgagatcggcgacaagaacgacaagaccgacggcgagctggacaccctcaccgatgccgtcaccaagcaggtcgacgacggccaccagaagaccgggtcggcgatcaagcggacccggtggaccgtgatcatcgtggcgctgatcgctctcgccctgctgatcggcatggcgctcccgctggtccgttcgatcctcggcccgatccgcagaatcggcgcggtgatcgacgggctggacaagggcgacctgaccgtgcgcagcgggatcaccacccgcgacgagctcggcaccatggcgcagagcctggaccacacgctcgacaagctgcgtgagtcgatgatcaccatcgccaaggactcggactcgctggccaccgcggccacccagctctccgcggtctccggcgagatcgcctccgcggtcgacaacaccgaccggcagagcagctcggccgccaccgaggcggacgagatctcccgcaacgtgcagagcgtcgcggccggctccgaggagatgggcctgtcgatccgggagatctcccgcaacgcggccgacgccgcccaggtcgcctcggtcgcggtggccgaggccgcccgcgccaccgagagcatccgccggctcggcgagtcgtccgccgagatcggcaacgtgatcaagctgatcaccagcatcgccgagcagaccaacctgctcgccctgaacgccaccatcgaggcggcccgggccggcgacgccggcaagggcttcgccgtggtggccagcgaggtcaaggacctggcccaggagactgcccgcgcgaccgaggacatcggcgcccgggtcaccgcgatccagaacgacaccaccggcgcggtcgaggtgatcaaccggatctccgaggtgatcgcgcagatcaacgacttccagacgacgatcgcctcggcggtcgaggagcagaccgccaccaccggcgagatgagccgcagcatcggtgaggtggcggccggctccagccggatcgccgcgaacatcaacgacgtgtcgtcggccagccaggcgacggtcagcggcgtcaaccagacccgggaggcgagcgaggaggtctcccggaccgccgaggagctgcgcgccctggtcggtgccttcaagttctga

SEQ ID NO: 578 - DNA, 342 bp, Actinoplanes utahensis
gtgagcgcgtcgattcagtccgatgtcccgccgtccggcaccggttgcgtggagtgcctcgaggccggcggctggtgggtgcacctgcgccgctgtgccgcctgcgggcacgtgggctgctgcgacacctctcccgcgcagcatgccaccgcccacttccgggcgaccgggcatgcggtgatccagtcgttcgagccgggtgaggactggttctgggacttcgcggccgagcaggccggcagtgggccggagctggcgcccccgaccagccggccggtggaccagccggtcccgggtccggccggcgcggtcccggccgactggagatccaagatccactag

SEQ ID NO: 579 - DNA, 390 bp, Actinoplanes utahensis
atggtgagtgtcatgaccgatcccgccgacgacctgatccccagcgtcttcgcccgggactgcacgtcccggttcgtgctcgccgacatcaccggcaaatggggcgggctcgcgctggccgcgttgcacgacggcacctaccgtttcaatgccctgcgccgccgggtcgacggggtcagcgagaagatgctggctcagacgctgcaggcgctggagcgcgacggcctggtccgccgcgaggtgcaggccaccatcccgccgcgggtggaatacagcctgaccccgttcggcgagcgggtcgccgccaagttcaaggagctgatcgacctcgtcgagggcgagatgccgcgggtgcgggtggcccaggaggagtacgaccgggtgcgatag

SEQ ID NO: 580 - DNA, 861 bp, Actinoplanes utahensis
atgaccatcgccgttgccggagccaccggacacctcggccgcctcgtcgtcgaggccctgatcggccgcggggtcgagccgtcctcgatcgtcgccgcggtgcgcagcccggagaaggcggccggcctgctcacccgcggggtccaggtgcgcgaggccgacttcgaccggccggagaccctgcccgtcgcgttcgccggcgtcgaccggctgctgctgatctccagcaacgcggtcggcaaccgggtcggccagcacgtcgccgcgatcgaggccgccaaggccgccggggtgcagctcatcgcgtacaccagcgtgctgcgcgccgacaccacgccgatcctgctcgccgccgagcacaaggccaccgaggaggcgctcgccgcgtcgggcgtggcatacacgttcctgcgcaacggctggtacatcgagaactacaccgcccagctgcccaccgtccggaccaccggggcgttcctgggcagcgccggcgagggccggatcgccggtgccacccggctcgactacgccgaggcggccgccgcggtgctcaccgccgacgacgtgcgcccggtctacgagctcggcggcgaccagccgttcaccctggccgagctggccgccgaggtgagccggcagtccggcgagacgatcggctaccacgacgtgccggccgacgagctggtcaccatcctgaccggggccggcgtgccggagggcttcgcccggatcctcgccgacaccgacgtgcacatccgggagaacggcgtgctcgacaacccgggcagcgacctgcgtgacctgatcggccgaccgaccaccccgctggccgacgcggtcgccgacgcgctgaaggcctga

SEQ ID NO: 581 - DNA, 558 bp, Actinoplanes utahensis
gtgatcggatggtccggcccgggctctttgcgcggcctgtcactcatcaggatccctccatgttgtggaccgtacccaagctactacggtgatcgggtgccgaacgccgccatcgccgccgtgaccgccgccgggatcgcccacgaggtggtccggcacgggccggtgagcagtgtcgccgaggccgccgccacccagggtgtggaactgcgcgatctggtgaagacgctggtggtccgccggggcccggacgacttcctgttcgtcctggtccccggcgaccgctcgatctcctggccgaaactgcgcgccgtgctgggcgtgaaccggctgtcgatgccggacgccgcgacggcgaaggcggcgaccgggtacgaacgcggcaccatcacgccgttcggcgccgccacggcctggtcggtgatcgccgacgagcggacccgtgggcggaccgtcggcctgggcgcgggcgagcgcggggtggccctgcgggtcggcgccgacgccgcggtcgccgcgctgggcggcgagtacgcggacgtcaccgacccggcctga

SEQ ID NO: 582 - DNA, 375 bp, Actinoplanes utahensis
atgagtgacaggccgcgcaaagagcccgggccggaccatccgatcaccgtcacaccgaccggccagcgggtcgtggtgaccgtcgccggcaaggtggtggccgacacgaacaacgcgctcagcctgcgcgagtcgacctatccggcggtgcagtacgtgccgctcgccgacgtcgaccgcacgctgctggagcgcaccggcacccggacctactgcccgtacaagggcgaggccggctactactcgatcgtcgtcgacgacgtcaccgcgaccgacgcgatctgggagtacgcggagccctacgacgcggtcgcgcagatcaaggaccacgtcgcgttctaccccgaccgggtggagagcatccggatcggctag

SEQ ID NO: 583 - DNA, 1011 bp, Actinoplanes utahensis
atgctggttgacttctccgcgccggtcgccgcctcgcccgccgaggtggaggccgcggccgtgtcggcggaactcctcggttatgacgggttcggcgcggccgagacgaagcacgacgtgttcaccgcgctgaccctggcggcccgggccaccgagcggatctcgctgcagtccgggatcgcggtggccttcgcccgcaatccgatgaccgtcgcgatcctcgccaacgacctgcagctgatctccggcggccggttccggctgggtctgggctcgcaggtgaagccgcacatcgagcgccggttcgcgatgccgtggggccggccggcggcgcggatggaggagttcgtggcggcgctgcgggcgatctggcacacctgggcgaccggcgagcggctgatgttccgcggcgagttctaccggcacacgctgatgaccgagttcttcgatccggggccgaacccgcacggcaacccaccggtcgagctggcggcggtgggggagcggatgaccgcggtggccggccgggtcgccgacggcctgctcgtgcacccgctgtccagcgtggcctacctggcggagaaactggttccggcgctgcgtgaggcccgcggcggcgcactggacggcttccagctgggcctggccgcgatggtggtgctgggcgcggacgaggccgagcggtcccgtgccgagcaggcggtccggcggcagatcgccttctacgcctccacaccggcgtatcggggggtgctggacctgcacggctggggtgcgctggccgaccggctcaacgcgctgtcccggcggcaggactggaccgcgatggccgccgagatcaccgacgaggtgctggacaccttcgcggtggccggggacccggcggccgtggcggccgggctggtcgagcggttcggcgcgacgatcgaccggatctcgttgtacacgccgtacgaggcggaccgccaccagttggcggcggtccgcggcgcactgcgggcggcggcctag

SEQ ID NO: 584 - DNA, 345 bp, Actinoplanes utahensis
gtgaccgcgctggccgtggtcaacgcctggggtgacgtgctcggtccggacggccgcccggtgtgcggcggcgccgggacggatcagccggtggcctccttcggccgggagaacaccacgctcggcgtgctggtcaccgacgcgcggttgagcaagagcgactgtttcctgctggcgcagagcgggcacaccggtttcgcccgggccctgcacccggcccattcgcggtatgacggggacgccgtggtggccctggcaaccggggcgcagccggccgatctggatctgctgcgggcggtcgcggcggaggtgatggccgcggcgatccgggccgccctaggctga

SEQ ID NO: 585 - DNA, 234 bp, Actinoplanes utahensis
atgcatctggggaactggacgggggacggcaccggcgtcacggtgatcctgccgccgccgggcacggtcgggtcgggtgaggtgcgcggcggcgctccggcgacccgcgagttcgacctgctgcacccggcccggctggtcgaccgggtggacgcggtggtgctcgccggcggctcggcgttcggcctggccgccgcggacggtgtgatggccgagctgcgggagcctagctag

SEQ ID NO: 586 - DNA, 1866 bp, Actinoplanes utahensis
gtgagccgtcgcggatggagatgcgaccggtcgtgggtgaagggcgaccgcccgccgcacgctgtgcgcggattcgctgaccggtgcgggaggaggggctgccgggaccgccggggttggtgcgcgcggagggccgaatgtggcgactcacgaggggatgaaaccgcccgggccggggaacgacttcgtacggttaagtctggaattgatcatttagctcgccacccgcagcgtgtcccgggggacccgatgaccaccctgaccgagccgcccgcgcggcggagtttcttcgccgatctgggcgtccgccacaagatcggcgcgatcatcgcgatcagcgtcctggtgtcgctggtcgccggcatcctggcgacccgtgccctgagccggtcggcgtccgcggccgagcggctgtaccaggcgaacatgaccagcgccgcgaccctggccgccctggagacgatcgccgtctccacccgtaacgacctggccaacctgctgatctcccggtccgaggcggacaacgccaagtacgagaagcgggtgcaggacggtttcaccggtttcgcgtcgacgctcgccacctacaaggcggccggcccggccggtgacgcggcgacggtcgccgcgctggagtcgaactggaacgcgtatcgccaggtggtcgagaacacccagatcgccaacgcgctgagccggaacgtggatgcgtacgtcaaggtccgggacgagcagaccgcgccgatcaccgacaagatcaaggccggcttcgtcgcgttgggccaggccgagtcggcggacgcgcagaaggcggcggccggcgcgcagtcgacctatcacaccaaccggaacgtgatcctcacggtgcaggtgctcggcaacctgctggcgatcctgatcggcgtcctggtgatccgggcggtggtcggcgcgctgagccgggtccgggaggtctgcacccggctggcggccggtgacctcaccgggcagaccggtctgaccagcaacgacgagaccgggcagatgggccgggcgctggacaccgcgatggtcaacctgcggcgcaccgtcgcgacgatcgacgagtcggcgacctcactggccggtgccgcggatcgggtgcgggaggtggccaccgagatcgccggttcggcggagcgcaccaccagccaggcgcagaccgtgtcggcggcggccgaggagatctcccgcagcgtcgacacggtgtcggccggcagcgaggagatgggcgcgtcgatcagggagatctcgcagaacgccgccgaggccgcccaggtcgccggggccgcggtcgacctggcctcgcgcacctcggcgacgatgaaccagctcggcgagtcctccagcgagatcggcaacgtgatcaagacgatcaccgcgatcgccgagcagaccaacctgctggccctgaacgcgacgatcgaggccgcccgcgcgggtgaggcgggcaagggtttcgcggtggtcgccagcgaggtgaaggatctggcgcaggagaccgcccgggcgaccgaggacatctcccgccgggtggaggcgatccaggcggacacgaacggggcggtcaccgcgatcgaggagatcacccgggtgatcgcgcggatcagcgacttccagacgacgatcgcgtccgctgtggaggagcagacggcgacgaccgcggagatgaaccgcagcgtctcggaggcggcgtcgggcaccggcgacatcgcgcagaacatcaccggggtggcggaggcggcccggtccacgagcgagggtgtggagcggtcgcagcagacgacggccgagctgacccggatgtccggcgagctgagcgccctggtcaagggcttccgttactag

SEQ ID NO: 587 - DNA, 165 bp, Actinoplanes utahensis
gtgaccggttgggcgctgccgctggccgggctggatccgccgccgctgccccgcccgcactggccggcggtgcccgccctgctggcggtcgtcgcggcgctggccgtgacgttgggcgccaccgccgtgctctccggccgccgcacgctgcgccgcatccgttga

SEQ ID NO: 588 - DNA, 1047 bp, Actinoplanes utahensis
gtgatcgcggtggtgctcgcgatggtgcgggcgagaggtggggcggcgctcatgctggcggtgctggccgcgttcgcggtggctccggtggtggcggcgccggcgtatctgcgggcggcggaccgggtggtggcggccgggcaggtggcggcggcggatccggcggagcgggcggtcagcctgcaggcggtcgagggggattcgcgccggtcgaccggggatccggccgggcaggtggacctgtcgtcgaccggggcttcgctgatcggcctgccggggttccggtatgcgtacgccgccgagtttcccgccgtcggcctggaacccgacgcccggacaccgacccgcctggtgcaccggcaggacgtctgtgcccacctggtgatggtgaccggccgctgcctgctcggcgagggtgacctggtgctcggcgaggagacggcgcggcggctgcggctggcggccgggcggtcggtgagcctgtcgtacgcccgcttcgatcagaacccggactcgcagctctgggtgggtgacggggcggccaagaagttcttcctggccgggacctatcgggtcgccgacccgtccgatgtgtactgggggtcgcacggctacttcgcgttcgccgagacgccgggcgggacccgggccggcgaaccggccttcaccggcctggcgtcggtcaccgcgatggagcacggcgacgtgcagctcgccatcgacgggtatgcggggccgggcgcgctggacgccgaccggctgccggcgctgcgggccgggctcgacgaggtgcgccgcaccgtcaccgacctgggcgccggggacggtgtcagcacctccgcgaacctgaagctggtcacctccatcccggcgctgctggcccggatcgacgaggggcacgtgaccgcccgccggatcgtgccggtcccggccgtcgccctggtgctgctcgcctgcctggccctgctgctggcggccgcggccggggccgaggcgcgccgcccggagaccgcggtgatcgcgctgcgcggggcccgcgctagctag

SEQ ID NO: 589 - DNA, 831 bp, Actinoplanes utahensis
gtgatcagtgggcggtcgctcgtgctgaaggtgcgaaatgggcgtacggcggcggccaccgtcgatgcggtgctgctcaacgagaccagcggggcgcgggtggtggtgtcgttcgggccggtgccgcccggtgagcacgccgtgacccggccgctcgacggctgcgacggcggctgccggttgctgcgctgggagattcccagcctgcccggcgcggacgggaaacccacgcccgacccggtggtcctgcactcgctggcccggctcggcccggacgccgagctgatcggcccggcccggatggccgacgcgacccgctggcgtaccgtcgcggccggcgtcggcctgcaactcagcggcggtccggacggtctgaccgtcaccgccgcgccgaacggcggcacagccgacagcgaccgggtgttcgccgtggacagtctgctgccgctgcccgtgctgctggccggcccgacgccggtgccgtggcggttcgccgagccggagatcaccgtgctgggcgccgggccggtgccggcccgggtgaccgggacggccgccgcgctgccggtgaccggcgccgccgggatcctcctcgacttcgacacggtgcgccggacggccggggagttctcgccggccggcgaaacccaggtgtggctgaccgcgaacgccccgcccgacgtcgtcgaccggctcagggccgccggggtcaccgtgctcggcgacgagagcatcgccggccgggcggctcgccggcccggccggggcaccgccccggccggaccgttcgcgctgctctgcgcggtgtccgcggtgttcaccgctagctag

SEQ ID NO: 590 - DNA, 795 bp, Actinoplanes utahensis
atgccgacgatcctgtggggcgcggtacgttcccgggccgcgcaagcctgcacactcctgctgctcaccgggctgccggcggcggtcgccgcggccgcgccccggttcgtgctgaccgggaccgaacgggccgccaccgccgccgcggccggcgtccccgccgcccagcgcaccatcaccgtgcaccgggaagacgacacccagggcgacccggccgcgaccctcgccggattcggcgccgccgtcgaccgcaccctgccgatgcccggcgccgcaaccgtgctcggcctcagccggcagatgagcgtcacggacgccagcggcgtgcccaccccgatcaacgtcgactaccgcgccggcttctgccggcgggtccggctcaccgccggcacctgcccggccgcggccggcgacgccgccctcaccaccgcggtcgccacccgcctcggcgtgcggcccggcgacttggtccggatccagtcgaccagcgccgccccgttccttcccctccgggtcaccggcatctacgagatcatcgccccggaaaccggatactgggccgacgagttgtaccggaccggcagcggcaccgacccgatctacaccgccgccgccaccttcaccggcgaccagctcggccgggccgtcctcacctggtcggccgaggcgccgccggccctgctgcgcggcgccggcggctacgacctcggcgccctcgtcgcccgggccggcgaactcggcgacgtcgaagacccgaccggaccgctgcgggccgacctggccctagctagctag

SEQ ID NO: 591 - DNA, 930 bp, Actinoplanes utahensis
gtgaactgctgcaccccgtccggcggggaccgccccgcgggagaggtcccggccgtcgccgcgggcggcacccacaccgtcgaccaggcccgcgtgcccgggcagacgttcgcgatgggcgacgcgcacggcgacgggcacccggccgacggtgaacaaccggtgcacccggtcaccgtgcccgggttcacgatcgacgtgaccgcggtgaccgtcgccgacttccgggcgttcgtgaccgccaccggcttccgcaccgacgccgagcacttcggctggtcggcggtcttccactcggcggtcgccgacccggaacgggtggccgggcggatggccggcacaccctggtggctcggcgtcgggggcgccgactgggcacacccgggcggaccgtccaccgtggccctcgacgaccacccggtggtgcacgtcagctggaacgacgcccaggcgtactgcacctgggcgggtcgccggctgccgtccgaggcggaatgggagtgcgcggcccgcggcgggctcgaccggctgcgctacccgtggggcgacgacctgccggccggcgacgactgggcatgcaacatctggcagggcgacttcccggtacgcaacaccgcggaggacgggtgggtcacgaccgcgccggtacgggcgtatgcgcccaacgcgtacgggttgcaccaggtggtcggcaacgtctgggaatggtgcgccgactggttctcaccgcggtactacgccgtctcgcccggcgacgacccgcgcgggccgtcacggggcgccgcgcgggtgatccgcggcgggtcctacctgtgccacgactcgtactgcaaccggtaccgcaacgccgcccgatcgtcgaacacccccgattcgtcgaccggcaacatgggtttccggacggtggtgctgtccatatcagagggataa

SEQ ID NO: 592 - DNA, 882 bp, Actinoplanes utahensis
atgagcatcgagttcggggttttcgtgccgcagggctggcggatggatctggccgagatcgacgacccggtggagcagtacgaggcgatgaccacggtggcccggctggccgacgccgggccgtgggacagcctctgggtctacgaccacttccacaccgtgccggaaccgacgatcaacaccaccttcgaggcgtggacggtcagctccaccctggcccgggacaccagccggatcaagatcggacagatggtcggctgcaacgggtaccggcacccgtcgctgttcgccaagatcgcgtcgaccgtggacgtggccagccacggccggctgctcgccggcctgggcgcgggctggtacgagcacgagtggaaggcgtacggctacgagtggaccgacgtgccggagcggatgcgggcgttccgcgaggcggtggagatcgtgcaccggatgtggaccgaggagcggccgagcttcaccggccggcactaccggatcgaccagccgatcaacgagccgaagggtgccggccggcgcaagcccgacctgtggctcggcggcggcggcgagaaggtgacgctcaagctggtcgcgaagtacgccgacggcagcaacgtgggtgacggcaaaccggacgtgatccggcacaagctcgacgtgctccgccggcactgcgacgagcagggcaccgactacgaccggatcgccaagtcgaccagcctcacggtgcgcaccggggacaccgtcgcgtcgatccgcgagcgggtcgagcaggtggccgaggccggggtgaactacgtgatcctgtacttcgagcgggtcgcctacgaccacgagccgctgctcgccgccgctcaggaggtcgtcccgcgcttcgcctga

SEQ ID NO: 593 - DNA, 1038 bp, Actinoplanes utahensis
atggttgccggcaagcaacggatcaccatagcggccatcgcggacgccgccggcgtctcggtgccgaccgtctcccgcgtgctcaacgggcgcaccgacgtgtcgccgcagacccgcgagctgatcgagcgcctgctgcgcgagcacgactaccgccctcgcaactctcggcactccggccgggcccgcctgatcgacctggtcttcaacgacctggacagcccatgggcgctggagctggtgcgcggcgtcgaggacgtgacccacgcggccggcgtcggcaccgtcgtctcccaggtgcaccaccgcaccaccgccacccgccagtggctgcagaatctgcgcgcccgcgcctccgacggcgtggtcttcgtgacctcggacatcgccgagccggtgcacagcgagctgcaccgcctgcgggtgcccgtggtgatcatcgacccggccggcggggcggccaccgacgtgccgacgatcggcgcgaccaactggtcgggcgggcgcaccgccaccgaccacctgatcagcctcggccaccggcggatcgggttcatcgccgggccgaaggatctgctgtgcagccgcgcccgcctcgacggcttccgcgccgcgatggaggcggccggcgtcccggtcgacccgagcctgatggagcagggcgacttccgcaacgagtccggcttcctggccggcggccggctgctcgaccagcccgaccgccccaccgcgatcttcgcctccagcgaccagatggcgctcggcgtctacgaggcggcccgccgccgcggcctgcgcgtcccggacgacctcagcgtgatcgggttcgacgacctgcccgacgcgtgctggtcgtccccgccgctgaccacgatccgccagcccctggcggagatgggggcactcgccgcccggacagtcctgcgcctgtcccgcggcgagacgatcgagactccccgggtcgagctggtcaccaagctggtcgtgcgggaaagcacgaagtccctcgccgagacccgcgctccggccgccgcctga

SEQ ID NO: 594 - DNA, 900 bp, Actinoplanes utahensis
atgacgaccacgctcgacagccggcggaccggacaggccgcgcacacgcccccgcccccggccggccggcgctcccggctgctgcagtataactggttcggcgggctggccggctggctgtggctgttggtggtgctcgtcccgatctactggatcgtgatcaccagcttcaagctgcagtccgactacttctccaccaacccgctggtgccgccgtcctcgccgaccctggagaactaccggttcgtgctgcagaacgacttcgtccggtacttcttcaacagcgtgatcgtcacggtcggcgcggtcgccccggccatcgtggtctcgttcatggccgcctacgcgatcgtgcggggcagcgggttgagccggttcctgcgcacggtcaacgggctgttcctgatgggcctcgcgatcccgctgcaggcggtgatcatcccggtctatctgatcatcatcaagctgcagatgtacgacacgctcggcgccatcatcctgccgtccatcgcgttcgccatcccgctgtcggtgctcgtgctgtcgaacttcatccgggacatcccgaaagagctgttcgagtcgatgcggatggacggggcgaccgagtggggcacactgtggcgcctggcgctgccgctgacccgaccggccctgatgaccgtcaccatctaccagggtctgcaggtgtggaacggcttcctgctgccgctgatcctgacccaggacccgaaccagcgcacgctgccgctggccctgaccgcgttccaggggcagtacaacatcaacatcccggcggtgctggcctcggtggtgctgaccaccctgccgatcctcaccctgtacgtgctggggcgccggcagatgctcagcggcctgaccgccggcttcggcaagtga

SEQ ID NO: 595 - DNA, 927 bp, Actinoplanes utahensis
atgaccatcgcaccgcccgtcgtgcggtccgctccgcccgccgcttcccgcggcgcgcggagcgtctccgtctcctggatggcctggcccgcgctgatcgccttcaccatcttcggcgtcatcccgctgctcggtgtgctggtgctcagcttctcgtcgtggagcggcctctcccagaacatcccgttcaccggtctggacagctggaagtccgtgctgaccgacccggatctgccgcacgcgctcggggtcaccttcctcatcatggcgctctcctggctggcgcagacgccgctgtcgatcctgctcggggttttcatcgcggcccacaagcggtaccgcagcgtgctcgcggtgctgttcttcgtcccgctgctgctcagccaggcggccatcgcgatcaccttcaagatgctgctcgacccgaacttcgggctcggcgccagcctgggctggggcttcctgcagcaggactggctgggcgagagcaagctggcgatcggcgtggtcatcttcgtggtgtcctggcagtggatcccgttccactcactgatctaccagggtggcgtccggcagatcccggccgcgatgtacgaggccgccgagatcgacggcgcgggccggatccggcagttcttcagcatcaccctgccccagctcaaatacacgatcatcacatcgtcgacgctgatggtggtcggctcgctgaccttcttcgacctgatctgggtgctcaccgccggcggtcccggcgactccacccgagccctcgcggtcgacatgtaccagcgcggcttccggaccgcgatgatgggtccggccagcgccatcgcggtcgtcctggtgctgctcggcctgggcctggccctgctggtgcgccggatcggtggccgggacgcgaccgaaagccagctggaagggatctga

SEQ ID NO: 596 - DNA, 1326 bp, Actinoplanes utahensis
gtgaaacgcaggagtttcttgagtctctccgcgggcgccgccgcggccaccggacttgccgcgtgtggcaactcgggtcccgccgactcgtcgaagggcggttccggcagcggcgacgccgccagttactggttcctcagcggcccgcccggacagccgatccgccagggcgcggtcgaccggttcaacaaggcgaacccggacaaccaggtcaaggtcaccacgttccagaacgacacgtacaaggacaagctgaagacggcgctcggcgcgggccaggcccccagcatcatctggggctggggcggcggcggcctcaagagctacgtcgacgccggccaggtcgacgacctgaccgactggttcagccagaacgccgcggtcaagaacaagctgttcccggcctcgttcggcccggccacggtgaacggcaagatctacgcgatgccggcggagaccgtgcagccgatcatcttcctctacaacaaggaggtgttcgagaagtgcggcgtggccaacccgccgcagacctggggtgagctgctcagcatcctgcccaagttcaacgacaagggcatcgcgccgatctcgctggccggccagtcgcgctggaccaacatgatgtggctcgagctgctcttcgaccggatcggcggccccgaggtcttcggcaacgcctacgacgggcagaaggacgcctggagcaacccggccgcgatcgacgcgctcaccaaggtccagcagctggtcgacgccaagggcttcgtcaagggcttctcgtcgatcaccgcggactccaacgccgaccaggcgctgctgtaccgcggcaaggccgccatggagctgcacggctcctggtcctacggcatcatcaagtccgacggtggcagcttcatcaaggacggcaagctcggctacttcaacttcccggcggtcgagggcggcaagggcgacccgagcaacgtctacggcaacgccgggcagttcctgtcgatctactccaaggcctccgacaagcagaaggagaccgcgaagaagttcttcgccagcatgctcgacgaccaggagcagcagggctggatcgactcgggcggcgtcccgatcgtccagggctcgaacgccaagctggcgtcctctccggacaaggacttcctcaccttcatctacgacgtctccagcaaggccaagaacttcggccagtcctgggaccaggcgctgagcccgtcggcggccgagacgctgctggacaacatcgccaagctcttccagaagcaggtcaccccgcagcagttcgccaccaacatgaacgcggtcatcggcaaatga

SEQ ID NO: 597 - DNA, 2373 bp, Actinoplanes utahensis
ttgaccacagaacaggtgaccccgccgtggcgcgacccgtcgctgcccgtcgccgaccgcgtcgaggcactgctcgccgcgatgaccctcgaggagaaggtcgcgcagctgggcagtcgctgggtcggcaacgacatgggtgacaccggcgaggaccagggatacgacccggaggagcagcacaacgtcgccccgatgcaggacgtcttcgcggccggcggctcgatcgcgctggccgacgcggcccggcacgggctcggccacctgacccgggtctacggcagcgtcccgcgcaccccggccgagggcgccgccgagctcgtcgagcagcagcgcgtggtgatggcgagccggctgggcatcccggccatcgtccacgaggagtgcctgaccgggttcaccgcgttcggcgccaccgtctatccggccgcgatcgcctggggcgccaccttcgacccggaactgatcgagcggatggccgccgcgatcgggcgggacatggccgcgctcggtgtgcaccagggactgtccccggtgctcgacgtgatccgcgactaccgctggggccgggtcgaggagaccatcggcgaggatccgtacctggtctccctgatcggcgcggcctacgtgcgggggctgcagagcggcggcgtgatcgccaccctcaagcacttcgccggctattccgcctcgcgcggcgcccgcaaccacggcccggtgccgatgggccgccgggagctgaccgacgtggtgctgccgccgttcgagaccgcgatccgggccggcggcgcccgctcggtgatgaactcctactccgacgtcgacggggtgccggccggcgccgacccgtggctgctcaccgagctgctgcgggatgagtggggcttcaccggcacggtcgtctccgactactgggcggtcccgttcctggccaccatgcacggggtcgccgaggacgacgtcgacgccggcgcgcaggcgctgatcgcgggcatcgacgtcgagctgccggacaccatcggtttcggtgccggcctgatcgagcgggtccggcgcggcgagctgagcgagcggtacgtcgaccgggccgcccgccgcctgctcacccagaaggccgagctgggcctgctcgacccggactggtcgccggagaagtcggtggccgcggccccgctcaccgacctgaacgcggccggcaaccaggcgctggccgccgagctcgccgagcgctcgatcgtgctgctggagccgggcaccgcgctgccggtcaccgccgcgggccggatcgccgtgctcggcccgtgcgccgacgacgcccgcaccttcctcggctgttacgccttccccaaccacgtgctcccccgctatccgcagctcggcctcggcctggagatcccgaccgcgctggacgggctgcgcgcggagttcccggccggtgagatcacctacgcccgggggtgcgaggtgaccggggacgaccgcggtggtttcgcggcggcggtcgagacggcccgggacgccgatctggcggtggccttcgtcggcgacctggccgggctgttcggcaagggcacctccggggagggctgtgacgccgcggatctgcggctgcccggtgttcagccggagctgctggaggagctgctggccaccggcaccccactggtcgtggtggtggtctccggccggccgtacgcgctgggcgacctggacggccgggtggccggactggtccaggcgttcatgccgggccaggccggcggcgccgcgatcgccggcgtgctcagcggccgggtgcagcccgccggccggctgccggtgcagatcccgcggcacccgggcggccagccgggcacctacctgcagccgatcctcggggccacgcacgccgaggtgagcaacctcgacccgcggccgctctacgacttcgggtacggccggtcgtacaccgcattcgcggtcggcgatctgcgggtcagcgcggacacggtgccgacagacggcgagttcacggtgaccgtgcgggtccgcaacaccggcgagcgggacggtgccgaggtggtccagctctatctggccgacccggtcgcccaggtcacccgtccggtgcggcagctgtccggtttccggcgcgtcgagctggccgccggcgccgccgcggacgtgaccttcaccgtgcacaccgatcggaccgcgttcaccggtcgtgacctgcggcgcatcgtcgagcccggtgagctgcggattctcgtcggcacctcggccggggacctgccctgctcggccaccgtccggctgaccgggccgacccgtgcggccggcgccgaccgccggttgaccaccggagtccaggtgcggccgatcgcgtcctga

SEQ ID NO: 598 - DNA, 1203 bp, Actinoplanes utahensis
gtgcctccccgcatcaacgacgacgagcggatccgccggttcgaggcggtcaccgacgcggcgttgtcccggctggacgtctcggacctgctcgacgagttgctcgaccgggtccgggacctgctcgacgtggacaccgcggcggtgctgctgctcgacgagcacgcccagcagctggtggccaccgcggccaagggactggaggaggaggtccgggccgggttccgggtggccgtcgggcgcgggttcgccggccgggtggcggccacccggcggccgctgcggctggccgaggtcaccgcggacgacgtggtcaacccgatcctgctggccaagggcatccggtcgctgctgggcgtgccgatcctggcgggcaccgagctgatcggggtgctgcacgtcggttccctcacgccgcggcggttcggtgctgacgacgtacggctgatggagctcgtggcggaccgcgccggcgtggccggccggatccggagcgacaagatggagcaggccgcggccctggcgctgcaacgcagcctgctgcccacccggctgccggaggtgcccggcgtcgagctggccgcgcggtatgtgccgggccacgcggtcggcatcggcggcgactggtacgacgtcttcccgctgcccaccggctggctgggcgtggtgatcggcgacgtctccggccacggcctctcctccgccgtggtgatgggccggatccgcagcgccctgcggtcttacgcgttgatctgcgacaccccggccgaggcgctcaccctgctcaaccgcaaggtgcaccacttcgaggcgggcagcctgaccaccgcgctgtacgggatggtcagcccggagcgggaccggatcgtgctctcctcggccgggcatctgcgcccggtcctggcccgcccgggccacccgggcgggctggccgaggtgccggtcgatccgccgctgggcctgggccggacccggccgcggcgcaacggcatcgtggcgttcccacccggcgcggtgctgctctgctacaccgatggtctcgtcgaacggcgggatcaggtgatcgataccggattggcgcacctgaccggcctgatccgggcggagaatgcggaggcggtgtgcgccacggcgatgagcgcggtggacaccgagcaaccgggcgacgacgtggccgtgctggccgtgcgccggtcgacatga

SEQ ID NO: 599 - DNA, 1437 bp, Actinoplanes utahensis
atgaccgccaagcagattctgcacaacttcgtcggcggcgccgcggtcgcgcccgccgagggccgatatgcggatctcgtcgacccgtccaccggcgaggtgttcgcgtccgccccggtctccggccgggaggacgtcgaccgggccatggcggcggccgccaccgccttcgaggactggcgcaccaccaccccgagcgaccggcagaaggcgctgctgaagttcgccgacgcggtcgaggcgcggaccgccgacctggtcgccgccgagtcgcgcaacaccggcaaaccgctgggcctgaccaccagcgaggagctgccgcccgcggtcgaccagatccggttcttcgccggcgccgcgcggctgctggagggccgctccgccgggcagtacatgaacggtttcgaaagctacgtccggcgcgagccgatcggcgtctgtgcccaggtcaccccgtggaactacccgctgatgatggcggtctggaagatcgcgccggctctcgcggcgggcaacaccgtggtgctcaagccgtccgacaccaccccggtctccaccgtgatgctggccgagatcgccgccgagttcttcccggccggcgtcttcaacgtggtgctgggcgaccgggacaccggccgcgccctggtcgagcaccggaccccgcagatggtgtcgatcaccggctcggtgcgggccggcatggaggtggcctcgtcggccgccgccgacctcaagcgcacccacctggaactgggcggcaaggccccggtcgtggtcttcgaggacgccgacgtcgcggcggccgccgccgacatcgcggtcgccggctacttcaacgccggccaggactgcaccgcggccacccgggtgctggtcgccccggcgatctaccgggacttcgtggccgccctcgccgagcaggcccgcgcgctgaagaccggcgcgcccgaggacgaggacgcgctgtacggcccggtcaacaacgccggccagctgtcccgggtggccgggttcatcgaccggctgcccgaccacgcctcggtcgaggcgggcggcgcccgggtcggcgaccgcggcttcttctggtccccgaccgtggtggccggcctgcgccaggacgacgagatcatccagaacgaggtgttcggcccggtgatcaccgtccagcagttcgccgacgaggacgaggcggtgcgctacgccaacggcgtcgactatgcgctggcctccagcgtgtggacccgcgaccacggccgggcgatgcggatgacgcagcggctcgacttcggctgcgtctgggtcaactgccacatcccgctggtcgccgagatgccgcacggcggtttcaagcactccgggcacggcaaggacctttcggtgtacgggctggaggactacacccgcctcaagcacgtcatgcacaacgtgggagcctga

SEQ ID NO: 600 - DNA, 1272 bp, Actinoplanes utahensis
gtgtccacctcagccgagctgcaccggcgtcgtctcgccgcggtcgccaagggggtcggttcgaccatcgcggcctatgtggaccacgccgccgacggcaccctgaccgacgtcgacggccgggagtggatcgacttcgcctccgggatcgcggtcaccaacgtcggcaacgccgcgcccaaggtcgtcgaggcggtccgccggcaggtggaacggttcacccacacctgcttcatggtcgccccctacgagtcgtacgtcgcggtctgcgagcagttgatcgcagcgaccccgggcaccttcgagaagcgggccgcgctgttcaactcgggtgccgaggcggtggagaacgccgtcaagatcgcccggcacgccaccggacgcccggcggtcgtggtgttcgaccacgcctaccacggccggaccaacctgaccatggcactgaccgcgaagaacatgccgtacaagcaccggttcgggccgttcgccccggaggtgtaccgggcaccgatgtcgtacccgctgcgcgacggcggcctggacggcgccgaggcggcccgccgggcgatcgacgtgatcgagaagcaggtcggcgccgggaacgtggcggccgtgctgatcgagccgatccagggcgagggcggcttcatcgtgccggcccccggattcctgccggcgctcgcggcgtgggcggccgaggccggggcggtgttcatcgccgacgagatccagaccggcttctgccggaccgggcagtggttcgccgccgagcacgagcggttgcagcccgacctgatcaccacggccaaggggatgggcggcgggctgccgatcgccggggtggtcggccgggccgacctgatggacgcggtgcacgccggggggctcggcggcacgtacggcggcaatccggtggcctgcgccgccgccctggccgccatcgagaccatgcgcgatcgggatctcccggcggcggcccgccggatcgggtcggtcctgctgcccgcgttgaccgccctgaaggacgagggaatcgccgacgtccggggccggggcgcgatgatcgccgtcgagctggtcaagccgggcggcatcgagcccgacccggtccgcacggcggccatctcccaggcctgtcacgcggccgggctgctcacgctgacctgcggcacctacggcaacgtgctgcggttcctgccgccgctggtgatcccggacgccgcgctgcaccgcggcatcgacatcctgaccaccgccttccacgacaactga

SEQ ID NO: 601 - DNA, 492 bp, Actinoplanes utahensis
ttgcccgagcacgtcctcacaggaaagaatctcgccgtgagtgacacgggcctggacgagatcaacaagcagatcatcgatcacctgcagcgcgacggacggatgtcgtacgccacgctcgccaagacgatcggcctgtccgaggccgcggtgcgccagcgcgtgcagcggctcctggacaacgggctgatgcagatcgtcgcggtgaccgacccgctcacgctgggcttcgcccggcaggcgatggtcggcctgcgggtcaacggcgacctgcgggagatcgccgacaggctggccgccatccccgaggtggactacgtggtgatctgcgccggccgctacgacctgctggtcgagctggtctgcaccgacgacgagcacctgctcgacctgctcaacgagaaggtgcgggtgatcgacggggtgaccgccgccgacaccttcatgtatctcaagctcgccaaacagacctacgcctggggaaccagataa

SEQ ID NO: 602 - DNA, 1233 bp, Actinoplanes utahensis
atgagcttctggctggagacgctcggcccgatcgagcggcgcccacccctgcccggtgaccgggacgccgacgtggccatcgccggcggcggctacaccgggctgtggaccgcgtactacctcgccaaggcccggcccgacctgcggatcgtggtgctggaggcggagttctgcgggttcggcgcgtccggccgcaacgggggctgggcgtccggcctgttcccggtcgccgaggcgaaactggcccggcggtacggcgcggccgccgcccgggccatgcacgccgcgctggccgacgcggtcgacgagatcggccgtaccggcatcgcgtgcgactacgccaagggcggggtcatctcgctgatccgcacccccggccagctgcgccgggccggcgccggggcgatggacgcggcggccgcccgggcgatctgcggcgcgaccggcgtgctcggcggcgtctacagcgagcactgcgcggcgctgcatccggccaaactggtccgcggcctggccgccgaggtggaacggctcggcgtcagcattcacgaggacacccgggtgctgacgctgaccgacggcgaggtcagcaccgaccgcggccgggtgcgctgcggcaccgtggtccgcgcgctggagggctacaccgcggagctgcccggccaccgccgcgatctcgccccggtctactctttgatgatcgccaccgagccgctcccggccgaggtctgggaccggatcggcctgcggcgccgggagacgttcagcgacgaacgccggatgatcatctacggtcagcggaccgcggacgaccgcctcgccttcgggggccgcggcgccccctaccacttcggttcccgggtccgccccgagttcgaccgggtcccggccgtcttcggcagactgcggcacacggtcggtgagctgttcggcatcgacgtgccggtcgccgcccgctggggcggcccgctcggcatcccccgcgactggatgcccggcgtcggcctgcacgacggcatcgcctgggccggcggctacgtcggcgacggcgtggccgccagcaacctggccggccgtaccctgaccgacctgatcctgggccgcgacaccgagctgaccgcgctcccctggaccggccaccggtcccgccgctgggagccggagccgctgcgctggctcggcatcaacggcggcctgcacggcaccgccctgctggacgtcctcgaccgctga

SEQ ID NO: 603 - DNA, 1932 bp, Actinoplanes utahensis
gtgcaagcgggccgggctgaccgtgctgcgcgcgccggacgggcaggccgccttcgagatggtcgtcgagaaacacccggacgcggtgctgaccgacctcggcatgccccggatggacggctgggaactgatccgcgcggtccggtcgaaccccgaggtcgccgacatcccggtcgccatcctcagtggccagctcactcccggcgacccgcgcgccgcccacgccgaggcctgcgcggtgcttctcaaaccctgtccgaacgagcggctcctggccaccatccaggacctgctggcacacggcccgcacgcgcacgcccagcgctgcgcggtgtgacggtgcagggcgtcccggacagcgacgcctttctcggcgccctgctggagagcctcaccgtgggcgtggtcgcctgcgacgcggacggccgggtggtgctggtcaaccggacgatccgcgaggtccgcggcttcccgctggacggtccggtgccggccgactacgtggcgagcaccgagcgggtcctggccacccccggccggccgccgatgacctgggagcggaccccgctgatgcgcgccctgcgcggcgagcacatcgtcgccgaggacgtcctgatccagtgtccggaccagccggtgcgggtcttcgcgtgcagcgcgcagccgatccgcgacgccggcggcggggtgctcggcgcggtggcgatcgggcacgaggtgaccgcgctgcaccgggcggaacgcttccgggactgccacctcgccgtcgaacaggcgctgaaacgggcgaccacggtgcgggccgcggcccccgaggtgctgcgcgcggtggtggagacactcggctggccgtgcgccgagttgttcgtgatcgacgaggcggcctgcggcgggctgcgggccgtcgggcactgggacaccggatgcgccgcacccgacgacgacttcttcgggcacgtgccgcgccgcggcgaagggatcaccgggcgggtctgggagaccggccgggccatctgggtgtcggacatcagcgcccaccgggatctgcggacctcgtacgagcgggagcgggtcgggatctgcatccgccgcggcatccgcaccgtgctcgccgtgccggtgcacgacggtgacaccctgctcggcgtgctcacctgttatgccggcgcccgggaacgccacgaggaactgctcaccgtcctgatggacggggtggccgcgcagatcggcgtgttcgtggcgctgcgccgcgccgaggaactcgcccggcagctggcccgggcgcagaacgacttcgtcgacctgatcgggcacgagatgcgcaccccgctcacctcgatcaccgccaacgccaccatcctcgccgaggaggcggccgggctcgaccacgacggccggcagatggcccgcaccatcgcccgcaacgccgccgtgctgcaacggatcgccgagtcgctgctcgacctggccggcctcgacggcgggcacctgaccgtggcgaaacgaccggtggacctggccgccctggtcggggacgcggtggcggccgcgcacgccccgatcagcgccgacctgcccggcgaactgccggtgccgggcgacccggaccggctccggcaggccctcgacgacctgttggccaacgcggtcaaatacagcccgcccggcgcaccgatccgggtcaccctgtgcggcgacgagacctccgccgagctgtgcatcgccgacaccgggatcggcacccgtgaggacgagcgggaccgggtcttcgaccgcttcttccgcggcagcaacgtgcggcaccaggggacgcacggcagcgggttggggctcagcctggcccgctccatcatccatctgcacggcggcaccatccaactggccgccaacgatccgagcggcaccgtggtctgcgtccgcctgccccgctga

SEQ ID NO: 604 - DNA, 1170 bp, Actinoplanes utahensis
atgtcggcgacctcggggttcgaccggaccgcgcggatcagttcccagccgtccatccggggcatgccgaggtcggtcagcaccgcgtccgggtgtttctcgacgaccatctcgaaggcggcctgcccgtccggcgcgcgcagcacggtcagcccggcccgcttgcacacccggaccaggacggcggcgatgtcctcgtcgtcctcggcgatcagcagtacggccactccgtcagcatgcgctcaccggtgcgcgcccggggaggtttccgcgcattgccgcgcccaccctatcgagcgctgcgccgcccggtgcggaaaccgctccccaccccggggggagaaacctttccaccgattcgcgggtacgcatgccgctccgcccgttcccaccgagcggatcatcgcgaccatcgataccctcgatcaggtgacgtcacaactaccgatcgtgttcatcgcggccctgggtgaaccgggccggtactggcagcccgtgctggaccgcctcggcgacctgaccaccgtcacctacgaccgtcccgggatcggcgatgcgccaccccgcccggcgccccgcccaccggtggcctacagcgtgctcgccgacgagctggccgctctgctcgacgcccgcggggtgcccggcccggtggtggtcgccgcccattcgatcggcagcctgatcgcccgggtgctggccgatcgccacccgcaccgggtggccggcctgatccacatcgacggctcgatgccccagttccacctgctgcccggcctggagtcgccggaggacggggagaccggcgacccggacgccgcggtgctcgacatcgtggccggccagaccgaggtgctgtacgccgcctcgcccaaggtccccaccctggtgctgacccgcaccccgggcgcctgggacgggcggcatccggccccgcccggcgccgaggagctgtggctggcccaccagcgcgccctggcccgcgacgcgggcgcgccgctggtggtcgccgacgattccggccactacctgcccaccgtccaacccgatctggtggcctacgcgatccgcgccgtgcacaccgccgcggtcaccggccggccggtggagctggatccgaccgccctgcgcgcggccggcgggcaccgcgaccgggccgtcacccattag

SEQ ID NO: 605 - DNA, 414 bp, Actinoplanes utahensis
atgaccgacagcgggctgagcatcggggagatcgcccggcggaccgggctgaccatcgacaccctgcgtttctacgagcgggcgggtctgctgacccggccggtcgaacgggatgcggcgggccgccgggtgtatcaccaggaggacgagggctggctggagatctgcaccaacctgcgcagcaccgggatgccgttgagcgagatcaaacgcttcgccgacctggtccgggccggcgccggcaacgagggcgagcgcctggcgttgctgcaggagcaccgggagcgggtcgacgagcagatccgccgcctgcagaagttccgcgaggtgatcgactacaaggtcgccgtctacgccgagcaggtcactcagggcaccgccgccacgttctggaccggcgtcggcaccgggtga

SEQ ID NO: 606 - DNA, 1383 bp, Actinoplanes utahensis
atgaccgaccgacagcctgatgacgtggacgcactctccgcgaccgcccgtgaccacctctggatgcacttcacccggctctccgcctaccgggacgccccggtgccggtgatcacccgcggtgacgggtgctacgtgtgggactccgccggccggcgctacctcgacgggctctccgccctgttcgtcgtccagaccgggcacggccgccaggagctcgccgatgccgccgccaagcaggccgccgagctggcctacttcccgatctggtcgtacgcgcaccccaaggcgatcgagctggccggccggctcgccgagatggcccccggcgacctgaaccgggtcttcttcaccaccggtggctccgaggccgtcgagtcctcgtggaagctggcccggtcgtacttcaagcggatcggcaagccgctcaagaccaaggtgatctcccgcgcggtggcgtaccacggcagttcgatgggcgccctgtcgatcaccggcatcccgccgttcaaacaggacttcgagccgctgatcccgagcaccatgcgggtgccgaacaccaactactaccgccggcccgacgagaacatgacacccgagcagttcggcgtctgggccgccgaccggatcgcggagatgatcgagttcgagggcccggacacggtcgccgcggtctacctggagccggtgcagaacgccggcggctgtttcccgcccccgcccggctacttccagcgggtccgccagatctgcgaccggtacgacgtgctgctcgtctcggacgaggtgatctgcgcgttcggccggctcggcgagttcttcggcgccgaccggtacgggtaccagcccgacatcatcaccaccgccaagggcctcacctccgggtacgtcccgctcggcgcgatgatcgcctcggaccggctggccgagccgttcctggacggcaccaactggttcgcgcacggcatcacctacggcggccacccggtcggcgcggccgtcgccctggccaacatcgacatcatgcagcgggagaacctgaaccggcacgtccgggagaacagcccgctgttccggtcctacctggagaagctgctcgacctgccgatcgtcggcgacgtgcgcggcgacggctacttcttcggcatcgagatggtcaaggacaaggcgacgaaggagaccttcaccgccgaggagtccgagcggctgctgcgcggcttcctgtccagcgccctgttcgaagccggcctgtactgccgcgccgacgaccggggcgacccggtgatccagctggcgccgccgctgaccgcgaccgagacccagttcgccgagatcgagcagatcctgcgctcggtgctcaccgaggcgtggaaccgcctctga

SEQ ID NO: 607 - DNA, 1401 bp, Actinoplanes utahensis
atgggagatcccttccatacccccctcgccgaggcgatcggggagccgtactggctgatgcaggacggcgccccggccccggcggaacccctcacgggtgtcgcacaggcagacctcgccatcatcggagccggctacagcggactgtggaccgcgctcctggcgaaagaacgagatcctgaacgggatgtggtagtcatcgaggccggcacggccggctgggcggcctccggccgcaacggcggattctgctccgccagtctcacccacggcttcgacaacggcatcagtcgcttcccggccgagatggagttgctcgaacggctcggcctggagaacctcgacgagatcgaggcgacggtccggcggtacgacatcgactgtgactgggagcggaccggagagctgaacgtcgccaccaccgactggcagctgcaggagcttctggagtattacgacgaggcccgggagcgcgggctcaacgtgcgcaggttcgaccgcgacgaggtgcgggcggagatcgactcgcccacctacctcggcgcggtgtgggacgtggactccaccgcgctggtcgacccggcccggctggtctggggactccgcgaggcgtgcgccgagctcggcgtccgcttctacgacaacagccgggtggagaagatcagcgcgaagcgtggcgtgctgcggctgcacacctggcggggccggctcgaggcgagacaggtggcgctggccaccggcgcgcacgggcagctgctgcgccggctgcgccactgggtcgtgccggtctacgactacgcgctgatcaccgagccgctcaccgcggcgcagctggccgcggtcggctggcggcagcggatgggggtcggcgactcggccaaccagttccactactaccggctgaccgcggacaaccggatcctgtggggcgggtacgacgcggtgtactacaacggcggtcggatcgcccccgagcgggacctgcgcgaggagacgttccggctgctggccgagcacttctacgagacgttcccgcagctggccgacgtacggttcacgcacaagtggggcgggatcatcgatacctgcagccggttcagcgcgttcttcggcaccgcgttccgcggccggctggcgtacgcggtgggttacaccggcctcggcgtgggggccacccggttcggcgcgaaggtgatgctcgacctgctcggcggagagcagacgccgctgacccggttgaagatggtgcgccgcaagccggtgccgttcccgcccgagccgatccgctcgtgggtcatccaggtgacccggaggtcgatcgcgcaggccgaccgcaacggcggacggcgcaacctgtggctgcgcacgttggacagattcgggctgggcttcgactcgtag

SEQ ID NO: 608 - DNA, 849 bp, Actinoplanes utahensis
atgaccacctcgacgctcaccccacccgtcaccgcccccggcgcggccccgcgccgtcggttccggatcaccggcgccagcctgatgttcggttacacctggctggtcatcctctggctggtcctgcccatcttcgtgatgatcctgttcgggttcaacaacccgcacggcaagttcaaccagacctggcagggcttcacggtcaagtggtacaaggacatcttcgggctcgacgagctcacctcggcgctgtggttgtcgctggtcatcgcggtgatcagctcgctgctcgccgccgcggtcggcaccggcatcgggtacgcgctgggccgctaccagttccgcgggtcgggcacgatcaacctgttgctgttcgccaccatggcgtcgcccgagctgatcatgggtgcctcgctgctgagcctgttcgtctcgctcaacaccggccggggcgtggcgacgatcgtgatcggtcacgtgctgttctcgatctcgttcgtcaccaccgtggtccgggcccgggtgatcaccctggaccggtcgatcgaggaggccgcggccgacctcggcgccaccgcctggacgacgttctggaaggtcaccttcccgattctgttgccggccatcttctccggcttcatgctcgccttcgcgctgtccatcgacgacttcgtggtcaccaacttcgtctccggcagcgcgaccacgttccccctgtacatctggggagccacccgggtcggcctgcccccgcaggtcaacgtgatgggcacgctgatcttcgcggccggcgtgctgatcgcggtcatcgccaaccttcgatcaagatccacatcaaaacgggactga

SEQ ID NO: 609 - DNA, 864 bp, Actinoplanes utahensis
atgaaccgggtaaaacgcacactcgcgccctacctgctcgtgctacccggcgggttgtggctgctgctgttcttcgtggtgccgatggccaccatgttctcgctgtccctgcagcagggcgacgtcatcaacggctaccggttcaccggtcattggcagacgtacgtggatgccatctccgactaccgggtgcagttgatccgctcgctggtgtacgggctcatcacgacggtggtgctggtcgtgatgagcttcccgatcgcgtactggatcgcgttccacggcgggaagcggaaatcgacgtacctcttcctgctgctcctgccgttcttcgtgtcgttcgtgctgcggacgatctcgtggcggcagatcctcaccgacgacggggtgctgctgcatccgctcaaggaggccgggctgctctcacccggcttccacatcctcggcacctcgtacgcggtgatcttcggcctggtctacaactcgctgccgttcatggtcctgccgatctacgtggcgctggagcggatcgacccgcgggtgctggaagcggcccgcgacctgtacgccaagccgccggtcgtgttcagccgggtggtcctgccgctcgcgctgcccggggtcttcgccggtgtgctgatgacgttcgtgccggccagcgccgactacgtcaactcgcaggtgctcggcagtgccagcaccaccatgatcggccaggtgatccaggcgcagtacctggccagttccaactacccgacggcttcggccctgtccttcgtgctgatggcggtgctgctggtcggcgtcttcacctatgcgcgggcgctcggcaccgaggacgtcatgaatgcggcggcacgatga

SEQ ID NO: 610 - DNA, 1251 bp, Actinoplanes utahensis
atgttcccgaccagtcagccggacccctccgtcctgcgcggcatgacgcagcggcgccttggtcgccgggacgcgttgcgcctcggtggcacgtcggctctcggagcgttgctggccgcctgcggcgtgcagggcaagggcaagccggaggccagcgtcgcccccgacgccgtggcgaagttctggagcggcaaggtcaagaacggcaagctcgacttcgcgaactggccgctctacatggacccgaagaagccgcagctcaagaagttcaccgagaagaccgggatcacggtgaactaccaggaggtcatccaggagatggggccctggttcgccaaggtgcagccccagctgtcggccggtcagtcgatcggcttcgacctcatggtgatcaccaactcggtgcagttcggccagttccgctccggcggcttcctggccccgctggaccactcgaagctgcccaactacgcggcgaacgccggtaaatcgtacgccaacgaggctttcgacccgggcaacgtcttcagcatcccgtgggcgtccgggatcaccggcatcgcgtacgacatcaagaagaccggccgggagatcaccaagctcgccgacctgtgggacccgcagttcaagggcaaggtcgggatgttctccgacacccaggaactggccaacttcggtctgctcgcggccggtctcaagccggccggctccggcgaggccgagtggaagcaggcggccgagaagctcaagcagcagaagtcggcgggcatggtccgcaactactacgaccagagctacgtcgacgcgctgggcaagggcgaggtctggctgacccaggcctggtccggcgacatcttccagaagaacgtctccgacggcacggacttccggttcgtgatccccgaggagggcggcacgatctggaccgacaacatgacgatcccgatcaccgcggccaacccggtcgacgcgatcatgatgatggacttcttctacgaggtggagaacgcggcgtcgctggccgagttcatcaactacgtgtgcccggtgccggccgcgcaggaccagatcaagaaggacgcggccgccgcgagcggggacgacaagaagaccctgacgatggtggccggcagcccgctggtgttcccggggcagtccgactacgacaagctgcactactacatcgacttcaacacgcaggaagagcagcagaacttccagcgcatcttcgaaccgatcacattgagctga

SEQ ID NO: 611 - DNA, 1158 bp, Actinoplanes utahensis
atgaccacgtctgtcccgcaccacgccgcgaaggccgcgccggccaccggcgagcggaccgggtacccggcgatcgagttcgccggtgtccgcaaggaatacctgtcgcacggtgaggcggtcccggccgtcaagagcctcgacctggcgatcggtcagggggagttcttctcgctgctcggcccgtccggctgcggcaagaccaccacgatgcggatgatcgccggcttcgagcagccgaccaccggcacggtcttcctcgacggcaaggacgtcaccaacgtggcgcccaacaagcgcgacgtcaacatggtcttccagtcgtacgcgttgttcccgcacctcaacgtcctgcagaacgtgtcgttcgggctggagcgcaagaaggtcgccaagagcgagatcaagcggcgggtcggcgagatcctggagatcgtctcgctgaccggcatggagaagcggcagcccaaggagatgtccggcggccagcagcagcgggtcgcgctggcccgggcgctggtcaaccacccgcgggcgctgctgctcgacgagccgctcggcgccctcgacctgaagctgcgccagcagatgcagatcgagctgaagcggatccagcgcgaggtcggcatcaccttcgtctacgtcacccacgaccagggtgaggcgctgaccatgtcggaccggatcgcggtgatgaacgccgggctgatcgagcagctcggcacgccgcgggagatctacgagcggccctcgacccgattcgtggccggcttcatcggcacgtcgaacatcgtcgacggccaggtggcccgggtcgaggacgggttcgccgtactggacctgggcagcggggagcggatcctggcgccggtgcccggcacggtgcaggccggccggaagctggaggtgtcggtgcgcccggagaagatcgacctgcaccggagcgccccgcaggcggtcaccggcagcctgctctccggcaccgtcaccgaggtcgtctaccacgggacatcgaccaactacacggtcgcgacctccgcgggatcagacttcgtggtgttcgatcagaatgctcacgatgccgaggacgtcgcctcgcgcggcgagcgtgtcttcctcacctgggccccccagcactcgtacccgatcggagtctga

SEQ ID NO: 612 - DNA, 1608 bp, Actinoplanes utahensis
gtggcgattgtccagcggatcagcggatcagccgtgatagctcatcacgtgcttgatccgggtgtactcctcgaagccgtacagggaaaggtccttgccgtggccggagtgcccgtaaccgccatgtggcatctcggacacgaacggcaggtgcgtgttgatccagaccgcgccgaagtcgagacggcgggacacccgcatggcacgaccgtggttctgcgtccagacgctggcgctcagtccgtagcggacgtcgttggcgtaccggaccgcttcggcctcgtcggcgaacggctgcaccgtgatcaccgggccgaacacctcgtcctggatcatctcgtcgcgctgccgcaggccggccaccacggtcggcgcgaagaagtagccgcggtcgccgatccgccggccgccggccaccacctcggcgtgcgccggggtgcggtccaggaagccggccacccgctccagctgggccgcgttgttgaccgggccgaagaacgccgcggtgtcggacggggcgccgacccgggtgccgcgggccgcctcggccagcgcggcggtgaagtcggtggcgatccgctcgtgcaccagcacccgggtggcggcggtgcagtcctggccggcgttgaagaagccggcgccggcgatcgcggccgcggtggccgcgatgtcgacgtcgtcgaagaccacgaccggagccttgccgcccagctccaggtgcaccttcttgaggtcgggggcggccgccgcggcgacctccatcccggcccgggtggagccggtgatcgacaccagctgcggcaccgggtgggccaccagcgcccggccggtgtcccggtcgccgcagaccacgttcagcacaccggccgggaggaactcggcggcgatcccggcgagcagcagcgtgctgaccggggtggtgtcggacggcttgagtaccaccgagttgcccgcggcgatcgccggggccagtttccagatcgccatcaccagcgggtagttccacggcgtgatctgcgcgcacacaccgatcggctcacggcgtacgtaggaggtgtggtccctgaggtattccgccgcggccttgccctccagcatccgcgccgcgccggcgaagaaccgcaactcgtcgaggaccgggcccatctcctcggcccgggtcgccgcgaccggcttgccggtgttgcggcactcggcctcgatcagctcctcggcccgcgcctcgaccgcgtcggcgatgcgcagcagcgcccgctgccgctcggccggcgtggtgtcccgccagacctcgaacccggcggtggcggcctccaccgcgacctgcacgtcccgctccgaggagaccggggcgagggcgtaggcctcgccggtgctcgggtcgacgaccggcgacgtccgcccctggtcggtgtccgtgaaggatccgttgacgaagttgcgcagcacggggagttcggtgctcacgggggtgttgccttccgtcggtgtggtgacgctcaccagaagtgggggaaccttgtcacatccttgacggatgtgacaagggaatccgaagtagtttccaatccggaaacagaaatcagaagcagagtggctcaggatccgtag

SEQ ID NO: 613 - DNA, 1473 bp, Actinoplanes utahensis
gtgagcgtcaccacaccgacggaaggcaacacccccgtgagcaccgaactccccgtgctgcgcaacttcgtcaacggatccttcacggacaccgaccaggggcggacgtcgccggtcgtcgacccgagcaccggcgaggcctacgccctcgccccggtctcctcggagcgggacgtgcaggtcgcggtggaggccgccaccgccgggttcgaggtctggcgggacaccacgccggccgagcggcagcgggcgctgctgcgcatcgccgacgcggtcgaggcgcgggccgaggagctgatcgaggccgagtgccgcaacaccggcaagccggtcgcggcgacccgggccgaggagatgggcccggtcctcgacgagttgcggttcttcgccggcgcggcgcggatgctggagggcaaggccgcggcggaatacctcagggaccacacctcctacgtacgccgtgagccgatcggtgtgtgcgcgcagatcacgccgtggaactacccgctggtgatggcgatctggaaactggccccggcgatcgccgcgggcaactcggtggtactcaagccgtccgacaccaccccggtcagcacgctgctgctcgccgggatcgccgccgagttcctcccggccggtgtgctgaacgtggtctgcggcgaccgggacaccggccgggcgctggtggcccacccggtgccgcagctggtgtcgatcaccggctccacccgggccgggatggaggtcgccgcggcggccgcccccgacctcaagaaggtgcacctggagctgggcggcaaggctccggtcgtggtcttcgacgacgtcgacatcgcggccaccgcggccgcgatcgccggcgccggcttcttcaacgccggccaggactgcaccgccgccacccgggtgctggtgcacgagcggatcgccaccgacttcaccgccgcgctggccgaggcggcccgcggcacccgggtcggcgccccgtccgacaccgcggcgttcttcggcccggtcaacaacgcggcccagctggagcgggtggccggcttcctggaccgcaccccggcgcacgccgaggtggtggccggcggccggcggatcggcgaccgcggctacttcttcgcgccgaccgtggtggccggcctgcggcagcgcgacgagatgatccaggacgaggtgttcggcccggtgatcacggtgcagccgttcgccgacgaggccgaagcggtccggtacgccaacgacgtccgctacggactgagcgccagcgtctggacgcagaaccacggtcgtgccatgcgggtgtcccgccgtctcgacttcggcgcggtctggatcaacacgcacctgccgttcgtgtccgagatgccacatggcggttacgggcactccggccacggcaaggacctttccctgtacggcttcgaggagtacacccggatcaagcacgtgatgagctatcacggctga

SEQ ID NO: 614 - DNA, 1335 bp, Actinoplanes utahensis
atgtctgaggctcaggtccgcgcggacgaccgcgcgcacgtcttccactcctggtccgcgcagggcttgatcaacccgctgccgatcgccggcgcgtccggttcctacttctgggactacgacggccggaggtatctggacttctcgtcccagctggtgaacatcaacatcgggcatcagcacccgcggctggtggcggcgatccaggagcaggcggcccggctctgcaccatccagccggccttcgccaacgacaagcggggcgaggcggcccggctgatcgccgagctcgcccccggctcgctgaaccgggtgttcttcaccaacggcggcgccgaggcgaacgagaacgcgatccggatggcccggctgcacaccggccggcacaaggtgctcgccacctaccggagctaccacggctcgacggccaccgcgatcaccgcgaccggcgacccccggcgctggccgaacgagccggtcgcggtcggtgtcgtgcacttctggggaccgtacccgttccggtcgccgttccactccgacagcgaggagcaggagtcgcggcgggcgctgcagcacctgcgggacaccatcgtcttcgaggggccgggcaccatcgccgcgatcctgctggagacggtggtcggcaccaacggcatcctggtcccgccgcccggctacctggccggcgtccgggagatctgcgacgagttcggcatcgtgttcatcgccgacgaggtgatggccgggttcggccggtgcggcgagtggttcgcggtcgaccactggggcgtggtgcccgacctgatcactttcgccaagggggtcaactccggctacctcccgctgggcggggtggtgatctccgacgagatcgccgagacgttccgcgagcggccgttcccgggcggcctgacctattccggtcatccgctcgcctgtgcctccgcggtcgcctcgatcgagatcttcaaggaggaggggatcgtcgagcacgcccggatgctgggcaccgaggtgatcgccccggccctggccgagctcaaggagaagcacccgagcgtgggcgacgtccgcggcctcggcgtgttctgggcgatcgagctggtgaaggacgcggaccggacgccgctggtgccgttcaacgcggccggagcggccgccggaccgatgaacgaggtggccgcggcctgcaaggagcgggggctctggccgttcacccacttcaaccgggtgcacgtggtcccgccctgcacgaccagtgtcgaggaggtccgcgagggtctcaccatcctggacgaggcgttgacggttgccgacggtttctacggatcctga

SEQ ID NO: 615 - DNA, 1905 bp, Actinoplanes utahensis
gtgcagcgccgggatcggcgggagcagtcgcgggtcgggcacgccggtggacaggtcgaggccgaagccgccggcgcggcgcagggccgcccgataacgcccggggccgccggagccgggggcggcgacgaccgtgccgcggcgtccgtccgtccggatggtgccggcccggcgcaggagctgccaggctgcgttgaccgtgctgggcgacaggcgcagctcggtggcgaccgtgcggaccggggggagtttggcgccggcctcgatcgcgccgtcgccgatcgcccggctgagcgcctcggccaggccgcgtgcgctggggtcggtgagtctcgcgaagatcgcctcgaacatttttgttacagtacatttcaagcattgttcggtccatggtcgtcacataatctcggccgcatgaatcagattgcgcactggatcggcggcgcggagcgtgccggccggtccggccgggtcgccccggtcttcaaccccgccaccggcgagcagaccgccgaggtcgccctggccggcaccgacgaggtcgccgaggccgtcgcggtcgccaaggaggcggccgaggcgtggcgcgcggcatcgctgtcccggcgctccgcggtgctgttcaccttccgcgagctgctggccgggcgcaccgccgagctggccgcgatcgtcacggccgagcacggcaaggtgctggccgacgccgccggcgagatcgcccggggcctggagaacgtggagttcgccaccggcatcccgcacctgatgaagggcgccttctcggagcaggccgccaccggcgtcgacgtgtactcgatccgtcagccgctcggcgtggtcgccggcatcaccccgttcaacttcccggtcatggtgccgctctggatgtgcgcgaccgcgatcgccgccggcaacgcgttcgtcctcaagcccagtgagaaggacccgtccgcggcgctctggttggcccggctgtgggccgaggccggcctgccggcgggcgtcttcaccgtgctcaacggcgacaaggaggcggtcgacgcgctgctggtgcacccggacatcgcggcggtcagcttcgtcgggtcgaccccgatcgcgaagtacatctacgagaccggcaccgcgcagggcaagcgggtgcaggcgctgggcggcgcgaagaaccacatgatcgtgctgccggacgccgagctcgacgcggccgccgacgcggcgatcaacgcggggtacggggcggcgggcgagcggtgcatggcgatctcggtggtggtggccgtgggcgacatcgccgacccgctggtcgaggcgatcgcggcccggctgccgaagatcagggtcggcaacggggccgatcggggtgtcgacatggggccgctgatcagcgcccagcacagggaccgggtcgcgggctacatcgccgccggcgaacaggccggcgccacggtgatcgccgacggccgcaagtcggcgatcgcggacgaggacggatatttcctcggggcgacgctgctggacaacgtcaccaccgacatgaccgtgtacaccgacgagatcttcggcccggtgctgtcggtggtccgcgtcgacacctatgccgaggcggtccggctggtcaacgagaacgagtacggcaacggcgtcgcgatcttcacccgggacggcggcgcggcccgccggttccagttcgacgtcgaggccggcatggtcggcgtcaacgtgccgatcccggttccggtggcctactactcgttcggcggctggaaggcctcgctgttcggcgacagccacatgtacggcccggacggcatccacttcttcacccgtggcaaggtcgtgacttcccggtggcccgatcccggaacctcggcgatcgacctcggcttcccgcagactcggtga

SEQ ID NO: 616 - DNA, 600 bp, Actinoplanes utahensis
atgagcgcatgcgacactcttcccatgagccaggtcacgctcccttatcacgaaggcccctggtccgaggatgactacctcgcgctcggcgaaaccgaccatcgcatcgagctgatcgacgggagcctctgggtgagcccggcacctaaccgaccgcaccaacacatttccgcattcctctggctggctctgcaagcaacagcgcgaacggctgggttccaggttcttctcaccaccaaccttcgactggcgacgggacgcatcctcatccccgatctggtggtggacaacggtccgcccctcgaaattgtcggggaggcaaccgacgcggtcctcgtctgtgagatcacctcgccgagtaacgccacctcggaccgcatcttgaagagggcactctatgcggaagccggcgtcccgtggtatttgctcgtcgagccggatttcagcgactacgcatcgctgacgctgcgcctgttccggctgaccggccgggaatatgtcgagcatgccctcgccaagcagggtgaaacactccgctcgcggttgccatttcccatctcgatcagcactgacgatctgatcagtccttggcgggaatga

SEQ ID NO: 617 - DNA, 1593 bp, Actinoplanes utahensis
atgtccaaggacatgcctgacgcgccgaccctgctcgccggacgataccggctgggtgccgagctcggccgcggcgggatgggccaggtgtggctggcccgggacgagaccctggaacgcgacgtcgcggtcaaactgctggacctgccggaggagctcgccgagggtgacgcgacgcggcgcaccctgcgcgaggcgcgggcttcggcacggttgagtcatcccagcgtggtgcaggtgtacgacgttctctcgctggacgatcgcgcctggatcgtgatggagtacgtgccgtcccgctcgctgcgggaggtgatcgagtcggacggcccgctggacgcgtaccgggccgcccggatcggcctcgacctgctggccgcgctggaggcggcgcaccgggccggggtgcagcatcgggatgtcaaaccggcgaacgtgctgctcgccgacgacggccgggtgctgctcaccgacttcggcatcgcggcgatcgacgacgacagcctgaccagccggtccgatgtgctgctcggctcgccgctgtacatggcgccggagcgcgcgcggtacggggtgagtgggccgccggccgacctgtgggggctgggcgcgacgctgtacgccgcggtcgagggccattcgccgttccagcgggcgtcgacgatggcgacgctggccgcgctggccaccgaggagccggacccgccgcagcacgccggcccgctcaccccggtgctggacgggttgctgcggaaagatccggacgagcggatcgtggcggcggaggcggagcggctgctgcagcgggcggtcgccgacctggagcggtcccggtcggtgccgaagccccgcaccccggtggatgacacggtgcagcaggcgaccgacggcgtacgcggaaatcggatcttgctggtcggcgcgctgatcgtggtgctgctcgcgggattcgcggtgttctggttcaaccgtccgtcgccgaggacgacgaccgggccggccccggcgacgacggccgcgatcgcggttgccggcgcggagccgtcggcggcgggttcggccggcgtgacgccgagcgtgagtgtcagtccgagcctgagtggcggtccgagcgtgagtccgagtccggcgaacgggcgtccgccgctgccggccgggtggaaggtttacgacgatgcgaccggcttctcggtgtacgtgccggagggctggacgacgtcgaagagttccggatcgtcgatgcggtactggcgggacggcaaggggcatgtgctcggcatcgaccagaccgaccacccaaggtcggatccggtggcggactggaagtcacagcgggatacgcgcctgcgcggcggcgacttccccgggtacgacgagaagaagctcgagtcggtctcctatttcgtgaaggccgccgactgggagtggactttccggaagaacggcgtccagcacgtcaacaaccggggggtcgtgacgtcggcccaccacgcctacggcttctggttccagaccccggacgccgactgggccaaatacgagaaggacgtcctcgaagtggttttcaagagtttcattcccgccaaggactga

SEQ ID NO: 618 - DNA, 927 bp, Actinoplanes utahensis
atgtccttggacataccctccccgggcgcctccgcaacgtccgccgcctccgcggccgccgggcgcggtggatctgctggggagttcatcgagcctgccgttctgggccggggggatcagcgacggatcatcctcgcacgcccgcgataccgttcccgcgtggatcacgagaccgccatcaccgccgcactcgccgccgccacggtcattcgggatcggtacggccgcagtctagaccgcgtcgacaagggtggcggggacttcgcgaccgcggcggatctcgcggctgaacaggccattcacgacgttctacgggccgcgcaccccggcgatgcgatcaccggcgaggagaccggcgcctccggccccaccggcgcccggcgccgctggctggtcgacccgctgtgcggcacgctcaactacgcggcccgcaccccgctggtcgccgccaacgtcgccctccgcgacggcgcccacctcaccgccgccgcgagcgccgacccgttcaccggcgaaacatactggacggacggctcgtcagcccggctgcgtcacccggacggcaccgacacaccactcaccccttcgggcgagtcggccctggtcgacatcaacctcgaccccccgttccccaccgaaccggcccggatcgtcgccacccccggcttccgcgcccgattccgcccccgggtgatgtccaccaccctggccctgctctgggtgtcggacggtcgccgagccgcctacctcacctacggcgacgtctccgacagcgtccacttcgccgccggcatcgccatctgcgaagccgccggctgcgtggtcaccgccaccgacggctccccatggcagaccggccgggggctgctcgccgccgccgaccccggcacccaccgcgacctcctcgccctgatccgctccacctga

SEQ ID NO: 619 - DNA, 894 bp, Actinoplanes utahensis
atgcggaaggccgagagttcgggagggagttccatggcggtgcaggcgaagcaggggacgggcgcgaagccggtggcggggaccggagggaaggcgcagagttccggcgcgccgcgggatgccgatgaactgcggaacgagatcgagcagaccagggccgagatgggggagacggtcgaggcgctggtggcgaaggtggacgttccggggcgggtcaagagtgccgctgcggacaaggtggcccacgtcaaggagtcggctgcggagctgaaggactcggctgcggaaaaggccgcgcatgtcaaggacgcggccatcggggcggctgggcagatcaaggacaaggctgccaaggtcggcggggccgcggaggcgaagcctggcggcggggctgcggaggcgaagcccggcggcggggccgcggaggcgaagcccggcggcgggattgccgaggggaacctcagtggcggcgggggagcggtcgccggaggcgggctgagcgcggtgaaggacgaggttcgggagaaggcggcccagatcaaggagtcggccgtggaacggggcagccacgccaaggaggcgatgacgcaggctgccggtgagctgagggaatccgctgcgagtggggcggagtcggtcagggccgcggcgatggcgaaactgcgggagccgggcgccggggagaagacgcacggtgcgggtcggatcgccgaggcgaccgcgcagaccagtgcgcggatggggtgtcaggcggcggatgcggcggagcgggcttccgcggcgatcggttcggctcgtcggcgggtcgttgcgcggcccagggagtttgctctcctcggcgcggtcctcgccgctgccgcggccggcgtggccctgatccggcgttcccgctga

SEQ ID NO: 620 - DNA, 420 bp, Actinoplanes utahensis
atggcgcacacagacgcacgaagtgagcaggccaccaccgcggaactggtcagccggctcagcgagcaggtgtcgaccctggtgcgggacgaactgacgctcgcccggatggagatggtcgagaaaggcaaacgcgccggcaaaggcgccgggttgctgggtgccgccggagtgttggcgatgtacggcgccggcgccctgctggtcgccgcgggcgccgcgctcgccctggcgatgccggtctggctggccgccctgatcgtcaccgcggtcctcttcgccggcgccggcatcgccgcactcgtcggccgtcggcaggttcgcgacgctctgcctccggaacccgaggaagcgatggccagcggccgggaagacgtcgacgccttcatgaccgccgcccgcaccgggaggagccggtga

SEQ ID NO: 621 - DNA, 1029 bp, Actinoplanes utahensis
atgcgttcccgactcccctttgccctcgccctctccaccgtcgccgccctggcggtctcgggatgcaccaagaagaacgacaccgacggggcccccagcggctccggtgacaggaagacctacaaggtcgccttcgtgccgaagctgcagggcgtcccctacttcgaggcgatgaacgccggcggcaaggccgccgccgccgcgctcggcaacgtcgagtggctctatcagggcccgacgcaggccgacgccggggcgcaggccgacatcgtccgctcctacatccagcagaaggtcgacgccctgatcgtcgcgccgaacgatccggattcgatggccccgctgctgcaacaggccaaggacgccggaattcacgtggcgaccgccgacaccgacgcgccgaacagcgtgcgggaggtgttcgtgaaccaggcgaccgccgacggcatcggtcaggggctgaccgacgcgctgctcaaggcgatgggcggcaagggcaggtacgcgatcgtctcctgcggccagaccgcggagaacctgaactcctggatcagggtgcagcaggcgtacaccaggcagaagtatccggacgccaccatcgtggacaccgtctacgccggggaggaccaggcgaaggcgacccagatggcgaccgacctgatgaacgcgcacccggacctgaccgggctggtcggcgagtgcacgtccagcgcgcccggggtggcccaggccgtcaaggacgctggcaagatcggcaaggtgttcaccgtggggctgggcacgccgcagtcgatgaagccgtacctgaaggacaggtcgtcgtcggccgccatcctctgggacgtgcagcagctcggctacctgaccgcgtgggccggtgcgcagatcgcccagggcaagccgatccaggcgaccaacgacgtcagcgacaagctgccggcggtcacctacgacgcggccggcaagatgctgctgctcgggccggcgctgcagatcaccgaccagaacgtcgaccagttcggctactga

SEQ ID NO: 622 - DNA, 1500 bp, Actinoplanes utahensis
atgacgacggggacaccccggctccggctgtccgggatcgccaagcgtttcggtgcggtgcgggcgatccagcaggcggacctggtcatccgagaaggccgcgtgcacgccctggtcggggagaacggcgccggcaagtccacgatgatcaaaatcgtgtccggggcggagaccgccgacgcgggcacgatcgagttcgacggcgagccggtccggatcggcggtacgaacgacgcgatcgccctgggcatcgcgacggtctaccaggagccgcagctgttcggcgagctcacggtcgcggagaacatcttcctcggccgcgagatcacgagagccggacggatcgactgggcggcgcagcaggggcgggtggccgagctgctggagcggctcggcctcccggcccgctccgcgaatgccgcggtgaacaccctgtcggtggccgagcagcagcaggtgtcgatcgcgaaggcgctggccaccgaggcgcgggtgctgattctcgacgagccgtcggcgatcctcaccgacgccgagatcgacgtgctgttcgacgtggtgcggcggctgaccgcggcgggggtcgcggtcatctacatctcgcaccggctggacgagctgttccggatcgccgacgaggtcaccgtgatgcgcgacggcaagaccatcgggacgtacgacatgagcgggctcaccgtgcgccggatcgcggagctgatggtcggcggggtcctctccgacgagcgcccgcaccgggtcgtcccggacggcccggccgtgctggagctgcgtggactgggccgggccgggcggttcgccgacgtcgacgtgacggtccgcggcggcgagatcgtggcgctgtacgggctggtcggttccggtgtctcggagatcgcggcggcggtgtacggcatcgaccggatcaccgccggcgagatccacatcggtggggagcgggtcaccccccgctcccccgcgcacgcgcagcggctcggtgtcgcgctgctgccggccaaccgcaaggtcgaggggatattcggcgtccagtcgatcgccttcaacatctcggccgggcacctgcggctgctctcccggttcggcacgttgctggaccgggggcgggagcgcggtgtggcgctggacctgatcaggcggctgtcggtgaagacgccgagcgaacggcagccgatcagcgcgatgtcgggcggcaacgcgcagaaggtggtgctggcccggcagctggtcgagcggccgagggtgttgatcctggccgagccgacccagggggtcgacgtgggcgccaaggaggagatccaccggatcgtcaccgagctggccgacagtggcacggcggtgctggtggtgacctcggatctgccggaggcgctgcggatcgccgaccggatccaggtggtccgcggcggcaccacgacgatgtccttcggcccggacgccagccaggtggatctgttggcagcggcggcgggaggcgacgagtga

SEQ ID NO: 623 - DNA, 957 bp, Actinoplanes utahensis
gtgaggaaccgggtcaccggccaggagctggtcctggtcggggtgatcgcggtgctctgggcggcgctggcggtgggcaccccggcgttcctgaccgccggttcgatccagccgctgctggtcgcgaccgccccgaccgccctggtcggcgtcggcatgaccatcgtgatcatcacgggcgggatcgacgtgtcggtcggcggcgcgctcatggtgtgttcggtgctgaccgcgaaggcgctggtcggcccgggggtcgaccccggtgtcgcggtgctgctcccggtcgcggtcggcggcgtgctcgggctggtgaacggcctgctgatcgcctacggccgggtgcacgcgatcatcatcacgttcggcacggcgaacctgttcctcttcgccggcctgcggatcttcgggtccgggacggtcaacgggatccccggcacgctcgcgttcttcgggcgcggcgcggacgggcgcaccctcggtgtcccgcacgccttcctgatcaccgtgctggtgaccgggctggcctggtggtatctgcggcacaccgcgggcggccggcacttcttcgcgatcggcggggatgcggtcgcggcccgcctggcaggggtccgggtgcaacggcgggtgctcatcgcgtacgtcgtcaccggtctgctcgtcggtctcgcctcgtgcttcgtgatcgcgcagggcacctcgacgctggatcagtcggtcggctcgggccgggagctcgcggtgatcgcggccgtggtgatcggcgggacgtcgatcatgggcggccgcgggtcggtgaccgggacgctgctcggggcgctgctggtgcagtcggtgagctccggggtgacccagctcggctggcggtcgcagctgtccgacctgttcgtgggcgtgttcatcatcgtggcggtgggtgccgacctgctgcgcgcacgggccaggaggagtcgatga

SEQ ID NO: 624 - DNA, 1032 bp, Actinoplanes utahensis
atgagccgggtcgtcaagatgctgctgacgcagcggatcgcgctgctcgcggtgctgatcgtcgccgtggtggtgacgttcttcatccaggacgcggggggctacctgaccgcgtcgtacgacttcgactacatgtccgccgcgctgatcaacgcggtgccgctggcgatgctgggcctggccgagctgctggtgatcctttccggacgcggcggcatcgacctctcggtcggcgcgatcgtctcgctggccggcatggtcttcggtttcgcgtacgggcactggggctggccgctcggggcggcgatcctcctgaccgcggtctgcggggcgctgctcggcgcgctcaacggtttcctggtctcctacatcgggttcccggcgctgatcgccacgctggccacctactacgcggacaagtcgctggccatcgtgatcaacgatcagcagccgatcagcaccaccccgatccagcacctgttcgcgatcagccgctcggtggagctgccgctgttcggccggtacgtgcccgatgtgccgctgggcgtcttcaccttcctgctgcccaccgtggtggcggtctggctgctgctggcccgcaccgcgtacgggcggcggctgtacgcgatcggcaccaacgacgttgcggcgcgctggtccgggctgccggtgcgggacacccggttcaaggcgtacgtctacgccggtctgctcgccgggctggtcgccgtggtcaccgtcggccagttcgcctcggcccgcccggacgccggggtgtccggcaacgggatggcgctgccggcgatcaccatcgcggtgctcggcggggtggcgatcaccggcgggatcggccgggtggccggcgtggtcctggccaccctgctgatcgtctggctgaacgccgggatcctgctcgccttcatcggcaacgagggctcgcagtaccagctgttcgcgctcggcgccgtgctcgtcttcgcggccctgctcaacgggctcaccaaccgccgctacggaggcacgtcatcatga

SEQ ID NO: 625 - DNA, 1152 bp, Actinoplanes utahensis
atgaacctggacgacctggacggcttctccgtcgaagtgcccagctgggcctacgggaactcgggcacccgtttcaaggtgttcaccgcgcccggagtcccccgcgacccgtacgagaagatcgccgacgccgcgcaggtgcaccggctcaccggcctggcgccgcgggtgtcgctgcacatcccgtgggaccgggtcgacgactgggcggcgctgcgcgcccacgccgaggggctcggggtgcggctgggggcggtcaactcgaacctgttccaggaggacgactacaggctgggttcgctctgccacccgaacccggcggtgcgcgacgaagcggtcgggcaccatctgcgctgcatcgagatcatgcacgagaccggatcgacggacctgaagatctggctgccggacggactgaactatcccggtcaggactcgctgcgcgggcggcaggaccggctcgccgatgcgctccggcggatctacgacgcgctcggcgacggccagcggatcctgctggagtacaagttcttcgaaccgtacttctacagcatggacatcccggactggggcacctcgctgctgcactgcctggccctcggggagagggccacggtggtcctcgacaccgggcaccacgcgcccggcaccaacatcgagttcatcgtgatgcagctgctgcggcagggccggctcggggcgttcgacttcaactcgcgcttctacgccgacgacgacctgatcgtcggctcggccgacccgttccagctgttccggatcatgacggagatcgtggcggccggcgcgcaccggccgtcgtccggggtcaacttcatgctcgaccagtgccacaacatcgaggagaagatccccgggcagatccgctcggtgctcaacgtcgagcaggcgctggccaaggcgctgcaggtggaccgggacgcgctcgccgtcgcgcagcgcgagggggacgtgctcggcgccaacgaggtcctgatggcggcctacgagaccgacgtgcgcaccgcactcgccgaccggcgggaggcgcgggggttgccgcgggatccggtcaaggccttcaagatctccgggtacgccgtgaccaccgccgccgagcgggccgacggcgccccggccggctggggcgcgtag

SEQ ID NO: 626 - DNA, 387 bp, Actinoplanes utahensis
atggaggacgaacggctcgccacggtccgggcccggatcgatgccatcaccgaaccggacccgtcacccgccgagatcgctctggtgctgcgcctgctgcgatccttcgcggccaagacccccgacgccgtcgaccgcctgctcgatgccctcaccaaggatgatcccggcctgacgcgggacgaggcgcacgcgttgaagggctcggccgcgaacatcggcgccgccgccctggccgcggtctgctcctcggtcgaggaccaggcccgcgccggtggcgtcgtggacccggcggccgcggccggcctgatccgcaccgaggccgccggagcgttgcgcgccgtgtccgccctggccgacgaatacgcccggcgctgccccgggtag

SEQ ID NO: 627 - DNA, 1203 bp, Actinoplanes utahensis
gtgcggaccgagctgtacaagtcggcggccgccgacgacaagaaacccatggtgctggtcgtcgacgacgagcagaccgtgctcgacgcgctctccctgcagctcgggcgggagttcaacgtgctcaccgcgccggacggcgagcgggcgctgaaggtgctggccgagcacggccgggccgccgcggtgatcagcgacatgcggatgcccgggatgaacggcatcgagctgctgcgccgggtccagatggaatacccggacatcacccgggtgctgcacaccggccacggcgacatgagcaccgcggtcgccgcgatcaactccggcggcgtctaccgctacctgcccaaaccggccgacacggacgcgctgcgcgacgcgatccgggcctcggtggccaagcacgacgaggcgatcgccgaccgggaactgctcgaccggacgctgcggaccagcgtgaaagcactcttcggggtgctcgaactgtccaacccgccggcctaccggcgagccgggcggatcagcacgctggtcggcgaactctgccacctcctgcagctcgacggcctctgggagatcgaggtcgccgcgatggccgcgcaactcggcgcggtcgccgtgccggccgccaccctcaccaaggtggaacgcgggctgccgctcagcgcggacgagcaggcctcggtcgacgccatgccgcggatcgcgctgcggctgctcggcgacatcccgatgatgggcgaggtgctggccatcgtgcgcgggctgaccggggcgccgaccccggccgaggggcgctcggcgctggccgaggacgcgatcgccgtgctgcgcacggcgaccgactacgagatgctggagagccgcggagtcaacgcggtcgacgcgatcaccgcgatcgaggagcgcgaggggcactacccgcatgtcgtggcggcgctgcggcgactcaagggggtccgggcggtcaaggacaccgtcaagagcgtgcgggtgaccgagctcgaggtggggatgcggctgatcgaggacgtggtggcgaccaacgggctggtgctgatcggcaaggaaaccgtgatcaccgagctgatgctcgaccgtctgaccaacttcgcccgcgccatcgaactgatcgagacggtgctcgccgccgtcccctaccgggcgagctaccagcccaccgcctacgcggggcaccgctga

SEQ ID NO: 628 - DNA, 1326 bp, Actinoplanes utahensis
ttggtgccgcaccgtatcgacacggtgggacgagccctgagcgttacgtcaaaacctcatgccgggccggtggccgccgaagtcaccttctgtgcgccggagatcccgccacctcgtgccctggagacgatgcagatgagcgcagtcggtgacgcggcccgggtcgcggcggtgcgcagctaccagttgctcgacgcgccccgcccggtggtcctggacgagctgacccggctggccggctcggtcttcgagacctcgatgtcgacggtgaccctggtcgaggcggaccggcagtggttcgccggcagcaccggcatgccgagcagcggcgggccgctgggcagttcgttctgcggggtggtggtcgatcagcggatgccgctggtggtcgccgacgcgctcacccacccggtcttccgcagctgggagaacgtggtcggtgcgccgcacatccggttctacgccggggtgccgctggtcgacgaggacgggttcaccctgggcaccatgtgcgtgctcgacgaccggccgcgggacaccgcggaccggcggctggacatgctgcacacgatggccgggcaggcggccggccacctgtccggtgtccgcaaccggatgctgctggccgaggtgggtgacgaactgtcccgggcgatcagccgggaggaggatttcgtcgccaccgtgtcgcacgagttgcgcaccccggtcaccaccatccagggctacctggaactgctggtcgacaacgaggagctggccccgtaccgcaggatgatcgaaccgatccagcgcaacggcgagcgcctggtccggatggtcgaccacctgctggccggcacccgtccggtcggcaccccgctgccgctgctgcgggcgcagaccgacctggtcacggtggccgaggccgcgatggccgcgtgccgcccgcaggccgcgcagcgtgacgtgtcgctggtgctggaggtggccgggggcgccgggcccttcccggtgcccggcgacttcacccggctcagccaggccgcggagcacctgatccgcaacggtgtgctgttcagcccgcccgggtccacggtgcgggtgctggccgacgagttcgggctgagcgtggcggacgcgggcgcgggcatcccggcggacgagctgccgcacgtggccgagcggttcttccgcggccggttcgcccgggagcaggcggttcccggggtcggcctgggtctggcgatcacccagcggatcctgcgggcacacgagggcacactgaccgttatgtccgacggatcgggaatgggcaccaccacgaggatgaccgtgatctcctga

SEQ ID NO: 629 - DNA, 1605 bp, Actinoplanes utahensis
atgcggatcctgcggcgtctacggctcggtggccgcctgtcggtggccttcgccgtcgtgctggtgctgctcggcgtggcggtcgcgatcggcgcggtcgggctgaaccggcagtccaccgcggccgcggacaatcgcgacctgatgcgtctgcagcaccaggtcgaccagcagaaatacttcgacggggacatctccgggtggcaggtcgcatacgcctgggacacccggcgcggcgatccgcggaaggcggtcgacccggccagcgagaaccgcgccggtttcctggccgacgcacaggcgctgcgggacctgctgcgggccaccgacaccgggcggatgaccccggccgagcgccagctcttcgacaccctctcggccacctgggacgagtatttcaaggccgactcgcaggcggcggccctgtacgccaagggcgacgtggcgggcggcgacaaacagatcctcggacccggatacgacctgtacttcgcgatcgtgcagggcaccgacaaactggtcgccgcggtcaccgggcgcgccgagcaggccacccgcaccgcccagcggcaggcggccaccgcccggaacgctctgatcatcgcgttcgccctggccgtggtcgcggccgtgctgctcaccgtggtggtcacccgcagcgtcaccggcccgatcggccggctgatcagcaccctgcaggcgatggcccgcggcgacctgacggtgcgcgccgacaccgacggcggcgacgagatcgcggtgatgggccgggccgtcgacgaggcgatcaccggcatccgcggcagcgtcgtcgagatcgtcgagagcggggtgcggctcaccgaggcgtccgagacgatgcgccgggtcagccaggagatcgaccaggcggtggcggaggccgatcagcaggccgggctggccgcggcgagcgcctccggggtgtccggcaacgtgcacacggtcgccgccggcaccgacgagatgggctcggcgatcagcgagatctcccgcaacgccggcgacgccgcgcaggtcgccacggacgcggtcgccgcggcccgggccaccagcgccaccatcaaccggctcggcgactcgtcggcgcagatcggcgacgtgatcgacgtgatcaccacgatcgcggcgcagaccaacctgctggccctgaacgccaccatcgaggcggcccgggccggcgaggcgggcaagggcttcgcggtggtcgccagcgaggtgaaggacctggcccaggagaccgcgcgggccaccgagcagatctcccagcagatcgccgcgatccagagcgacaccgggcaggcggtgaccgccatcgacgagatcagccggatcatcgagcagatcagcgactaccagaccacgatcgcgtcggccgtcgagcagcagagcgccaccacggccgaaatgaaccgcggggtgaccgaggcggcgaacggcgccagcgacatcgccggcaacatcgccaacgtggcgagcagcaccgcggccagccgtgcggcggccggtcaggccgcccggacggcgcacgaggtggagacgctcgccgagcagttgcggtccgctgttcagcggttccgcatctga

SEQ ID NO: 630 - DNA, 321 bp, Actinoplanes utahensis
atgaggatcgtccgctacgacggtccgggcgcggtccgcctggccctgcacggcgagctggacctggccaccaccggccgggtgaccgccgaggccgaggcggcgctggccaccccgggcgtgcgtcggctgatcctggacgtggccgggctgaccttctgcgactcgtcgggcatcgacgccctggtgaacatccggaccgccgcgcagacccggggcgccacctgccaggtggtcggcgcgcagggcatcgtgcaccgatccatgcaggccaccggggtactggccctgctgtcggcgcccgatcggggtgccgcctga

SEQ ID NO: 631 - DNA, 429 bp, Actinoplanes utahensis
atgagtgcgttgaccgcctatctggacgtccctctgcaccacggcgcacccggcgcggcccggcgcgcggtggtcgccgttctcggtggctggggtttcgacgaccccgactggctggatgtgaccgccgtggtggtcagcgagctggtcaccaacgcggtccggcacggcggcggctgcgtcgccctgcaggtcgaggcccacgaccgccgggtgatcgtgtcggtcgccgacggttcctcggtggtgccccggcggcgcgacccggacggcgccggcggccgcgggatcgccctgatcgaggcgctcgccgaaggctggacggtgcacaaccacgagggcggcaaacaggtgcgggtgcggctggtgccctgccccggcgccggcacgccgatggcgtccggctcggcccgcggggacgtcgcatga

SEQ ID NO: 632 - DNA, 2070 bp, Actinoplanes utahensis
atgcaagaaactccgcgagtcgccgatatgcgggcggagggtacccacgaacggcgggtgacgaaacctgaacggcgctgtcgtctctttcaaccatttacgcggcttatgtcggcctacagtacggtgatggcagcggtgctggtcgtcgaggacaacccggaacatcaggcggtgctcgccgagatcgtccgccggctcggccacagcgtgacggtcgccgatgacggccgggccgggctcgccaccgccctcgccgagccgttcgacctgatcgtcgccgacgtcgacatgccgcacctggacggggtgcggatgtgccgggcgctgcgcgccgcgccggccaccgccgacgtgccggtcgtgctgatcaccggctacctgccgcccggcgacacccggctggccgaggccggcgccgccgcggtggtacccaaaccgttcagcgtccgggagctcaccgagaccctgcgcggctgcctgccggtgccggccgacgggccgttcctgtccgagctgatgcgcagcctggacagcggggcggtggcctgcgaccgacacggccgcatcgtgttcgtcaaccgggcggtccgcgacttcttcggcgacgagtgcgccaccgtgccgatccgggaatggccgcgccgcttccagctgcgccaccacgacgggaccccgctgcggccggacgagatggcgctggagcgggcgctgcacggcgaaccggtgcaccacgccgacgtgcggaccagcgaccggcagcggcggccgcgctggctgaccgtcaacgcccggccggtgcgcgacgcgtccggagccgtgctcggggcggtcgccgcgatgcacgacgtcaccggcgaccaccagcagctgcggtacgagaagtgcaaggccgaggtactgcacgcgctggtgcacgcccgggaggtggaacacgccggcgcggccgtgctgcgcagcctgtccacctgcctggactggccgtacctgcggttctggctggtcgacgaggtgtccggccggctgcgcccggcggtcacccacctctcccccggtgccgaggagatccccctcccgcccagcctgcgccccggcgaaggggtggccggccggtgctggacgaccggtgagctgatctgggtggccgacatccgggccccggactcgccggtgatggcccaggtcctgggcaccggataccggtcggccggagcggtcccggtgctcagcgccgagcaggtggtcggcgtgctgaccttcttcaccccggaccggcaggatgcggaaccggcgctgaccgtgctgctcaccggcgtggccgggctgctcggcgcctacctggagcggcgccgctcggacgaactcgccaaccagctggcggccagcatcggggagtacatcgcgctggtcgggcacgagctgcgcaccccgctcacgtcgatcgccacctacaccgacctgatcgccgagtccggcgacgacaccaccatcggcgaggtccgcgacctgctcgcggtcatcgaacgcaacaacgcccggctgcgcaccctggtggaacgcctcctcgacctgtccgccctggaatccgggcacgccgggctgaccgtcggcaccgtcgacctgtccgcggtgctgcgcgacgcggccgccgcggtcaccgccgaggccggcgacggcggcgcccgggtccgcaccgacctgccggaccgcctggacatccccggcgaccaggcccgcctgcggcaggtcgcggagaacctgatcgggaacgcggtcaaatacagcccgcccggctccaccgtgacggtcaccctgaccgccgactcggacgccgcggtcctggtcgtcaccgacaccgggatgggcattccggccgaggaacgcaatcgcctcttcgcccgcctctaccgcgccaccaacgcccggcacagcggcatccccggcgccggcctcggcctggcgctgagccgagccatcgtcgagctgcaccacggcacgatcaccctgaccgcgggccacccggacggcaccatcgccaccgtccgcctccccctgaccgccaccgactag

SEQ ID NO: 633 - DNA, 687 bp, Actinoplanes utahensis
atggacgcgcaagcgatgcacatcgcgaacgggatcgtgaacgggccggtctccgccgccttcgtcgtgctcgccgtcgcggccctcgccgtgtgcgtgtggcgggcgcgggccgatctcgacgatcggctggcgccgatggccgggctggtcgcggcgttcatcttcgccgtgcagatgttgaatttccaggtgctgccgggcgtctccgggcacctgctgggcggcacgctcgcggtcatcctggtcgggccgtgggtcggcgcgctctgcgtctcgaccgtgctgatcgtgcagtgcctgctgttcgccgacggcggcctgaccgcgatcgggctgaacatcacgaacatggcgctgctcggcaccgcggccggctatctgctggtcgccggcctgctgcggatcctgccgaagagtccggccgggctgggcgcgaccgcgttcgtcgcctcggtcgtctcggtggtggtcgcctcgcagggtttcgtcctggagtacgcgctgggcggcaccaccgacctgtcgttgccgtggatctccggcacgatggccggggtgcacgtgctgatcgggatcggtgaggggatcatcgcggcgaccaccgtgatgaccgtggcccgggtgcggcccgacctggtctacgcgctccggaaattccgcaagccggtggaggtggccgcgtga

SEQ ID NO: 634 - DNA, 336 bp, Actinoplanes utahensis
gtgaaccgcaagcttttcctggccgcggggctgctggtcgccctgctgctggccggcgtggtgagcaatttcgcgtccggcagcccggacgggctggacgcgacggcccggcagggctgcacattcgacgcggccggccggatcaccggcgggcactgcatggcgcagcgggagcaggcgcatcagatggcggacagcccgctcgccgggtacggcatccgcggcctgcaccatgcggcgctgtcgaccgggctggccggggtggccggggtgctgatcacgttcgggatcgggctgggcgggttctggctcgtccgccggcggaaggtgtcctga

SEQ ID NO: 635 - DNA, 765 bp, Actinoplanes utahensis
atgggggcggggcactcgcatccgctgtatctggaccggcggggccccctgcaccggctggcgcccgaggtcaagatcgtggcggcgctgctgttcacggtggtcgtggtggtcacgccaccgacgctctacgccgccttcctcggctacctcctcctggtggccctgctggccgccgccgcccgggtgccggtggggtggctggccaaacgcgccagcatcgagctgccgttcgtcctgctcgcgctggcactgccggtcctcgggcacggcgcacgggtcacctggctgggcctgtcgctgtcggtcgacgggctgcacggggcgtggaacatcttcgccaagggcaccctgggcgtgctcgcctcgctgctgctggccgccaccaccacgatgcgtgacctgatcctcgggctggaccggctgcgggtgccgtcggtgttcacccagatcgccacgttcatgctgcgctacatcgacgtgctcgccgacgacgcccggcggatgcggatcgcccggctgtcccgcggctacgatccacggttcctgtggcaggtcaaggcgttcgcggtcggcgtgggttcgctgttcctgcgctcctacgagcggggcgagcgggtctacctggcgatggtgtcgcgcggctacaccgggcggatgccacagctgaccgggccggtcgcgccggccgggcagtgggcggtctccgcggtactgccgctgctcaccgccggcatcgcggtcgccgcgggggtgctcggatga

SEQ ID NO: 636 - DNA, 774 bp, Actinoplanes utahensis
atgaccgcgctgcggatcaccgggttgcactactcctacccggacggccgggccgcgctgcgcggcgtcgacctgaccctcgccgccggcgaacgggtcgcgctgctcggcccgaacggcgccggcaagaccactctggtgctgcacctcaacggcatcctgcacggcgggggcggacaggtcgaggtctccggactgccggtcaccccgggcgaccgggccgcgatcgccgaggtccgccgccgggtcggcatcgtcttccaggaccccgacgaccagctgttcatgccgtcggtcgcggaggatgtcgctttcggcccggccaattgcggcgtacgcggcgccgagctcgaggcccgcgtcgacgaggcgctgcgggcggtcggcatggccgagcatcgggatcaggtcccgcatcacctgtcgttcggccagcgccgccgggtggcggtggccaccgtgctggcgatgcgcccggagatcctggtcctggacgagccgtcgtcgaacctggatccggccagccgccgggagctcgccgagatcctcgagtcgctgccggtcacgctgctgatggtgacccacgatctgccgtacgcgctggagttgtgcccgcgctcggtgatcctggacgcgggccggatcgtggccgacggtgcgacgtccgcgctgctggccgaccgggacctgatgcgggggcaccggctggagttgccgttcggcttcgacccggtggccgcggtcagaggacgccgggagtccggcgccctctga

SEQ ID NO: 637 - DNA, 459 bp, Actinoplanes utahensis
atggccggtacgctcagcccttggccgacgacccgacagggttcgacgcaacatcccgtgcccacgctgcaatacctgctgcgtgcacacggtcacacggtcaccgtggacggcgtcttcggcgcccagaccggtgatgcggtacgcgcctatcagcgcacgaagggtctccccgacaacggcatcgtctgcgcggagacgtggctggcgctgatcaaggaggtcggacccggcgcccagggcaatgcggtcgccggggtccaacacaagttccgccgggagtcggtgccggacggcgagttcggcccggagaccgagtcggcggtccgcgccttccaggcccgggcgggtctcgacgccgacggtgtggtcggccggcagacctggcaggccatcatcgccggcccggaaacgggtccggaagcagcgggcccggaaacgctggccgaggccgcctga

SEQ ID NO: 638 - DNA, 2523 bp, Actinoplanes utahensis
atgtcgtctgatcccgggggtatcgtcccgctcgaaggggccgaaggaccctgcccggcagggtcctggccgagaagagtgagcatcgacgaagccttccgggaaggaaagatcgtgaccgctgtgctcgaccatgaggacctggtgcgcaggctggcccaccccgacgacaccgaggtcgcgagcctcgacgcctggtggcgggcgaacaactacctcaccgtcggccagatctacctgcagggcaatccgctgctgcgggagccgctgaagccggagcacatcaaaccccggctgctcgggcactggggcaccagccccggcctgtcgttcatctacgcccacgtctcccggctgatcaagaccaccggccagcaggcgatctatctggccgggccggggcacggcggcccggcgctggtcgccgcgggctacctggaggggacctatgcggaggtctacccccgggtcgggcaggacgaggaggggctgctgcggctgttccgccagttctccagcccgggcggcatccccagccacgtatcggtgaccacgcccggctcgatccacgagggcggcgagctgggctatgtgctggtgcacgcgttcggctcggtgatggacaaccccgacctgctgaccatcgccgtggtcggtgacggcgaggcggagaccgggcccctggagggctcgtggaagggcatctcgttcatcaacccggagcacgacggcgcggtcctgccgatcctgcacctcaacggcgcgaagatcgccggcccgaccgtgctggcccgcaaggatccggccgaggtgcgcaagctcctggagggccacggttacgcgatcatcgaggtcggcggcgacgacctgcccggcatgcaccaccggttcgcgcaggcgctggccgaggcctggggccggatccgggccatccaggcggcggcgcgcggcggggccggggacggccggcgtccacactggccgctgatcatcctgcgcacgccgaagggctggaccggcccgcagacggtcgacggggtgaccgtgggcggcacctggcgcgcccaccaggtcccgctctccggggtcaaggacaacccggaccacctgcggatgctcgaggagtggctgcgctcctaccggccggacgagctgttcgacgccaccggtgcgcccaccggcccggtccgtgacctggcgcccgagggcgacctgcggatgagtgccagcccgcacgccaacggcggccggctcacccgggatctggacctgcccgacttccgggactatgcggtcgaggtgaagacgccggccgccgggcgcgccgagtcgacccgcaagctgggcgagatgatgcgcgacatctacacgcgcaacgacgaccggttccggctgttctgccccgacgagacgaactcgaaccggctcggcgccgtcttcgaggtctccgaccgggccttcatggagaccgtcaccccggacgacgtgcagctcagccccaccggccgggtgatggaggtgctctccgagcacaactgccacggctggctggagggttacacgctgaccgggcggcacggcatgttcgccacctacgaggccttcgcgatggtcagcgcgtcgcagacgatccagcacggcaagtggctgcaggaggcctcgcacctgccctggcgggccaaggtgccgagcctcaacatcctgctcacctcgaccgcctggcgcaacgaccacaacggcttctcgcaccagggccccggtctgatccagaacgtgctcacccagcgcggcgacgtcgcccgcgtctacctgccgccggacgcgaacacgctgctgtcggtggccgaccactgcttccgctcccggtcgtacatcaacctgatcgtcatcgacaagcagccgcagctgcagtggctcgacatggaccaggcgatcgaccactgcgccaagggggccggcatctgggagtgggccggcaccgacgacggcaacagcgacccggacatcgtgctggcctgcgccggcgacgtggtcaccatggagacggtggccgccgcgcggatcctgatggagcggctgccgcagctgaggacccgggtggtgaacgtggtcgacctgatgacgctgccgcggcccaaggaccacccgcacggcatgagcgagacgatgttccgcgagctgttcaccgaccacgtcgacgtggtgttctccttccacggctacccgggggcgatccaccagctggtgcacggccggccggacgccgaccggttccgggtgcgcggcttcatcgagcagggcaccaccaccacgccgttcgacatgacggtgcgcaacaaggcgtcccgctaccacctggtgatcgacgcgatcaacaacgcgaggcggctgccgagcggcgcgtcggagctgaaggcgtggtgcgaggcgcagctggagaagcacgcgacctacgtggtggagcacctggaggacatgcccgaggtgcgggattggtcactccaggactgggcgcaaagttga

SEQ ID NO: 639 - DNA, 666 bp, Actinoplanes utahensis
atgcccacgctcgaccgtcaggacgacgtcttcattctcgacctcggtgactcggagaaccggttccaccccgactggctcgcggcggtcggtgccgccctcgacgaggtggagaaggcggacacgccgaaggcgctggtcaccacggcgtccgggaagttctactcgaacgggctggacctggagtggctcggcacgcacggggacgatttcgcgcagtatgcccaggacgtacagaatctgctcgcccggtttctcgctcttccgctgccgaccgtggcggcgatccaggggcatgcgttcgcggccggggcgatgctgacgctgacgcacgacttccgggtgatgcgggccgaccgcgggttctggtgcctgcccgaggtgaacatcagcatcccgttcacgccgggcatgtcggcgctcatccagggacggctggcaccgcaggtggcccacgaggcgatgaccgccggccggcgctacggcgggaccgacgcgcgggccgcggcgatcgtcgaccaggcggtggaggcggaagcggtgctgccgaccgcggtgcggctcgccgcgacgctggccccgaacgcgggggacacgctcggcacgatcaagacccggatgtacgcgaccgcgctgaccgcgttgcgggagcgggtcacccggtag

SEQ ID NO: 640 - DNA, 618 bp, Actinoplanes utahensis
gtgctgctgtccgacgactggccacgtctgcgcgccgtctgcgaacgcgacgtcgtgcaccgttccggcgagttgggtcgtgccgggtggactgccgcgctcgccggtgtctcgtcccaggtccgctggcgcgagggcacgatcgaggcggccggccgctcgggcggcacggtgtcgctcgacggcgagagcctcctgctcgtgccctcggtcaccatctggcccggcgtcgccgtcttcgccgacgacccctggcccaaggcgatcgtccatcccgcccgcgggagcgcgacgctcttcgaccccgcgccgccggccgcctcgctggcagctctgctcggccggtcacgggcccggctgatcaccgctctggcgacgccgacgagcacgacacaactggcgcggactctcgcgctggcaccgggagccgtcggcgatcacctcgcgatactgctcggcaccgggctcgtcggcaaggccaggtcgggccgttcggtgttgtactcccgcacgcctatgggcgatgcgcttctgcacggcgtgacagctgccaccccatcggtccctgacgcagcggctcaccgggagcgtagacggccgctgccggggtcgccttga

SEQ ID NO: 641 - DNA, 891 bp, Actinoplanes utahensis
gtgccggcgacgtggcgtccggacagcgcgccaagtaccagtcgatctcttcgcggacggcgggaaggggctgagagcgaacctgtaaaagatcttgatcgatggtctgcgccactgggccgttcgctgttcaacgccgcatcggccggcgcgcaactgctcggtctggccctcggcggcgccgcggttgcggcgatcggcgcacgccacgcgctgctgatcggcgccggctgccacgcggtcgccgccgtgaccgtccgattcgggctgccggacctgaccggcgcggcgtcgaccggttcgccggtgcgggcgagcctcaccggtgccggcacactgctgagcaacggaccggtccggcggctgctgctcgcgcagtggctgccggccgcgtccatgatgggcaccgacggcctgctggtggctttcgcctccgggcgaggctttcccggtgcggctgccagtgtgctcctggccgcgtcgcccgccggcatgttcgccggcgagctggtgatgggccggctcgtccgccccgcccaccggccacgactggtcgcacctctgatgctgctgacgggtgcgccgctgctcgcgctcggcgccgtcgctttcccggcgtccgttgcgctgctcgtgctcgccggcttcggtttcgcctacggcgtgggtctgcagcaaccgtttctccaggcggtgcccgccgagtcgcgcgggcagtcgttcgcgctcctcagcaccggtgcgatgacgctgcaggggctcggccccctggtcttcggcgccgccgcccagctcaccaccccgggcttggcgatcgccgccgccgggctggcgacgatcgcctgtctccccctggtcaggccctggtccggtcgtcgcggcaacgactaa

SEQ ID NO: 642 - DNA, 2250 bp, Actinoplanes utahensis
atgaggttcaccgacggctactggcgtaagcgcgacggcctcaccgtcgtgcaccccgctcacctgcaggacagcgttcccgggccggactcgctgaccgtctacgccgccacccggcgggtgcgcgaccggggcgacaccctggacgcgccgctgatcacggtcaccctgaccgcgccgatggacgacgtcatccgggtcaccgtcgaacacttccagggcggtgtcgccaagggtccggagttcaccatcggcgggcagccggccgacgtcacggtcaccgcgtcgacgttcacctccgggacgctgaccgcccgggtcgacaccggcgacgactggggactcgacttcctggccggcgaccggcggatcaccggcagtggcgggaaggggatgggcgtcgtctccgggccggccggcgacttcgtccacgagcagctggacctcggggtgggggaggtcgtctacggcctcggcgaacggttcgggcccctggtcaagaacggtcagagcatcgacatctggaacgaggacggcggcaccagcagcgagcaggcgtacaagaacgtcccgttctacctgaccagcgccggctacggggtgctcgtcgaccacccgggcagggtctccttcgaggtggcctccgagatggtcacccgcacccagttcagcgtcgccgggcagcgcctctcctacctgatcatcaacggtccgacgccggccgacgtgatccgccggtacaccgcgctgaccgggcggcccgcgctgcccccggcctggtccttcgggctgtggctgaccacctcgttcaccacgtcgtacgacgaggagacggtcaacaggttcgtcgacgggatggccgaccgggacctgccgctgagcgtgttccacttcgacacgttctggatgcgcgagttcaactggtgcgacttcgagtgggacacccggatcttcccggacccggccggcatgctgaaacgactggccggccgggggctcagggtctgcctgtggatcaacccgtacatcgcccagcgatccccgctgttcgccgagggcaaggccggcggctacctggtgcgcaccaccggcggcgacgtctggcagtgggaccgctggcaggccggcatggcgctggtcgacttcaccaaccccgaggcccggcagtggtacgccgcgaaactgcgcgccctcaccgagatgggcgtggacgcgttcaagtcggacttcggcgagcggatcccggtcgacggcatcgcctggcacgacggctccgacccggaacgtatgcacaactactacacgcagctgtacaaccgggtggtcttcgacgtgctgcgggaagcgcgcggcgagggcgaggcggtgctgttcgcccgctccgccacggtcggcggccagcagttcccggtccactggggcggcgacaacaccggcaacttcgcctcgatggcggagagcctgcgcggtggcctgtccctgatgtcgtccggtttcggcttctggagccacgacatcggcggctttgaaggcctgcccgacccggccgtcttcaaacgctgggtggcgttcggcctgctgtcctcgcacagccggctgcacggctccaagtcgtaccgcgtcccgtggaacttcgacgaggaatccgtcgacgtgctccgcaccttcacccacctcaaacaccgattgatgccgtacgtcttcggcgccgcccgcgaagcacacctgaccggcctgccggtgatgcgcccgctgtacctggcgttccccgacgacccggccgtcgcctacctggaccggcagtacctgctcggcggtgacctgctggtcgccccggtgttcagcgccgccggcgacgtccgctactacgtgcccgcgggccgctggacccactacctgaccggcgagatcgtcgaaggacccggctgggtccgcgagacccacgacttcttcagcgtccccctgctggtccgcccgggcgcggtgatcccggtcggcgcccgccacgaccgccccgactacgactaccgcgacggcgtcacgctgcgcctgtgtgaaccgccggcggaccgggtcgcggtggtcgtccccgggccgtccggcgcggacacggtgttcacggtcgctcgcgagggcgacgagatccggatcgggcgctccggcgacgccttgccgtggcgggtccaactcggttccggcatcaccgaactgcgggccgatcaggacagctgcaccctggccctgggttag

SEQ ID NO: 643 - DNA, 882 bp, Actinoplanes utahensis
atgaccgtcaccgccacgcgcgcaccgcggacccgcatcccggaacgtgtcccgctgcgcggacgccacccgggccgcttcctgatcctgaccctgctgctcgtcctgctcctgctcgtcgtcgcaccgctgctggtgatcgcggtcaacgcggtgaagagcccggccgactacgccgcgcacggcccgctcgcgctgccgcaccacctctacctccagggcatcgtcgacttctggaaccgggtcgacttcgggctcaaactctggaacagcttcatcaccagcctggtggtggcggtcctcggcgtgatcctgtcggtgttcaacgcgtacgccctgggcatcggccggatccagggccggatctggttcctggtcttcttcctgatcgccaacctgctgccgcaggaggtgctggtctacccgctgtactacctgtcgaagcagctcggcctctacgacagcctgttctccatcgtcatcatcttcaccgtcatccagagcgccttcggcacgtacctgctcacctcggtctacaccgagttccccagggagttgctggaggcggcggcgatcgacggcgccgggaagtggcgcgcgctgtggcgggtggttgtcccggtcagccggcccaccctcgcggtgctgttcacgttcttcttcatctggacgtggaacgagttcttcctgccgctgatcttcctgatctccaacgacaaccagaccgtcccggtggccctcggcgtgctgcagggcgaccggatgatggacgccacgaccaccagcgcgtccgcgctgatcggcatcatcccggcgatggtcttcttcctgatcttccagcggaccctcacgcgcggcatcgccgccggcgccatcaagtga

SEQ ID NO: 644 - DNA, 930 bp, Actinoplanes utahensis
gtggatggcccggaccgggccgcccacgacggagaaaggttcccggtcgtgaagaatcgcggatacgccgtctatctcctgcccggactcgtcgcctccaccgcggtgatcgtcgtcccgctggtgatgacgatctacatcagcttcacccggtggaccgggatcggcagcccccgctgggtcggcttcggcaactacacccggctcttcgccgacgccaacttctgggcctcgttcggccacatcgtcctgctgatcctggcgatggccgtggtgccgaccctcctcgggttggtgctggccgcggtgctgttcgactacgtggccaagaagttcagcgaccgctgggcgtcgatcctgcgctccggctactacctgccgcaggtgctcccggtggcggtgaccggcatcatctggggctggatcctgcaccccggttacggcgcgctgaaccggatcctggagacgatcgggctgggctcgctgtcccgcaactggctcggcgatccgaagtacgccctgtacagcgtgatggcggtgatgatctggtgccagctcggctacccgatcgtcatgttcatgtccgggctgcagcgcatcgaccccgagctgtacgaggcggccgacctggacggcgcctcctggtggcagcggttccggaggatcaccatcgcgatgatccggcccgagctgtacgtcgtactggtcaccaccacgatcgcctcgctcaagatcttcgggcagatcttcgtgctgacccgcggtggccccagcaacgcgacgctggtcccgtcgtacttcgcctacaagaacttcttcgagaaagcccaggtcgggtacgggtcggcgatctccaccgtgctcaccgtcctgatcgtgatcctcgcgatcgtcttcctgcgcctgcagaaccgtgccgagcggagctga

SEQ ID NO: 645 - DNA, 1308 bp, Actinoplanes utahensis
atgacactcacccgacgtgggctgctcaccggcgccctcgcgacgaccacttccgtcgccctggccgcctgtggcggcggtggttcgtccgacgacggtgccgacgccaagaccctcaccctctggcactacgaaggcccgaccagcgcgatgggcatcgcctggaacagggcgatcgagatcttcaaacagaagcacccgggcgtcgaggtgaagttcgaggagaagagcttcgagcagatccagcagaacgcccagatgatcctcaactcggacagcgcgccggacatcctggagtacaacaagggcaacgccaccgccggcctgctcgccaagcagggcctgctgaccgacctgaccgacgaggcgaccaggcgcggctgggacaaaaagctcagcgccagcctgcagaccaccgccaagtacaccgaccagggcatcatgggcagcggcaagttcttcggcgtgcccaactacggcgagtacgtcatggtctattacaacaaggcactgttcgacaaattcaagatcgcggtgcccaccaccctggaccagttcaccgcggcgatggacaccttcgtcaagaacagggtcaccccgctcgcggtcggcggcgccgagtacccggcccagcagatcttctacgagctcgcgctcgccaaggccgaccgggccttcgtcgacgactaccagctgtacaagaacaaggtggacttcaacgggccggtgctcagctacggcgcgcagaccttcgccgactgggtgtccaagggctacctcgccaaggacgcggccgggatcaaggccgaggacatgggcgtctcctgggagcagggcaggttcccgatcctgatcagcggctcctggtggtacggccggttcgccaaagaggtgaagaacttcgactggggcaccttcctgttccccggcaacacgctgcaccccggctccagcggcaacctgtgggtcgtcccggcgaagagcagggccaagagcctggcgtacgacttcatcgacatcaccatgtcgcccgagatccagaacctgctgggcaacagcggcggcgtgccggtggcggccgacccggcggcgatcaccgatccgaggaacaaggagctgatcgagaacttcaccaggctcaccacctcggacgctctggcgttctacccggactggccggcccccggctactacgacgtcatggtcgccggcgtgcaggggctgatcaacggctccaagaccccgaaggcgttcctcgacgaggtcgccaagccgtaccacgagaacctggccgacctcggcaagtga

SEQ ID NO: 646 - DNA, 1035 bp, Actinoplanes utahensis
atgtccgggggaggcgcggtgccgacgatcaacgacgtcgcacgggcggccggcgtgtcgcccagcacggtgtcgtacgtgttgagcggccgccgtccgatctccgccgagacccgggcccgggtccaggccgccatcgccgagctcggcttccacccgcacgccggcgcccgggcgctggccagcagcaagaccaacgtgctggccctggtggcaccgctgcggctggacgtgaacgtgccggtcatcatgcagttcgcgacggccgtggtgaccgcggcccggtcgttcaaccacgacgtgctgctgctgaccaaggacgaggggaccgccgggctggagcgggtggcgcacagcacgatggtggacgcgctgatcctgatggacatcgagcgcgacgacctgcggctgcccgccatccggcggctcaagcagccgtcggtgctgatcggactgccggccgaccacgccgggatcgcctgcgtcgacctggatttcgaggcggccgccgccctcgccctgcggcacctggccgggcacgggcatcggcggatcgggctgatcggtccgtcgcccgcggtgtaccagcggcagacgacgtacgccgatcgcttcctgaccggtttcctgcgcgcctccgcggaactggggctgcggaccgtgagccacccgtgcgagcccggcgccgacggcgtccgggccgcgctggccgacctcgacaccgagttgcccgggctcaccgccctggtggtgcacaacgaggaggcgctgcggccgctgctcgacctgctgcacgcggccggccggcgggtgccgcaggacatctcgatcgtcgcgctctgcccgcgggacgtggcggtcgcgatgccggtcgccctgacgtcgatcgacatcccggcgcacgacgtcgggaccatcgcggtggagaccgcgatgcggttgctggacaaccgccgggtcgagttcacccgactgctcgagccgagcctggccgagcgggacagctgccgcgaaatcccgccgtcacaccgttga

SEQ ID NO: 647 - DNA, 3123 bp, Actinoplanes utahensis
atgcccgccgcgtccccgccgatcacgattaatcgcactcgcccattgtgccgggatgcgcgccccggtttcggccggatttccggcgggtgttgcctctcgcatcgggctccttctatggtgacccccatgcgtcgaagcgcttcgatgcggtggtccgcccacgatgtcgaagcgatccgacgcccgtcctcgtcctcgcctgcttcgagggagatcgccatgcggaagagacgcggcctcgccgccctggccgccgccctgctcaccctgcccttgacggccgcgcccgcgcccgcggccgagagctacccgttccgggaccccaccctggcgctgccggcccgcgtcgacgacctggtcggccggctcaccctcgacgagaagctgtccctgctgcaccagtaccagccggccatcccgcggctcggcatcgccgtcttcaagtccggcaccgaggcgctgcacggcgtggcctggtccaccgactacaccaacggcggcgccaagaccgacgcgacggccaccgtcttcccgcaggcggtcggcctggccagcagctgggacccggcgctggtccggcaggtcggcgccgcggtcggcgacgaggcccgcgggctgcacgcgcagaatccgacggtgtggggcctcaacctgtgggcgccggtggtcaacctgctgcgcgacccgcgctgggggcgcaacgaggagggctactcggaggacccgctgctgtccgggacggtggccaccgcgtacggcaggggcctgcagggcgatgacccggaccatctgctgaccgcgccgacgctcaagcactacgcggcctacaacaacgagaccgggcgggaccggacctcgtcgaacgtgccgcagcgggtgctcaacgagtacgaccgcaagaccttcgagatcccgctgcgcgccgacgccgcgaccggcgtgatgtcgtcctacaacctggtcaacggacggccggcgaccgtcgaccccgacctcggcggcctggtgcgcggctggagtgaccggcggctgttcaacgtcacggacgccggggcgccgaccaatctgaccggttcgcagggctacttcgcgacccaggccgaggcggacgccgcgatcgtcaaggcgggcggggacagcttcacggtcgacgacaccgacggcgctccgaccgtgaccgcgctgaggcaggcgatcgaccagggactgctgagcgtgcgccaggtggacaccgcggtcggcgacgccctgagcatccgcttccggctcggcgagttcgaccccgacggcggcccgtacgccgggatacccgcgtccgacgtggacagcccggcacaccggcagctggcccgcgaggccgcggcctcgtcgatggtgctgttgaagaacaccggcgtgctgccgctggcggccggcggatcggtcgcagtctccgggccgctgggcgacaccgtctacaccgactggtacggcggtcagctcccgtatcgggtcaccccgctcgacgggatcagcgcgaagtcgccggccacctatgcgccgggcgccgaccggatcgcgctgaaggacgtggcgaccgggcggtacgtgagcgccgccgacccgtccgcggtcgccgcgaccgccgccacggcgggcagcgccgcccagttcgacgcggtggactggggcgacggggtgtcgacgctgcgcaacgtcggcaccggcaagctgctcggctacaactgggggccgttcgtgacgaaggagtccgagccgaccggctggttcgtgcagcaacagttcaaggtggaggaccagacggacggcacggtggtgctgcactacgccgggtacgagacacaggagagctggttcggcccgaacacgtacgtgacgatcggcgcggacggccggctcgggctcggcccggccgcctcggcagcccacttcgccagggaggtcatcgccgacggggtggccgcggcggccaccgcggcccgccgggcgcggaccgccgtggtggtggtcgggacgaacccgttcgtcgccgggcgggaggcgcacgaccggaccgggctggggctcggcgcccggcaggaggcgctgatcgaggcggtccgggcggccaacccgcgcaccgtcgtggtggtgcagagcagctacccggaggcgatcacctgggcgcaggcgcacgtaccggggatcgtctggaccacgcacgccggcgcggagaccgggcacgccctggctgacgtgctctacggcgacgtgaacccgggcgggaggctgacccagacctggtaccgcggggtggaccagctgccggccgacctgaaccggtacgacatcgtcaagaccggtcagacgtatcagtacagctcggccgagccgctctatccgttcggccacgggctgtcgtacacctccttccggtacagcgggctgaaggccggcggcggccgggtcaccgtcgcggtgaccaacaccggcaaacgcgccggcagcgaggtggtccagctctacacgcaccagcggacgtcccgggacgtcaccgcggtcgagcagttgcgcggcttccggaaggtgacgctgcaacccgggcagaccagagtggtgagcttcccgctgacgccgcgggacctggcccggtgggacgtcacccggcaacggtgggtgaccgagagctcggtgtacgacgtgctggtcggctcgtcgtccgcggacatccggcagcggggcagcgtctcggtccggggcgagacgatcccgccgcgcgatctgtcccgggtgacccgggcggagaccttcgacgactacgccggggtgcggctgctggatgagaccagggccgccggcacggtggtcggcggggtcacggccggcgactggatcgccttccgggacgccgcgctgcatggcggccggacggtgacggtccgcgcggccggtgccgggacggtccaggtccggctcgggtcgccgggcgggcgcctgctcggcacggcgacggtgcgcgacaccggtggcgtctacgcgtacaccgacgtcaccgcgccgctcgccgcggcgtccggccggcaggacgtgtacctgctgcccggtcccgggctgcggatcgcgtcgttcgatatccgatga

SEQ ID NO: 648 - DNA, 1578 bp, Actinoplanes utahensis
gtgagcagggcggcggccagggcggcgaggccgcgtctcttccgcatggcgatctccctcgaagcaggcgaggacgaggacgggcgtcggatcgcttcgacatcgtgggcggaccaccgcatcgaagcgcttcgacgcatgggggtcaccatagaaggagcccgatgcgagaggcaacacccgccggaaatccggccgaaaccggggcgcgcatcccggcacaatgggcgagtgcgattaatcgtgatcggcggggacgcggcgggcatgtcggcggcgtcccaggcacgccgcaggcggggcccggacgagctggccatcgtcgccttcgagaggggtcgcttcgtctcctactcggcgtgcggcatcccgtactggatcggcggcgcggtcgacggccccgaggcgctggtcgcccgcaccccggcggagttcgccaaggccggcatcgaggtgcgcacccgccacgaggtgaccgacatcgatctgaaggcgcggagggtcaccgtccgcgatctcgacgccgggcagagccggaccgagccgttcgacgacctggtctacgccaccggcgccaccccggtccgcccaccctgggcgcggaccggggcgcgcggcgtcttcggggtgcagaccctggaggacggcgccgcactcgacgccttcctggcggcggagcggccggccaccgcggtcgtcgtcggcggcggctacatcggcgtcgagatggccgaggcgatgatcaaccggggcctgcgggtcaccctgatcgagcggtccgcgcagccgatgggcaccctcgacgaggacatgggcgcactggtcgccgccgcggtccgcaacctcggcatcgacctgcgcaccggggtcaccgtcgaggccctggagtcggcacacggcaaggtcaccgcggtggtcaccgacgccgggacggtcccggccggcgtcgtggtcgtcggcttgggcgtacgaccggccgtggcgctcgccgaggccgccggcctgccgtgcggtgactccggcggcctgcgcaccgacctggggcagcgggtcggcgagcgggtctgggcggccggcgactgcaccgaggtgctgcaccgggtcagcggccggcggatgcacgttccgctcggcacccacgccaacaagcagggccgggtcgccggcatcaacatcggcggcggccacgccacgttccccggcgtgatcggcaccgcggtcaccaaggtctgcgatctggaggtggcccgcaccggcctcagcgcggccgaggcggagcaggccggcttcggcacggtcagcgccgtggtggagtcgacgagccgggccggctacttcccgggcgccgccccgatgaccgtcaaactgatcgccgagcggggcaccggccgcctgctgggcgcccagatcgtcggccgggcggaggcggccaaacggatcgacgcctgcgcggtggcggtgtggaatgagatgacggtgggtgacatgaccgggctggatctgggttacgccccgccctacgccccggtctgggatccgattctgatcgccgcccgcaaagccggggacgccctctga

SEQ ID NO: 649 - DNA, 3291 bp, Actinoplanes utahensis
gtgagacaaccatcccgctggttaacctccgtcctggcgatcggcctggcggccggcgtgacgacggtgaacggttcgctgccggccaccgccgcgccggccgcaccggcgccggacaccgcaccggacaccgcgccggacaccggaaccgtggcgcccaaggagtcgccgaccggcacgctcggtgcgcacgacgccgggctgctcgccgcggcccaggccgagcacaagccgagcgtcaccgtcatcatcgccaccggccagggccggtccgccgacgtggccggccggctgaaggctctgggtggcaccgtggcccgccgcttcgaccaggtcggctacgtgctggcctcggtgccgaccggcaaggtgctcagcgccgcgaagctgcccggcgtcaccggcctggacctggacgagacggtcaaggtgccggagccggacgtggccgccgaccgcggcgccggcaagcaggccccgcttccggccggcccgggcgcggacaccccggcggacaacccgtacctgccgaccggtgagaccggctcggtcgacttcaagcgccggcatcccacctgggacgggcgcggcgtgacgatcggcatcatggacagcggtgtcgacctggcccacccggccctgcagaagaccaccaccggcgagcggaagatcgtcgactgggtgaccgccaccgacccgctggtcgagagcgacgccacctggcgggccatgcgcaccccggtggccgggccgagcttcacctatgccggcgcgacctggaccgcaccggccggcaactacctgatcaaccggttcgccgagtcgatcaccgcggcctccgagccggccggtgacgtcaaccgcgacggcgacaccaccgacgtctggggcatcctctacgacccggtgagccacgacatccgggtcgacgtgaaccagaacaacgacttcaccgacgacgccgtgatgcggccgtacgccgagaagcaggacgtcggctacttcggcgtggacaacccggccaccccggtcgccgagcggatgccgttcgtcgtggagtaccgcgaggacgtcgacctcaccccggcgggtctgcccggccaggtcgccgacttcgtcaacatcggcatcccggagggtctgcacgccacccacgtggccggcatcgcggccggcaacgacctgttcggcaaccggaacttcgacggccaggcgcccggcgcgaagatcgtctccgcccgggcctgctcctggggcggcggctgcaccgcggccgcgctgaccaccggcatggtcgacctggtggtcaaccggcacgtcgacgtggtgaacctgtcgatcggcggcctgcccgcgctcaacgacggctccagcgcgcaggcgcagctctaccagcagctgatcaccaagtacggcgtccagctgttcatctcggccggcaactccggcccgggcgtgaacaccatcggcgacccgtcggtggccaccgacgcggtgagcgtggcggccagcatcagcaagcagacctggctggccaactacggctcggagacccgcaaggcgcggcagctgttcccgttctcctcgcgcggcccgcgcgaggacggcggcttcaagccgaacatcaccgcgcccggctcggccatctcggccacccccacctgggagccggtggccggtctgaccaccgtcggctacaccctgccggtcggttacgccatggagaacggcacctcgatggccgccccgcaggccaccggcgcggccgcgctgctgctctcggcggccaagcagaccaagcggacggtgaccccggcccagctgcggcgcgcgatctactccaccgccgacccgatccgcggcgagcagacgtacgagcagggcaccggccagctggatgtgccggcgtcgtggaagctgctgacccggatcgccgaggtgcgcggctacacctcctcggcggcggtctgcaccccgctggcgcagtatctgaccccgcccggggtcggcaccggcatctacaaccggtgcgcggcgtcggccggcggcttccggccggggcagaccagggtggtcaccctgtcgctgacccggaccagcggaccggaccggaccctgctgcacaccctgtcgttccagggtgaccggcacgcgttcgccacggtgccggtgatcgggctgccgctgaacaagaccgtcaaggtgccggtccgggtcaccgccggcaggggcgtgaccagcgcgctgctcagggtggacgaccccgtcaccccgggcgtcgacttcgaggtgctcaacaccgtggtcgccgggctggacgcggtgcagccggcctacgccagcacgttctcgggcgcggtggaccggaactcgaccacctcgttcttcgtcaccgtgccggcgaacgccaccacgctgcaggtggacctcgcgggcctgaccgccggctcgcagacccggtggaccgcgatcaacccctacggcgtgccggtggagtccaactccagcccgaactgctacaccaactactccgacccggcgacgtgcaaacccgaggagcggtcgtacgacaacccgctgcccggcgtctgggagctcgcggtcgagtcccggcggacgtcgccggtgctgagcaatccgttcacgctgaccgccaaggtgcagggtgtcaccgtcgaaccggccaccgtgtcgctgccgtcggtgcaggtcggcacggccaccccggccacctggacggtcaccaaccggttcgggccgatcgcggtcgtcccgcagggtggcccgctgggcagcgcgctgagccagcggccgaccatcgagcagggcggcgtgcaggactacccggtggtggtgccggccggcgtgagccggctgaccgtggtgatcggcagcccggccgacccggccgccgacctggacctgttcgtctacgaccagaacggggtgcaggtcggcaagtcggcggacggcgactcggaggaggcggtcacggtgaacgcgccggcggccggcacgtacaaggtggaggtgcagggctactcggtgcccagcgggtcgaccgcgtacgactaccgggatgcctacttcagcccggcgctgggcagcgtggacgtgcccggcgcgccggtgccgctggcggccggcgccggcgcgtcggtgaccggctcggtgaccgttgccgcggtcccgccggccggccggcacctgttcggtgaggtcaccttccagaccgacgagggcgcggtcgtcggccgcggcgccgtcgagatcgggaccgtcaccgggtag

SEQ ID NO: 650 - DNA, 621 bp, Actinoplanes utahensis
atggcgttgctgcacaaggcggagatccgcccgacgaaactcgaactgctcagcggctggctgccgacccggccgtggttttccggtccggcgaatcccgaggtcacccgggtggccgcggcccggttcgacgatccggccggcgaggtggggctggaggtgatgctcgtccgggtgggtgacgggccggtgctgcacgtgccgctgacctaccggggtgcgccgctggccggggccgaggcgatcggcacgaccgagcacagcgtgctcgggacccgctgggtgtacgacgcctgtcacgatccggtcttcgtcagcgtgctgggcgaggtgatccgctcgggtggcacgcaggcggccgaggaggtgcacgacggcgagcgggtcgtggtgcgggagccgggcctgctgctgcgcggcgccggctccgccgcgccggcgcccggcgatccggtgaaggtcgccgagggggaggtggtccggatcgagacgaccgggggcggcatcgaactgttccgtacgccgtgggccgccccgttgccgggcgacgcggtcctgaccggcatgtgggcgggccgccccgagccggtggtgctggcccgcctcaccgagggggactga

SEQ ID NO: 651 - DNA, 834 bp, Actinoplanes utahensis
atgagaatgagcatggtggcacgcgtggcagccgcgggggcgctgctgacgatcctcgccgggtgcagcggctccggtgacaagagcgccacccccaccttcgtcagcccctccgcggccggcggcacgtcaccggcgaccgagtcgacgacccaggagtcggcggcgcgccaggcgttgccggccgcgctgcggcaccgcgtcccgaccttcaccgagcaggcaccggcccccaccaaggtcaccctgccgcccggcccgaaggcgccgaacttcgcccggatccccaccaccgagaagatcgcgttcatcacgatcgacgacggctgggagaagaatccggaagcactcaagctgttccaggccgcgaacgtgccggtcaccctgttcctcgaggtcaacgcgatcaaggacaacccgacgttcttcaccccgctgcagggcgccggcgccacgatccaagaccacacgatcacccacccgaacatgacgcacctgtcgtacgacgcgcagaaacacgagatctgcgccggcgccgacgagctgaagaagcagtacggcaaacgccccacgctgttccgcccgccgttcggctcctacaacgacaacacgctgcgcgccgtccacgactgcggcctgaaagcgtcgttcacctggatggagaccaccgacaagggcatcatccggttccagcgcccgacgcacctgatcgccccgggcgacatcatcctgatgcacttccggccggccttcatcgacgacttcctcgccgtcctcaacatcatccacaagtccggactcaccccggcccggctggaggactacatcccctga

SEQ ID NO: 652 - DNA, 939 bp, Actinoplanes utahensis
atgaacggcgacatgctcctctcgatcggcgacctggcgcgccggaccgggctcaccgtcaagaccgtcaggttctactccgatctcggcgtcgtcgctccggccacccgcagcccggccggctaccggcgatacgcggcggacgccgtcgcccgtctcgacctggtgcgcaccctgcgcgagctcggcatcgacctggccaccatccggacggtggtggaccggcagagcaccctccccgaggtggccgcggcgcacgccgacgcgctgcaggcgcagatccgggtgctgcggatccgccgcgcggtgctgacggtggcggcccggcgcggcgccggccccgcccagctcgaggtgatccaccagctggccaggctgtccgccggcgaacgccgggaactgatcgacgacttcctcggcgccgtcttcgccgggctgcacgagcaccccgcccttcccgcggtcgcccgctcgatgacgcccgacctgccggccgacccggagccggaacagatcgaggcgtgggtggaactggccggcctgttccaggacgacgacttccgggccaccctgcacggcatggcccgcgagatggccggcgaccgggccgcggacgaccgcaccggcctgccccgggtcctcgccgacgcgatccgggcccaggtcgccccggcgctgcgggccggcatcgaccccggctcccccaccgccgagccgaccatcgcggcgctcgtcgggcactacgcgcacatcaccgggcaccccgacgacgccgcgctgcgccggcggttcgagacgctgctgaggggcatgaacgacccgcgccgagaccggtatctgtcgctgctcgccgtggtcaacggccggcccgtgccggacagcctggcgccgatgctcgactgggcggtcgcggccctgcgtgcaaggaccgcgcggtag

SEQ ID NO: 653 - DNA, 1326 bp, Actinoplanes utahensis
gtgggcgcggacgcggcccccgccgcctaccgggcgctgctggaccgacccggcttccggcggtacgcgatcatcggcctggcgtcgaaactggcacccggcatggccggtctgagtctgctgctcctgatcggcgaccactattcgttggcgaccgccggactggcggtcagtgcctcggccgtcgggcagggggtcagcgcgccggtgcgcggccggctcatcgaccggttcgccgccggtccggtcctgatcggttgcctcgccgcacaggtggcggccaccgtcgcgctggtcgccacggccggccggaccgggcccgccgtggtgatgctgacctgtgccgcgatcatgggagcgaccggtccgccggtggcggtcatgatgcgcacactctggcgtcgggtgaccgacgccgggacgttgtccaccgcgatggcgctggactcgtcgatggcgggcgccgccctgatcgtcggaccggcggtcgccggctggctcagcgtcgccgtgtcccccgtcgccccgttcgtggtgatcacggcgctgaccgccgggacggtcgtcctgttgatcggcgtcaccgcgacaccgtcgcgaaccgggtcgccccggcaccggccgggacgggtcgctgcgccgccctcgcgccagccggatcggctcggcacgacgctcccgagccgaccgggtccggtcgctgcggcgctcccgcgccgaccaggtctgctcgctgccgcgctcccgcgccggccgggtctgctcgccacgccgtcgctgcgccggctgctggtcgcgaacggactcttcgtcagcgcggtgaccgccaccgacgtggtgctgcccggctacgcacgggaatttcacgccgccggactggccggggtgtacctgggcgtgctctccgtcggcagcgtgctgggcagcttcgccgtgggcgccgcaccggccctgctgcgccgcggcagcgggctgcgccaacggctcggcctgttcaccgccggatccgccgctctggcgctcggctcgtggctgtcccccgcggcggtcctcctgttctgcccactcaccggcctgatgatcggcaccctcttcgccaccctgcgcaccaccggcggcgacctggccccacccgaccgtgtcaccgaaacgatgtcctggctcagcaccatggacctgaccggcgccgcggccggcgccgccgtcttcgcccacatcgccggctcagcgggaagccgcacggcgctggccctcataccggtcgtcctgctcgccgccaccgcgatcagccgcaacacccccgaaggagcgccgactccccactga

SEQ ID NO: 654 - DNA, 1719 bp, Actinoplanes utahensis
atgtcgccccgcatgcggacagtcgccctgttcgtgtccgtcggtgtgttcgtcgcgctcgccgggtggtcggtgattgcggcgttgacacggccggcgtatgaccggcttgccgatctgcacgtctatctgggcgcggtgcgcgcgatgcgggacgggatcccgctgtattcgtatgcggcggagaacggcgacccgttcacgtatccaccgtttgcggcgctggtgttctggccgctgggcgcggtgccggaaccgatggtgcaggtcgcctggacgctggtgacggtggccggggtgatggccctggcggcggccctgacggtccgcaacggcatcgccggccggcagagattcctggtggtgatgctcgcggcggccacgatgctgctggcgtcggcgccggtgcagagcaatctgcggttcgggcaggtgagcatcttcgtggtgctgctggccctggtggatgcactcggattgctgccccgccgggcaggtggcgtgctcatcggcgtggcggcggcgatcaagctgacccccctgctgttcgtgccgtatctgtgggtggtcggccggcgccgggacgcgatccgatccggggtggccttcgcggcgtgcgcggcggcggccttcgcggtgtggccggccgtctcggggacgttctggacccaggcggtgttcaccacgtcgcggatcggcgacctgtcgtcgaccgggaaccagtcgctgaacgggacgctgctgcgctacgcgattcccaccagcgagcgcatggtcgcctggacggcgttggccggactggtgtgtctggtcgcgttcctgtgcgctcgggagtaccaccggcggggacaggtagccctggccgcagtggtgatcgggtgcgcgacggtggcggtgtcgccggtgtcgtggactcaccaccagatctggaccgtgctggccgggatcctgctgatcgccgggccgcaccgtggccggatcgcggccggcgtggtcgtgttggtcacgatgtccgtgcaggtcggggcggtgctgccggtcggcgggttcctgcacgacaacgcgcgggcgtggtgcgcggtggcggtgtgctgcggcggggcggtcagcctgtggccggcggcggccgggcgggtacggctgctgccgggtctcgcggtggtaggccgaccgcgcacggcgttgctgtactgcacggcggccgccgcgggaatcgccggagtcttggcggtcacgcatgatcgagcggtcaccgcgcaggtgtacgcggcggcgaacgcgcaggatccggtctggtcacaggtgttcagcagcggcccgtgcggaggcatgggactgcgggacggcagatacgtctgctcggacctgaccgggccggcgatggccggtgagcagctgaacttcgcggctggtgacgacggtgccggccacatcgggatcgagggacaggcgggcccggacgtggtccgtttggtgtatgtcccggtacagggcgccaagccggtcgacgtgccgctgtggccggaactgcccgcccccaagaccgcgccggactcggacgacccacccaagctgcttccggtcgtggacgagcgcagcatgacgacgcaccgcttcggggtgcgcacgaacgaccccactgacgcggtcctgctggcctacgaccgaaacggtcaggtcatcggcaccgggggcgacaaactgcacgacatgtcgtag

SEQ ID NO: 655 - DNA, 1158 bp, Actinoplanes utahensis
atgcgtcgcacgattttcaacgaggaccacgaggccttccggcagacgctgcgggaattcctgcaggccgaggtggtgccgaattacgacgagtggctgcacaacggcgaggtgccccgcgagttctacaagaagctcgccgaactcggtctgttcggcatcgaggtgcccgaggagttcggcggcgccggcatcgactcgttcaaattcgccgcggtgcagtacgaggagaccgcccgggccggcgtctcgttcggcggctccggcgtgcacgtcgctctctgcctgccgtatctgctgaacctggccacccccgagcagaagcagcggtggctgccgtccttcgtcagcggcgacatgatgttcgcgatcgcgatgaccgagcccggcaccggctccgacctggccggcatgtccaccaccgcgaaactcaccgaggacggcagacactacgtcctgaacggcgcgaaaaccttcatcaccggcggtgttctcgccgaccgcgtcatcgtctgcgcccgcacctccccgccgaaacccgacgaccgccgcttcggcatctcgctgctcgttgtcgacacgaaactgcccggctactcggtcggccgcaaactcgacaagctgggcctgaagacgtccgacaccgcggaattggcgttccaggacgtcctcgtgccggtcgaggatctgctgggcgaggagaacaagggcttctcgtacctggggcagaacctgccgcaggagcggctcggcatcgcctacggcgcgtacgcgcaggcggcggccgcggtcgaattcgccaagaagtacacgcaggaacgcaaggtgttcggccagacggtgtcgtcgttccagaacaccaagttcgaactggccgcctgtcaggccgaggtggacgcggctcaggccgtggccgatcgggcgctggaggccctcgacgccggggaactgacggcggccgaagcggcctcggcgaaactgttctgcaccgaggtggcgcatcgggtgatcgaccggtgcctgcagttgcacggcggatacgggttcatcaacgagtatccgatcgcgcggctctatgccgacaaccgggtgaaccggatctacggcggcacctccgaggtgatgaagatgatcatcgcgaaggacatgggtctgtag

SEQ ID NO: 656 - DNA, 750 bp, Actinoplanes utahensis
atgagccgggtagccatcgtcaccggggccgcgcgcggcatcggcgcggccaccgcactgcaattcgcgaccgagggcgcggccgtcgccgtgctcgacctcgacgaggacgactgcgccgacgtcgtcggccggatcagagcggcgggcggcaccgcggtcgcccacggctgcgatgtggccgacgaggcccaggtcgacgccgtgatcgacaaggtcgccgccgagctcggcggggtgcacgtgctggtcaacaacgccggcgtgacccgggacaacctgctgcacaagatgcccgcgtccgactgggacatggtgatgaacgtgcacctgcgcggcgcgttcctgtgcagccgggccgcccagcggcacatggtcccgcagcgcaccggcaagatcgtcaacacgtccagcgtgtccgcgctgggcaaccggggccaggccaactacgccgcggccaaggccggcatccagggcttcacccgcaccctggcgatggagctcggcccgttcgggatcaacgtcaacgcggtcgcgcccggcttcatcgtcaccgagatgacggacgccaccgccgctcggatcggcgtctcggctgccgatatgcaagccaaggcagccgagatcacgccgctgcgccgggtcgggcagccggaggacatcgcccgggtggtcgccttcctggccagtgacgccgcctccttcgtcaccggacagaccatttacgtcgacggcggacgccgtctctaa

SEQ ID NO: 657 - DNA, 1149 bp, Actinoplanes utahensis
gtggacctcaccctctcggcggaacagcaacagctgcgcgacctcgcccgggactgggtggagcgcgaggtcgtgccgcacgccaccgagtgggatcgcgccgagcaggtcgacccgaagatcgtcggcaagctcgccgagctgggctttctcggcctgggaatcagtgaggcgcacggcgggtcgggcggtgacttcctcgactacgcgatcgtgatggaggagttgggccggggtgacaccgcggtgcgcggcatcgtctcggtcaccctcggcctggtcgccaagaccattcaggcgtacgggacggacgagcagcgggcgcactggctgccccggttctgctccggcgagacgctgggctgcttcgcgctgaccgagccgggcaccgggtccgacgccggcaacctggtcacccgggcggttcgcgacggcgacgactggctgatcagcggcgagaagatcttcatcaccaacggtacgtgggccggggtggccctggtcttcgcccgcaccggcggtcccggcccgaagggcgtctcggcgttcctggtgccgaccgaccgcgcgggcctcacccgccgggagatcaagggcaagctggggctgcgcgggcaggccaccgccgagctcagcttcgagcaggtccgggtcgccgacgcggagcgcctcggcgacctcggtgcgggcttcaagatcgcgatgtcggcgctggacaagggacggatcgcggtcgcctccggctgcgtcgggctgtcccgggcctgtctggaggccgcggtggcctacgccggggagcgcacccagttcgccaagccgatcgcgtcgtaccaactcgtccaggagatgctcgcggacatcgcggtggagaccgaggcggcccggctgctcgtctggcgcgccgccgacctggtcgaccggcgccagccgttcggcaccgccgcgtcgatggccaaactgttcgccagcgaggccgcggtcaaggccgccaatcaggcgatccaggtgttcggcggatatggatacatcgacgagttcccggtcggcaagttcatgcgcgatgcccgggtgcagaccctctacgagggcaccagtcagatccagaagctgctcatcggccgggcgctgaccggaatcagcgcgttctag

SEQ ID NO: 658 - DNA, 639 bp, Actinoplanes utahensis
atgccgcggccgaccaccccgctgctcagcaaggccgggatccgggccgccgcgctggagatcatcgaccaggacgggctggacgggctcagcatgcgcaagctggccaccgccctcggggtcagcgcccccgcgctctacttccactaccccaccaaggagcaactgctcgacgacgtggccagcgagatcatggagcaggtggacgtctccgggttcgccgccggctggcgcgacgggctgctcggctgggcccggtcctaccgggcggcactcgccgggcacccgaacatcgtgccgttcctggcacacggccccggccagcgcgacgcctcgctacgccgggccgacgccatccacggtggcctggtcgcggccggctggccggcccgggacgccacgatgatcggcgcctcgacgaaatatctggtggtcggcgccgcgatgggctcgttctcccgcggcttcgtcgacgacgtgcaggtctacctggaccgctatccggcactcggcgacgcgcaccggctccgcgagcacgccgacgccgtcgaccgggacagtttcgagttcgcgctcctcacctttgtggacggacttgccgcccgcctcgcccgatcggcgacaccgccggtgcattga

SEQ ID NO: 659 - DNA, 870 bp, Actinoplanes utahensis
gtgttcaaaagtcagcggctctggctcgacctggccgggctcgcgctgtccgccggcctgttcgtggcggccttccacgcccacgccccggtgcaggacatgctcgtcggggtggccacctcgttcatcttcgccaccatcctggacatgttcgtcaccctgcagaacaggctcgccgaccgcgcccgcgtgcatttcttcggcgccgagctggtccgccgggaaacgctgctctgctatcccgacttcgtcatgcacgacgacgtccgggccaccctgaacgaccacaaccagcagatgctgttccagcgtccgcactcccggttcgtcgagttgaccgtgcaccggatcgacatcccgcgggtggtcgccgccaacgacatccagtcgctgctctacgtctcgtccgctttcgaggcccgcaacacctgcccggtgatgatcacggtcgacaccgcgatcgtcgacgactgcgcgcgcagcttcgtcagtttcggcctgtccagcaacgactgcacgcacctgtacgccaacgagcacgccgacccgctgttcaccatcatcgaggacgaggtcggctccgaattcatccggctgcgcaacggttcggagtaccgctccaccaagcgcaagcagtacggcatcatcctccgctacgctccgaacccggaggagttcccggaacgtcgctggctgctggtcgccggcctcggtccggtcggcaccaccgccaccgggtggtatctgtcccagcactggcgccagctggccggcagcgtgccccgcgacaagaatttcatcgcggtcctctccaccggcgtctacaccgaccacgcaccgcatctcgaggagatctgcctggatgactga

SEQ ID NO: 660 - DNA, 867 bp, Actinoplanes utahensis
atgactgaggtcctgctggccgggctgtgcacgctcgacatcctgcaactcgtcgagaagtacccggccgacaacgagaaggtcaccgcgctcacccagaccgtcgccgccggcggcccggccaccaacgcggccgccaccgtcgcccacctcggcggtgatccggtcctgctgaccgccgtcggccgccaccccctcgccgccggtatccacgccgacctctccgccctcggtgtccgcctcatcgacctgaccgataccgatcccggcgcccccagcgtctccagcatcgtcgtcagcgccggcaccggcaaccgggccgtcgtctccaccaacggcgcggcccgctcggtcaccgtcccgcacctcgccgccctcgtcgacggcatgagagcagtgcaagtcgacggccactatccggagctggccaccgcggtcctgaccgaggcgcggcgccggggcatcccgaccctcatcgacgccggcagctggaaaccggtcaccccgcggctgctcccgctgctcgacgtggtggtctgctccgccgacttccgaccgcccgggatcagcaccccgcacgacgtcgccgccttcctcgccgacgccggcgtccgctggatcgccatcagccgcggcgaccggccgctgctccgctggaccggcggcggcttcaccgagcagccggtcccggcgacaccggtgatcgacacactcggcgccggcgacgtcctgcacggcgcgctcaccctcgcggtcgcgcgccgctggccactcaccgacgcgacattcgccgaggcgctcgacgaggcggcggcggtggccagcaggtcgtgcggctctttcggcacgcgtgcctggatgtcctga

SEQ ID NO: 661 - DNA, 735 bp, Actinoplanes utahensis
atggcgcggatcgacttcgagggcccggtcgcggcggtgtacgaatcgggtcgcggcgcgccggacggcggcctggacgggtggcggacggcgctcgccgcgcacctgccggtggccgccccggtgctggacctgggtgccggcaccgggctgtacgcgcggctgctgcacacctggttcggggtgcgggtggtggccgtggagccggccttcgcgatgctgcggcaggccgcgccgcccgcgcaccgggcggtggggcgagccgagcggatccccctcgcgagcgggtgctgcggtgcggcctggctgtccacgatgatccaccacgtgggggacctgccggcggcggcgcgggagctgcgccgggtgctgctgccggaggcgccggtgctgatccgcagtgccttccccggcgatcaggagcggatcgcgctgtaccggttcttcccgacggcgggagcggtgctggacaccttcccgacggtggcgcaggtccgggcggctttcgagacggccggctacgcactgcgggagcagcgccgggtccggcagatcaacgcggcgaccctggaggactattacgagaaggtccggcatcgcgccaacaccaccctgcacgccatcccggatgccgaattcgccgccgggctgcgggcgctgcgggcggcggcggactccggggtccgcgagccggcggtctccgaactgaccctgctcgtgctgtccccgcggtga

SEQ ID NO: 662 - DNA, 711 bp, Actinoplanes utahensis
ttgcatatcctgtcggctatgggcggcctcgtcatcctcgatctggacgacaccctgctgcgcaccgcggccgccacccgggccgcccgccggctggtggcggaccgggtcttccccggcgccgccgaccgggtgctgccgatctggcggcgggtcaccctgctctatccggaccagcagttcgatgatctcctgtcggtggtggccgcgctgctcggcacccgtttgccgcccgacctcgacctgcgggaactcgccgccggctatcaggctgccgcgctggcgcggatcaccgcccggccgcgggtggtggccgccgcacgccgcctgcgcgacgtcggcgggcatgatctggcgatcgtctcgaacggggacgacgccgtgcagcgcaccaagatcgagcggtgcggtctgggtgatctggcaccggctgagcgggtggtcatttgcgacggggtacgcattccccgcaaaccccatccgcaggcggtgcacgccgtgctgaccggcgccccggccgtgctggtcggcgaccggaccaccgacgtgctgtgcgcccggcgcgccgggatcccggtcgtccggctacgcgcccgcaccgccgacctggaacgcggcgccggcctgcgcgcgatcgcccgcccggacgccctctgttcggccgccgagctctacgaggtgacccgggaactcctggaggaacgaggatga

SEQ ID NO: 663 - DNA, 669 bp, Actinoplanes utahensis
atgaccacgcgcagcctgcccgaggagaccgcgttccgctggcgtcagttcaccggcctgggcaccacccgggtgcactgggactggcggggcggctggcggccgggccggtggtcgtactggtggtatctggatctgaccggcgccgcggagctcgccgcgctggccgcggacctgctggccgagctgcgcctggagtgcctggacccggccgtgcacctgcacgtcagcctgcagcaggtcggcttcaccgacgaggtcaccgccgggcaggcgcgggccctgctggccgcggccggccggctcggcctggcgccgctggagctcaccttcggtccggccgacccgaacccggagtcggtggtgctgcgggtcagcccgtgggagccgatccagcagcaccggctgcggctgcgccgggtcaccgagccgatcgtcggcacgctcaccggcgccgacgaccacttctggccgcacgtctcgatcggttacgtcaacgccgtggtgccggccgcgccgatcgccgaggcgctgcgcgcgctgcccgaccgccgggtcacgctgaccgcgcgcgaattgcggttggtccggctcaaccgggacgaccgcctctggaaatgggatgtggtcggcgcggtgccgctcagcgccgggccggcgagacgatga

SEQ ID NO: 664 - DNA, 654 bp, Actinoplanes utahensis
atggccgacgtggttcgggaccgggagcagctgttcgcgcgcgtcgtcccactgctcgggtcgggcagacgggtgctgatcgggatcgccggcccgcccggcgccggcaagagcaccctggccgcctggttgcaggcgcgggtcaccgagcggttcggcgccgatccgctgctggtcgcgcaggtgccgatggacgggttccacctgagcaacgcggtactcgccgagcgcggcctgcgggatcgcaagggcgcgccggaaaccttcgaccgggacggtttcgccgacctgctgtgccgggcgcgcgacgcgcaggacgagatcggcgccccggcgtacagccgcgagctgcacgagccggtgccggacgcgcaccggatcccggcctcggtccggctgatcatcagcgagggcaactacctgctgctgcccgatgacggctgggaccgggtcggcgagtgcctcgacgagatctggtatctcgacgtgccctgggaggtgacccggcagcgtctcgtcgaccgccaggtggccggcgggcgcaccccggaggcggccgcggcctgggtcgacggcaacgacaaacgcaacaccggcctggtcgtcgcggcggccggccgggccgcggtcatcgtctcgccggcccggcgctga

SEQ ID NO: 665 - DNA, 1008 bp, Actinoplanes utahensis
atgctgcgcaagctgggtttcctcaccatcgggctgttcgacgaggtggatccgcgccggggtcacgagtcgaccctggagatcatcgagctgggcgagcggctcggcttcgacagcgcctggctgcgccaccggcacctgcagttcggcatctcgtcgccggtcgcggtgttggccgccgcctcgcagcggaccagccggatcgacctgggcaccgcggtcatcccgctcggctgggagaacccgctgcgcctcgccgaggatctggccaccgtcgacctgctctccgggggccggctccatccgggcatcagcgtcggcccgccgatgaactacgaccgggtcaaggacgcgctctatcccgacacggccgccgccgaggacttcagctattcccgggtcgagagactgctggctttcgtccgcggtgagcaggcgaccgacctgcgcggagcgatcgggttcgagcagttctccgaccgggtccagccgcactcacccgggctcgcgtcccggatgtggtacggcggcggcagcctgcgctccgcgcggtgggccggcgagcacgggatcaacttcctgaccagcagcgtcgtcaaggccgaggagtcggaggacttcgccgagatccagctgtcgcacgtgcgcgccttccgggccgcccacccggacggcgatcgcgcccgggtctcgcagggcctggtggtgatccccaccgactcggccaccgccgagcagcgcgcccggtatgccgcgtacgccgagcagcgcaccccgcggacgacgaccccgcagggcccggcccggatgatgttcgcgcccgacatcgtcggcacctccgccgagatcgccgagcggctcgaggcgcacgccgcgttccgggagatcgacgaggtggcgttcgcgctgccgttcaccttcgggcacgacgactacgtgcagatcctcaccgacatggcggagcggctcggcccggccctgggctggaaaccggcgtccgcgggttag

SEQ ID NO: 666 - DNA, 861 bp, Actinoplanes utahensis
atgtcccgcccccggacccgtgcctacctgatcgcggcggccgccgccgcggtgctcgccgccggtgcggccgtcgctgtcgcccacgaccgcgcccccgatccggtcgccgggcagtgggtcgcgcccgccgccgcggcgctccggccctcgcccaccgcctcggcgaaaccgctgcccgccgcgaagccgccggccggcctcccggtgatcgagtacgcgtccggcccgtccgggctgcccgccgacccggagcagaactcgaccgtcgcaccgacccgggccctgcaccccaccaccaggatcgcgctgtacgacgcaccgggcggcaagccgcgcgcctacctcccgcccgacatcagcgggttgcgcaccgtcgtcccgatcgtcgagcagcgcgacggttgggtggccgtgctggtcccgtcggtcaaccggcggatcggctgggtgccggtgggctccggcgagaccgtcacgctgcgcgaccagctggtcgcccagctctccgagcacgcgttgatctggctgcgcgacggccaggagcagcagcgctggacggtggcgaccgggtcgaaggcgaccccgaccccggtcgggcgcacctacgtgatgggcacgaccccgttgaagggcgacatctacctcaacatgggcgcgctggtgctcggctcggtgccggagcagccggagaagatggccgcggtgttccagctggcgcacaccggcatccacgcctggtacaacaagtcagcattcggccacagcgtgtcgaacggctgcctgcggatgccgaaggccgcccagcagaagctgctcgacgagattccgccgggaacgaccctgacggtgctgtcctag

SEQ ID NO: 667 - DNA, 1140 bp, Actinoplanes utahensis
atgacagatcttcgtacccggaaaccacccgtggcgaccgacgagaccgtcgccgtcgacgccatcctcgacatcaccgacgaccgtggctggctacgcgccgacggctacctgcccggcccgtccgacctgccggtcgccgtgcccgacctgcgccggctcggcctgcgccgcggcgaccgggtcaccggcttcgcccggatcagccgccccggcaaaccggtcaccctgcagctcaccgccgtcaacggccgcccgcccggcgcccgccccgacttctaccagctgaccgccctctacccgcagcagcggctgcgcctggaaaccgaccgggaggtgctcgcgacccgggtgatcgacctggtgatgccgatcggcaaaggccagcgcgccctgatcgtcgcgccgcccaaggccggcaagaccacgatcctgcaccagatcgccaacgcgatcacccgcaaccacccggaatgccacctgatggcggtgctggtcgacgaacgcccggaggaggtcaccgactggcagcgcaccaccaaggcggagatttgcgcggccaccttcgaccgtccgccacagcaccacaccgccgtcgccgagctggccgtcgaacgcgcgaaacggctggccgaactcggcgaggacgtcgtcgtcctgctcgattcgatcacccgcctgggccgcgcctataatctgaccgccccggccggccgcggacgcaccctctccggtggcctggacagcaccgccctgcagcctccgaaacgcctgctcggcgccgcccgtaacatcgaaggcggcggctccctcacgatcatcgccaccgccctggtggagaacggctccaccctcgacaccttcctcttcgaggagtacaagggcaccggcaacgctgagctgaaactggaccgcaccctcgccgaatcccgcgtcttccccgccatcgacgtggccggctccggcacccggcacgacgagctgctggtgtcccccgccgagctgaccgtcctcggccagctgcgccgggccctcaccggcgccgaccgtcgcgacaccatgcagcagctgctcacccagctcggcaccacccccaccaacaccgatctgctgcgccgcgtcgcacactccctgtcctga

SEQ ID NO: 668 - DNA, 882 bp, Actinoplanes utahensis
ttggcggaggaacacgacatcggcgggtcgaccgtgcgacggctgcaggtcggggcgcacctgcgcgcgttgcgcctggccggtgggctgagccgggagaaggccggatatgtcatccgcgcctccgagtccaagatcagccggatggagctgggccgggtcgggttcaaggaacgtgacatcgtcgacctgctcaagctgtacggcgtgaccgaccggagcgagcacgagcgcctggtcgcgttggcccgggaggcgagcgcgccgagctggtggcattcctacgccgacgtgctggacacctggttccagaactatctggacctggagcaggcggccgagctgatccggacgtacgaggtgcagttcgtgccggggctgctgcagaccgacgcgtacgcccgggcggtgatccgtctcggtcacggccatgccgacagcagcacggtcgagcgccgcgccagcctccggatgcaacggcagaaggtgttgcgtcggccggacgggccgcgcctgtgggcggttctcgacgaggcggtgctgcgccgcccgatcggcggccgggcggtgctgcgggagcagatcgccacgctgatcgagacctgccgctcgccgaacgtgcggctgcaggtggtgccgttcgagtcgggcgggcacgcggcggccggcggcgcgttcagcattctgcgcttcccgcacgaggagctgcccgacgtggtctacatcgagcacctgaccagcgccctctatctggaccggcgggacgaggtcgaccactacgcggccgcgatcggccgcctgttcatcgaggccgagccgcccgccgagaccccggagatcctcacccgcatcctgcgcgagctggacaccgggaagatctga

SEQ ID NO: 669 - DNA, 876 bp, Actinoplanes utahensis
gtgcacacccgcaggatcgtcgtcggctacgacggctcggtcgaggcccgcaaagcggcccgctgggcgctggacgaggccgaacgcggcggcgtgccggtcgagctggtctacgcgtacgagtggcccagctacgtgccggccgcggcgatgatgccggccgccgcggtctaccccgacctcgacaccgacctggccgtcgcggacatgctcgggcgggcggtggacgccgcgacgagcagtcaccccggggtcccggtgcgcgcccgggtcgagcacgccaccgcggcggtcgccctgatccagcgcgcggccgaggcgtccctggtggtactcggcggccggcggccgaccggggtgcgggcctggctgggctcgaccagcgggtcggtcagcgcgcacgcccgctgcccggtcgtggtggtccgcggcgagccgcgggagaccgacccggtggtggccggggtcgacgactcggaggcggccggtccggtgctcggcttcgccttcgagcaggcggtggtgcgcggggtgccggtccgggcggtgcacggctggtccccgccggacgggcgcgacctgctgtgcgacaccaacctgcgggccatcgccgacgagcggggccggctggaggcgatggtcgagtgctggcgccggcggtatccacgggtgccggtcagcgccgaagtggtggtcgggtcgccgggtgaggtgctggcgcaggccgcggcgggcgcgcagctggtggtggccggggcgcgggcgcggcgggcgctgcgggtggcgctgcggccctcggtgggacggcacctgctgcaccgggcccgctgcagcgtggctctggtgacccggagccgcgcggtgatccgcttctga

SEQ ID NO: 670 - DNA, 1008 bp, Actinoplanes utahensis
atggctgtcaaggccgagtacctgtgggtcgacggaacccagcccaccgccaagctgcggtccaagaccaggatcctggccgacggtgcggagcccccgatctggggtttcgacggttccagcaccaaccaggcgcccggtgacaagtcggactgtgtgctccgcccggtcttcacctgtccggacccgatccgcggcggcgacaacatcatcgtgctgtgcgaggtcgagctgatcgacggcaccccgcacccgaccaacacccgcgccgcctgcgtcgcgtccgccgagaagtacgccgaccaggagccgatcttcggcatcgagcaggagtacacgttcttcaaggacggccgcccgctcggcttcccggccggtggcggcttcccggccccgcagggcggttactactgcggtgtcggcgcggacgaggtgttcggccgggacatcgtcgaggcgcacatggacgcctgcctcacggccggcctgcacctgtccggcatcaacgccgaggtgatgccgggtcagtgggagttccagatcggcccggtggccgccccgcaggtggccgacgagctgtgggtggcccgctggctgctgtaccgcatcgccgaggacttcggcatctccgccaccctggacccgaagccggtcaagggtgactggaacggcgccggggcgcacaccaacttctccaccaacgcgatgcgcgacaactacgccgcgatcatcaccgcggccgagtcgctgggcaagcgccgccaggagcacgtcgacggttacggcgcgggcatcgagcaccgcctgaccggcctccacgagaccgcaccctggacggagtacagctacggcgtgtccgaccggggcgcctcggtgcgcatcccgtggcaggtggagaaggacggcaagggttacctcgaggaccgccgcccgaacgcgaacgtcgacccgtacgtggtcacccgcctgctgatcgacacctgctgcgcggcgctggcgcaggcctga

SEQ ID NO: 671 - DNA, 390 bp, Actinoplanes utahensis
atgggccgggcaggtttccccgggcagggaaaggtacggcggtcgatggcgagcttcgaggcgaggacagccgccgcgccggaccatgtcaccgtgttcctggccggtgactgtgacctggcggcccgcgaccggctgaccgccgcgctgctcgacgcggtgccccgcgccggcgaggtgttcgtcgatgtttcgggggtcggtttcctcgattcgaccggggtgcacgccctggtgaccgcccatcacgcggctcgcgggcggggtggccggctctatgtcgtcggcgccgccggctcggtcgccgcggtgctggaaatgaccggcctggacgcgcttctgaaagcgcccgggggttcgaccgccgaggacgggcgtcgccatgcctga

SEQ ID NO: 672 - DNA, 375 bp, Actinoplanes utahensis
atgcctgacatcgacagcatgtcctacaccgagccggacgatctgcgcaccgtccgcgtcttcgtcgcggagcgggcccgcgcgctgggcctgccggccgcccggatcgagctgctcaccctcgcggtcagcgagctgaccacgaacacgctgcagcacaccggcggtggcggccacatccgggtgtgggccgaggacggccggctggtctgtgacgtggtggacggcggcggcccgcgcccgttcggccgcacgatgccgtcggcggaggcgatccgcggccgcggtctggccatcgtggagcgggtgtgcgacgcggtctacacgaccgccgtgccgggcggcaccatggtccggatctgtctcaatctctga

SEQ ID NO: 673 - DNA, 1500 bp, Actinoplanes utahensis
atggccgtcgacgacgtggtccgggaactcctcgccgcgattccggccggctgcacctggctggtcccggtcaccgggccggacggcgcgatcatcgacttccgggtcgccgcgaccagtgaccagatccacgacatctacggccggggcgcgcaacgcgtcgacggcctgctcgccgagctgtatccgtccatggtggacggaccactgtggcggctctacgtcgaggtgctgaccaccggcacgcccgccaccatggacgagttccggttcgagcagtcgcgccccggggtggtcgccgactcccgcttcgagatcagcgtgtacccggtcctcggcggcctgctggtctggtgggcccgggtcgacgagcaccgccgccggctggagagcaccgagctgctcggcagcctcggctgggccgagcacgagctggccaccggcggcaacgagtggtccccggggatgtaccggatcttcgagcgggacccggccgacggcccgctgtcccgcgtcgagcaggccgccgcgatgctggccgaggaccgggggatcgccgaggccgcctggcagaccctggacgtcggggccacctccgacgtgaccgtccggttccggatcggcgaccgcgtcaaacacctgcggatcctctccgacctggcgcacgacgcggccggccggccggtgaagatctacgccgtggtgcaggacgtgaccgcccgggtcgcctcccgcaccgagatcgagcggctcagcgaccaggtccgggtcggcgagctgaccgcgctcgccgagcaccggctggcccggcagctgcagcagatgatccagccggtgccggccggcccgttccggctcggcgacctcgaagcgatggtcggctaccaaccggccgagagcgcggtccaggtcggcggcgactggtactgcgcgcagaccctgccggacggccgcgtcgtgctcgccgtcggcgacgtcgccggacacggcatggaagccgccagcggcatggcccacctgcggttcgccctggtcggctggctctcggtcggcatccgcgaccccggactgctgctgcggcacctgaaccggctgtgcgcccagctcggcatcaccgggacggcggtggtcggcgtctacgaccccggcaccgggcggctgccctgggcacgcgccgggcacatggccccgatgctgggccgcggcggccgcgccgtcgacctggaacgcccgcccgggctgctgctgggcgccgaggcggacaccgagttcccggtcgccgacgccgagctgcgcccgggcgacctgatcctgttctacaccgacgggctggtggaacgccgcggcgacgcgacccggcgcacgaccgaggtgcgagaccgtctcagcgcggtgtccgcggcgccgggtcccgacccgctgccgcacattcaccgattgctgtacgcgccgagcgccgacgacgacacctgcaccctcgctgtgctggtcagagattga

SEQ ID NO: 674 - DNA, 180 bp, Actinoplanes utahensis
atgagccgcagcatcggcgaggcggccggcggcagcaccagcatcgccggcagcatcaccgcggtcgccagcgccgcgcacgcgaccacgtccgcgctcggcgaggcggacgcgtcgatgagcgagctgacccgggtcgccggcgagctgcgcgacgtggtcgcccggttccgggtctga

SEQ ID NO: 675 - DNA, 456 bp, Actinoplanes utahensis
atgccgcacacctcgaccacggccttgacgttcagcgacgccgaggccggcctgacctggccgatgggtgactgggcggccgctctcgagccgccgaccgtgctgatcgccgacgacgacgaaggcatccgcgacctggtcggcaccaagctgcgggcggccgggtaccgcaccctgatcgccgcggacggccgcaccgcgatggccctcgcggtcggcgaacggccctcactggtgctgctcgacgtgtgcatgccgggcctcgacgggctgggcttctgctacgagctgcactcgtcgccggagaccgcgcacattccggtgatcttcatcagcgggcgcgccgagccggacgacatcgccctgggacgcgtggtgggcgccgaggactacctggtcaagccgatcgacccggccgatctgctggagcgggtgcagcggctgctcgggcactga

SEQ ID NO: 676 - DNA, 978 bp, Actinoplanes utahensis
gtgggtgccatcgggttgcgaacgcccccacagattaggttagggttacctaaaccgatccgggaggcgaccttgaccccgaccgctgcgccatcgaccgaagcactcccgttccgcttcttcccggtcgaggtccgccgggtcacccgcctgagccccagcttcctgcgcgtcacgttcaccggcgacgacctcgaccggttcgccgccaacggcctcgaccagcgctgcaagctgatccccccgctgcccggcagcggcctcgaccacctgcccaccggcgacgactggttcgccgcctggcgcaccctgcccgacgagcatcgcaacccgatccggacgtacacggtgcgcgccgtccgccccctcctcgccgaggtcgacatcgacatggtcctgcacggcgagaccggtcccgcctcccgctgggcggtcaccgccgcccccggctcgatcgcctgcctgctcggcccgaacgcggacttccccggcgtgcacggcggcatcgacttccacccgccggtcggcaccagccgcgtcctgctcgccggcgacgagacggccgtccccgcgatcgccgccattctcgccgcgctccccgccaccacctgcggcgacgccgtcctcgaggtaccggtcaccggcgacgagctgccgctcaccgcgccggagggcgtgcggatcacctggctcccgcgggacggcgccgcccacggcgcgaagctcgtcccggccgttcaagcggtgatcggcgtcaatggcgtcaccggcgccgagctggaggacgtcgacgtcgacgcggacatgctctgggaggtgccggacggctccgccgccaccgacggcttctacgcctggctcgccggcgaggccgccgtcatcaggacgttgcgccgccatctggtcacgacctgcggcgtcgatcgccgggcggtggccttcatgggctactggcgtctcggccgggcagaatgctga

SEQ ID NO: 677 - DNA, 1008 bp, Actinoplanes utahensis
atgacagtcgccaccgggctccctagggtgccgatcatgactgccgaatcccgggacctcatctggcgcccgctggccgtgtccgacgccgcggcgatggccgacctcttcaacgcgatcgacgacgaggatcacgtctgggggcagtacaccgagcaggacgcggccgaggaactggactcaccggtcgacgacctcccgacgtccacgctggcggtgttcgacggcgcgacgatgctcggcttctccgcggtccactacaaaccggcagcccaggtcgtccaccgggtacacgcggccggcgccgtccgacccacccatcgccgtcagggcctcgggacgaggctcatgcagcacggactggcgaccgccaaggcgctgcacgcacggcatcaccccacgctccagctggtcgtcgaatccgtctacggcgagcacgtgcacggggccgtcgccctgtaccgcgcggcgggcatgacgtcgacgaagtggagccggcacatgaggcatccgctcggcaccgccattccggacgcccccatccccgacggtctgcacatcgagagctacacggcggagaccgacgaggagttccgcacggtccgcaacgacgccgctcaggccttgggccggtcgccgctcagcgccgaggagtggaaggtctgggccgtgaacgcgaacttccggcccgagttgagcttcctgctccgtgacgtcgaaaccgggacggcggccgggatcgtcctgatcgtctcgtgggaggcggaaacggcggcgaccggcgtccgcgacgcgtatttccgggtcatcgccacgcggcccgcgtacgaggagcgcggcgtggccgaagccctgatctcccacacgctccgggccgcacaggaccagggctacggacgggccagcctcaggggcgacgcggacagttcgagcaaagagttcacgatgtacgagagggccggcttcatcacccaggacactcaggtgcactactgcatcgaactctga

SEQ ID NO: 678 - DNA, 933 bp, Actinoplanes utahensis
atgtcgttcttcgcgaacgccgagaccttcgccggccaggtcgtcgccgactacccgggcggccgaccggacgccaccgcctggtccgtcgcctggcacgacgacgagatggaccaggagggcgtgctctccgacggcttccgcgacatgttcgagggcttcgtcgccgaccggggcgccaccaccgagacgctggtcatcggcgcctggggctatgcggcgttccgcccggccccgatccggcagctggtcgacgccgccccgcgcctgccccggctgcgcgcgctgttcctcggcgacatcaccggcgacgagtgcgaggtctcctggatgaaggtgggcgacgtcagcccgctgctcaccgcgttccccgcgctgcgggccctgcaggtgcgcggcggtgaggacttccggttctccccggtgcgcaacgacagcctgcgccgcctggtcgtggagagcggcggcctgggctccgccttcaccaccgccgtgctcgcctcctcgttccccgagctcaccgacctggagctgtggttgggcaccagcgagtacggcggtgacaccagcctcgccgacctgcgcccgctgctcgacggcacgctgttcccgcggctgcgccggctcgggctgcgcaacgccgagtccgccgacgagatcgcggtcgcgctcgcccaggcgccggtcgtcgcccggctggagtcgctcgacctgtcgatgggcacgctcggcgacaccggcgccaccgcgctgctggccggccagccgctcacccatctgcgccggctcgacctgcgccaccactacatgtccgcggaggtcgccgccgccgtggtcggcgccctgcccggcgtcgaggtggacatcgacgacccgcaggaggacgacgtcttcgacgacgtcgcctaccggtacaccgcggtctcggagtga

SEQ ID NO: 679 - DNA, 1947 bp, Actinoplanes utahensis
atgggaacggcgccagtcgccggcgagcttcacctacgccgcgcaccacgcgttcttcgccggtttcctgcccacccccgggccccgactcttcgcggccgccttccccggcagcgcgagcaccgggccggacacctgggtcttcgacgtgcccgacctgcccaccgcgctcgcccggcacggctatcacacgctctgcctgggcggcgtcggcttcttcaaccggcgcaccgcactcggctcggtgctgcccgggctgttcaccgaggcgcactgggagccgtcgttcggggtgaccgctcccgactgcctcggcgctcagctcgaccggctcgcgatctcgctggccgcggtcccgcccgggcagccggtcttcacgttcctcaacgtcgccgcgatgcaccaaccgaaccggcactacgccgggctcgcggaggacaccgtggtcagccacggtgccgcgctcgaatacgtcgacgggctgctgccccggctgttcgcgctggtgcggggacgcggacggccggtgttcaccatcctctgctccgaccacggcacggcgtacggcgaggacggccacaccggtcaccgcatcggtcacgaggtggtgtggacggtgccgtacgcggacttcaccctcccggcggcgtcatgatcgacggctcgccctaccagggctacctgtacgcgtatccgcacaagacgtcgtaccgcccgctcgacccgcgccccgcgctcgccgacgtctggcgcgacgagccgcgcgacgccctcttcctctacgtgcacgtgccgttctgcgagatgcgctgcggcttctgcaacctgttcacccgcaccggcgcccccgccgagcaggtcaccgcgtatctgcggcagctgcgccaccaggcgtcccgggtcgcgctcgacggcgccgtgttcgcccgcgccgcgatcggcggtggcaccccgacctatctggaggcggacgagctcgccgcgctcttcgacatctgcaccacggtgatgggcgcccggctgcccggcatcccgctgtcggtggagacgtcaccggccaccgccacccccgaccgtctggcggtgctcaccgggtacggcaccacccgggtcagcatcggtgtgcagagcttcctggacgccgaggcccacgcggccggccgcccgcaacgccgcgccgacgtcgaacgcgccctcgccgcgatccgcgacgcccgggtcccggtcctcaacctggacctgatctacggcatcgacggccagaccgccgacacgtggcggcagagtttggacgcggcgctcgcctggcgccccgaggagatcttcctctatccgctctacgtccgcccgctgaccggcctgggccggcgcgcggccacccgcgacgactgggacgcccagcggctggccctctaccgccagggccgcgacacactcctcgcggccggctaccggcaggagtcgatgcggcagttccgcctcccggccgccgccgacgacggccccgactactcctgccaggacgacggcatgatcggcctcggctgcggcgcccgctcctacacccgcgacctgcattactcgttcgactacgcggtctcggtcaccgaggtccgcgcggtcctcgatgactacctgtcccgtccacccgccgacttcgcctacgccgaggtcggcttcgccctctcccccgccgagcaacgccgccgttggctgatcaaatccctgctccgcgccgacggcgtcgacatctccgcctaccgtcgacgcttcggcgccgacccggtcgccgacttcccccagctcgctgtcctgtccgacaccggcctcacccaccccggcaccctccgtctcaccccggccggcctggaacgctccgacgccatcggcccatggctcacctcagcccaggtccgcaccgccatggccggataccacctccgatga

SEQ ID NO: 680 - DNA, 1335 bp, Actinoplanes utahensis
atggctcacctcagcccaggtccgcaccgccatggccggataccacctccgatgacggcacctccccgagcatcgggcctcgtccgtccgccagcagccggccgctcccccgccccggcaccggaggctgtcccgccaacccgcgacgccgcccctttcccgggcctcgacggcgctcctcctccgagcgccggggccgctccttccccggcgtccgggggtgatccttctgcgtcgctcgggcttgcgtctgcgccggctgcggcgtccggcctgccatccgcaccggccgcggcaccccgcctgccatccgcaccggccgcggcaccccgcctgccatccgcatctgctgtggcggccggttccgcgccggtcactctgctgccgctgcccaccgtgcgacgaccggcggagccggccggggatctcgcgccgttgccgccaaccctgaccgtgctctaccgcgggccgctggccagctgcaactacgactgcccgtactgccctttcgccaagcaccacgacccaccggccctgctgcgtcgggaccgcaccgccctggaacgtttcacagcctgggccgccgccaccaccgagacccgcctgtcgatcctgttcaccccgtggggcgaggcgctgacccgtagctggtaccgggacacgatgatcaccctctcccacctgccgcacgtcgaccgagtggcgatccagaccaatctggccgcccgccccgactggctgaccgccgccaagcccgatgccctggccctctggaccacctaccaccccggccaggtaacccgcgcccgcttcctgtcccgctgcaccagcctgctgcgcctgggtatccgcttctcggtcggcatagtgggattcccggagcacctcaccgaggcccgagccttgagagccgctctccccccggagatctacctgtgggtgaacgcggccgagggaaagcactacaccccggacgaggaggccgactggacggcgattgacccgctcttcggctacagcgtccgcccccacgcctccctgaaccaaccctgccacaccggcgaatccgtcatctcggtcctgggcgacggcaccgtccgccgctgccacttcatcacaaccccgatcggcaacctgtacgacaattcctggcgcgccgccctccgcccccgcccctgcaccaccacgatctgcgactgccacatcggctacgtccatttgaagcccttggacctgcacaccaccttcgccggcggcctcctggaacgcatccccgccacctggcccgccgccccgacaacaaacaacgccgggcacccccgccgcccgaactag

SEQ ID NO: 681 - DNA, 438 bp, Actinoplanes utahensis
atgcggatcagtgacatcctgcgcgtcaaaggcaccggagtagtgacagtcccacccgacctctccgtggagggcttgatcgccaagctggcccaccacaggatcggcgccgcgatcgtctcccgggacggcaccgcggtagccggcatcgtcagcgaacgagacatagtccgggccttggccagccacggcccgtcagtcctgaccgacccggtcagctccatccagaccacccaggtccgaaccgtctccccggacgcccaactggaggatgtcgaacgcctgatgaccgacaaccgtttccgccacgtcccggtcgtccagaacgggcacctaaccggaatagtctccatcggcgacgtggtcaaaaatcgaatcgacgagctcgaaaccgaacgcaccaccctcgccgattacataaccggcgatcggacctga

SEQ ID NO: 682 - DNA, 648 bp, Actinoplanes utahensis
gtgcgcgcttggcgtataacgagcagcatgcgcacttttgagctggccgagatgctgcgggaggtgcccggcaccgaggtgaccgccgggccgggtctggtcacggtgcacatcccggcgatcggtgacactctccggatcgcgttccgcgacgttctcgacgccgactgggtgcatgtacccaccggcgagcccgccgtccaggtcgacctgcggcgcggacaccagtcactgccgctgatcatcaccgtggacgacgtcgtgttcaccccgtcgtacgctgatgatcttgttgatccggaagaccacctgctggtgccggcgatgccgagtctgatcgcctactccgagatgcaccgggacgtgcgggcactcgggaaggcgctcgacgacccccgggtgcagctggctgacgaggtgctggcggcgaccctcaccgcgcatcggtgtttcctggccggagcgatgcgggtcgggctctggccggtgcgggtggcggcatggtgggaatacacgtccgcgcggtcggccgggcaggtgcgggtggcgcggttcctcccggatccgcgctgggacgagttgatgcacggggtccaggaggctcgccagacgcagttcgaacaggagaatctgcgcgtcatccggtga

SEQ ID NO: 683 - DNA, 1341 bp, Actinoplanes utahensis
atgaccgtcccgcgcagactccacctcaacgcgttcctgatgagcgtcggccaccacgaggccgcctggcgcctcccggaaaccgacccgcacgccgacatcgacgtcgagcacttcaagaacctggcccggatcgccgaacgcggcaaactcgactcggtcttcctcgccgacggccccgtcctgtggaaccaggtcggccgccgcccctccggcgtcctggaacccaccgtcctgctcaccgcgctcgccggcgccaccgagcggatcgggctcatcgccaccgcgtccaccacgtacaacgagccgtacaacctggcccggcgcttcgcctccctggacatcatcagcggtggccgggccggctggaacatcgtcaccaccgccgacctcgacgcggcccgcaacttcaacctcgaccacctgcccgcccaccgggagcggtacgagcgcgccgccgaattcgtggacgtgtccctgaaactgtgggactcgtgggccgacgacgcggtgctcgccgacaaggagaacggggtctggggcgacgccgacaagatctacccggcggcgcacgagggccacttctacaaggtggccggggcgctcaacgtgccgcggtccgcgcagggacacccggtgctggtccaggccggatcgtcggagagcgggcgcaccttcgccgcgaagtacgccgaagcggtgttcaccgcgcaccagaccctcgccgacgcccaggagttctacgacgacctcaagcgccgcgccgccgaattcggccgcgacccggaccacatcaagatcctcccgggcatcgtcccggtcatcgcggccacctcggccgaggcgcaggccaaagaggccgaactgaaccgcctgatcaagccggaatacgcgctgccgcaactcgccggcctgctcggggtgccggtcgcaagcctgcggctcgacgaacaactgcccgccgaactgcccgacgaggacgagatcgaaggcgccaagagccggcggacgctggtcgtcaacctgggacgccgggagaacctgacggttcgcgagatcatcgcgcggatgggcgggggacgcggacacctgaccttcgcggggaccgcggtggaagtcgccgacgagatcgaacactggttcgcctccggggccgcggacggcttcaacatcatgccgccggtgctgccctcgtcgctcagtgacttcgtcgagcaggtggtgccgatcctgcaggaccgcgggctgttccggaccgaatacacggggcggacgctgcgcgaacactacgggctgccgcgcccggtcaaccgcaacgccgcgcacccggtgttgatctga

SEQ ID NO: 684 - DNA, 897 bp, Actinoplanes utahensis
atgagcatcgacatcacccggatcggtggccggatcggcgcctcgatcaccggcatcgacctgaagcagccggtcgcccaggacgacgcccgcgccatccacgaggccctcgtcgcgcacaaggtcctggtcttccgcgaccagcacctcgacgacgagcagcaccagcgcttcgccgccctgttcggcgacctgaccctggcccacccgaccgtcccgtccgtcgacggccaggccaacgtcctcgaagtcgccggcggccccggtgcccgcgccaacgcctggcacaccgacgtcaccttcgtcgtcgccccgcccaaggccaccacgctgcgcagcctcgtcatcccggaacacggcggcgacacgctgttcgccaacaccgccgccgcctacgccgacctgcccgaacacctgcgcgtactggccgaccggctgtgggccgaacactccaacgagtacgactacgccgagcacccgcagttccgctccaccgaggtggagaagtaccacgaggtgttcgtctccacccggtaccgcaccgcccacccggtcgtgcgggtcaaccccgactcgggcgtgccgaacctgttcatcggcaacttcgtcaccggcatcatcggcctgtcccgcaccgaggcccgcgacatcctgcgcctgctgcagcactacgtgacccgcccggagaacacgctgcgccacaagtggcaggtcggcgacctggtcgtctgggacaaccggagcacccagcactacgccgccgacgactacggcgacctcgcccgcaaactgcaccgggtcaccgtcgccggcgacgtgccggtcggcgtcgacggcaccaagagctacatcctcgaaggcgacgaggccacccactacacgccgaaggtgcagtga

SEQ ID NO: 685 - DNA, 831 bp, Actinoplanes utahensis
gtgtctagctccaccctcatcttcccgtctgccgcgacctcggcggtcaccgcgccgccggtcggccggcgggtggtgcggctgctgtccagcgtggtcacgcgtaccgccgccatcgtcgttctcgccctgatctgggagatctctccccggctgggcctggtcgaccggacgttcctgccgccgctctccgaggtcttggtcgcctggtgggacctggtcaaatcgggcgaactgctggagcacacggaggccagcctcacccgctcgctggccggattcggtctggcgatcgtcatctcgatcccgctgggactgctgatcggctggtacaaaccggtcgccaacctgctgaccccgctgctcgaagtcttccgcaacaccgccgccctggcgatcctgccggtcttcgtgctgatcctcggcctcggcgaaacctccaagatcgcgatcatcgtgtacgcgtgcgcctggccgatcctgctcaacaccgtcagcggcgtccgcaccgtcgacccgctgctgatcaaatcggcccggtcgctcggcctcggcccggcccgtctattccagaaggtgatcctgccggccgcggtgcccaccatcttcaccgggatccgactggccggcgcctactcgatcctcattctgatcgccgcggaaatggtcggcgccaaagccggactcggctacctcatcaactacgcgcaatacaacttcgcggtacccgacatgtacgccggaatcatcaccatctccggcatcggcctgatcgtgaaccagatcctcatcctcatcgagcgccgcttctccacctggcgcacgtcctaa

SEQ ID NO: 686 - DNA, 804 bp, Actinoplanes utahensis
atgaccgcgaaaatcgtcttcgagaacgtcggcaagaccttccgggcccgcggcaccacggtcaccgcgctgcaggacatcaacctccaggtccaggacggcgaattcctggtcatcgtcggccccagcggctgcggcaaatccaccctgctcgacctgctcggcggcctcgccgaaccgaccagcggccggatcctggtcgacggcaagccggtcaccggccccggcctggaccgcggcgtggtgttccagcagtacgcgctgctgccgtggcggaccgcccagggcaacgtcgaattcggactcgaggccaagaacgtgccgcgcagggagcgcgcgtcccgggcccgcgaatacctcgacctggtcggcctgaccggcttccacgaccgctacccgcacgagctctccggcggcatgaagcagcgcgtcgcgatcgcccgcagcctcgccttcgaccccgacgtgctgctcatggacgagccgttcgccgccctcgacgcgcagacccgcgacggcctgcaggacgagttgctcaagatctgggagaagaccggcaagaccgtcgtgttcatcacccacggcatcgaggaagcggtctacctcggtcagcgcgtcgccgtgctcacctcccggccgggccggatcaaggacgtcgtcgaggtgccgatccaggcccgctcggccaccgaggacctgcgctcggacccgcagttcgcgcactaccgccacgagatctggagcctgctgcgcgacgaggtcagcaaggcccgcaccgaggaactggaggccacccgtgtctag

SEQ ID NO: 687 - DNA, 1023 bp, Actinoplanes utahensis
atgacaactcgccgtaacgcactcgccggcctgctcggcggcgcctttctgaccgccaccggagtcgcggcatgcggttcgagcggggggtcggcctccggcagccaggtcaaggaactgcgatatcagggcaacgtgggccaggtgacgctgcccgaactcgccgccgacctgggctatctcggcgacgtgaaactcaagtggatcggcaacacgatcagcggcccgcaggacatccaggccgccaccaccggcgacgtcgacttcggcggcgccttcaacggcgccatcgtgaaactggccgcgaacggcgcgccgatcaccgcggtgatcggctactacggcgtcgacaaggacacctacaccggctactacgtgctcgacggcagcccgatcaagaccgcccgcgacctgatcggcaagaagatcggcgtcaacaccctcggggcgcaccacgaagcggtgatcaagacctatctcgccaagaacaacctgaccgacgccgagatcaagcaggtcgagctgatcgtggtgccgccggtcaacaccgagcagtcggtgcggcagagccagatcgacgccggtgcgctcggtggcgtgctgcgcgacaaggcgctcacccgcggcggcatccacccgctgttcaccgacttcgagctgctcggcaaattcaccgcgggcagctacatcttccgcaacgacttcctcaagaagaacccggacacggtcaagaccttcgtcacgggcgtgggcaaggccatcgaatgggcccggagcacccccaaggaccaggtcatcgccaagttccaggagatcgtcggcaagcgcggccgcaacgaggacaactcggcgctgcagttcttcaagagctacggcgtggccggcaccgccggcgcgatcaccgacaccgaattccagacctggatcgactggctgtcccgcgccggtgagctgaagaagagcatcaagcccgccgacatctacaccaacaggtacaacggtaacgcgggcggtgccgcatga

SEQ ID NO: 688 - DNA, 999 bp, Actinoplanes utahensis
gtggtcttcaagaagttgctgggcgccatgggagtcggtgggccgagcgtcgacaccgtgctggccaacccgagcacctacccgggtgctccgctgaccggtcaggtcaacctgaccggcggcacccaggtcgccgacatcgagcacatcaccctggccctggtcacccggatggaggtggagggcggcggccacgactactcgaccaccggcgacttctaccggctgaccgtgtccggcccgacccggatccacccgggtcagcagatgtccatcccgttccgcatcgacatgccgtgggagacgccgatcaccacggcgtacgggcagccgctgcgcggcatggtgatgggtgtgcgcaccgaggtgtcgatcgcccgggcgctggacaagggtgatctcgacccggtctacgtgcacccgctgccgatccaccagaagattctggacgccttcggtcagctgggcttccgcttcaagtccgccgacctggagtacgggcagatctacggcgtccaccagaccctgccgttctaccaggagatcgagtactggccggccgcgcagtacgcgcacgcggtgaacgaggtcgagctgacgttcgtgaccagcccgcacgcggtcgaggtggtcctggagttcgacaagcggggtgggctgttccactccggtcacgacacctacgggcggtacaccgtctcccaccacgacgcggagaccaccgactggcgctcggtcgtggacggctgggtgcgccaggcggtcgacaagcaccggtcccggccgggctacggcgggcatgcggcctacggcgctcccggctacccgccgcccccgcccggctacgggcaccacggcggccaccacggacaccacggccactaccaccacgggagtgggatgggcgggtccgtcctgggcgcggtcggcggtctggcggccggtttcgtgatcggcgaggcggtcgaggagatcttcgacttcggtgacgacgactga

SEQ ID NO: 689 - DNA, 330 bp, Actinoplanes utahensis
gtggtctacgacctcgcggaagtcaccgtcacacacgagccgggtcacccggacgaggtggtcgccgggcagccgtccaccggggcggtgagcgtcaccacgctcgacgggccgggggtcgagatcggtatctgggagatgaccgtgggagcggtccgcgacaccgaggccgaggaggccttcctggtgctgtccgggcgcgcgacgatcgcgaccggtggcgagacctacgaggtgaagccgggcgacctggtgcgcctgacggccggcacgccgacggtgtggcgggtcaccgagccgatccgcaagctgtacatcaccggacggtga

SEQ ID NO: 690 - DNA, 990 bp, Actinoplanes utahensis
atgactaagacaccggtcaccgtcaccgtgacgggcgcagccggccagatcggctacgcgctgctgttccgcatcgcctccggccacctgctcggcgccgatgtgccggtccgcctgcgcctgctggagatcccggccgccgccaaggccgcccagggcaccgccctggagctcgacgactgcgcgttcccgctgctgagcagcgtcgacgtgttcgacgacccgaaggcggccttcgacggcgtcaacgtggcgctgctggtcggcgcccgcccgcggaccaagggcatggagcgcggcgacctgctcgaggccaacggtggcatcttcggcccgcagggcgccgcgatcaacgcgggcgccgcgtccgacgtgcgcgtgctggtggtcggcaacccggccaacaccaacgccctgatcgcccagcagaacgcgccggacgtgccggccgaccggttcaccgcgatgacccggctcgaccacaaccgcgcgctggcccagctcgcggcgaagctgcaggtgccggtcgccgacctgcgcaaggtgaccatctggggcaaccactccgccacgcagtacccggacgtcttccacgccgaggcggccggccgtcccgtcaaggacctggtcgaccaggcctggctggccgacgagttcatcccgcgggtcgccaagcgcggcgccgagatcatcgaggtccggggcgcgtcctcggccgcctcggccgcctcggccgccctcgaccacgtgcacacctgggtcaacggcaccgccgagggcgactggacgtcggccgcgatcgtctccgacgggtcgtacggcgtaccggccggcctgatctcctccttcccggtcaccgcgaaggacggtaagtgggagatcgtccagggcctggagatcagcgagttctcccgcgcccggatcgacgcctcggtcgccgagctccaggaggagcgcgccgccgtgcagggcctcggcctgatcaagtga

SEQ ID NO: 691 - DNA, 462 bp, Actinoplanes utahensis
gtggccattctggcgccgccctatcggcccctgtcccccggtttcccgccgctcgacccggcgcgcggcgacggcggcgcgaccatcgccgtgacgatgcggttcgcgccgctcgccttcctgctcggattcttcaccccggtgctggagatcgacggcaggaacgtgccggccacctggggccgggtgagcaccccggtggcgctcggcgagcaccacgtgcacgtccacgtgccctcactgctgccgtcccggctcggcgcggccgagaccaccgtggtggcactgcccggccggaccgccgagctggagtaccgcgcgccgatgctggcgttcctgcgcggcgcgctcgggccgccgccgcagaggtaccccggcatggcgctcgcggtggccctgctggtggccgcgacaaccgccgtgatctgcggatgtttcggcctgttgacctccggtcactag

SEQ ID NO: 692 - DNA, 414 bp, Actinoplanes utahensis
gtgacggtacagatctggcgcacggtgacggtgggcgcggcggctgccctggtgaccggcctctgtctcacggtcgccgagctcggccgggaggactccgggccggtctgggtgcagggcaccgaggcgtccagcgagccggtgactccgggcgcggcgccgccggtcacccacctgccggtgcggagcgcggcccggaccacccggcccggcaccaccaccctgccggaccgcgacgacgccgccgcgatcgacggcgacgaggccaagggcgaggacggcagcggcagcgatccgcggttcaccacctgcgccgaggcgaccaccaagggcttcgggccgtacgtgcagggcgccgacccggaatacgactggtacccggacccggacaacgacggcaccgtctgcgagtag

SEQ ID NO: 693 - DNA, 3129 bp, Actinoplanes utahensis
atgccacagcggggccggggtgacgcccggctcgaccagctcccagccggtgaggagccgggcgaatcactgcgtgtcgcgcggcaccagcggcgtgccggtccggttgtagacgtcggcgacccggcgcaccgtctccggggcgtccccgccgctggcgtgcgtgagcaccagcaggctgccgggcgcggccgcggcgtggtagccgtgcagggcggcgtcgagcaccgggccgtcgggcaggaagtgcagcaccgccagcatcaggatcgccaccgggcgaccgggatcgatcacccgcagccccgggtcgctgagcaccgacgcgggatcgcgcaggtcggcctcgacgaccacggtccgcggatcgtcgccgagcaggtcgcgggcgtagagcacggcggtcgggtcgttgtcgacgtacacgatcctggcttcagggttcgtccgcagagcgacctcgtgggtgtttccctcggtggggatgccggcgccgaggtcgatgaactggctgatgccgcgcgccgccgcgtagcggacggcgcggtgcgggagcgcccggttggcccgggcgacggcgccgatctcggggaccagctcggcgatccgggaggcgaccgaccggtccaccgcgaagttgtgcgtgccgcccaggaacacgtcatacacccgggcggaactgggccggttcggatcgatgctcacgccccaaaggtagcccgaattgaaggcattaatgctactttggtacgggaggggacgggtgtggagtcacgcaacgagctgccggggctcctgatcgacaccgccccggacgcgatcatcgtgagccgtgcggacggcgtcgtcacgatcgccaatcggcgggcccacgagatgttcggctacccacccggtgcgttgcccggcatccccttcgacgagctggtccccggcaacgggcgtgacgggtgcggcacgccgatgcgccgcatccccctgctcggcgtgcgccgcgacggccgcactttcccggtcgaggtgtcgctgtcgtggaccccggccggcaccggcggaacgtacgcgatcgcggtgctgcgcgacgacaccacccagcggcagaccgcggccacccgcgcgctgctcgcctcgatcgttcagtcctcgcacgacgcgatcgtcacggtcggcctcgacgaccgggtgctgtcctggaatccgggcgccgagatgctctacggcttcaaggccgaggagatgatcggcgtcgacgtcgacgagatcattccgccggaccggcgggaggacgaggcacagatccgccggctggtccggctcggcgcccgggtcgaccggtaccggtcgctgcgcctgaccgcctccgggcagccgatcgcggtcgccatgctggtctccccgctcttcgacgagcacggcacgctggtcggcaccaccggaaccgcgcgcgacatcaccgagcgggagcgggccgaagcccgggtccaggcgatcctcgacgcggcgccggacgcgatgctcggagtcaccgaggacggccgggtggtgctggtcaacgcggaggctgagcggctgttcgggcatccccggcacgacctgatccactccgacgtgtcccggctgctgccggacgggctaccaccgatctccgcgatgctgcgcaccggcggcggcgccgctccgctggacccggtgcgagccggtggcgccgtttctcgggagccggagcgggccggtggcgccgtttctcgggagccggagcgggccggtggcgccgtttctcgggagccggagcgggccggtggtggtgagcagcggtgggccaagcggcgggcggttcgcagcgacggcgccgaactgccggtcgacatcgcggtcagcgccctgcacaccgataccgggatgatcgtggtggccgcggtccgggacatcaccgagcggctggccatcgaggccgagcggcgccggctgcgtgaggagaccgaccggcagcgcctggaggcccggatgcagcaggcccagcggctggagagcctgggccagctggccggcggcatcgcgcacgacttcaacaacctgctcgcggtgatcctcaactacgcggcgttcatcatcgaggacgcggcgggcagcgcgccggccgccgacgccgagcagatcgcccgggccgcgcggcgtggcagcgacctcacccaccagctgctcgccttcgcccggcgggaggtgatccggccccggccgttggacctcaacgcggtggtcaccgaggtgcaccagatgctggaacgctcgctgggcgagcacatcacgctgaccgtccggaccgccgaggcgctgcccgccgtgatggccgaccccggccagctggagcaggtgctggtcaacctcgcggtgaacgcgcgggacgcgatgccgaccggcggccggctcaccatcgacaccgccgaggtcagcgtcgacgaggagcactcggccgcccgcgccgggctcagccccggccgatacctgcggctgcgcgtctcggacaccggcaccgggatgccccaggaggtgatcgacaaggcgttcgagccgttcttcaccaccaagcccagcggtcagggcaccggcctcggcctggccaccgtgtacgggatcgtcactcaggccggcggcaccgtgcagatctactccgaaccggggatcggcaccaccttcaccatcctgctgccggtcaccgacgtgcgggcgcaggcggccgcggcggaggagaccggtgccgagctgaccgggcacggcgccaccgtgctggtggtcgaggacgaggccgcgctgcgcgaggtgacctgccgcattctccaacggggcgggtacaccgtgctggccgcatccggcggggccgaggcgctccggctggtcgacgagcacccgatcgacgtgctgctcaccgatgtgatcatgccggggatgctgggccgggacctggccgaggcggtgaccgcccggcatcccggtaccagggtgctgttcatgtcgggttacgcccagccggtgctgaccgaccatggcaccctgtcggccgagatgcacctgctggagaagccgttcaccagcgccgagctgatgcgggcgctgcacgacgagctgcagtag

SEQ ID NO: 694 - DNA, 531 bp, Actinoplanes utahensis
atgtcgctgcaaacgcatcgaagccacaccagggctgttgcgcatcggccggtgctggcaccacaccttcaggaaaccatcgagtcgctcgcggccggggagaccgcccgggagatggccgcacgtctctatctgtcgccgaacaccgtcaaatcccgccttcgtacgctgtatcagcagctgggcgcccgggaccaggcccacgccgtggcgatcgggttccggctcggcgtgttgcgcgccccgggtgcggccgagcccgatgacgaccggcagccggtcgtcatcgggagcctcaacccggacagcctccgggagatcatcgccgagctcaccgccctgcttcgcatcgtggaacgggtccggccgctgcccggcggacacctgccggacctgctgcgccgggtcggtgagctggccaccagcccgcacgacgacccgcgcggggtgctggcccggatcgcgcagatcgccgccgaggcgggattcaccgccgaagggccgggcgcggagccgccgtcccggcgataa

SEQ ID NO: 695 - DNA, 549 bp, Actinoplanes utahensis
gtgccggacatcgtggagatcatcaaggcgcagcaccagcaggtcgacgcgctgctgagccaggcggccgaggaggacgccgatcagctcggactgctgcaggaggtggcccggatgctgctgccgcactccgaggccgaggagagcttcgtctaccccaccatccgcgacaaggcggcggagaccggtgaggaggtggccgacggggtggaggagcaccaccagatcgaggagatgctgaagaacctgctcgacggcagccccgacgacccgggttgggacggcaccctggcggcgatcaccggcgagctgcggcaccacgtgcaggaggaagaggaggagctgctgccggtgctggccgagcggctcagtgccgaggagcgcgaggagctggggcggcgcttccaggaggcgacgcagggcacgccgcccgccggtgggcacgaggaaacccggcgcgagctctacgagaaggccaaggagcaggacattccggggcggtccaagatgacgaaggacgagctcgccaaggcggtcggcgagggctga

SEQ ID NO: 696 - DNA, 303 bp, Actinoplanes utahensis
atgtcagcgttccggatgttccgcgcgacggcgatcgccgaggcgttctcctggaccggcctgctgatcgggatgtacctgaaacacgtctcgcacaccacggacgccggcgtctggctcttcggccgcatccacggcgcccttttcgtcgcctacctcgccgccaccctctggaccgcccgcaccgaacgctggtcactgtggcgcaccgccttcgccctcggcgcctcgatccccccgctggccaccctgctcttcgaacgttggctcacccgacgccgccccaccccgctgcccgcttga

SEQ ID NO: 697 - DNA, 717 bp, Actinoplanes utahensis
atgccgcagatcgcgatcggcggctcgggctggcgggccccgttctggctctacaccgtcgcgctgctgctggccgtgccgatggtcccgctgatccggcagccggcccggcccgcctccgctcctgcgggtcgtgagctgccgccgctgccctggcgccggttgcgcaccccgtgtctggtcaccctcgccggcggcgtcgtcttctatgccctgatcgtcgagctgtccttcgtcctggacggggtgggcgtccagcaggccgcgacgatcggcgcgctcagcgccctgatgtcgttggccaccgcggtcgcggccggctcgttcgcgaggctgtccgggcgcaccccgcgccggctgctgccgatcgccttcggactcgcggccgccggtttcctgctcatcgcggccaccccgcgggttccggtgatcaccgccggcgccgtgctgaccggggccggtaccggcctgctgctgcccaccctgctcacctgggccaccaacaacctgggcttcgaggaacgcgggcggggcaccggcctgtggaccggcaccctgttcgtcggcgagttcttctccccgctgctgaccagcggcctgtcggcggcggccggcgggctgcgcccggccctgggcgtcgccacggccgtgctggcggccaccatgccgctgatcgtcccgcgcaccgcgggcgccctgaacgtcacccgcgactga

SEQ ID NO: 698 - DNA, 558 bp, Actinoplanes utahensis
atgtccgccgaagcagctcgcgccgccgagcttctcacccagctgtcccaccccgcgcgcctacgcgccttcgccggtctggtcggccggggcagcgagggattctcgatcgccgagatgtccttcctgctggacatgtccaagcccgaggcgggggaggcactgggccggctggccgcactggggctggccagcggcaccggcgacggttattaccgggccacgcctcaggtgctgcgcgacgcggcccaggccctggtcgcgaccctgccgatcgctccgctgctgcgcgagtatccgcagctcaagggctatttcacgcatggtttcctgaccagtctgccaccgacgctcagcgagcgttacgagcagatcggcgagctgctcgcccgcttcctggcggtcgagggggtgctcaccgaggacgaggtgaaccggcggatcgcggtggtcgccgaggatgtggcggccgtccgccggatgctggtcgagaccggctggctggaacgcgaccgcgccggcaccgcctacggcgccggccgggtctacgtcgggtga

SEQ ID NO: 699 - DNA, 1965 bp, Actinoplanes utahensis
atggttccgtcgtatgtgatcgatatgctcggcgccatgtctccgatctcccgccgggccctgctcggcgccgccgccgcggccggtggtggcgccgccctcggccccgctgccctgccctcgcttccggcccaggcggccggcagcctcgaccaggtgcagcacgtcatcatcttcatgcaggagaaccggtcgttcgaccactacttcggcaagctctccggggtgcgcggcttcgccgacaccagcctgctgcgcttcccgtccggctcggacgtgtggcaccagaagcgcgcgaccggcaccgtgctgctgccctggcggctggacaccaccaagaccgacgcgcagcgcatctccgatctggaccactcctggtcgggcacgcactcggcgtggaacagcgggaagtacgacaactggatcccggccaagaccgagaagaccatgggttactacacccgcgccgacatcccgtggcagtacgcgctggccgacgcgttcaccatctgcgaccagtaccactgctcggtgcagggcccgaccaacccgaaccggctctaccagtggtcctgcacgatcgacccgaacggcgggcacggcgggccggtcaccgacaacaccgaggccggctactcctggacgacgtatccggagcggctgcagaaggccggggtcagctggcgggtctaccaggaggcggacaactacgacgacaacccgctggcctggttcacccagttccggaacgccgccaccacctcgccgctgtaccagcgcgggctgctcaaggcggcctcggcgctcggcgcgttcaccgccgacctggccgccggtacgctgccgcaggtgtcctgggtggtggcgcccgcggccaagagcgagcacccgcagtacccgccggcctacggcgccgacttcgtgcagggcttcctgtccgccctggccgcgtacccggacgtgtgggccggcacggtcatgttcctcaacttcgacgagaacgacggcttcttcgaccacgtcgcgccgccggttccgccggccggcaccgcggacgagttcatcggcggcaatccgatcgggctgggcccgcgggtgccgatgacggtcatctcaccgtggagcaccggcgggcgggtctgctccgaggtgttcgaccacacctcgccgatccggttcgtcgagctctggaccggcgtgcgggagaccaacatctcggcctggcggcggaccgtctgcggcgacctgacctcggcgttcgacttcacctcgaaggtcaccacgttcccgtcgctgccggacaccgcggccctggtggcggcctgcacccagcaggacagcctgccggacgcgaccgcgccgaccagttcgacgctgcccgggcaggagaccggggaccggccggcgaacccgatcggataccggttgaccaccacgtcgtggacggacaccgccacgaaccggttctggttcaagacggtgaactccgggtcgatcggggcggggctcaccgcgtacaccgtcaatttccgtaaatatcagacgtggcagtacacggcggcggcgggcgcgacggtgtcggactacttcagtgcgctcacctacggcggcggcccgtacgacgtcgacctccacggaccggacggctacctgcgcggattcaccggcgacgtgcggacctggacgaacaccacgaaggcgcaccccgaggcgtccgtggtcgaggacggcgcgatggggctgaccctcacgctgaccaatcagggcacggtggcgaccaccttcacgatcggcaacaaccaggtgtacggggcgtccagcggcccggtgcgcaccgtgaccgtggcggccggcgggagctcgaccctcacgctcagcacgctggccggtcggtacgactatacggtgacggccagcgtgggtgacgggttcggccgccggttcgccggccgcgtgtaccggtga

SEQ ID NO: 700 - DNA, 1113 bp, Actinoplanes utahensis
gtgctgaccgcgaccgtcttcaccgacgcccccgatcgcccgctcctgctgctcggctcctcggtcggcacctcggccgagaccctctgggcggactgcgcgtcccgtctgtacggccgctaccacgtggtcggcttcgacctgcccggccacggccgcagcgccccgtccgacgcgccgttcaccatccccgacctggcccgagcggtcctcgacctggccgacaggctgcggccgggcgagagtttccggttcggcggcgactcgatcggcggcgcgatcggcctgcagctgctgctcgacgcgcccgagcgggtgaccgccgccgtgctgctctgcaccggggccaggatcggtcagccggaggcctggcacgagcgcgccgcgctggtccgggcggagggtgtcgaagcggtcgtcgccgggtccgacgaccgctggttcggcgccggcttcccggcggccggccgcgagccgctgctgcgggcgctgcgcgcgaccgatgccgagagctatgcccgctgctgcgaggcgctggcgcgattcgacgtacgccatcggctcgccgagatcgccaccccggtgctcgccgtggccggtggtcaggaccggccgacgcccgccgacggcctgcgcctgatcgccgacggtgtgctgcacggccggctggtcatcctcgacggggtcgcccacctggccccggccgagtccccggaggtggtcgcgttcctgctcgaccagcacttcgacgagctccgcgcggccggcagcacggttcgccgggaggtcctcggggccgcccacgtcgatcgggcgaccgccgggaccaccgcgttcacccgcgacttccaggatctgatcacccggtacgcctggggcgagatctggacccggcccggcctggaccggcgcagccgttcggtggtgacgctgaccgcgctggtcgctctcggacatcacgaggagctggccatgcacgtgcgcgccgcccacacgaacggcctcaccgtcgacgaaatcaaggaggtgctgttgcagaccgcgatctactgcggggtgcccgccgccaacaccgccttccggatcgcgcagcgggtcctcgacgagatctga

SEQ ID NO: 701 - DNA, 1104 bp, Actinoplanes utahensis
gtgggtgatctgctgtggcccggcgaccaccgggccggtgacctgctcaccgacgcggccgtggtgaccgtgatgatccgggtcgagcacgcctggctcaccgcgctcgccgagaccggcctggcccgcatcaccgtccccgcgccggacgagctggccggcctggtcaccccggacgacctgcccgccctggcccgggacgcggagtcgggcggcaacccgctgatcccgctgctcaagctgctccgggcccggttgcgcggccgcaacaccgccgccgcgggatggctgcacaagggcctgaccagccaggacgtcgtcgacacggcgatcgtgctgggcctgcgtgaggcggtcgcccgggtccgcggcgcgctgctggcccagaccggcgcgctgtcccggctggccgacgagcaccgggagacccggatggccgggcggacgctcacccagcacgccgtcccgatcaccttcggactgaaggcggccggctggctgaccggggtcctcgccgcccgcgagctcggcctgccgcagcgcttcccgtggcagaccagccgggccccgctcacccgggtcgccgacgcgttcgtgacctgcaccgacgcgtggggccggatcgccaacgacgtgctggtcggctcccggccggagatccacgagctgatcgagggcggtgccgagggcaagggcggctcgtcggcgatgccgaacaagcggaacccggtgcacgccgtgctgatcaagcgggccgcactggccgggccgccgctggccgcgctgatccacgcgggcgcggcggccgccgtcgacgaacgcccggacggcggctggcacgtcgagtggtccaccctgcgcaccctcgcccggcacacggtgaccgccggggcgcagaccgccgagctgctcgccggcctgcgcgtggacaccggccggatgctggccaccctgcacgatgcgcggccggaaatcgacgcggaacagcagtcgatcaccccgggcgtcgctccggaccagccctatctcggcgccaccgacgcgatcatcgacgccgctctggcccgcgccacggccgcaccggagaagggactctcgtgctga

SEQ ID NO: 702 - DNA, 564 bp, Actinoplanes utahensis
atgaccgcggcaccgggccagaccgtcggccccttcttccacctgggtctggaatatccggggatgaacgagctggtgcccccggcgcatccccgggcggtgcggttgcacggccgggtgaccgacggcgccggcgaaccggtgccggacgcgatgatcgagatctggcaggccgacccgcaggggcacgtcgtgcggcagcccgggtcgttgcgccgtgacgggtggacgttcaccggctggggccgggccgccaccgatccggacggccgttaccggttcgccaccgtggagccgggccggaccaccccggaacgcccggcgttcttcgcggtgacggttttcgcccgcggcctgctggaccggttgttcacccgcgcctacctccccgacgatccggccgcgctggccgccgacccgctgctggccgcggtcgacccggcccgccgcgacacgctgatcgcccggcgcgacgagcagggcctgatcttcgacgtccggctgcagggcgcgggggagacggtcttcgtgacctatccccgcctgcgggacgcctgggcatga

SEQ ID NO: 703 - DNA, 747 bp, Actinoplanes utahensis
gtgaacacccaggccgacatcagtcaggagatcgaggcggcggcccggcagtcgagtggcccccagccccggatcgactatccgccgtaccgcagcagcgtcctgcggcatccgcagcagccgccgcagccgatcgacccggagtcggtcgagctgtgggccccggcgttcgggcaccgcgacgtcgccgacgacgaggcggacctgaccatccagcacgccggcaccccgctcggcgagcggatcgtggtgaccggccgggtgctcgacggcgacggccgcccggtcgcccaccaactggtcgaggtgtggcaggcgaacgccgcggggcgctaccgccaccagcgtgaccagcatccggcgccgcacgacccgaacttcaccggggtgggccggtgcctgaccgacgcggacggcaactaccgcttccagacgatcaagcccgggccgtatccgtggcgcaaccaccggaacgcgtggcgtcccgcgcacatccacttctcgctgttcgggaccgaattcacccagcgcgtggtgacccagatgtacttcccgggcgatccgctgtgcgcgctcgacccgatctaccagtcgatcaccgatccgaagtcccgggagctgctgatcgcccggtacgaccacgacctgaccaccccggagtggagcctcggctaccgttgggacatcgtgctcaccggcagccaccgcactccgctcgacacgctcgaccccgaggaccacgcatga

SEQ ID NO: 704 - DNA, 741 bp, Actinoplanes utahensis
atggccaggagcgtcaccggccgggcgctggacctgctcggcgcgttcgacgccgagcaccgcagcctcaccctcagcgacctggcgcggcgctccggcaccccgctgaccaccgcgcaccggctcgtcgccgagctgcgcacctggggcgcgctgtcccgggagccgaccggggagtacgtgatcgggcggcgggtctggcagctcggcctgctcgccccggtgcagagcgagctgcgcaccgcggccggcccgttcctgcacgacctgtacggcgccaccctggccaccgtgcacctggccgtccgggacgggctggaggtgctctacgtcgaccggctgggcgggcacgagtcggtgccggtgatcagcaagatcggctcgcggttgccgctgcacgcgaccggggtcggcaaggtgctgctggcgtacgcgccggacgacgtgctgggtgcggcgctgcagaagctgaccagggtgaccgcgtacaccgtgacccagccggcccgtctgctggaacaactgcgccgggtccgggccgacgggtacgccaccaccggcgaggagatgagcccgggcgcctgctcggtggcggtgccggtgcgcaacggcgacgacgtggtcgccgcgctcggcatggtggtgccggatctgcgccggcagctgccccggatggtgtcggcgttgcaggtcgcggcgcgcgggatcggacgcacgctgacttccgtccagtggaaatag

SEQ ID NO: 705 - DNA, 1170 bp, Actinoplanes utahensis
atgcgtacccaggtcgccatcatcggcgcgggcccggcgggcctgcttctctcccacctgctcgccctgggaggcatcgactccgtggtcctggagacccgctccgaggagtacgtcgcggcccggatccgggccggcatcctcgagcactccagcgtcgagctgctggaatcggtggggctcggcgctcggctgcgcgccgagggggacgagcaccgcgggatccacctgcagtggccgcacgaacggcaccatctcgacttcgtgaacctgaccggccggtcggtctgggtctacgggcagaccgaggtgcagaaggacctgatcgccgcccgccgcgcggccgggcaggagatccactacgaggtgaccgaggtccggctgcacgatgtggacgccgatcgccccttcgtgaccttttccgacaggtccggtcgcagcgttcggctggacgcggccgtcatcgccggctgcgacgggtcgttcgggccgagccgagccgccgtcccggccgcgaagacgttcgagaaggtctacccgtactcctggttgggcatcctcgccgacgtcgccccctccaccgacgagctgatctacgcctggcacccgcacgggttcgccctgcactcgatgcgctcggccacggtcagccggctctacctgcaggtgcccaccggcaccgacccggcctcctggtccgacgaccggatctgggacgagctggccacccggctcggccacgggcagaacggctggaaactccaccccggcccgatcaccgacaagagcgtgctgccgatgcgcagctacgtgcagaccccgatgcggtacggcaatctcttcctggccggcgacgccgcgcacatcgtcccgccgaccggcgccaaaggactgaacctcgcgatcgccgacgtcgcgctgctcggcagggcgctggtcgccctgctcggcgagcggaacccgacgctcgccgacgcgtactcggaggccgcgcagcggcgggtctggcggtgcacccacttctcctggtggatgaccacgatgctgcacacctcgggtgacgggttcgacgccgaactgcagctgtcgcagctgcgctgggtgacgtccagcgaggccggcgcgaccgggctcgcggagaactacgccgggctgccgatcacctactga

SEQ ID NO: 706 - DNA, 1617 bp, Actinoplanes utahensis
gtggggtggctcggcgagtggctcggcgggctcccgccggtgttggtctacgcggtcgtcggcgccctggtcgccggcgaggccgcgatcatcgccgggatggtgctgccgtccgcgaccgcgctgatcgccaccgggctgctcgccaacgcgggcgtcgtcccggtcctgccagccctgctggtcgccatcggcgcggccctgctcggcggcaccgtcgcctaccggcgggcggcgcgcaccaccggtgccacgccgccggcccgcaccggcagacactgggcgcgggccgaacggctcttcgcccggtacggcggacgggcgatcttcctcggccagtgggtggtcggcgcgcggacgctgatgccacggctggccggccgcaacggcgtaccctatcggcgtttcgccctgtggcacacgccctccgcgatcctctgggcactctggatggtcggcgccagctatctcgccggcgccggataccaggccctcgccgcccgggccggccgggccgccggtgcgctggccgccctcaccctgatcatcgtcggtctgctgctggtcggccgctggctcggccgacacccgttcccggtccacgcccccggccgcctgtcgctgatccggcgcaccgtcgcccggtggcaccccgcggtgctcgccgcggtcagcctggccctgttcaccggcctcgccctggtgctgatcgaggtcatcccgccgatcgtccgtttcagcggcctggccgccgccgacgactcggtgaccacctgggcgcgcgggcagtggacgtcggacgggtactggttcgccctgtccaccgccggcaccctggcccccgaggtgccgctcaccttcgccgtcgtcgtcgcactgatccgcttcgcctggcgccgccgccccgacggcctgcgccacggcctcctgcccgccgtcatgtacctcgccgagctcccgtcccgagcccgcagcctgcgccggccccgcggtcctgagccgggcgcttctcagccgggcgcttctcagccgggcggatctcctcccggcgtttcccgaccgggcggtctccgggcgcgcggtctgctgcgcggctctttctgggcggccctgttcgaggcggtcggcccggtgctgccggccatcgtcctggcggtcgccctgtccctgctcctcgacccgggctggcgcaccgccggcaccatcgtcttcccctcccccaccgaattcgacggcggcggcctccccctggacaccgcccccagcatcctggccggaatggcggccggctccaccgcacagaccgccgccgccatcggcctgctcgcctggctgctcaccgacaacctgcgctggggctggcaggtcaccgtctggacggtcgcggccggcaccctgaccaccgccgccggctgctgggtctacctgggctggggccgcctcagcgaaaccgtcgcggcggtcgtcatcggcgcggcctgggccgccctcaacgccgccatctggaccgcccgctaccgatcagccgagcggccggtgctggacgaggccgaccaggttgccctcgctgtcccggatgaaggcctggacctcctcggtgccgaccggcccgagtga

SEQ ID NO: 707 - DNA, 381 bp, Actinoplanes utahensis
atggcataccggccgatgacgatggtcgaccttgctggacacctgcggcggcagcaggcggacaaggtccggtggaaacatctgtgggagttcctcgaggaataccggtgggaggctccggagagccggccggcactcttgcgcgacgagccggcgccgtgcggtgatcctcagtgggatgcgctgctcgccgcgctggccgagcaactcgccgcccaactggatctcgcaccaccggagtggtcccgacccagggttctggtaactccctggttcccttcttcgctgccgtccaagcgcatggaagcgctcgtctcggcgcccgcggccttccgcaagcacggcgtctatctgtccgcccgtgacctggaggcggcatga

SEQ ID NO: 708 - DNA, 2172 bp, Actinoplanes utahensis
atgcccgaagggatcatcgagagacaactggatgtcggcctagttcggctgaacgatgaccttgcccagggcgcgcccctcgcccacccgggccagtgcctcgggcgcttgctccagcggaaacgtgcggtcgatgtggacgtcgagctcgccgccggcgcacaggtcggccaccgggccgaaatggtgcggtccctgtttgacggcgagcacacccagccggcgaccggtgagccggccggcgaccgtgccggccgtcagcacgcgcagcagcgtcggcaccgagcggcgccggggaccggcacggggagttcctcgagcctgagcacggcgggcggcccgtaccggtcgtacaccactgctcgcatccgcacacgtcccacctcacggttggtagcacgcgcggacaagctttccgaccggaccggccacggccacctggttacggccgccgttcttggcctggtagagggcgtggtcggcgcgggccatcaactggtcgagggcgtcgccgtcggcgccgagagtggccacgccgacgctgatcgtcacgcggacccgtccaccgcgggtggtcaccggctcggcggcgacggcctcgcgggtccgctccatcgccgcgatatcggcgccgtcgcagtcgggccggatgatcgcgaactcttcaccgccgtaacggccgagcacgtcggagttccggatggtgtcctggacacgctgggcaacggcgcggatcacgtcgtcgccgacgccgtgaccgtacccgtcgttgatgttcttgaacttgtcgatgtcgatcatcgcggcgctgagcgggctccgcccgccaactggcaaaatcggcgcatgggtgctcccgagctggttctggtgctgcgctatcgcaaggcggtgacgtacggctttcacgcgctgctcggggcgctgggcgagcacgactcccccacccgctacgaggtccgcttcggcgagactccggagcagacggcccggcacattcgcgaggccggcgacacccgcgtcctcgtgctgtggtccttctattctcccgacgccgccgcgctcgccgaggaactcgagcagatccgggccctcgccgacggcccgcacgtcacgcacctcgccggtggggtgcacgccaccgccgagccggtgcagacgctcgatgccggttgggacgtggcggccgtcggtgagggtgaatcgaccctgatcagcctggtcgacgcgaagggcgacccggccggcatcaccggtctggcctaccgcgacaccgccgggaacctcgtgcggaccggcaaggcgaagcagcggccactcgacgacttccccggcttcgcgctgcggtgggacaggttcaacgccctggaaatcacccgcggatgtgtctacgcgtgccggttctgccagacgcccttcatgttctcggcgaggttccggcatcgcagcgtcgacaacgtgcggtggcacgtcgatcagatgcgggcgcgcgggctgcgggatgtccggttcatcacgccgaccgccctgtcgtacggcagccagaacgaggatccgaatctggccgcggtcgaggagttgctggccacctgccgggaggggatcgggccgcgcgggcgggtctatttcggctcgttcccgagtgagatccggcccgagcacgtcacccgggaaacgctgcggctggtcaagaagtactgcgacaacaacaacatcatcgtgggcgcgcagtccggatcggaccgggtgctggacgcggccaaacgcgggcacggggtggaggaggtgaagcgcgcggcccggctcggcatcgaggaggggttccggatcaacgtggacatgatcttcgggatgcccggggagagccgggacgacgtcgaggactcgctgcggctggcccgtgagctggccgacctgggggcccgcatccacgcgcacacgttcatgccgctgcccggcacgccgtggcgggacgcgccgcccggggatgtcgacccggccacgatccgggaggtggaccggctgtcgcggcggggcgcgctgtacgggcactggcagaaacagcgggatcacgcggcccggctggcggcggcggcgcaggcctatccgcggccggggcgcagccggacgatgctgacggtgcatgacatacgccaccaagattcgccgtga

SEQ ID NO: 709 - DNA, 768 bp, Actinoplanes utahensis
gtgagcccacgacgtttactggccgcgacggccctgctgctgctggccggctgcgatggatcggcccaggcgaaaccaccgcagacacccccgccgacggtgaccgccggccggtcggcgccgcccaccagggcacccgctccgaagccccggatcacctacccggccaccggtagccggaagttcgcggtcgcctcgggggaggccgcggccccggccggcgatcggaagggccggctgctccggtaccacgtgctcgtggaacgcgacatcaaaggcgtcaccgccagcgagttcgccaccgccgtcaccacgacgctgcgcgacccgcggagctggaccgccggcggccaatggcgtctgcagcgcgtcgggccggagcagaaggccgatttcgcggtacgcctcgtcacgccggccacccgcgacagactgtgcgagggcgccaccgacgggtacacctcatgccgtacccatgatgaggtggtcatcaatgtcgcccgctgggccaagggtgtgccgcactacggcgcgagcctcgccgtctaccgcgagtacgtgatcaatcacgaggtggggcatcgtctcggccaggctcacgagctgtgccccgggcggggccggccggctccggtgatgcagcagcagaccctcggcctgcacggctgcaccccgagcgcctggccgttcctgaacggggtccgcaaccgcggccggatcggggcctacgacgacccggtgccgccgcgcgacaggggactttcctga

SEQ ID NO: 710 - DNA, 1614 bp, Actinoplanes utahensis
atgcccgtcggagccgcgcacgcgtccggctggccggtgccggtcgacgttcccgtgcggacggagccgttcccgcacgggccgttcggacgctacgaaccgccgccgaccccgtggcagacgttccgtgccaagtactggcccggacccaccgccacccggggccgcgcggtgcccgccggggtgctggccggcgcgctcgggttcgcgttcctgctgccgctgaaccggtccgggatcggctggttcctcggcttcctggtgctggcgctcggcatcgtcggcgcgatccggcgctccgccgaactgcccgtctacgagcggtggatccggtccggctgggcgctggcgacgctggccctgctgctggtcccggcgttccgcaacgcgtggtggctggtgacgttcagcattctcggcgcgctcgggtgtgccacgctggcgatcgtcgggggccgccaggtgcggtcgatcctcttcggtctggtggcaacgccgtacgccgccatctccggtctgccctgggtgcgccgtcacctgcgggcgagccgcaaccccgggatcgcccggcgcatcggtttctccgcggtgctcaccatcctggtgctgctggtgttcggcgcgctgctgtcgtcggcggacgtggcgttctccacgctgctcggcaaggcggttcccgagatcaacgtcgggtcggtgttccgctgggtgttcctggccgtggtcggtggcctgatcgcggtggccggcatctacaccctgtcggcgccgccggtcacctccagcatggacagacccggtcacggccggttcggtctggtcgagtgggcgccggccgcgggtgcgctggtgctgctgttcggcgggttcgtggcggtgcagttcacggtgatgttcggcgggagccggcacgtgctggagaccgccgggctcagctacgcgcagtatgcccgcagcggcttctggcagctggtggcggtcaccctgctgtcgctggtggtgctggccgccctggcccgctgggcgaaacgcgacgacccgcgcgaccggctgctgctgcgcgtcctgctcggcctgatctgcggactgagcgtggtgatcgtggcgtccgcgctgtcccgtatgtgggcgtaccagaaggtgtacagcttcaccggcgagcggatcttcgtgatgtcgctggagatcctgctcggcacgatcttcgtgatggtcgccgcggccggcatccgctggcagggccggtggatcccgcgggccaccgtcggtctcgccgtgctcatgctgctcggcctcgcggtcctcgaccccgaggggtacgcggcgagccgcaacgccacccgctacgccgagaccggcaagatcgacgcctggtatctgcgggccctgtccgccgacgccaccccggcactgaccagactgcccgatccggtccggcggtgcacgctcagctggatcgcccaggacctgtcgcgacccgacccgtggtacgcctggaacctgggccgggcccgggcccgcaaggcgctcgccgacctgggcaaggacgcggtcggcgaccacgtggactgccgccgggccgaccagttcgacctgcccaagaaacgacggtga

SEQ ID NO: 711 - DNA, 474 bp, Actinoplanes utahensis
gtgcgctgcgccaccgcctcccgactgtcggtggcggtgactccatcgacatctctggtgcctcggattacctcccggattcgtgccgtcagggcggaacggttccgttccagcgttgatatctgtggtgctgaacccctatgttgtgcggaccgacccatcgaggagggtgctgtggccgacctgccacctgagcaacgagatccggcggaaccgacgccggcgcctcaacttctggtcatgccgccgaccgaggcgattccgtcgatggtctggccggacgggggaccggcctgggcgatcccggtgcagattccgtccgggacccgggggtacgcactgttcgtgccgatggtgccggcgcagccgtccacaccggtcgcggtcgccgccccggcgtccccgcaacggaccgcgccggccgccggtgccggcccgggagtcgtcgccgaccgtcccggcccggctagctag

SEQ ID NO: 712 - DNA, 813 bp, Actinoplanes utahensis
gtggctcgtgtcacgtcaacgacctgtgtcgatcatccgatgacgcgggaaccgtactacgtccagtccctggaacgaggcctggcggtcatccgtgcatttgacgcggagcaccgcgagctgacactcagcgaggtggcccgccactgtggactcactcgcgccgcggcccgccgattcctgctcaccctgaccgatctcggctatgtgcgcaccgacggccggctgttctcgctgaccccgcgggtgctcgaactcggctacgccttcctgggtggactgaccctccccgaggtcgccgagccgcacatggaacgcctggtcggcgaggtccgcgagtcgtcctccctgtccgtcctggacggacccgacatcgtctacgtgagccgggtgccgaccagccgcatcatgcgggtgtcgatcaacgtcggcacccggttcccggcctacgccacgtcgatgggccgggtgctgctcgccgcgctgcccgaaccggacctggagacctacctgtccggggccgagctcaagccgctcaccgggcgcaccatccgcacccccggcgagctgcgcgccgagctgcgccgggtccgcgccgacgggcacgcggtcgtcgaccaggagctggaggaggggctgcgtgccatcgccgccccgatccgcgatcgctccggcgcggcggccggtgcactcgacatctccgtccacgccgcccgcgccaccgtcgacaccatccgcgagcgtctcctgccaccgctgctggccgccaccgccgccatcgaagccgacctccgtatcggccggcagcgatag

SEQ ID NO: 713 - DNA, 1779 bp, Actinoplanes utahensis
gtgcgcacacatctacggaggaacagatatgcggcggcgtttgctcgcgggcctggcactggcgctggtggccggcacggtcgcggcctgcggctcggacaaggactccagttcctccggcggatcgtccgggggtgtggacaccgtgaccgtgggcgtcatcccgatcgtcgacgtcgccccgatctacctgggccagtcgaagggcttcttcaagtcccgcaacatcgagctcaagctggaggccggccagggcggcgcggcgatcacgcccggtgtggtcagcggccagttccagttcggcttctccaacctgacctcgctgatgatcgcgcagaccaagaacctgccgatcaaggtggtcgcggccggcgtctcgtcgaccggtgtgcagggcaaggacttcggtgccgtggtggtcaagggcagcagcccgatcaagaccgccaaggacctggagggcagaaagatctcggtcaacaccctgaagaacatcggcgacacggtcacccgcgagtcggtgcgcaaggccggcggcgacccgagcaggctgcagttcgtcgagatgccgttcccgaacatgccggccgcgctggacggcggccagatcgacgccgcctgggtggtcgagccgcagctcaccacgatcaagcaggccggcggccgggagatcgcctcgacctacgtcgacgccgccccggacctgaccgtcgccgcgtacttcacctcgcagaacctgatcgcttccaagcccgacctggtgaagcgcttcaccgaggcgatcaacgagtcgctgacctacgccgacgcccacccggaccaggtgcgccagatcctcggcacctacaccaagatcgacgagaagatccgcgccgccgtggtcctgccgaagtggcccaccgagatcaacaaggcgtccgtgcagacgatcgccgacctcggtacccaggacggcatcttcagcaccgctccggacctgggcaagctcctgccgtgacgtccgcgcgccgtggcaacccggtcctgctcggcctcgccgggccggccgggttggtcctcatcgtcgagctgctgccccggctcggcctggtcaacgaccggttcctgccgccggccagccggatcgccggcgcgctcgccgacgaggtggccaccggggcgttctggcagtcgctgggcgacacgctgtacgcgtgggcggccggcctgctgatcgcggtggccgccggggtgctggccgggctgctgatcggctcggtgccggtgctgcgcgcgctgaccgcgtccacggtggagttcctgcggccgatcccgtcggtcgcgctgatcccgctcgcggtgctgctctacggcacccggctgggctccaccctgctgctggtctgctacgccgcgttctggcaggtgctggtgcaggtgctgtacggggtggccgacgtcgacccggtcgccgaggagaccgcgcgcagtttccggttctccgcgtggggccgggtgcggcacgtgctgtggccgaccgcgctgccctacgtgttcaccggcgtgcggctggccgcctcggtggccctggtcctggcgatcaccgccgagctggtgatcggcgcccccgggctgggcaaggagatcgccaccgcgcagaactccgacgcggtgcccaccatgtacgccctgatcgtggtcaccggcgtgctcggcgtgctgatcaatctactgacgcgcaccggcgagcgccgcctgctggcgtggcaccagtcggtgagaggcgaggcgggcgtctga

SEQ ID NO: 714 - DNA, 813 bp, Actinoplanes utahensis
gtggcaccagtcggtgagaggcgaggcgggcgtctgatgggcgtactcaagaagtggtctttggccgtgatcctcccgattctgctcttcgccgggtggttctggctcagtgacgacagcaggagctactacgcgccgccgctgcggcagatcctccaggcgttcggcgacacctggaccctcgaccggctgcgcaccgacgtcgcccccagcctggtccggctgctcgccggcttcctgctggccgcggtgatcggggtcggtctcggcgtcgcgatcggcctgaaccgcaagctgcgggcggtgctggaaccggccctggagttcttccgggccgtcccgccgccggtcctggtcccggtgatcatgctgttcgccgggatcggcaacggcatgaaggtgatcgtgatcgtctccggctgtgtctggccgatcctgctcaacacggtcgagggggtgcgcgccaccgacagcgtcgtgctggacaccgcgcgcgcctacggcgtgaccggcccggcggggctcacccgggtgatcctgccgtcggcgtccccgcagatcgcggccggtctgcgccaggcgctgtcgatcgcgatcatcctgatggtgatcagcgagatgttcgcgtccagcaacggcctgggcttcaccatcgtgcagttccagcgcagtttcgcgatcccggagatgtggagcgggatcatcctgctcggcctgctcggcttcgcgttgtcgctgttgttccggctcgccgagcggcgggcgctgcggtggtacgaggggctgcgcgcggcgcggcgccgggccggttag

SEQ ID NO: 715 - DNA, 771 bp, Actinoplanes utahensis
atgctggaggtcaagggcctgcggaaggtctacaggtcgggcggccgggaggtggaggcgctgcgcgatctcaccttcaccgtcgagggcggtgacctggtctgcctggtcgggccgtccggctgcggcaagacgacgctgctgcgctgtgtctccggcctgctcacgccgaccgccggcgaggtccgggtgggcggccgggaggtggccgggccgccgccggggatggcggtggtcttccaggagtacggccgcagcctgttcccctggatgagcgtgcgggacaacgtcgagctgccactgcggcagaagggtgtcgcccgggcgcggcgccgggagctggtcgagtcgtcgctggacgcggtcggtttgggcgggaccgcgacggcgtatccgtggcagctgtccggtggcatgcagcagcgggtggcgatcgcgcgggcggtcgcctacgagccggagacgctgctgatggacgagccgttcgcggcggtcgacgcgcagacccgggccgatctggaggatctggtccggtcgctgtggcagcggctcggggtgacggtgctgttcgtgacccacgacatcgacgaggcggtgtacctggggcagcgcgtggtgatgctgtcgtcgtcgccgaccgtggtgcaggacgagctggtggtggacctgccgaccgaccgcgatcagctgcacacccgggccgatccgcggttcatcgagctgcgcgcccacgtgtacgagcagatccagctggcgaagaagaacgcctga

SEQ ID NO: 716 - DNA, 1602 bp, Actinoplanes utahensis
atgcgaaaaatcctggcggccaccgtcgccgcctcggtcggcctgctcgtcggcgccggcacgatcccggtcgccgccgtggcgcacagcggccacgacgacggctacaccccgccgccgatcgactggggcacctgcacccgggcgagcctcaaggcgcgcaacgcccagtgcggctttctcaccgttccgctggactacgcgaaaccgaacggcaccaagatcaagattgcggtgtcccggatcaaccacaagtcggccgacgcgcagtaccagggcgtcatgctgaccaacccgggtggccccggcggcagtggtctcggtctgccggtgatcggcgagtcggtgccggaccacgccggcgactactacgactggatcggcttcgacccgcgcggcgtcggctccagcgtgccggccctgtcctgcgacgtgaactacgccggctacaaccggccgtactacgtgccggtcacccggtcgctggagaagacctggctgaagaaggccgcgggctacgcgaaggcgtgtgaccgggccggcggcgcgctgctcgaccacgtcaagaccaccgactcggtggccgacatggagagcctgcgcaaggcgctgggccagcgccagatcaactactacggcttctcgtacgggacgtacctgggccaggtctacgcgaccctgcacccggaccgggtgcgccgggccgtcttcgacggtgtggtcgacccgcggggcgtctggtacgacgccaacctcgaccaggacatccagttcgacaagaacatggacgtctacttcacctggatcgccaagtacgacgcggtctaccacctgggcgtcaccggcaaggcggtgaagaagaagtactactcggtcctgcaacagctccgcaaggcgccggcggccggcaagatcggcccggacgagtggaacgacatcttcgtctcggccggctactacgtctacggctggcgggacgtcgccgacgcgttcgcggcctgggtcaacgacaaggacccgagcctgctgctggccagctacagcgagccgggcgcgccgggcgccgacaacaactacgcgatgtacctggccacccagtgcagcgacgtgaagtggccgaccaactggtcaaagtggcagaaggacaactggacgatctactcccggtacccgttcatcacctggaacaacgcctggtacaacgcgccctgcaccacctggggcgccaagccgggcaccccggtgcggatcaacggtgcgaaggctccatcggtcctgctgatcagcgagaccgacgacgccgccacgccgtactccggagccctgcaggtgcgtaagctcttcccgcgctcggtgctgatcgagggcgtcggcggcaccacgcacgccggctcgctcagcggggtggcctgcaccgacgacaccgtcgccgcctacctggcgaccggtgcgctgccgtcgcgggtgcacggcaaccggtccgacaagcagtgccagccggtgccgcagccggacccgaccgcggtttccgcgctcagcaagaagagcgcggccaccgcggacaccgcccgtgacgtgattcgcgcggcggtcggccgctga

SEQ ID NO: 717 - DNA, 354 bp, Actinoplanes utahensis
atgcgcaaggtcgttcggttcatgggttgctacgtggcactcagcttctcgacgctgggcgcgatcgtcgccctgcgcgacacgcactacgtcaccgacgcggtcggggtgcgggcctcgctcgtcgcgctggcgtcgctgatctcgctccacctgtcggtgcgggcgctgcgcggcagccgcggggcgctgctgcggctgcggatcgtcacggcgatcatgctggtcgcgatcgtggtgatcgcggcgctgcccgggatgttcccgctctggttcaggctggagcaggtggcctgcggactgctgctgctcaccccggtcatccggatcaaccggaagccggccctggcctga

SEQ ID NO: 718 - DNA, 642 bp, Actinoplanes utahensis
atggcgaagcggcgcaaggtgggcaacctcctcgggttgcacatcctggcgacgctgagcatcgagccgatgcacccctacgagatggccgcccggctcaaggagttcggcaaggatcaggacatcaagatccaatggggatcgctctacacggtcgtgcagaacctggagaagcacggcttcatcgaggcggcggagacggtccgggacggccgtcggcccgagcgcacggtgtatcggctgaccgggaacggccgcgccgagctgaccgactggatgcgcgagctggtcggcactcccgcacgggagtttccgaagctgcaggcggcgctctcggtgctcggcgtgctcccgccggacgaggtgatcacgctgctcgagcagcgcctcgccaccctcgcgatggagaacgatcggatgcgggccgacctcgacggcaaccgcgcggtggtcccccggctgttcctggtcgaggcggagtatcggatggcgatccgggacgccgaggtcacctggctgaccgggctgctgaccgagatgcgcgagggcaccatggccggtctcgccgcctggcggcggatccatcggaccggcgagatgcccactgatctctcggagttcatgacgatcaccgagacgtga

SEQ ID NO: 719 - DNA, 948 bp, Actinoplanes utahensis
atgagtgatgccgtgacggcacaggaactacgcaagagttatcccggcggggtgcgggccctcgacgggctcaccctcaccgtccgcgccggcgaggtgttcggcctgctcgggccgaacggcgccggcaagtccagcaccgtcaagatcctcaccacgctggcccggccggattccggcggcgcgaccgtggccgggcacgacgtgctgcgccaccccgaccgggtgcgccgcacgatcggcgtcgtcccgcagcgctccgcgctcgacccgatggcgaccggaaaggacaacctccggcttcaagggcgtctcttcggcgtacgcggtgggcagctcacccggcgcgtggacgagctcctggagcgcttcggtctgggcgaggccgccggccgggcggtccgcggctggtccggtggcatgcagcgccgcctcgacgtggccctggccctgatccaccggcccggcgtgctcttcctcgacgagccgaccaccgggctggacccggaggggcgcgccgagatgtggaccgagatcggccggctcgccgcggacgagtcgatcgccatcctgctcaccacgcactacctggacgaggccgaccggctggccgaccggctcgccatcgtcgacggcggccggatcgtggccgagggcaccccggagagtctgaagggggagttgcggggtgatgccgtacatctgcaattggcgctgccaccggatgagccgcaggcgcggcgggccatcgcgcacgtcgccggcctgcgcgacatcgccctggacgggcggacgctgagcgcgcgggccgacgacggcgcggcggcggtcccggcggccctggccgccctcgaatcggccgggatcggcgtcgcgacggtgaccgtcgcccgcccctcgctggacgacgtgtatctgcgccacgcgggacggaggtacgcggcatga

SEQ ID NO: 720 - DNA, 777 bp, Actinoplanes utahensis
atgacgaccctggtgacgcacacctggtggatgaccaaccggcggctgaaggtgctgatcaagcagccggcgttcgtggtgatcctgctgatccagccggccatctggctgttgctgttcggcaacctgttccggaaggtggtggagctgcccggcttcggcggcgggtcgtacctggactacatcgtgcccggtgtggtcgcgatgaccgcggtgtcgtcgaacatgtggtccgggatgggggtgctcgaggagatcgagcgcggcaccatgaaccggctgctgaccaccccggtcgcccgcggcgccatcatgaacgcgctggtcgtcgagcaggcgctgtccaccgcggtgcaggtggcggcgatcgtcctgctcgggctggccgccggggcgagctacccgggcggcgcggccggcctggtcgtgctgctggtcaccgcgctgctgctcgggacgatcttcagtgcgctctcgaacacggtcgggatgctggtccggcaacgcgagacgatcatcgggatcaacaccctgctgctgttgccgctcaccttcctgtcctcggcgttcatggcggcgacactgatgccgtcgtggatgcggcggatcgcggaattcaacccggtgaactggtgcctggcggccgcccgggcggcgatgcgggacacgcccgactggggggtggtgctcagccgcggcggatggctgctcgcgctggccgcggtgatgatcttcctgtccacgcggacgttccgggcgtaccagaaatcggtgtga

SEQ ID NO: 721 - DNA, 567 bp, Actinoplanes utahensis
atggttgcggccgtccctggaccggaacggaaacgaggacccgcaccgatgacgagccccgcgcagcccgccggatggtacgccgaccccagtggtctgcccgcgacccgatggtgggacggccagcagtggaccgaccacctgcagcccgggccggcggtgctgccgccgaccgcggggctgggcggctactacccggcggccgcgccgtccgggccgctggtgccgggggcacacacggtcgcgccgcccgacccggaggcggccgcgatcttcgcgcactcggcggcgtcggccggggccgcgttcccggcggcgcggccggtggcaccgggaccggcgggtggcgctctaccggcgccgcccgccgaactcgtcgactacgccatcccgccggtcgactccgccgcgccgctcagcggcttcgggatgccggcgccggccggcgacccggagaaacggccggctgcccagcacgcgaccggcctgctgacgcatccgctgctgctgggcaccctggccgtcgtcgtcctggtcgccctgatcgtgctcaccgtgctgcgctga

SEQ ID NO: 722 - DNA, 456 bp, Actinoplanes utahensis
atggccgagcacgcggccgcgcaacgccggaactggctcgtcgccctcggcgcggcggtgatcctgctgatcctgctcgccctgacgctgtcgttctgcgatcggaacgggggcgccggcaccacggcggggccggcgacgacggccagcagcgagacgctgccaccggtgtccgggccggcctcgcggccggcgtcagcctcggcgtcgccgggcacgctgtcaccgaagaccgtgacgaccgccgacgatccgacgaccaagccctcgccgtcgcactcggcgtcgccgtcgcaccggcccagctccaagcccgaccggacgccggccggtggcgtcgacgccgggggcggcagcgggctcgacggccggcgcctggcactgctggtcggcggcgcgttcctgctgctcgcggcggtgatcaccggccggttcggcttcggccgcgctcgatga

SEQ ID NO: 723 - DNA, 624 bp, Actinoplanes utahensis
atgatccgcaaccgtcgggccgccgtcttctccgttctgctggcagtgctcggggccaccgtcaccgtgctcggcctgatcaccgacgacgcgctgcccgacccgccggccgtcaccccggcctgggaggacgtgccggcgccaccggcacccaccaggtcgaggacgcaccgctcgcaacccaccgcgctggacatcccggcgatcggtgtgcacaccccgatcaccccgatcgggctgcgcggtgacggcaccctggacgtgccgccgctgcgctccgacgccccggccggctggtacgacgggtcgcccaccccgggcgagcccggtcccgcggtcgtcgtcggccacgtcgacaccgcgcgggacggcgcggcggtcttctaccggttgcgcgagctcaagccgggcgacaccctcacgatccgacgcagcgaccggtcgaccgtgaccttcaccgtcgtcaaggtcgccagttatccgaagaaggcgttcccgagcgacgaggtgtacgggccgacgggcggcccggcgctgcgcctgatcacctgcgggggatcgttcgaccggagccgtcgcagctatcggagcaacatcgtcatctatgcggtcgaggccgcctga

SEQ ID NO: 724 - DNA, 1860 bp, Actinoplanes utahensis
atgtcgaccatccgccggcgcaccgcgctgcgccggaccaccgccggagcgttcgcgctcggcctggccctcacggccgtcacggcccaggcctcgccggccgccgcacattccacatccgccgtgcccaacctcggcccacacgtcaccgtcttcgacccgagccagccgatcgccgacatccaggccaccctggacgccgcgaacgccaagcaggtcgacaacgagatgggcaccgaccggtacgccttcctcttcaagccgggcacctatggcaccgccgagcacccgctgcaggtcaaggtcggttactacaccgagctggccggcctgggcgccaaccccggcgatgtcgtgatcaacggcaaggtcgaggtgtacaaccgctgcctggagaacggcggcacgagcaactgcctggccctggtcaacttctggcggaccgtgggcaacctgaccgtcaacatcaacggggcgggccaggacggctgccggggcacggccaacttctgggccgtctcccaggccgtctccctgcggcgcacccagttcaccggcggcaccctgtcgctgatggactactgcaccgccggcccgcagtacgcctccggtggtttcatcgccgacaccagggcggagaccatcgtcaacgggtcgcagcagcagtggctgacccgcaacagccaggtcggcaactggtccaacggcgtgtggaaccaggtcttctccggcgtcgtcggcgcccccgacgagtcggcgtttccgaacccgccgtacaccacgctggccaccaccccggtcagcaaggagaagccgtacctgttcgtcgacgcgcacggcaggtggcaggtgcaggtgcccgccacgcagaagaacacctccggcgtcacctgggcctcggccgggcgcaccctgccgctcagcgacttctacatcgccaagccgggcgactcggtcgccaagatcaacctggccctggccctgggcaagaacctgctgttcaccccgggcgtctacgacatcgaccgcaccatcgacgtgtggcggccgaacaccgtggtgctcggcctcggccacgccaccctgaccgcggtcaagggcgccaccccggtgcaggtcgaggacgtccccggcgtcaccgtcgccgggctcaccatcgacgccggcaccgtcaggtcgtccgcgctgctgcgcgtcggccgcggccacggcttcggcttcacctcggcgaacaatccgaccagcctgcaggacgtgtacttccgggtcggcggcccgcacgtcggcaaggccggcaccgcgctcgaggtgaacagcgaccacgtgctgatcgaccacacctgggtgtggcgcgccgaccacggcgtcgagggcttcaccggcggcgacaccgagcggtggaacaccaacatcggcacctacggcgcggtgatcaacgggaacgacgtgaccgcgaccggcctgttcgtcgagcacttccagaagtacaacaccgtgtggaacggcaacggcggcaccaccgtgctctaccagaacgagctgccgtacgacccgccgacccaggcggactggatgaacggcccggtccagggctacgccggttacaagatcggcaaccgggtcaagacccaccacctgtacggcgcgggcgtgtacgtgttcaatcagaacaaccccacgatccacaccgcgaacgggttcgaggcgccgcagaccccgggcgtccacctgcaccacatcatgacggtgaacctgagcgccggcgtgatcgaccatgtcgtcaacggcgtgggtgcggcggcggacaccacgaaggtcggcgtgccggtctacgtgaacgactacccggccgctccgtaa

SEQ ID NO: 725 - DNA, 456 bp, Actinoplanes utahensis
atggcagcatttttctcccttgtggccggggtcgtggtcggcctgatagctggatggttcatccgtggacgctcgctcggggccgcgacggctcccgcggtggtcacgccggctgccgccaccgagaccgcgcccaccacctcaccctccgtttcgccgaccgccgtttccccggcctccgtttcgccggcctccctttcgtcgagctccgtttcgtcgaccgccgagaccgctgtcatcgagcccgccgccgaggccggcaccgagcgcttcgacgtggccgagacggctgtcgtcgagccggtcgaggctgaggcggaggtcgccgagccgggtgccgagaccgtcgtgatcgaggccgtcgtcgtcgagccggtcgctgtcgaggagccggctgccgcggctgagccggccgcggtcgacgagccgatcgtcgccgctgagctagctagctag

SEQ ID NO: 726 - DNA, 381 bp, Actinoplanes utahensis
gtggccgacgagccggtcgccaccgacgagccgatctccgcggaggagttcatcgacgagccgatcgcggaggaggccgaggaggcgtccccgatcatcgagccgtccgaggacccggcgccgatcgacgcgccggccccgatcgaggacaccatcggcgttccggccccggttcaccagccggacgacctgaccaggattcccggcatcggcccgaaggtcgccatggcgctcgcggcggccgggatcacgacgtacgccaagctcgccgattctgatgtgaccgatctgaagaaggcggtcaacgccgccggcatgcgcggctccgccagcctggccacctgggccgacaaggcccgcgagctgaccgtcgccggctga

SEQ ID NO: 727 - DNA, 438 bp, Actinoplanes utahensis
atggccgcgatcaccgctaccgccaccgcgtcttcgacttcgtccgaccgccaggccgcgtggacgcgcctgcagacgtaccgccgccagctcgccgccgacctgatcccggtgcaggcgagcccgcagaccatcaacaccgaccgggccgccgtcgccgccgccgaggccgaggtcgcccggatcgagggcgtccgcacggtgaccgccggcaaggtcgcctccaccgccgtgcaggcggagagcgccgcgatcgcgagcgaacggtcgtccgccgacagccagcggtcgtccgcggcggtcgcgtcgtccgcgccggttccgtcacgatcgtccgcggccgccccggcgtccgcgccggccgggtcccgggcgtccgcggacacggcggccgtgaccggcctgccgtacggccgcagcctcgacgtcacggtctga

SEQ ID NO: 728 - DNA, 1761 bp, Actinoplanes utahensis
atgagcgggcgacgtctggcggtcgtggtgacggtcgaacaccacgacgatcccgtcctgcgccggtattcggtgccgtcagcggacgtgcggggtctcgccgccgtgctggccgatcccggtctcggcggcttcgacgtggagttcctgcaggacccggagacgtgggacgtctatcagcgcctgcaggccgtcgccgacaaccgcacccccgacgactgtctgctcgtctacttccgcggcatcttgctgtccggcccgggcggcggcctgtacctggccacccccgacacggtgatgcagcgtcccgccgacaccgccgtcgacgtgacccgcctggacgcgctgatccaccgcagtcacgccggtcaggtcgtgatcatcctggacggccgcaccggcggcccggtcgacgccggcgcctacttcccggccgcccacgccgccgacaaccgcagccgcgtcctgctcaccgccgacgcccgccccgaaccccccactttcgccggcctgctcgccgacggcctccgcggcggcgccgccgaccgcaaccgcgacggctacaccggcatcgacgaggtcatcgaccacctgcgcgaacgcgacccgtccgtccgccactggacgttcggcaccggtcgccagccctacctgtcgaaggtccgcaagccgggcagcgaccagatggccctgatcgccgaactggccgcggcggccgccggccccgacctcccgcaggccgcccaggcccgcaccaccctgtcccgcctcgccaccggcagcgaccgggtcgccgccgccgccaccgccgccctgcgccgcacctccctgcgagtccccgacccccagatcactttcggccagacgcttcccggcggtcccgcgcagaccgcccgggtcccgctgaccgccccgcccctggtggccacctccaccgtgaccaccaccggcgacggcctgcaagcggtcctggacggctcgcacctccaggtcacctggcgccccggccggtcctccctgaccggctccgtcaccatcgacggccccaccggcgtcgcccacctgtccgtgaccggcgaggtcaccccggagacctcggccctcccgaaaccgggcaccgcccctcagcccggacccgccctacccggcgctgcccctcaccccggcgccacttcccagcccggcgccacttcccagcccggcgccgcctcccagcccggcgccgcctcccagcccggcgccgcctcccagcccggcgccgcctcccagcccggcgccgcctcccagcccggcgccgcccttcaccccggcgctgtctctcatcccggcgccaccgctgaatccggcagcggggctcaatccggcgccgctgctcgatccggtcaatccgatgccaccgggcagggtggcaccgccctcgaaccgacgctgcctgcaccaccgcctcgctgggccggcggcaacggcgtacggcccacgtccggggccccggcgggccagccgccgttcagcgctccggtcgacccctggcctgacgcccccacctcgacgaccccgccccggcccggccggcggatccgtggccgaccgcacccgcctggctgcccgacgccagccctcaccaccgggtcgtcggcccgccctccgcacccggctcccacgaccaggtcaccagcccgctccccacttccggtgccccggatcagaacaccgaccgcgccccggcctccggcgcgcatgaccagacgacgagtgccctga

SEQ ID NO: 729 - DNA, 2274 bp, Actinoplanes utahensis
gtgacaccgacgttgtcgcctgccggcccctggcccggcgaccagccctccggccgcggcgcgttctacgcgcagcagcccggtttcggctggcagcaggcccccgccaacccctccgattccgccgctccccccgaatccgtcggccccgccgactccgccgactccgccacccccgccgaacactggacgaccgctgccggccaggcccagcagtcctccgatcctgccggcccgtggccgggcacctccgatcccgccggcccatggccgggcaccgccgttcccggccagtcctggccgtcccgcggcaccccgcatgagcagagcgaccgcacaaccgtctcctgggaggcgggttccgccgcagccgcagccggtggctggccccgatccaccgatccggcgaccgacccggcagtcccccaccggccagagtccccggtcccgactggcccacagtggccgggtcaagccgccgcggcagatcaagccaccccaccggaaccgcccacctggcccccacccccacatccctctgcagcaccgtcgaccgccccagcgagtggcgtcggcccgggcggatcctcgtcgcgcgtaagctggatcggcccgaacgactggccctcgacagccgacacccccggccatggaccgaccggtgctcccggccatggacccatcggtgctcccggccccggacgagccggcattcccggcgccgcaacagccggcgccgcaggtcccggacaggccggcattcccggtgcgggaattgccggcgccgcaggtcccggacaggccggcattcccggtgcgggaattgccggcgccgcaggtcccggacaggccggcattcccggtgcgggaattgccggcgccgctggtcgcggaccggccggccccggctccccgccggcacccccttccggaacaggtccggctgatgctcccggagtctccggcccccacagcggctcggagaccacggcctggggtggcgtccagtccccgagcggatggcagcaggcgcagaccgccgcccccgccaatccggcatggccgacctcgcccgccgggtggccggccgctcccggatggcagcagcccggcgtagcgtcgcccgcggcgggtggcgatccggcgtacgccaataatcctccgcaggagaagcggcgcctgcgcgtcgcggggatccttgttcttgctctgcttctcgcggccggtgcgtatctcggcatccggtacgccgcgggccgcggtcgggagcaggccgccccgccgccgacggtggctcagacgctgaccggcacgccgccgtcggggcaggcgaccggaccggccacgacgaccccggcgccggcgagtctcggcaccccggtcgtgctgaacacgatcaagggggtcggccgggagccggagggtgtcgtcgtctcgtcggacagcaagacgctgttcgtcgcggatcagggcgccaagcaggttttcgtcgtcgatgccgcgagtgggaaggcgcagccggtcgacgtaccgaacacgccgcgtttcctgaccctgtcgaaggacggtgcgaagctctacgtctcgatgttcgagaacgatttcagcgccaacgggctcgcggtgatcgacacggcgaagcgcagcgtgatcacgtcggtgaagacggggccacggccgttccagccggctgtcgccgcggacgggcgggtctggctgccgatccacaacggggcccgggtggagatctacgacgggacgacgctggcccggttgtcgcagatcagcgtgccgccgaatccgcactggatcgctttcacgccggacgggtcgcgcgcgttcacctcggatcacgagtcgagccgggtgtcggtggtcgacacggcgtcgttggcggtgctgaacaccatcacggtcggccggtcgccgcacagcctggcggtcaccccggacggcggcaccgtggtggtcaccaactatgacgtcgacaccgtggagacctatgacacgaggacgctgaagctgactcagcgttatcaggtggggaaactgccgcaggcggtgctggtgtcggcggacggtgcgcacgcctacgtggtgaacgagggctcggacaccctgtcggtgctggatctccccgcgcggaaggtggccgccacgatcccggtcggggacagcccgcgggtggtgggtctgtcgccggacggcctgcggctgtacgtgaccgcggggcgggacggtgcgatcacggtgctgaaggcggccgacggctga

SEQ ID NO: 730 - DNA, 1371 bp, Actinoplanes utahensis
atgccaacggattccggcgtcgatcgggcacgcctcagcaagctcgccgagcgcgagcgggccgctttcgccgagcggcatccgcggtccgcggcggcttacgggcgggccgaccacctgttcggccgcgtcccgatgacctggatgaacaagtccgcggccggcttcccggtctatctcaagaccgcgcggggcaaccggctgaccgacgtcgacggcaacgatttcctcgacttctgcctgggtgacaccggggcgatggccggccactcgccggccccggtggtcgccgcggtcacccggcggctgggcgagttgggcggcgccacgacgatgctgccgaccgaggacgccgccgccgtcggcgccgagctggcctcccggttcggcctgccgttctggagcttcgcgctgaccgcgaccgacgcgaaccggtgggcgatccggttgctgcgcgccgtcaccggccggtccaagatcctggtcaacagctactgctaccacgggtcggtcgacgagtcgctgatcgtcgtcggccccgacgggcgtggccgcagccgcgagggcaacgtcggcgcgccggtcgacgtgaccgagaccagccgggtcgccgagttcaacgacctggccggcctggagcgcgagctggcgcacggcgatgtcgcggcggtgctgatggagcccgcgctgaccaacatcggcatcgtgctgcccgagccgggctatctggccggggtccgcgagctgacccgccgatacgggacctatctggtcaacgacgagacgcacaccttctcggccgggccgggcggcgcgacccgggcctgggatctcgcgcccgacgtgctgaccatcggcaaggcgatcgggggcggcgtgccggtcggcgcctacggtctgtcggccgagctggccgacgcgcttctcggtcgcgccgacctcgacctggtcgacatgggcggggtcggcggcaccctggccggcaatccggtgtcgatggcggccacccgcgccacgctggaggaggtactgaccgagggcgctttcgccaccatgaccgccacggcgaccgccttcgccgacggcgttcagaaaatcgtctctgcgcaccgtctgccctggtcggtgagccgtctcggcgcccgggtggaatatcggttcgccgacccggcaccgcgcaccggcaccgagtcggcggccggcgcggatgccgagctggaggacttcctgcacgtctatctggcgaaccgcggcattctgctgaccccgttccacaatatggcgctgatgtgcccggagaccacgctggacgacgtcagccgccaccatgagatcttcgacgcggcgctctccgcgctcaccgcttcctga

SEQ ID NO: 731 - DNA, 3249 bp, Actinoplanes utahensis
gtgacggacggcacagggtggcggcggtggacgggcacgaccggcggagtgctcgggcgcctgcgccggccggtggagggttccgggccggccgcggtgccgcagccgcgcccggcgccgtggatggccggcggccccggcgacgagctggtggaacgcggccggctgcagacccggctgcgggagctgctgctggccggtgacgtggcgctgcacggcatcggcgggatcggcaagacgacgctggccgagcaggtcgtccgcttgcccggcctgcgcgaccggttcccgggcgggctgctctgggccacggtcggccagcagcggaccggtgcggcgctcgccgcgctggtgggcgacctggtcgagcagctcaccggggaacgacccggggtggtcaccccggctcaggcgggggtgcggctcgccgccgcgctcgcgcaccggccgccggtgctgctggtcatcgacgacgtgtggaccgcggagcagctcgaaccgttcctggacgggccgggctgccgccggctgatcaccacccgggtggccggggcgctgcccgaggatctgccccggatcgaggtcggcgggatggggcacgacgaggcgaccgcgctgctcacccgggacctgccagggttggcgctgccggacctgacggcgctgctcgccctgaccggacggtggccgttgctgatcagtctggtcaacggcgtgctgcggcaccgggtggcaccgcaccagctgatcgatcaactgggcgcgtacggatgggtggcgctcgacctcgccgtgcccggcgagcgggaacgcgctgtggaggggaccgcggaggcagccctggagctgctgaccgagtcggatcggcggcgcctgctggagctcgggatctttcccggggccgagccgatcccggacgcgatgaccgatctgctctgggccgggacgggggagctcaacgccggtgaagcggccgggttgcgcgccacgtacgcccggctgggcctggtgaaaccgaccgcggacgggctgcgcgtggcgggggtgctccgggcgtacctccgcaatcggctcctcgacccggagatcgcgcaggtgaaccgccgcctgctggagatggcccggccgcgcagcggcgggccgtggtggacgctgcccgccaccgagcgccatctgtggcggcatctcgcctttcacctgcgggaagccggttggtgggacgagttgttcgccaccgtgaccgacctgcggcggctggcccggcagatcccgatgctcggtgtcgcggccgcggtggccgatctggatcgggtgccggatccgcgcgccggtgcgctgcgtgcccggctctcccgtggcgcctcactcttcgcaccgatcgagcccgcggacgcactggccgacgtgctgctcgcccggctctccggagcgcccgaactcgctgccggcgtgaccgaatttgccgccgcacagcggggccgggccggactcaccgcgcgctggccgctgcccgacgtcggaccggacagcctgacccgggtgatcggcggtggccccggctggctcgacgccgtcgcggtcgccaccggctggatcgcgaccggcggcgccagcggcgtgatcaccctgcacgatccggcgtccggtgacgtgctcgcccggttgaccgggcaccccggggcgatcaaggcgctcgccgcgacatatgacggagcgtcactgatctccgcgggtgccgacggcacgctgcggctgtgggacgtggaccgccggcaggagcggaccctgtggacgacgtccggcgagatcctgggctgcgcggcggccccggccagccaccggatcgcggcggtgagcgccgcgggggagctgatcgtcctcgatgtggccgggaactggcggattctcggccatcggggcggcgaacggctggtcggctgcacgttctacgacgacgaccgggtgctgacggccagtgacgaaggcgcggtggtcggccacgatctgcgcagcggacgccggaaagtcctggtcatggcgggaaaggacctggtcgccgggctggcggccgggccgtcctgggtggcgctcggcggcgtggacgggacgatccggatccagccgatccgcggtggcggcgagacggtcaccgtccgtggacatcaggggtgtgtgagcacgatcgtcgccttcggcgaccggatcatctccggcggcgaggacggcacgatccggatgattgaccggtacggggcgcaggtcgccgtggtgcgagcccatccgggatgggtgaccgggtgcgtgatcgggcccgaccggcgcacgctgatgaccaccggcagtgacggaaccgtccgggtgtgggatcttccgcggctcggccaggagaccgtcggcggaccggtggactgggtggacagctgtgcggtggcaccgtccgggacatcgctgatcagcggcggccgcgacggtgtggtgcgcaggtgggagatcggcggaggcggcggcgccgtgctgtgggcgggagaggagccgatccggcggtgcgtggtcggcccttgcggatcgtggatcgcggcggcgtcgccatcccggacgatcctgctccgcgaaccctcctcttcgccggccgacggatgggaggtcgaggaacttcccggtgcgctcggctgcgccgcggccccggaccaggacctgctcgcgtggtgggacgaccagggcgcagtcaccgtccggtcggtcgccggcggtgaaccgctgcaccggacctgcgacagtccgatccgggccgccgccttcctgcccggtcaccggctcatcctcgccggagccggcggcgaactcgccgtctggcagtgccggaagaaccggctgcggccgctgctcccctcgcgtcgtgccgaggtccgggcgatccacgtggtccgggaccggatcacggtgatcgacgcctccggcgtcgcctgcttcgatgtacgcacgctgcgccgcaccgggtgcgccgcattcgccgagaccgcggtgacccacggcgccgtttcggccgacgggagctggctcgccaccaccagccaggacggtgaactgcggatccgcccgctgaccggcgacctgcagccggtcgcggcgatgcgggtggacggcgcgctgcacgaatgcgcctggggcggcgactccctggacctgttcgcggccggccggcgcggcatgtacgccttcaccttccgcccaccacgcccggcgccgtag

SEQ ID NO: 732 - DNA, 1278 bp, Actinoplanes utahensis
gtgaccggcacgggggaaacaccaggcagcgacaacagcgcgccggatcccacatcgcaccagcccaccgacccgaccgcgccgccgcccgccggcccgcccaccgacccgaccgccgcgccggtcgagccgcctgtccggccggccgctccgggagagcctccgcagccgcacaccccgccggcggagccggtctccgagtgggcccgcccggccgagggcgcggagccaccgccgcagccgtggacgccaccgcatcagccatttcctcagccaccccctccgttttcgcaggcccccaccggtttcccggcacctggcaactatcccgcgccgggcgcctccgcactgccgggccatcccccgacttcaccgccgggtcatcccggcgcgcaacccccgggttatcccggcgcgcaacccccgggttatcccggcgcgcaacccccgggctatcccggcgcccagccagccggctatcccggctatcccgccggtgtgttcccggggcagccctggccgcccctgccggcctccccgggcagccggcgccgcggcggcgtcctggccgccgtcatcacctcggtgatcgccgccatcgtcctgctctgcggtggcagcatctacgcgctgagccattccggcgacagatcgcacggcggcgccggcgacgactacccgttcacgctgccgtccggcttcgccttcccgaccgacgacccgtccgggaacccgttcgcgacgccgtccgccacgtcgaccgagccgcagcccagcgtcacggccgccaaggacatctacgacctggaccaggtctgcgacgccaacgtctacttcccggacgccccgaagcgggcgggcaaggccccgcacccggtggtgctgctggtcaagaccggcccggacgacgtgcgctcgcaggacccggtcttctacctgcaggaggagggcaccgccaagagcgacgagaacacctgggccgcacgcggcccgggcaaggtgcagatggccgcctgcatggatcggaccaccgagggcaagaagatccgcacctgcaagtacaccgacccggatccggagacggtcacgctgtaccacgcgagctggcggctgcgggtctacgaggtggccacgcaccggctgctgctcgacaagaagctcgaaggcaccgagacggcgtgtcccttctccgtgttcgtcggcaaggacaagaagatctacgccaaggtcagtgaccacacggcgctcggcgccctgcggaatctggtcgagaaatag

SEQ ID NO: 733 - DNA, 1101 bp, Actinoplanes utahensis
atgatccgcatccagcacgtcgcactgcgccgggtgcgcctgcccctggtgcaccgtttccggaccagctcgcacgcgaagcgcgaactggagcacatcctggtcgcgctcaccgacgagtcgggggccaccggctggggcgagatcgcctcgccgagcggcccgttctattcggcggagaccgtggagagctgctgggcggtggcccgcgatcacctgaagccactgaccctggcgaccgggtgggatcacccggcggatctcgcggccgtgctggcgaaggtccgcggcaatcacttcgcgcgcgccggcttcgacgtcgcggcctgggcgctgtggtcggcccggcaggggaccgccctgagcgcggccctcggcgggacccgggaccgggtggccgccggcgtctcgctgggcatcgaatcgaccatcgacgagctgctggaacaggtgtcggcgcgggtgaccgagggttaccagcgggtcaagctgaagatcgcccccggctgggacgtcgaaccggtgcgcgcggtccgtgcggccttccccggcatcccgctgcacgtggacgcgaacggggcctaccccgcggcggagaccggcgtcttccgcagcctggacagcgcgggcctgacgatgatcgaacagccgtacgccccgcgtgacctggtcgcgcacgctgctctgcaggagaccctgcagaccccgatctgcctcgacgaatcggtcgaggaggtggccgacctggtcaccgcgctgcggctgggggcgggccggatcctcaacatcaaggtgtcccggatgggcgggctgaccgccgccgtccgcgcgcacgacctggcccgggccgagggcgtaccggtgtggtgcggcggcatgcacgaattcggcatcggccgggccgcgaacgtcgcgctcagctcgctgcccggtttcacgctgccctccgacgtgtccgggtcggacaagtattacgcccgggacatcaccaccgagccggtggtctgcgactccggattcgtcaccgtcccggccaccccgggcctcggctgggaacctgatctcgggtatctccaggagcgcaccgtcgaccgggtctga

SEQ ID NO: 734 - DNA, 633 bp, Actinoplanes utahensis
gtgacttcgagaggcacgcccgcggagcgcttcgaccgtaacgttcagcgacggtcggcgcaggtgctcaagcagcgggtgctggaacagcagcgggccgaattcgatcgggcgctgcagtgggccgccgagcatgatgcgatcgaacgggccgcggcgctgatcgtctccgcgcggcgtcgcttcctggtcgggaacggcaagtcgctcagctacgcgtcgctgctcgcctccgacctgagcgccgggctgtccggggtgcatctggtggacggggcggcgctgcgcccgctcgacgtgctcagcgacatccggcagggtgacctgctgatcgcggtgtcgctggaacggtaccggcgggagacggtcgaggtggccaccgcctacgtccggcacggcggcgacctggtgctgatcaccgacgccgaggacgcgcccctggccggcctcgccaccgcccggatcgtggtcggcacgggcagcgcctcatacgtcaactcgccgacctcgacggtgctcgcgctgcacctgctcgcgaccctgaccatcgccagctcgaagggcgccggccggcgtctgcgggagcgggacgcgctcgccgccgagctcgacctccacgtggaggagacatga

SEQ ID NO: 735 - DNA, 825 bp, Actinoplanes utahensis
atggacgtcgtggtgcggcagctggacgggatagccgagtggacggctgccgggctcctctatcggagcgttttcggctacaccgcgcccgagtggggcctgaacccgcgcctgctggccgccctccgtgagaacggcggcaccgtgatcggcgccctgggcgagaacggtgagctggtcggtttctgctacggcttcaccggcctccaggacggcgagatctaccactattcacaggccgccgtcgtagcccctgccgcccagggcaccggaatcggccgcctcctcaaacacgcccaagccgccgccgcccgcctgaccggcgctcgcaccatgagatggacgttcgacccctacgccctccgcaacgcccacttcaacttcgccgtcctgcgagccaccggcctgcgcttcctccccgacttctacggcgaacccggcaccgaccgagtcctcgtctcctggaacctggaccaggccgtccccagcgacaccgcccagccgccgacgatcgtgcccccgatccccggcacgagcccggcaacccggcatgccgacggcctacccgccacgggtcacgccgacagcatgccgggcgccgggggtggggtgggcgcaggccggggccgggcagggccgggggatgggcggatcgtcgtggcggcgggggagcgggttgccgcgcctgatccggcggatcggggttggctgcggcgtgagctggtgacgcggtttgctgagggtgggcgcctggtggacgtggtccggccggatggtgaccccgggcgggtggcgtacctgttcgcaaccgaggatggggcgtga

SEQ ID NO: 736 - DNA, 924 bp, Actinoplanes utahensis
atgtcgtcatctgcgatcgcgcggctgcagcggtatgtcctggccgagtcgcctaccggggattcgcgggggctgggggcgttggccgagatgctggaggcggatgcggtggcggccggattcagcgtggggcgggaggcgcatccgaccggtgatcatctgatctggagcagggccgcgcggggggtggccggggagccgctgctttttctcagtcactacgacacggtgtggccggtggggacgctcagcgggatgccgtggcgggtggacggcgacgtgatccggggcccgggggtctatgacaccaagagcgggatcgtggcgctgctggcggcggtggcggcggtggaccggccgcatccggagatccgggtgatcgtggtggcggacgaggaggtcgggtcgccgaccgcgaccgggctggtcgaggcggaggggcggcgggcgggggtggtgctcgggctggagccgccgcatccgggtggggacctgaagaccgggcggcgtgggagcacccgggcgcggatcgaggtcggtggggtcgaggcgcatgcggcgctcgatccgggggcgggggtgaacgcgatcgacgagctggtcgatcagctgctccgggtgcgggagatcggtgcttcccggccggtgctggtcaacaccgggacgatcggcggcggtgggcggaccaacgtggtggccggtcaggcgtacgccgatctggggctgcggttcgccgatccggaggatgagcgggtcgtgctgggcgagttggccgggctgcgggcggtccgggcgcgggcgaccgtcggcacgcggctgctgtcgcaccggccgacgtggcgtccgggtccggccggggaccggctgctggcccggatcgccgggatcgccgccgccatcgggcagccgctggacgggcgctag

SEQ ID NO: 737 - DNA, 291 bp, Actinoplanes utahensis
atggacctctcgggggtgacttcgatgctcaacgacaacgaacgccgcgcccttgccgagttggaacgcgatctggagcacgacccggacttctccgcccggatggccggcctcggcgtcgtgcagcccgagccggccttcccgatcgtcccggtgctgtgcgcgctgctgttcatcaccctgccgctggtgatgatgttcttcggctggccgggcgcgctgatcctgctggatctgttcaccgccgtcgtcgcggtcatcatgatccgccgccgggccgtcaccggctga

SEQ ID NO: 738 - DNA, 309 bp, Actinoplanes utahensis
gtgaccacgatcagcagcatcagcaacaccgcgccctaccagatcctgcaggcgcaggcgccctaccgtccgcagccccgcccgcaggacgctgcggatcccggcgacgggcgacaggtcgccgggctcgccgacccggagaagctgaccagggtcagtgacctgctcgacatggacacctcggacgtgacctcggccgcgaccagcgcgtccagcctggtcagcctgctgcaggacaggggcgtcgacttcagccagctccgtgacgtgctgaaccgcaccggcgatctgctcgacgtccgcgcctga

SEQ ID NO: 739 - DNA, 519 bp, Actinoplanes utahensis
atgaacgacgacaccgaggtgctgccgcgcacccccaccgacatcgagcacgacgacctgaacagcgccatcgcccacgccgcgccgaaacgctggtggaaccggacgaccctggtgctggccggcctggtgctgctggtgggcggcttcctcggcgggatccaggtgcacaagcggtgggggtcctcgtcgacgtcgtccacctcgtcgtcgtccgcgccgtccggttcgttctccggcgccttccccggtggcgccggcctgcccagcggcggcttcgggccgaccgggccggccgcaccggggacgtccggaacgatcagcagaatcgacgggaacacggtgtacgtgcagaccgcggccgggcagacggtgacggtccgggcgtcggacaccaccacggtcagcaagaccaccccggcgaccgtcgccgacctgaccgccggactccgggtgaccgtgcagggcgccaccgactcgtccggcgtggtgagcgcgacctcgatcaccaccggctga

SEQ ID NO: 740 - DNA, 1185 bp, Actinoplanes utahensis
atgagcgccaccgagatcctccggttcgccctgcgcgggctgtccgccaacaagctgcgctcggtgctcaccatgctgggcatcctgatcggcgtggccgcggtgatcctgctggtcgcggtcggcaacgggtcggcgcgggcgatcgccgaccggatctccgcgctcggcaccgacacgctgaccgtgatgagctccagccggagcagcggcctgacgatgaaggtcgccgacgccctggacgacccggcgctggccccggacgtgaagtcggtgtcaccggtggtcagcacctcggccacgatcacctacgacggcagcgaccacgacgtcggctcgttcgtgggcaccaccccggactggttcggcgcgtccaacttcccggtcaggaccggtgccctgttcaccgcggacgacgaggcgcaggcccgccgcgtcgtggtgatcgggcagaccgtcgccgcggaactgttctccggggtcgacccggtcggccggcaggtcaccgtcggcggcgcgctgttcaccgtcgtcggcgtgctcgactcgaagagctccggcggcttcagcgacgccaacgacaccgcggtcgcgccgatctccgcggtccgccaggtgatcgccggatacggcacgctcagctcgatcctggtggaggcccgcgacagcgaccacgtcgacaccgcacagggcgagatcgccaccatcctggacaggaagacgccggccggcagcgacgggaccgcggcgtaccggatccagaacgcctcccaactgctcgccacccagaccgagaccgccgacacgttcaccaccctgctcggcgcggtggccgcgatcagcctgctcgtcggcggcatcgggatcaccaacatcatgctggtcacggtcaccgagcggacccgggagatcgggatccgcaaggcgctcggcgcaccccggcgggtggtgctcagccagttcctgatcgaggcgacgctgctcagcgtcatcggcggcggcctcggcgtggccgccgcactgatcggcagccgattctcgatcgtcggcgtgcagccggtggtggtgcccggctcggtgctgctcgccctgggtgtgtccgtgctgatcggcctgttcttcggcgggctcccggcggcccgcgcggcccggctgcggccgatcgacgccctgcgctacgagtga

SEQ ID NO: 741 - DNA, 717 bp, Actinoplanes utahensis
atgcccgtgacccggccggtcctggacgtccgtgacctgtacaaggtgtacggcgagggcgagacccaggtgcgcgcgctggacggcgtgtcgctgcaggtcgaccgcggcgactacgtggcgatcatgggaccgtccgggtccggcaagtccaccctgatgaacatcatcggctgcctcgacgtcccgtcccacgggcggtatctgctcgacggctacgacgtcagccggctctccgacagccagctggccctggtgcgcaacaaactcatcgggttcgtcttccaggccttcaacctcatcccccgtacgtcggcggtggcgaacgtcgagctcccgctggcgtactcggggatgcgcgccgccgaacgccgtcgccgcgccatgttcgccctcgacgtggtcggcctcgccgaccgtgccgaccacgagccccaccagctctccggcggtcagcagcagcgggtcgcggtggcccgcgccctggtcaccgaaccggccctgctgctcgccgacgaacccaccggcaacctggacagccacgccaccgaggaggtgctgcacgtgttcgacgaggtgaacgcggccggccgcaccatcgtgctgatcacccacgaggaggaggtcggcgcccgggccgaccggctgatcaggctcctcgacgggcggatcaccgcggacctccggcaggaccacgtggggcggcacgccgcatga

SEQ ID NO: 742 - DNA, 1194 bp, Actinoplanes utahensis
gtgagagcccttcgcaggcccagcacggcgatcaacgccctgctggcattactgatcgtcggcgccgcgatctggggcgtcaacctgatccgcagcaccacctccggcaaccaggcgaaagccaccgacctgcggacggtgaccgtctcgcagggcacggtgaccaggacggtgaccgccgacggcgcggtggccagcgcctcgaccgccgccgccacgttcaccacggccggcacggtcaccagcgtcaaggtcaaggtcggcgacaaggtcgccaagggccaactgctcgcccaggtcgacgccaccgccgccgagcgggaccggaaactggccgacgccaacctggccgccgcgaacgactcgctggcgcgcgccgagaaggccggcaccgacaccaccatcgccgagaacgcggtcacctcggcgaaactggcggtcgacgacgcccgggcggaggtcgacggcacccggctgaccgcgccgatggccgggacggtcaccgcggtcaacggctcactgggcggctcctccagcgggtccgccggcacctcggccggcacctcgtccggtgccgcggcatccggcgggtccggcgcgtccgccggctcctcggcgagcacgtcgaacggcttcatcgagctggccgacctgaccaggctgcagatcaccgcggccttctcggagtccgacgcgactgcgctcaaggccggccagtcggccaccatcacctggaacgcgttggcgggcgcggagaccaccggcaaggtgctggccgtcgacccgaccgcgacgaccagcaacagtgtggtcacctacggcgtgacgatcagcctgcccgacccgccggacggcgcgaagccggggcagacggtcagcgtcgcggtggtcaccggcagcgtcgacaacgcggtccgggtgaactcggcggcggtcaccgcgaccgggcggcgatccaccgtcaccgtgctcggcgcgaccgggcagcaggaggtgcggcaggtcgaggtgggactgcagggcgacgacgcgtaccagatcacctcgggtctgaccgccggcgagagggtggtcgtcccgaccagcaccaccagcaccggtagcggcgccggattccgcaccggcagcggcttcggcgccggtggcttcagcggcggcggtgccccgccggccggcggccagggcggtcgctga

SEQ ID NO: 743 - DNA, 1542 bp, Actinoplanes utahensis
gtgcgccggagccgccgggtgcgccggaacccgggccgccgggtgcgccgggtgtgccggaacccgggccgcccggggccactgccgagggttgcgccattccggacggcggcaccatgccggacggcgggccgccggtgccctgcgggcaggccgagggcgtcgtaccgccgggtgcgtcggtgttgtcgttgctcttgtcggacgagtcaccgcaggcggcgagcaggaccacggtcgacagggcgacggcggcgcggcggagatgcgagctcggcatgtctgctccagagattcgggcccgtccggatacgtgaacagccacaatctacgatcatgagcaagctgttggggcaaaaccggactaaacaccgcaataggttgataggtgccgggatcgtcgtggccgggatcgtcggcggcgcgctgctcgcggtcgtgcacagccaccagcagggcggcgcgaccagcacgatcgtggccgtccgggtcggcaagggcgacgtcaccctggacgtggcgaccagcggcacggtccgaccggccaccacccgggagctctccttcgcggtcaacggcacggtcgcgtcgatcgccgtgcgggccggcagcaaggtcaaggccgggcagaccctggccgccgtcgacgccaccgccgcgaccgccgccgtgacggacgccaggaacacgctcaccgacgcgaagagccggctcaccgacgcgcgggaccaggcggcccgggtcaccgccgcggccaccgcgtgcgccaccgccgcatccgaccgcggccttctcgccaccgccgcatccgaccgcggctttctcgccaccgccgcatccgaccgcggctttctcgccggggccgacgtcagcccgacggcgaccgtggcggtgaacagttgcaccacccgtggctacccggacaccggcaacgacccggtgctcaccgcgcagcaggcggtcaaccgggccggggaggccgtcaccagggccgaggcggcgctcgccggcgccgtgatcaccgccccgatcgccggcaccgtggtctccgtcgcgggcagcgtcggcgacacggtgagcagcgggaagaccttcgtcaccctggccgacacgtacaccatgcaggtcgaagccgcattcccggaggccgacgccgggtcgctggccgtcggtcagagcgccaccatcacgctcgccgaccacgacgacgcgctgaccgggaccgtggtgcaggtcgacccggtcggcacctcggacggcacgctggtccgctacggcgcggtgctctctttctcggccccgcccagcgacctgctggtcggacagtccgcccaggtcgccgtgcgggtcggagagaccaggaacgtgctgcgggtgccgtccaccgcggtgcacgacatctccggcggctccggcaccgtgctgctgcgcgtcggcggccggtcgtccgagcggaccgtgaccgtggggctgcgcggcgaccagtacacccaggtgaccgacgggctcaccgccgacgatcaggtcgtacgttcgtggtga

SEQ ID NO: 744 - DNA, 699 bp, Actinoplanes utahensis
gtgacgccgccgtaccgggcaccgccaccccgtcccggggtgaatgacgacatccaggcccggcaacgactgcgccggcacaaccgggccctggccgagctcgcggccaccaagaccgaactggtcagcgccctgctgcacgagttgcgcaccccgctgacagccgccctcggcatgctggagatgctgcccgagcagaccggcgacccgctgctcgacgaggcgctaccgatgatcgcccgcaacctgcgccggatcgaacggtccaccgccgagatcgccacgatcagcgggatcgagagtggcagcctcccgctcgaccggatcagcttcgacctgccggccctgctcggtgaggtggccctggccgccggcgcggaatgctcggccgacccggcgaccggcctgatcaccggcgacccggcccggctcggcgaggtgttcagccggctgctggccgcggtccgggcactgaacgggccggccgcgatcgaggcgaccctggccggcaccgagtggcacgtcgccttcccgctccccgaagggcaggccagcgaccggctgttcacctccgggggagccggcggcaacgcgatggcgctgatcctggcgcgggcggtcgccgggcgccacggcggcagcgtgggcgtgcacagtgcgggcggaacggcgtacctgcgcatcgtcctgccggtctag

SEQ ID NO: 745 - DNA, 450 bp, Actinoplanes utahensis
gtgacttccccgccttgcgcttttgccgtctccggccgtctcccgcgccgatactgggtggcagcgagcgaggaggacggggtgacttccgttctggtggtggacgacgatccgaccgtgctggagatcgtcgagacggtgctgcggtccggcggtctggacgtcgacgcgtgccgcgacggccgggacgcgctgcgggtcgcgcacgagcacgtgccggacctcgccgtcctggatgtcaccatgcccgggatgaccggcctggaggtgtgccgggcgctgcgcggcgacgcggagaccgcggacatcccgatcattctgctcaccggacgcggccagtggctggacgtggcctccgggttcgacgcgggcgccgacgactacctggtcaagccgttcaccgcgcaggatctgctgacccgggtggaagcgctgaccgggcgactctga

SEQ ID NO: 746 - DNA, 1938 bp, Actinoplanes utahensis
atggtggacgacggtgagcggatcaccggcgggcgactgtcccggtggaccgtcggacggatgctctcggccggcttcctgctcgccctgctctccctcgccgtggtcgggaccagcgcctatctgcgcatcggcgacctgctgcacgaccagccgccactgcagcactcgcacatggtgctcggtgacatcggcgcgctgaacgactcggtgcgggtgttcgacaaggtcgcccgggatgaccgcccgtcggccgaccggtgggccgacgcgttgcgcggctccgccgccaccgtccaggaacggctcgacaacctgcgtcacgacgcggccggggaccgggtccatcaggagtatctggggcagttgcagccgctgttcaccggccggctcgacgcgctgctgcgggccgccgacggcgccacgccgaaaccggacgtcgacaccagcgccatggacgccctgatcaccaagatgcaccagcacgaggaggatcagctcgacgaccggttgcaggcggcccgcagcagcgccacgatgacccggcagctgatcctctgggtgtcggtggccaccctggcgctggtggcgctggtcgcccgctggatcacccaccggatcaccgcgccggcccggcaggtgaccgcggccgcgcagcgggtgctggagggcgacctgacccggcgggccgaggtgaccgggccgctggagctggcccagatggcccgggcggtgaacgcgtcgatgaccgcgatggtcaccgcccacgacgaggcgctcgccgccaccgccgcgaagtccgccttcctggccaccatgagccacgagatccgcaccccgatgaacgcggtgatcggcatgaccggcctgctgctcgacaccccgctcgacacccgccagcaggaactcgtcgagaccgtgcacgccagcggcggcgccctgctcgtgatcatcaacgacgtgctggacttctccaagatcgaggcgggtgagctcagcctggacgagcggccgttcgatctgcgctcctgcgtgcagcaggcgatcagcctggtcgcgctgaccgccggcggcaagggcctgcacctgtccagtcacctcgccccggactgcccggccgcggtcctcggcgacgccggccggatccggcagatcctggtcaacctcctcggcaacgcgatcaagttcaccgaccacggggcggtcaccgtgcacgtcgcggccgacgctgcgcccgggcagccggaccggatcgaggtgcggatcgccgtccgggacaccggcatcggcatcccggccgaccggctgaaccgcctgttccgcccgttcacccaggtcgacgcgtcgatcgcgcgcaactacgagggcaccggactgggtctggcgatcagccagcggctggccgaggcgatgggcggcggcatcaccgtcgacagccaaccggcccagggctcgaccttcaccgtcacgctgctgctgcgcccggccggcccggcggaacagccggccccgctgcccgcggtcccggccgccgtccgcccgctgtacgtcctggtcgccgaggacaacccggtcaaccagcgggtcgccgaactgctcctggaacgccgcggccaccgggtcgacatcgtcgccgacggcgccgccgccgtcgaggccgtccaccggacgcgttacgacctggtcctgatggacgtccagatgccgatcctggacggcctggccgccaccgaacgcatccgcgccactccgccaccgcacggcgcgccgtacatcgtcgccctcaccgccaacgcgatggtcgacgacgaggccgccagccgccgcgccggcatggacgccttcctggccaagccgctgcgcgaaaccgacctcgacacgatcctcgccgaggcggcccggcacacccccgaagccggccccaccctagctagctag

SEQ ID NO: 747 - DNA, 240 bp, Actinoplanes utahensis
atggagagggcggccgccaccggcgacacccgcaacctggcccgcctggcgcacggcctgcgcggttcggccgccacgctcggcgcggtcgagttggccgcgctctgcgccgatctggaggcccgcgcccatcagcacccggcgaactcgatcacgctactccgcgacctgcacacgcaggccgccgaggtgtcggccatcatgcggcggctggcggcggacttcgccgcggccgcctga

SEQ ID NO: 748 - DNA, 609 bp, Actinoplanes utahensis
gtgggccgcccgatgagcgccaaggatctgatcctcggccggatccgtgccgccctgcgggacgcgccggcggccccggacatcccgcggacctaccgccgcgacttccctgcggccgacctggaactcctcgtcgaccggctgctcgactaccgggccgcggtccaccggatccccgagacggccatcgccgcgacggtgtccgggctggtccgcggcccggtggtgatcccacccggcctgccgccgtcctggcatccggccaccgccctgatcgacgacgacctgccccgggaccggatcgccgccgccgaggccgtgctgaccgccgcggccgtcgccgtcgccgaaaccggcaccatcgtgctggacgcctcgcccgaccagggccgccggatcatcagcctgctgcccgacatccacttcgtggtgctgcgcccggcccaggtcgtcgcctcggtcccggaggcggtcgcccggctcggcgcgggccgcccactgacctggttcagcgggccgtccgccaccagcgacatcgaattcaaccgcgtcgagggcgtccacggcccccgccacctgcacgtcctgctcctcgacggcgaggcgtga

SEQ ID NO: 749 - DNA, 1416 bp, Actinoplanes utahensis
atgagcaccttcctcggcatgccggccaccgcgccgcgcggcgtcggccacctgcgcggcgacgagccgttcccggcggcggcccgcaccgcgctcgccgacgaccagctgcggcgcaacctgcggcacgccaccaccacgatccgcggcaggtccggcagggtgatcgccgaactgcccgactggcaggaactccgcgccgccgggtcggcgatcaaggcatcggtgatggcccggctgcccgaactcctcgaggagttggaggcccgggtcaccgaccgcggcggggtggtgcactgggccgccgacgcgatcgaggccaacgcgatcgtcacccgcctcgtccagcaggccggcgccgaccgggtcatcaaggtcaagtcgatggcgacccaggagatcgggctcaacgaggccttggaggcggccgggatccagccggtcgaaaccgacctggccgaactcatcgtgcagctcggccacgaccgaccgagccacatcctggtgccggccatccaccggaaccgcgccgagatccgggagatcttcctgcgcgccatgcccggcgtcgacccggacctcaccgacgacccgccggtgctcgccgaggcggcccggcgatatctgcgcgagacgttcctgtccacgaaggtcgcggtcagcggggcgaacttcgcgatcgcggcgaccgggacgctcgccgtcgtcgaatccgagggcaacgggcggatgtgcctcaccctgccggacacgctgatcaccgtgatgggcatcgagaaggtgctgccgacgtggccggacctggaggtcttcctgcaactgctgccgcgggcgtcgaccggggaacggatgaacccgtacacgacgatgtggaccggggtgacacccggcgacgggccgcagaacttccacctggtgctgctcgacaacgggcgcagcgcggtcctcgccgacccggccggccggtcggcgctgcactgcatccggtgctccgcctgcctcaacgtgtgcccggtctacgaacggaccggcgggcacgcgtacgggtcggtgtatccgggaccgatcggggcggtgctgtcgccgcagctcaccggcgtcgccgacaacgcctcgctgccctacgcgtcgtcactctgcggcgcctgcttcgatgcctgcccggtgcggatcgacatcccgtcgatcctggtgcacctgcgcgatctggcaccccatccggcggccgaacgcgccgccatgcgggccgcggccttcgcgatgaaccatccccgctggtacgcgtcggctcagcgcgccgcgaaactcgcccgcatcgcccggcggcgcggcatccccctgtccgcctggaccgatgcccgcgaccttcccgaaccccccgcccagaccttccgcgactggtgggccgcccgatga

SEQ ID NO: 750 - DNA, 1380 bp, Actinoplanes utahensis
atgagccaccggttcgcagccgtcgatctcggcgccgccagcgggcgggtcgtggtcggcacgttcaccggcgacggcctcgacctggcggtggtgcaccgctttccgaacgagccggtgcgcgccggcggcaccctgtactgggacatcctggcgctctaccgcggggtgctggacgggctcgcccgggccggtccggtggacagcatcgggatcgactcgtgggcggtcgactacgggctgctcgacgtgtccggggcgctgctcggcaacccggtgcactaccgggacgcgcggaccgacgggatcgccgcccgggtccccgacctctatgccgtgaacgggctgcagacgttgccgttcaacaccgtctaccagctgctcgcggccgcggacaccccgcagtacgcgacggccgcgaccctgctgatgatccccgacctgatggcgtactggctgaccggggagatcggcgcggagtacaccaacgcctcgaccacggggctgctcgacgttcgtaccggccgatgggccacctcgttgatcgcggacctggggttgcgggcggacctcctcccgccgatccgtcgccccggcgacgtgatcggccgcttccggggcattccggtggtcgcggtcggctcgcacgacacggcgtcggcggtggtcgcggttcccgcctgcggcggcgatgtcgcgtacgtgtccagcggcacctggtcgctcgtcggactcgaactggaccggccggtgctcagcgccgcctcccgcacggcgaacttcaccaacgagggcggcgtcgaccggaccatccgctacctgcgcaacgtggccggactctggccgctgcaggagtgcatgcgggggtggggcgccccggagatcaccggcctgctcaccgccgccgccgcggaaccgctgctcggcgcggtcgtcgacctcgacgacccgatcttcctgccgcccggcgacatggccggccggatccgccgcgcggccggactgtccaacgacgcctcgccggcccggatcacccggtgcatcctggacagcctggcgctcgcccagcggcgcgcggtgcgccaggccgccgagctggccggggtcacgccgggcgtgctgcacctggtcggcggcggcgcccgcaacgagctgctctgccggctcaccgccgacgccaccggccttcccgtgctggccgggccggtcgaggcgaccgcgctgggcaacctgctggtccaggcgcgggcggccggggtggtctccggcgggctcgatgcgatgcgcgcgctggtgcggcagactcaacagatcgtgcgctacgaaccgcgcggcgacgacggcccgtggcgggccgccgccgagcgggtgagggggtga

SEQ ID NO: 751 - DNA, 2031 bp, Actinoplanes utahensis
atgacgaacccggcagtggccgcgctcatcgcgaggtcgcaccgcctcggtgcggatccgcgcaccaccaactacgcgggcgggaacacctccgccaagggcgccgaggtggacccggtgaccggcgagccgaccgagctgatctgggtcaagggctccggtggcgacctcggcaccctcaccgagcagggcctcgcggtgctgcggctggaccggctgcgcgcgctgcccggcgtctacccgggggtggagcgcgaggacgagatggtcgccgcgttcgactactgcctgcacgggcggggtggggcggcgcccagcatcgacaccgcgatgcacgcgctggtggacgtgccgcacgtggaccacctgcacccggacgccgggatcgcgatcgcgaccgccgccgacgggccggcgctgaccagggagatcttcggggaccgggtgcggtgggtggactggcgccggcccgggttccagctgggtctggacatcgccgcggtgcagcgggcgcatccgcgggcgatcggggtgatcctgggcgggcacgggatcaccgcgtggggtgcgaccagcgacgagtgcgaggcccacgcgcaggagatcatcagcaccgccgccgcatacctcgagcggcacggccgccgcgagccgttcggcaacgtccggaccgcggctcttccgcggcagcggagacgtgagcgggccgccgagctgttcccgatcatccgcgggctggcctccaccgaccgcccgcaggtcggccacttcaccgacgacgacgtcgtcctcgacttcgtcggcagcgagcggctggcggagctggccgcgctcggcacctcctgcccggaccacttcctgcgcaccaaggtcaagccgctggtcctggacaccgcgccggacgcgccgcttgcggccatcacgcagcggctcaccgagctgcgcgagggctaccgggccgactaccgcgcctactacgaccggcacgccaccgcggacactccggcgatccgcggcgccgacccggcgatcgtgctggtcccgggtgtggggatgttctcgttcggggcgaacaagcagaccgcccgggtggccggcgagttctacgtcaacgcgatcacggtgatgcgcggcgcggagagcatctcccggtacgcgccgatcgacgaggcggagaagttccggatcgagtactgggccctggaggaggccaaactccagcggatgccgaagccgaaaccactggccgcccgggccgcgttcgtgaccggcggcggctccgggatcggccgggcgatcgcgctgcggctggccgccgagggcgcctgcgtggtgatcgccgaccgggacgtcaccaccgcgcgggccgtggcggacgagatcggcggcaccgacgcggcgatcgccgtcgaggccgacgtgaccgacgcggccgcggtcgacgccgcgctggacgcggcggtgctcgccttcggcggggtcgacctggtggtcaacaacgccggtctgtccctctcgaagtcgctgctggagaccaccgagcaggactgggacgtgcagcacgacgtgctggccaagggctcgttcctggtggccagggccgcggcccgggtgctgatcgcgcagcggatgggcggcgacatcgtctacatctccagcaagaactccgtgttcgccggtccggacaacgtcgcctacggcgccgccaaggcagaccaggcgcatcaggtgcggttgctggcggccgagctcggcgatcacggcgtacgcgtcaacggcgtcaaccccgacggtgtcgtccgtggctcggggatcttcgcggccggctggggtgcgcggcgcgccgccgtctacggggtgccgcaggagcggctcggcgagttctacgcccagcggaccctgctcaagcgggaggtgctgcccgagcacgtggccaacgcggtcttcgtgctcaccgccggcgaactgtcgcacaccaccggactgcacgtcccggtcgacggcggcgtcgcggccgccttcctgcgatga

SEQ ID NO: 752 - DNA, 2937 bp, Actinoplanes utahensis
atgcatcgtcgtcgctggattgccggggtcgccgtggcggccgtcgtcggtggggttccggtgcccgtgctgggcgcggtcaccccggtcgcgaaaatcaactttcagcctgccaccgcggccgtgccgggcgggtacaccgccgacaccggagccgcgttcgacggcgcgcaggggtgggtgcggcaggacagcctgagcagcaccgcccacgtgccgctggatctgacccgcaacacgcgggaccgcgcgcgtgcgggaatcgatcaacggctcgacaccatcattcatctgcagtacggcgatgtcggcggcaccaacggcatcgccaccgccggcgcctgggagtacgccgtgccggacggcacctaccaggtgaccgtctcggccggggaccagccggcgtacgacagccggcacaccgtccgcgtcgagggcgtcaccgcgatcagcggtttcgtgtccaccgcggccgccgagttccggccggcgacggtgaccgtgccggtcagcgacgggcggctgaccgtggacgcgatcggcggcgtcaacaccaagctgaactacgtggagatcagccgggtcaccgcggacccgcccaccgggctgaccgccacccccggcgacgcccaggtggcgctggcctggagcgggaacgcggcgagctaccgggtctaccgcgggagcacgctgctggcgacggtgacccgggcgtcgtatctggacaccgcggtcaccgacggcaccgcctacgagtaccacgtgaccaccgacggcggttcgtcggcgacggtcggcgcgaccccggccgcgttcgccctcaaggtggacttctcggatgcggcgaccgcgccggccgtcggatatgtgcgggactccggtggggcgtacacctcgacgcgcggctacggctgggtggatctgggtgagggcaccccggtcgacctgaccggcaacgggcgcaaccggaacccggccgccggccagagcgatccgcggctggccaccttcgtgcacgcccagcttccggccggcgcgccgggggtggccacgccgggcgcctgggaggcggccgtgccggccggggtctacacggtgaccgtcgcggtcggtgacgcgggcaccgcggtggacagcgtgcactgggcgaatgtggaggaccagaacgcgatcgccgggttccggccgagcgccgcggtcaggttcgccgccgcgacccgcacggtgcgggtcaccgacgggaggctgacgctgagcccggccgggggtacgaacaccaagttcgactacgtcgacatcgccagcgtgccggccgccggggccgttcccgcggtgcgggccggcacgccggcgaacggcgcgaccggcgtctcccccaccaccagcgtggtcgaggacctggtgctgcccaacggcggtgtcgcggccgcctcgctgaccgcctcgacggtgaccctgacccggctcagcgacggcgcggcggtgccggccaccacgatcaccagcggcggcggggacgtgatcaacctgtcgccgaccgcgccgctggcggtgggcacggcgtaccggttcaccgtgaccggcggggtcaccgacgtgaccgggacggcgttcacgccgtactccatcgtcttcaccaccggcaccggcggaaacccgggcggaccggcggccttcgacaaggtcgtgggcgtggccaccggggcgtcgttcacctcggtgctgaccgggccggacgggcggttgtacgccgggacgctggacgggaacgtctaccgcttcccgatcaacgcggacggcacgctcggcacgccgctgatcatcggctcggtgcgggcgaacgccgcggcgctcgggctgcccggcgcgcccgcccgcacgatcatcgggatggcgttcgacccggcgtccacggcggccgcgccgatcctctggacaaccgacaattacgagtacgtgggtccgctcgacgtcccggactggtccggccggatcggccggctcagcggggccgacctgggcacctacaccccggtggtgaccggtctgccgcgctcggtgaaggatcacgagacgaattcactggcgttcggcccggacggcgcgctgtacctgacccagggcgccaacaacgcgatgggcgccgccgactccacctggggcaaccgggcggagcacctgctcagcgcggccgtgctgcggctggacccggcgcggttgccggcgacgctgcccctgaacgtgcagaccgagcagggtgggagctacgacccgtacgccggcaatgcgccgttgaccctgtatgcgaccggcgtgcggaacgccttcgacctggtgtggcatcgcaacgggcacctgtacacgcccaccaacggctcggcggccggcggcaacaccccggccaccccggcgacgctgcccgcctcgtgcgcgcggcgcggctacaccgggccggtggtgccggcgctcaccaacgtgccggccgcggagaccgattacgtcttcgacgtgaagtccggccggtactacggccacccgaacccggtgcgctgcgagtgggtgctggccggcggcaacccgaccgcgggcgcggacccgttcgaggtggccgcctacccggccggcaccgcaccggacccgaacttcgacctggccggcacatacgacgcgggcctgcacgcctcggccgacggcgcgatcgaataccgcggtggcgcgctcgacggcaggctgctggtggtccgctactcggatgggcaggacatcgagacgttcgacgtggccgcgtccggcgcgctgtcgaaccggaccgtgggcatcaccgggctgaccggtttcagtcagccgctggacgtcaccgaggacgtcaccaccggcaacctgtacgtgaccgagctcggcgccgcccggatcaccctgctgaaaccacacgcctga

SEQ ID NO: 753 - DNA, 171 bp, Actinoplanes utahensis
gtggtcggacccgggcgccggcgcggcggacggagcagtgtcggggtgacgagattgatggaggaggaagcgatgacgaccatcggccgcagccacgcagctcacacctggggtctgggccgcgtctggacccggttgccgctggtccgcaagcaccgctggctcatctga

SEQ ID NO: 754 - DNA, 1449 bp, Actinoplanes utahensis
atgggcggaacgaggccagcgttcaggggaacgcacggcattctgctgtgcatgcgcaaatggtcaccactgatcgccgtctgcctcggcaccttcctgctgctggtggacgtcaccatcgtcgtcgtcgcgttgccgtcgatcgccggcaagttcggggccgactacgccgacctgcagtgggtgctcgacggctatgccctcgcgctcgccgccctgctgctcggcgccggctcgctcgccgaccggtacggccgccgccgtacgtacctcatcgggatcgtgattttcgccgtctcctccctgctgtgcgcggtcgcgccgaacgagcaggcgctgatcgccgcccgcgtcctgcagggcgccggcggggccgccatgttcgcctgcaccgccgccctgctcaacgtcacctaccacggccacgaccggggtgtcgccttcggcatctggggtgcggtcaacggcgccgccgcggcggccggcccgctcgccggcggcctgctcacccagcatttcggctggcgctgggtgttcctggtcaacctgccggtctgcctggtcgcggtctggttcacggtgcgcggcgtgaccgagtcgaaggcgccctggggcggccggttcgacctgcccggcacgctcaccttcaccgtggcggcggccgccgtcacgtacggcctgattcgcgccggtgacgccggctggaccgacggcgtggcgctcggcgcgttcggcgccggagccgttgccctggtcgcgttcatcatcgccgagctgcgctccgaccacccgatgctggacctggcgctgttccgccgggcgccgttcgccgcgttgatcctggccgcgttcctgacccaggccgccgcattcggctacctcccgttcgccacggtctggctgcagcaggtgctgcacaacggtccggtcgacgccggcctggtcggcgcgctgccgatggccgccgcctcgctggtggtcggcgcggccgccggtaagttcctgcagaaggtcagcccgcgctggacggtcggcctcggcctgttgctgatcgcggccggtgacctgctgcaggcccggctggacgcgggcagcaccggccggatcctgattcccggcctgatcgtggtcggcctcggcgtcggctgcgtgctgccgtcgctgtcctcggcggtgctggccgaggtgccgcgcgagcgcagcggcatggccggcggggcgctgaacaccttccggcagctcggtttcgccctcggggtggcggtcttcggcaccatcttcgccgaccggatcggcgccgcgcacggccgaccggccggcttcgccgacggtctccaccagacgttgtacgtcgcggccggcaccgccctggtcgccgcggtggtggtgctggccgtggtccggcgccgcgcggacacgcccgccccggagccggtcaaggtcggctga

SEQ ID NO: 755 - DNA, 1038 bp, Actinoplanes utahensis
atgcacagcagaatgccgtgcgttcccctgaacgctggcctcgttccgcccatcctggcggatctcgacagccgatatggtggcgtggtggaaatcgacacgctggaccgacaggtgacacacgcgctgcggatcaacggccgggccggctaccgggagatcggcgcggtgctcggcgtctccgaccagaccgtcgcccggcgctaccgccggctgcgggaggaggcggggctgcgggtcgtcgggttgcccaaccccatcgagctgcggtacgagacctggacgcttcgcctgcgcgccgcccccgacgcggccctggcgatcgccaacgccctggcccgccgccccgacaccacgtgggtgtccctgacctcgggcggcaccgagatcgcctgcagcgtgcacgtgcccgcctcgtccgaccgcaaggccctgctcctgcagcaactcccgcgcacaccccggctcgtcgcggtcagcgcccactgcgtgatccacaacttcgtcggcggggcggtcggccccgacctgcgcgacgacgcgctgaccgccgagcagaaggcggcgctgtccccgccgcggaccacgtcaccggcccacctgacccccggcgacgcgccgctgatcgaagcactcgcctgggacgggcgactcagctacaccgaactggccgcgtcgaccggctggccggaaacgaccgtgcggcgacggacgcaggagctgttcggatccgggtcgctctacaccgacgtggagatcgaaccggaggtgttcggcttccgggcggcggtcaacatctggctgtcggtggcgccgtcccggatggcgtcggtcggggcggcgctcgcggcacacgaggagatcgtgttcgcggcggcgacgaccgggccgacgaacatccagacggcggcgatctgccgcgacatgccggccttctaccgctacgtcaccgagcggttgagcctgctggacggcgtggagcggatcgagtccgcccccgtcctcaaacacgtcaaacaggtcggcgcggtccgctga

SEQ ID NO: 756 - DNA, 405 bp, Actinoplanes utahensis
gtgacccgggggtcccggattgatcgagcgggccgggaaatggcaagctgtcgcgctgtggaagctctccggttgatcctgctcttcgtgcacctcgtcggtttcgccctgctgctgggcgggtcgatcgcgcagttcctgtccggcacgttccggatcagcccggcggtcctctggggatcgatcatccagctggtcaccgggctcggcctggccgctccgctgcgcggcggcggcgatcacgagccggacccggccaagctcgtggtcaagctggtgatcgccgtgatgatcttcatcatggtgttcatcccgcgcaagcgcgaggcggtcaacaagggccactacatcggcatcatcacgctcaccctggcgaacgctgccgtcgccgtcttctggcgctga

SEQ ID NO: 757 - DNA, 1263 bp, Actinoplanes utahensis
gtgccgggtcaccggccggttcggtggggtgccgctgaccgcgcggctgcgctacacgcgcacctgggcgttcggtgcggacgtcggctggcggatcgtggccgcccagctcacggtcgtcggttgaaatgtttcattctcggtgcgatgctgacgtacggggaggggtcgcgcagacctagaatgcgtttcaatcagcgttccagcgagggggctacggggttgggtcagcagccgcgcaacggccgcgcgccgtcggtcaaggacgtggcggcggccgccggcgtctccctcggcacggtctccaacgtgctcaaccggcccgcggtggtcagcggcggcacccgggaacgggtcgagcgggcgatggccgagctgggcttcgtccgcaacgagtcggcccgccagctgcgcgccggcaccagccgcgccctggcgtacgtgatgctcgacggtggcaacccgttcttccaggatgtcgccgagggcatcgagatcgccgccgacgccgccgacctgtccctgttcgtctgcaacagcggcggccgggtggagcgcgaggccaaacacctcgaccgcctggtccagcagcgggtccagggcatcctgatcacaccggtcgacccggacgccgcgcacctggccgacatcgcccggcgcggcatcccgttcgtcatggtggaccggctcagccgcgagggcgggcactgctcggtcgccgtcgacgacatcctgggcgggcggatcgccgtcgagcacctgatcgatcgcggccacgagcgggtcgcgttcgtcggcggaccgtccagcatcggtcaggtccgggagcgctgtcagggtgcccgggaggtctgggcggagttcggcaggcccgccggcgacctgatccacgtgcccaccgaggcgctcaccgtcagcgagggacgctccgccggtgaacgcctcgccgggctgccctcgcgccgccggcccaccgccgcgttctgcgccaacgacctgctcgccctgggcctgctgcagcacgcggtcaccgccggcctgcgcgtccccgacgacctggccatcgtcggtttcgacgacatcgacttcgccgccgcggccgcggtgccgctcacctcggtgcgccagcctcggcaggaactcggccgcaccgcggcccggctggtcctggacgaggccaccgacccggaccacgagcacgagcaggcgacgttcgtcccggccctggtcgcccgcgcctccaccggagccgcccgccgctga

SEQ ID NO: 758 - DNA, 567 bp, Actinoplanes utahensis
atgcgttcccggttcgcccccgccgccctgctctgcgcctgcctcgccgctctcaccgcctgcagcgccgacgactccgacgccgccgctccgaccggcgccaccacccggggctcagcacccgtcgccgggaacgactcagcgcccgccggaaacggctcaacccccgccgccgggaacggctcggcaccggcggccgggaacggcacggcggcggccggcgcccccggcccggggtcgaccgacgacaggaccgtctgccatctggtcgaccaggccggcagcgtgatgaaggccggcatctcgcaggtgcagcggtcggacggtcacgtggaacccgccgacgcgaagaacgtcttcacgaccttccacaccgcgatcgacaacgcgctcgccaaggccgccgactccgacgtcaccaccgccgcccgcgcggtgtcgaaggagatcggcacggcggccgccgcacccgatccgatcagcgccgccgccaacgccgggttcgacgttctcagcaccaagctgaccaccgcctgccagtccgccggcgtcaccatcaacttctga

SEQ ID NO: 759 - DNA, 783 bp, Actinoplanes utahensis
atgcgctgcagacggccgggccgatgctgttcccgctcggcatgctggggttcttcgggctgctggtcgccgcccgccggctgccggtctggacgccgctgctgttcggcgtcggcaccgcggcgatctcggtggacctcgatctgctgccgatcgccgccttcgtggtcttctgctcactgctgccgctgcgccggacgtcggaattcgcagattccgcaacaccgcaggtccggtaccgtccgcggcgtgaacttcggtcccggtaaacgccgacgcttcgaaaatgtcggtgggtggtggcaacatccgggcatggagattcttcccggcgagggcgtcgcactggtcaaggtgggcgagacgagagatgtggtggaggcccgcctcggcccgcccatgcacgccggcatctcggcgcgcgcggtctacgacaccgagccgaccctggtcgtcgactacgacggggacaccgtcgagctggtcgagctgggcttctcggccgacggcggcgagcaggccaccctcgaaggggtgcagctgacctaccggttcatggacgacgtgctcgacgagctgatctctctcgggcaccggccggagccgttcgacatcggctacacattcccgtccggcttcaccatcttctcgatgggctaccgcagtgccaccgacctcgacccgtccgcctctccggacgatccgcggccggtcgtcgaaggcgtcggcatcgccccggccgagtattggctggggccggcggaggagtccgccagtcgctga

SEQ ID NO: 760 - DNA, 1152 bp, Actinoplanes utahensis
gtgaccatcctgaccgagcaggccgccgaggacttcgtcgcggcccgcgccctcgcgcccgggcggcccgggttcgtcggcgtcgccgtcgacctgctgctcgatccggagtccgcgcccagcgcccgccgcccgctgcggcacggcttcctggacgcccgctcgccgcgggtcgcggtggtcagcggcccgccgtcgccgggcatcgagatcgccctgcgccggatgtccgacgacctggcggccgccacccgggtcaccgaccagcagggcctcacggtgctgccgttcgccaccgacaccgtgcacccggacagcccggcgcacgcctacggcacggcgaccgcgggcctgcgggtcggcctggaggcggggctcgacgaggacggcccgctcggcctgcgccgccgctgggtgctggcgcacactctcgccccggtgctggccgcggccttcgccaacgcgccgctgacgcacggccgcccgtccggctggcgcagcgtgcgccaggcactgcgccgcgacctgccggtcctgccgggccacgcggtcgctgcgcttcccgcgccccgggtcccgggccatgtcacggagggcttcggcgcccggttcgccatcgatccgcgtacgtcatgggccgccgcggccctcgacgcacccaccgtgaccggccgcagcctccgggaccggctgcgcgccggcgcccgtctgaccgagagcgatctgctgcgccacctgaccgccgtgcgcccgccggtcgccgcccgcggtcacctggagatcgacgcggtcgaccggcagcccgggcacggctggcgcctgccggccgcgatgatcaccgcgctgctggacgacccgcgcgccgccgaggaggcctacgccgccacggtccacctggccggcgagcccccggttgtgggagcgggccgcccgcgacgcgctcaccgacccggtgctggccgacgccgcgcgggcctgcttcctggccgcctacgccagcttcgcccgcaacggcgccgcccgcgagctgcgcgacgccctggccgacttcaccgacgcgtacgtcaatcggggccgctgccccgccgacgacctgctggaccacatcaccggccgggtctgaaccggccgcgcctgaacggccgcttctga

SEQ ID NO: 761 - DNA, 1038 bp, Actinoplanes utahensis
ttgttgggctaccgtcctggcgtgaacgaggaatttcccgggcagcccgccagcgatcccctggcgtccgccgcccccgccagtgatgcgctggccgcaccgcccacggctccgctgtacgacgcaccgcccacggctccgctgtacaacgcggcaccggcgtacccgacgccggacccgccggcgacgctccccttccccgcaccggcacagccggcctcggcacccccggcataccagccaccggcataccagccaccggccgccgcaggcttcccgcccccgggtttccctccgccgggcttcccaccgccgggcttcccgccgccgcccggctacccgggccagcagcccggctaccccgccgcgggctacccgttcggtccgcccccgtccggcatcgtcaacggcttcgcgatcgcctcgctgatcttcggcgtcatcggcggcgtcttcttcgcgatcggcttcggcatcgccgccctgacgcagatccgcaagcgcaacgaccgcggtcgcggcctggcgatcgccggcctgagcctggccggctgctggatcctcggcatcgtcacggcggtcatcatcggggtggcggccgacgacaccccccgggcgaacgacctgaccaccggcagccgtcccacctcgatcgccaccacgcccaccaccgtgccgaccgaggcgcaggatgtgcggaccgagaagctggccccgggcgactgcatcgagaccctggtcgagcaggagacggtgcgcgacctgccggtgatcgactgttcgaagccgcacgagggtgaggtgtacacggtcttcaccttcccgaagggcgacttcccgggtgacaccctcgtcgagaaggaggccgacaagcgctgcggccggtccctcgacccgtacgccaagggcaagtacgccagggccgactacttctacgtcttcccgtccagggagtcgtgggcattcgaccgcggggtcacctgcatcgcggccgcccccaagcacggcaggtacgtcgggtcgatggtgaacaggtga

SEQ ID NO: 762 - DNA, 165 bp, Actinoplanes utahensis
gtgaccgggcgcttcttcgcggccgccgacggcggcgaccgcaacacactgatggcgctgctcgcgccggagggggacgccgacggccgggtggcggtggttctcaacaccgccaacccggacaaactgtcgtcggttcaggccggcaccgtgcggatccgctga

SEQ ID NO: 763 - DNA, 789 bp, Actinoplanes utahensis
atgatgaatgtgaatgtgttttgccgttgccgaccgggagcggaatcgccggggagagactcggatcgcaactcccggacctctcaagggcgagggggcgccgccgaccttgcaggacgacccgcggagtgcgggccaggcgacgtgaaaggccggcgtgtgatggagttgcccgagatcggttccgagatgttcctggccctgggcgagggcgtgaacttccgctcccggctggagtcggtggacggggaggtcttcagcgtggccgctccgctggagacggccgggccgtcggggttcctgccgggctacgagttcgacgtgttctgggtgccgccgcgcagccgggtggtgatgccggtgctgctcaagagcgtgaccgacggggcgccgttccggtggaacctgttcccgacggcggagccggtgatcagcaaccggcgcgagtacgcccgtggcggggccggtgcgccgatccgcctgttcggtgagtgggggccgcagtacctgcagggccggatgctcgacatcagcgagggcggcctgcggttctgggtgcccgagggcaagatgttcaaggagggcgagcagctgcgcgccctggtctggctcggcaacggcgaggcggagctcaagggccgggtgtacgcggtccgcgaggcgggcgacgagcccggccaccacgtggtgctgatcttcaagaccgtggacccgttggcccagatgatccgccagtacgtgatcgcctgggagatcggcgagcgccgcaaggcccgccagcgcgcctga

SEQ ID NO: 764 - DNA, 879 bp, Actinoplanes utahensis
atgcgcatctccatctggcccggcgccggtcagtcctggtccggcattctcgaggccacccgtcacgcggaagagaccggctgggacggcgtctggatcgccgaccacttcatgccgaacgccggccccggccgggacccgctcgcccccaccctggaagccggcaccctggtcgccggcctggccgccgcggtgccccggctgcggatcggcacgctcgtctacggcaacacgtatcgccacccggcggtcctcgcgaacatggcggtcaccgccgaccacatcagcggcggccggttcaccctcggcgtcggcgccggctggcaggtgaacgagcacgagcagtacgggatcgagctgccgccgaccaggcagctgctggaccggttcgtcgaggcgctgcaggtgctgcacgggctgctgcgtaccccgaagacgacgctgaacggggagtactaccagctgaccgacgcggtatgcgaaccgaaaccggtccagcacccgctgccgatcatgatcggcgccaagggtgagaaacggatgctcggcgtcgtcgccgaatacgccgacatgtggaacacctggggccatccggaggtcatcgcgcacaaatcggcggtcctggaccggttctgcgccgagatcaaccgggacccgcgcaccatcgagcgcaccgcgcaggccctcacggtcgtcgacgggcccctgccggacaatctgccggttccggtgatcggcggcagccgggcggcgctcgccgacgccatcgccgaataccgcgcggccggactcgacgaactcatcatcccggacggcctgctcggcaccggcgccgaaaagctcaaggacatggacgtcatcctgggactggtgcggtag

SEQ ID NO: 765 - DNA, 744 bp, Actinoplanes utahensis
ttggatgggcgcgtgaatcacgatgaggtaatggcgctgttcgatcggcagatgcgccgcgacatgccgggcgccgaacgcggcctccggtacacccgcaacgccggcacggcgcaggactggaatgccgtggtgtggtccgatctcgacgaggagaccgcggacgcggaaatcgccgagcaggtgcgctactttgccggacgtggtgtcgggttcgaatggaagacgtacggccacgaccgcccggccgacctcggcgcccggctggaacgggccggtttcgtgccgggtgagccggaatcgctgatgatcgcgccgatcggcgaactggatctggacgtggccccgcccgacggggtgcggctggtgccggtgaccgacgcggccggcctggccttgctgatccgggccagcgagtcggcgttcggggaaccggccggctcgtggcggcatcaagagccggcaagcctgcgcgcgttcgtcgcgatggccggcgacgagccgatctccggtgcccgcatggaggtgcacgagggcaccgcgttcgcgagcctgtggggcggcggcaccgtcgagaaatggcggggccggggcgtctatcgtgccctggtggcctgccgggcacggatcgcggccgacctcgggtacgagtatctgcaggtcgacgcctccgaccagagccgcccgatcctgctgcggctgggcttcgccgcggtcggtacgaccacgccgtaccaccgctga

SEQ ID NO: 766 - DNA, 522 bp, Actinoplanes utahensis
gtggccagccggccggcgcgctgcggttcgtcgtcgacgtgctgtcggccgcctgaccggcctcccgggggtcgtggaccgtgctgctcaacggtcgtggaccgtgctgctcaacggtcgtggaccgtgctgctcaaccgtcgtggaccgtgctgctcaacggtcgtgaagcgccggtgctggagggtcgtcgggtccggtggcagccgctcggccaccggcacgccggcgatctcgcggcacgtgatgcgcatcgacctcgagaccgacgcccgcaacgcgcgctcccgggccgcgatcgagcgggtcggggcgcggttcgcgggtgtgctgcgcaaccggtcgaagtcgtgggcgccgggcgaggacgggctgctgcgcgactcggccatgttcgcgatcaccgctgctgcggagtggccggactgccgggaccggctggtgaggcagctggaagccggcgggaaaagcggcggacagccgggaacgagtccggttggatgggcgcgtgaatcacgatga

SEQ ID NO: 767 - DNA, 777 bp, Actinoplanes utahensis
atgggcccgagcattccagacggcatcggcggaagtgtgtattgtcgggccgtgcctgatcccgtgaccagccgtggcaatgtgactgccaagcgttccgccgccgcttcgccgcgccgcggcgccccgccgctgaagacgaaggccgagaagcgggccgaggccaaagctgccaaggcgcgggcccgggcgcagcggaaacgccgggagctgctgaccatcggcggggccgcggtcgtcgtgctggccctggtcgtcggcctgatcgtctggatcggtcactcgtcgtcggattccggctccggcagcgcgggcaccgcgagtgcggccgcctccgatgcggcggccccgccgagcgcggcggccgagccggccgcgacgttcccaccgctgcccgtgggcgccgacccggctctcggcaagaagccgaaggtcaccaagggcgccggcaagctgaccgccctgaagaccaccaccctgatcaagggcaccggcgcgccggtccaggccggtcagacgatcagcgtgaactacgtcggggtgacctacgccgacggcaaggagttcgacgagtcctggaagcgccaggagccgttcagcttcccggccggcggcgggcaggtcatcaagggctgggaccagggcctgatcggggtgccggtcggcagccgggtgcagctcgacatcccgccggcgctggcctacggcgagaagccggccggtggccagccggccggcgcgctgcggttcgtcgtcgacgtgctgtcggccgcctga

SEQ ID NO: 768 - DNA, 387 bp, Actinoplanes utahensis
atggccactttcacgctctatttcgacaacccgttctgggtcgccgtcctcgaaatcccggacgccggcctggtccgcgccacccgccacgtcttcggttcggaacccaccgacgccgagctctaccagttcctcctccggttcggcggcaccctcctctcccgcgccgaggccaacccaccggcgcccgccactgaccggccccgacgcaagccccggttggcggtgaccggcctgggcaccgccgcccagcaggcggtgaaaaaggaactggagcagcggaaacaggaatcaagcctgcgcagccgaactcagcgcgaggagcacgacgcccatcgccggcaagtccgccaggccaaagcccgagcccgccgccgcggccactga

SEQ ID NO: 769 - DNA, 864 bp, Actinoplanes utahensis
atgaatgccatggaccgacgtgagctcgccgacttcatccgccgctgccgggagcgcatccggccggaggatgccgggctcacctccggcccccgccgccgcgttccggggctgcgccgggaggagctggccctgctcgccggcatgtccgccgactatctgatgcgcctggagcaggcccgcagtccgcagccgtccatccaggtcctgcgcgcgctcgccttcgccttgcggctcgacgacgacgagcgcgaccacctctatctgctcgccggccaacgcccacccgccggtcggctcgccggcaatcacgtccggcccgggctgctcaccctgctcggccagctgaccatgtccccggcccagatcgtcaccgacctcggcgacctgctcgcacagaacgcgctggccgagaccctgttcggcagcatctgcccggccggcccgcacgaccacgagcaggaccacaacctggtgtggcgctggttcaacgacgggcgcctgcgcgcctccatcccggaggaggaccacgactactgcagccgcatgcacgtcgccgacctgcgcgccgccgtcgcccggcgcggcgccgacccggccgccgccgccctggtccagcgcctgcgggacagcagcgccgagttcgccgaggtgtgggaccgccacgaggtcgccgtccgccgcaacagtcgcctgcggctgcaacatcccacggtcgggctgctggagctcgacttcgaaatgctcctgacccccacggaggaccaacgtctgatcctgctcaccgccccaccgggcactcccaccgccaactatctggaccttctacgagtcatcggtcaggagtccttccaggaaacctga

SEQ ID NO: 770 - DNA, 912 bp, Actinoplanes utahensis
atgcgagcgatcgttttccaggagttcggcggtcccgaggtgctgcgggtcacggaggccgatgttcccgagccgggcccgggccaggtgcggatccgggtccgcgcggccggggtgaatcagctcgaccacaagatccgcgagggggcgatggcgcaggtcttccccacgacgttcccggccacgccggggctggaggcggccggtgtcatcgacgcgaccggcgagggtgtcaccgggccggctcccggtgatgaggtgatcgcattcaccgataccggggcctacgcggagttcgccctggccaccgtcgtcgcgccgaaaccggccgggttgagctgggcggaggctgcggcactgccggtggccggggagaccgcgcagcgggtgctcggcctgctcggggtgaaagcaggcgagacgctgctgatccacggcgcgagcggcgcggtcggcggggtcgcggtgcagctcgcggtcgcgtccggggcgacggtcatcggtgtcgcctcaccggccaaccacgactacgtgcggtcgctgggcgccatcccggtggcctacggcgagggcctgatcgcgcgggtccgtgaggtggccccgcagggagtcgacgcggtcttcgacgcggccggctacggagcgctgcccgactccatcgacctggcgggtggttccaccgagcgcgtggtgaccatcgccgatccggccgcccgcaccctgggcgtcgtcttctcggccggcgcgcagaacacggtcgagggcctgaccgacctcgcccgtctggccggcacaggagcccttcgcctgaccgtggccgggacgtatccgctgtcggatgccgggcgcgcccaggtccagagcgccaccggccacacccgcggcaagctggtcatcgccgtccccgactga

SEQ ID NO: 771 - DNA, 396 bp, Actinoplanes utahensis
atggcggtggatgggctgtcgcgggtgttcgcggcgctggcggatccgacacggcgggacatggtggttcggctcgcgggtggcgatgcgacggtcaatcagctcgccgagccgtaccggatgtcgctgcaagcggtctacaaacacctcaaggtgctggaggacgcagggctggtgagccggccgccggggccgcaaccgcggtcggtgcggctggagccggatgtgttcggcgaggtcggcgtgtggatcgagctgtatcggcggcgagccgaggaacgctaccgccggctcgactcggtgctgggcgccatggacgacaacgggcggccggatcgtcacgggcacggatcagacaggtcagagcgcgacgagcaggagggtggagcacaatga

SEQ ID NO: 772 - DNA, 474 bp, Actinoplanes utahensis
atgagcgaggcgaagatcgaggcggacgagaagctgccgatcatccggatcacgcgggacttcgcgggtacgccggagcagctgttccgggcgcacaccgacccggagttgttcgcgcagtggtgcgggccggattcgaccaccgcccggatcgagcagtgggatgcccgcgacggcgggtcctggcggtacgtggcggtccgcggggatgaggagtacgggttccgcggctgcttccacgaggtggggccgcgccggatcgtgcagacgttcaccttcgagggtgcgccggacggggtgtcgctggagacgctgaccttcgaggatctgggggacggccgcacccggctgcacgggcagtcgctggtggacagcttcgaggcccgggacgcctggctgcgcagcggcatggagacgggtgtcgccgagggctacgccaagctggacgccctgatcgccaagggcgccatctga

SEQ ID NO: 773 - DNA, 1119 bp, Actinoplanes utahensis
atgattgatgagagtgaggctttcctgcacctcggcgagtctggcgacgacctccgcgcggtgcgcctccaggacggcaaggcgttcctgctcgttgccgtgtccggaggagaccagctcagcgtaacgacggatcgtcttgataggcatgccggtggcccgcagctttgtacaggccgtgatccagtcgaggtcgaactggcggtagcgccgccgaccggcggcggtgcggtcaatggcagcgaccatcaggccggcacgttcgtagtagcgcagggtgtgcacgctgatcccggtgcgacgggcggcctcggcgatggtcacacccacggtcgggatggaggacgtggattctggtgtcggccccggcttgacttcgagcacgctcgaaatcctagcgttctggtcatgaccgcaacgctgatctccggagcgaataagggtctcggcttcgagaccgcccgccagctcatcgccgcaggacacaccgtctatgtaggaagtcgcgacatcgaacgcggacgccgggccgcccagcagttgggcgcccgggcagtccagctcgacgtcaccgacgacgcgtccgtggccgccgccgtcaagaccgtcgaagccgaggaagggctggacgtgctcatcaacaacgccggcattcaggcggagctgagtgagaacaacgtcgtgatcggcgcggccgagctgacggccgaggtgatgcgccagacgttcgagacgaacgtcttcggcctggtgcgcgtcctccacgcgttcctgccgttgctgcagcgctccaccaacccggtcgtcgtcaacgtcagtagcggtctggcctcgctcacccgggtcaccacccgcggtcacgcggcattcgcctacccgggagtcgcctatccggcgtcgaagaccgcagtcaacatgatcaccgcgcaatacgccaaggcattcccgaacatgcggatcaacgcggtcgaaccaggattcaccaaaactgacttgaacaagaacaccggccgccagaccgtcgggcagggcgccgaaatcatcgtacgaatggcccggacaggcccgaacgggcccaccggaggctacttcgacgccgaaggccaactgccctggtga

SEQ ID NO: 774 - DNA, 672 bp, Actinoplanes utahensis
atgattgggccacgcacgatgtcgacggcctcgatgaagggatatgcggtgattctcaagctcaagctttgtgtgctcgtggcgagttgcgcggtggtggcggcacccgcgggtcctgcctcagcggctcctgacgcgaccaccacagccgccgacccagcggtcgctttcgtggaactccggcgggcgatggccttgaccggcacgaaggtcgccgactcctcgccgttcaacctgcacgtggccgggcgcgggagtgggtactgcctggacaacttcgcctccggagagggccggaacaactcgccggtaggtttgtggacctgcaatggcggtcgcacggagctctggcggtggcgcatcttcaatcaaaacatctattacggcgtcgagctggtcaataacgcgagtggacgctgcctggactatccggcctcgatgggaaacacggtcggtgcgcaattcaatgtatacgattgccgggacggttccgcgccgggccagaacttccacctcaccaacgcgtccggcggtgtcgcgatggagtcgcaggcgaccaacaacgcggtcgccgtagacgcgtttacctccaagtggcacggcgacggcagcccggtcggtctctggtattacagctctcccggaaacgccttccagcactggtaccagtag

SEQ ID NO: 775 - DNA, 636 bp, Actinoplanes utahensis
gtgtccgcccgccgtgaccacgacgtcacgctgatcggcccggtgcaagcctccacggtgcgtaaggccgacagcgggttcggcccgtccgccttcaccatcgactgggatacccgcaccgcaacctgtcccggcggccagaccacgacgaactggcgagaggcgaccagccatcgcggaacccccgtcagccggatccggttcctgaaaacccagtgccagccttgcccggtccgcagtcaatgcaccacgtcaggttcccgcaacctcaccctgcgcccccgggaggagcacgaagcgctccagttggcccgagctgaccagtccacggccgagtggaaacgccgctaccaaccccgggccggcatcgaggccaccatctcccaaggtgtccgcagcttcaacctccgccggtcgcgctaccgcggcctggccaagacgtccctgcagcaccagttcacaggcgccgcgatcaacgtcaaccgcatcggcgcgtggctcgacggccgccctcacggactaacccgcatgtcccacttcgccgccctgcgcccggggcctgacgatctgagacggcctacccggacggtgccagctggccgccctcggggaggcggagcaggctgctctgagtaa

SEQ ID NO: 776 - DNA, 666 bp, Actinoplanes utahensis
gtgcgcgaggtcaaccggctggaacgctgtatcgagacgatgcgcgccgcgctgaacgccctctcggtgctggcgccgacctgggtggcggcgctggcggacgcggagtggttcgaccgctacagcgaccgcccggagcagtaccgcctgcccgcaccgggaacccgcaagcggatcgcgcttgccgaacaggtcggcgcggacggctcccggctgatgacggcggtgttcgccggcgacgcacccgcgcacctgcgccaggtggaggccgtagaggtcctgcggcagacctgggtccaggagtacgccatcacctctaccgacgacggacaggagcggatcgtgtggcggcacccgaaggactgcccgccgggtgcggtgcgcctggccagcccctacgacaccgatgcgcgtaacgccgtcaagcgggatacctcctggtcgggctacaaggtccacctcaccgaaacctgtgaccccgacgaggtccacctgattacccacgtggccaccaccgtcgccaccaccccggacaccggcatgatcgctgaggtccaccgcgaccttgcccaacgggacctgttgccctcggtgcatctggccgacgccggctacgtcaacgcgcgcatctggtgtccgcccgccgtgaccacgacgtcacgctga

SEQ ID NO: 777 - DNA, 1263 bp, Actinoplanes utahensis
atgagccgtcctacccggagactcgtgatcgcggtccgcgccgacccggttatctgcggacactccggtgaggctcgcaacctcgccgaagtcgccctgcaccggggcttcgacgacgtccgcctgctcacctggccgatccccgcgctgcaggcggccggcctgccgctcaagccactggaccggctgctgccgtacagcgacgggatcaccgtcgaacgcccggaggcggtcggcgactaccgggtgcccgacggccggcacctggccggactcaccggtcggctcgtcgaactgctcagcgacggcgtgcccacggtctgcctgtcgatgtacctggttccgcacactcaggtgatcaacgacgcggtcaccgcggcccgggccgccggcttcaacccgcaggtccacaccatcgccaaagcggtcggctcggacgtcacgaacgtgatccgctcgtgcctgcgcgaaggccggttcggtgcggccaccgtgctgatgaccaccttcctggccagcgacgaggtggtcgccgtctccgaatacaccaaggacgagatcatcgcctcggccgaggaggtcgacgcgcactgcggcaccagcttcgcgagccagtgccgtgaccgggtgacagtcagctacccgccgatcgactcgtcggccttcctcagcctcggcgacgacgcgatcgacgaggcgttggagaagcgcggcctcaaacgcggcaagtacatcctgttcctgtcccgggtggcccgcgccaaaggcatctacgacctggtcatcgcctatggccagatgcagtgccgggaagaggtgccgctggtcgtcgccggcaacggcccggccctcgaacacgtccgggcgatggccaaggaagacgagcggatcatcttcctcaacgacgtcgacgacgacgagaagccactcctgatggccgggtgcgccgcctacgctctgcccaccaagccggagccggacttcgtcgagaccttcggcatcgccctcgccgagaagatgctggccggcggcggcccgatcgtcaccaccctgaccggcggcaccggcgaagcggtcggcgacaccgccatcatcgtggaggccggcgacatcaccgcgctcgccgaagccctcgaccgggtcgtcctcgacatgccggaaacggagaaacgggcgatggagagccgggcccgcgactacgccatgtccttcgaccgcaccgcggtcttcgactcactcttccctgccggccctcccgcctga

SEQ ID NO: 778 - DNA, 2133 bp, Actinoplanes utahensis
gtgggcaacacccaccccggcgcgacctcgcccctgggcatggtcagcgcgtgcgcctattcaggcgcctaccccaccggttacggccggtacgcgaagaacaccgagggcgtgcccgaggagatgttcgagcgcaccgaggcctccggcttcacccacttccagcagtccggcaccggcgcgatccgcaagtactacaactacgtgcgggtcaccccgatggtccagccgctggacgaccttggccagtcctgggcgctgcacgacgaacgcgccgagcccgggtactacgccgcgaacctcgacaccggggtgcgctgcgagatcaccgtgggggagaaggtcgccgtccaccggtacacgttccccgaccaccacagtgcccgggtcgtgatcgacctgtcctgcggcggcctcgccatcgacctgggccgcacggtcccgctgcgcgcccaggtggagagcatggggcacggctgcgcgcagggcaccgtggtgatggagggcgtgccgctctccgtccacctggaggccgacgcccccggctggcggcagatgctgtggtacgaccggcggctgatcccgggcggcacccggctcgacttcgacagcatccggcacaccacgctgcgcccgttcggcatgctgttcatggggtcggcccgggccgggcagaccatcgaggtccggatgggtttctcgctgcgcggctgcgaccaggcccgggagaatctgcgccgggagtgtggcaccggcgagccggccttcgagaaggtgcgccttagcacgaagcagcgctggcgcgaccacgtcggccgggtccgggtcgacggcgggaccgaggcgcgccgcacggtgatgggcaccgcgctgtaccactccctgatcaagccgtgcttcgccgacgacgagagcccgttctggcccagctccggcccgtgggcgttcgacatctgcaccatgtgggacatctacaagacgcagatcccgctgctgcaggcgatcgccccggaccgcgccatggacctgctcgaatccctgatccgggtgtgcgaggaggagggcaacttcccgatcggctaccggatggcgcgcggcgccgaccggttcttccggcaggcgtccgcgctggcgcacaccgcgatcgccgacgcgcacgccctcggccggggcggcgtcgactggggctgggcactcgtccacatggtcgacgacctgcgccggatgtacggcgaagacttcttcgagcacggcgtggtgcacccgatcacgcacaccctcgacctggcgtacgcccaccactgcaccgccaaactcgcccgcgccctcaacgaccgcagactcgccgacgacctggaacgccgcagccaccagtgggtgaacgcgttcgacccggtcagcgggctgctccgggactccgagttctacgagggcggcaagtggaactactcgttccggctgctgcacgacatggccgcccggatcgaactgtccggcggcgaccgcgggttcatcgacaaactggaccgattcttcggctacggcgccgaaccggtcaaacagccgggggtgagcccgcagccggccgagatggccctcggctacgcgctcaaccggttcgaaggcctgaacaacgagccggacatggaagccccctgggcctaccactacgcgggccggcccgaccgtaccgccgaggtcgtgcactctgcgctgacctggcagttcggtaccggtcccggcgggctgcccggcaacgacgactccggcggcctgagcgcctggtacgtctgggcgtcgctcggcctgttcccggtcgccgggcagaacctcttcctggtgaacgcccccgccttcgaacgggccgcgatgcgggtcggcgacgaggagttcatcatcgaaacgagcggacacgtcgacacgccgatcggcgtcgacggtctcgaccgggacccacccgcccagtacgtccaatcggccaccctcaacggcaagcccctgcacgcggcgcacctctcggcgaccgacgtgcaccgcggcggccggctgcacctcaagctcggccccgaaccctcgacgtggggacacgggaaccgcccgccgtcccactccttcaccccctttaaggaatga

SEQ ID NO: 779 - DNA, 1227 bp, Actinoplanes utahensis
atgtcggctctcgacatcgtcggcgacgacctgaagaccgagctccccagcggcgagacgatccgtttcgcgcacctcgactacgccgcctcggccccctgcgtcgaggccgccgctcaggcggtcggcgagctgctgccgcgctacggcagcgtgcaccgggggaccggggtccgctcgcagacctcgacggtcgcctacgaggtggcccgggacgtggtggccgagttcgtcggcgcccgccccggcgaccacgtgatcttcacccggaacaccaccgactcgctgaacctgctggcccgggcgctgcccgcgggcaccaccacgatcctgttcgacggcgagcaccacgccaacctgctgccctggccgaacccgttgcggctgcccaccccggcgtcgccgcacttcgcggtgcaggcgctgcagaacgcgctgcgcgacctgcgcaccccggccgtgctggcgatcaccggggccagcaacgtgaccggggagatctggccggtgcgcgagctggccgacgtggcgcacacctacggggtccgggtggtcgtcgacgccgcccagctcgccccgcaccggccggtcgacctggacgagctgggcgccgactacctggcgttctccgggcacaagctgtacgccccgttcggctccggcgtgctggtcggccggggggactggctggacgccgccgacccgtacctctacggcggcggggccagcgccacggtgggtgagcggcccggcgagcagacctgggcggccggtccggcgcggcacgagggcggcacgccgaacctgctgggcgcgaccgcgctggccgcggtctgcgccgcgctgctggtcgccgaccgcgacgagctgcaccggcacgagcaggcgctgctggcccggctgcgggccggcctggtcgccgtcccggaagtccgggaggtgagcatcttcggtcccgagcacccccgggtcggcatcgtctcgctggtgctgcccggccacgatccggcccgggtcgcccaccttctcggccgcgagcacggcatcggggtccgcgccggccagttctgcgcgcaccccctggtccgccgcctcaccaacacggagaaatccgatatctgcggtacgaacggtgccgggctgctgcgggcgagtttcgggctgggcagcaccgtgtcggacatcgatcgattcgtcacggctctggcggacacagttcgctcctga

SEQ ID NO: 780 - DNA, 774 bp, Actinoplanes utahensis
atgagcagcttcgagcagcagtggacccggtggcacgacgagcacgaaacccggcgggcggacaagcacggcttcctggcgatcaccgggttgcactggctgaccgagaccccgcagcggttcccggacgcacccggcgagtggagcaccggcccggagggcgtgctggtcaccctggcgcccggggaggagcttgacgggatcccggccggcgagcaccggttcccgcccctcgccgagcgcgccgaccacaccgtgggctggggcgaggcgaaactggagatcgcccgccggggtggtcacgacgtgctgcgcccgcggcaccccgcgcacgagaccctggtcgggtatcggggcacgccggcctacccgccggccgaggagtgggtggtgaccgggacgttcgtgccgttcgacgagccccggccggtgaccgtggggtcggtcgccgagggcctcgagcacgtgtacgagtcgcccggacgcatcgagttcaccgccgacgggcgggatctggcgttgaccgcgttcaacggtcacacgcccggctcgctgttcgtgctgttcaccgacgcgacgtcgggcgtcaccacgtacccggcgaaccgcagtgtggcgatcgcgccaccggccgccgacggcaccgtgaccctcgacttcaaccgggcgacgaacctgccgtgcgcgtacaccgagttcgccacctgcccgctgcccccggccgagaacaggctgccgatcgccgtggcggcgggcgagcagctgccgcgctag

SEQ ID NO: 781 - DNA, 1086 bp, Actinoplanes utahensis
atggaggagctgctcgcgccggccgaggcgctgatcgggatccggtcgaccgccgaccggcccgccgagctgcaccgggccctgggcctggtgctcgacctggtcggcccgggcttcaccacccggcgcttcgagtcccggggcaggcccagcgcgctgctcacccaccccgaccggccgggccggcctcgggtgatcctgaacggtcatctcgatgtggtgcccggaacgccgtcgcagttccgggcccgccgcgagggcgaccggctgtacgggcgcggtgcgcacgacatgaaggtcgcggcgctggtcctcgccacggtgttccgggaaatggccggggagctgccctacccgatcgcgttgcagctggtcaccgatgaggagacgggcggacaggacgggaccgggcaccagctggcgcagggggtgcgcggcgacttcgtgatcatcggggagcagagcgggctgcgggtggtcaccgagtcgaaaggcctggtgcgggcccggctgatcgcttccggcctgggggcgcatgcggcgtatccgtggctgggttccaacgccctgctgacgctgctgaccgcggtgcagcgactgatcgcgcgctatccggtgccggccgaggaggcgtggacgacgaccgccaatctggcgcggatcgagaccgggaaccaggcggtcaatcaggttccggcggatgcgacagcctggttcgacatccgctacccgccggaagacgcggcattgaccgggcgttccattccggagatcgccggtcacctgcggtcgatcgtgggcgccgaggtggaggttcaggtcgacgcggtggggacgccgcatcgggcggatccgtccggggccggggtgcgtgccctgcaggaggcggccaaggcggtcggatactccggggaactgctgcgcaagcacggggcggcggacagccggttctattttccgctcggcatcgatgccgtcattttcgggccgaccggcgacgggcagcacggcccgtcggaatacctggagatcagctcgctgcagccctaccacgacgcattgacgcgattccttcaatcccgctga

SEQ ID NO: 782 - DNA, 594 bp, Actinoplanes utahensis
atgacggcccccacgctgctccgtccggtgaccacaccgggtccgctgaccgcggccgcccggctgctcgccgagtccctgctcggtggcatgggtgaccgctggctgcacacccggggggtcgccgggcgggccgccgagctggccgggccgctcggcgtcgacgccgacctggtcaccgcggcggcctggctgcacgacatcggctatgccgagccgaccgtcgtcaccgggttccacccgctggacggcgccgaccacctgacccgcaacgggtggccggtccgggtggccgggctggtcgcctaccactccggggcccgtttcgtggccgcggcgcgggggctgagcggatcgctggccgcctacccggacgagcggaccgtgctggcggacgcgctcacctacgccgaccagaccgtggggccgagcgggctgcgggtggacccggcggcccggtacgccgaggtgctgctgcggcacgggccgtgctcactgaacgcgctggtggacccggaacgcgggccgtacctgcggggcatcgccggccgcatcgagcatctgctcgccgcacgagctcttcagcgggattga

SEQ ID NO: 783 - DNA, 1251 bp, Actinoplanes utahensis
atgcgaatggatcatgtgaccggacggcagcgggggaccgcgctggtggcgctggcgctcggcggcgtggcgatcggtttgaccgagttcgtggcgatggggctgctgccggagatgacccgcgatctgctgccggccgcgtgggcgcgctcgcacgaggacgcggtggcgcaggccgggtgggtgatcaccacgtacgccctcggggtggtggccggcgccccgctgatcgccgccctgtccgcccggatgccgcgcaagcggctggtgctgggtctgctcgcactgttcacggtgggtacggtggcgtccgcgctggcgccgacgttcgggctggtgctcgtcgcccggttcgtcgcggcgctgccgcacggagcgtatttcggggcggccgggctggtcgcggcgaacctgatgggcccgggcaacgaggcgcgcgggttcgccgtggtgctcggcggcctgacgctgtccaatgtcgccggtgttccggtgatcaccctgatcgggcagtcgtccggctggcgggtggcctacctggtgatcgccggggtgttcctgctggcgctgttcgcggtgctggccacggtgccgcagacgccgacgcccgcgggcgcgtcgatcggcgccgagttgcgggcgttgcgccggccgcaggtgtggctggtggcggtcaccgcggcggtcgggttcggcgggttcttcgcggtggacagctacatcgccccggtgaccaccgaggtgaccgggttgtccacccgcgcggtgccgtgggcgctggtcgcggtcgggctggggatgaccgtgggtaacgcggtgggcggctggttcgccgaccgcaacctgcgccgggcgacgctgaccgcgttcagcacggtgatcgtggcggcggtgatcttcgcgttgaccgcgcacagcacggtcgggttgttcctcgggtcgttcctggtgggcgcggcgagcctggcgctgggcccggccatgcaggcccggctgatcgcggtggcgccgggggcccagctgatgggcgcggcggtgaaccagtcggcgatgaacaccgccaacggcctgggggcggcgctgggcgggctggtgatcgcgcgcggttacggctatctggcaccggcgtggaccggcgcggtgctggccgcgatcgggctggggctggcggcggtgagcttcgccgctgaccgcacgttccgccggagtttgaccgctgttcaccatcggcggcctacgctctggcgatga

SEQ ID NO: 784 - DNA, 813 bp, Actinoplanes utahensis
atgacagcggacctcttcgatgcctcggccatgtacgacgacgactacctgcacttcttcgccaggcacccggcggaggaggcgggtcgggcggcggcgggggtgacgcacgggcccgccgtgccggccgcgggcggcgggccggccaccgccgacgtggtgtggcggctgctcggcctggcacccggcatgaccgtcctggacctggcctgcggccacggctctctggccgccgccctcgcggcccgcggctgccgggtcaccggcctcgacttctccgaggtcttcctggcccgggcccggtccgacgccgccgcccgcgccctcgacatcgactatgtccccggtgacatgcgcgagctgccgcgggagtggaccggccgcttcgaccgggtggtgaactggtcgaccgcgttcggctatttcgacgacgccgtcaaccggcacgtgctcgacgagatcgtccgggtgctgcgccccggtggccggctggcgttggacctcgacaatcaggtgcggttcctgacctcgtggacgccgtcccggatcaccgtcgccctcggtaacggcgatctgctcgccgaccggcaccgcttcgacccgctcaccggacgcttcgaggtcgagcgcaccgtggtccgcgacggccgggcgcgcaccctgaccttcgtcaagcgcctgttcggtttcccggagatccgggactggtgtgccgcggccgggtgcaccacggtggccgggcacggcgaggacggcgagccactctcggcggaacaccggcggatggtcgtcgtcgcggcggttcgcggctga

SEQ ID NO: 785 - DNA, 1599 bp, Actinoplanes utahensis
ttgaccggtccgtcgcgccgccgaactgaaccggcacatccacccgccgtcacgaaggacctggccgccatgcgctccgtcacccccgtcgtcgcccgttccctgccgctgctgctggcggccggggcgacggtctcgtcagcgacgaccccggcgtccgccgccaccgcggcggtcaagccggcggcggcgatcctggcctccacgaccgtgccgggcgcgcgggacagcctcaccccggcccagcggctcgccgcggtccagtccgccaagcagatcaactactacccggcgggtggcagctggacccggatgtggaccgacttcgacgccaagaagatcgacgccgacctggccaaggcccgggcactcggtgcggacagcgtgcgcgccatcgtgttcccgtcggccttcggctaccccaccccgaaaccggagtacgccgcgaagctggcccagttcgtgtcgctcgccgcggcccggggcatgaccgtcaaggtcaccctgttcgactggtgggacggctactccgacgtggccggcagcaccacctgggcgaacgcgctgctcgccccgttccgtaacgacgaccggatcatttcgatcgaactgcagaacgagctcgacccgaccgacccggccgcgatcggctgggcgaagaagctcctgccggtgattcgcaaggccgtgccgggggttccggtgaccatcccgatcagctcgtcggccggcgtcgccggcctgtccacgctgaagtcggcgatggcggcgacgccgctggactactacgacttccacctgtacggcaattcggaacgcgccctggcctcgatccggcaggcccaggccgccgtggcgccggccccgctggtgatcggcgagaccggtacgaacacgctgcagtccagcgagggtgagcaggccgcatatctcgcccgggtgttcgccgccgccgaggtggccggggtgaacgcggtcgcgccgtggacgctgaacgacttcgccgccggcagcatcccggactccggcgtcgcgcggatccccgagcagtactggtacggcctgtaccgcgccgacagcaccgccaagccggccgccgcggtggccaaggccgagtggaacggcgcgccgtccccgaccggcctgatggacctcggcttcgagaacgccgccggtcagacgccgtggcggtcctacctgtccgacctcggcacgcccacccggacgcagacggccgcgcggtccggcaagtggtcggtgatgctgaccaacaccggcaagacggcggccgggtcaccgtcgtaccgggtgtcgccgatcgagccggtgcagcccgggcggcggtggcacgccgaggtctgggtccgcggcaagaacgagaccggctcgacgcagatcgcgctgagctggttcgacgtgaacgaccgctggatcggcggcgcctcctccgccgacctgccgtccgggaccaccgactggacccggctgtcggtcgacggtgtggctcccgcgggcgcggccagcctgcaggtgcacctgaagtcgggggccgacaccggcacggtctggttcgacgacgtggcgatcagcgcctcctga

SEQ ID NO: 786 - DNA, 1578 bp, Actinoplanes utahensis
atgattcgtagacggcgtcagggtagcgatcggctcggcggctcccgcgaagcgacgggccagcggtggacggccgggcgggtgtcggccgccggctacgggtcggtcatcgggctgctggccctcggcggtgccgccgcccacctgggcatcgacggcgcgcaggcgcagcgggcgccgatcgaccgggcctatcaggcgctggacaccctgtcgagcctgcggagccagctgcaggacgcgcagcgcggcgaacgcggcttcgtgctgaccgccgacgagcactacctcgcgccctacacctcggcggcgacccaggtgccgcaaagcctggcgcggctgcgtcagctgctcggcgccgacaccgcgcaccgacagacgctcgacgatctgcaggcctcggccaccgccacggtcgactacctcggtctggcggtcacccagctgcgcgacgagggtttccgggacgcccggccggacgtgctcggcaccgccggcaccgagacgctggatcgtgccggccggttcatcgacaccctgcgccaggatcagctgaccgtgctgcacgcccggcagcagcagcaacaggagcaggaatcccgggcgctctggctggtcaccgcggcgctgggggccgcctcggcgatcgcgctgaccgcctggcgggccacccgatcgccggccccgtcgccgccggccgagcccgctgcggcggtcgagacgttctcggcatccgactcggcttcggagcccgccgaggagacctggcacacgccgctgcgggtgctgctggccgaggacgacccggtcaaccagaaggtcgcccagttcatgctcggcaaactcggccaccgcgtcgacaccgtcggcaacggtctggaagccgtccaggcgctgcgtgccgccgactacgacgtggtactcatggacgtgcagatgccgatcctcgacggcctcgaggccacccgcctgatccgctcggagttcccggccgaccggcagccgcacatcatcgccatgaccgccagcgtgctggccgaggaccgggccgcgtgccgcgcctccggcatgaacgactacctgcccaagccggtcaaccttcccgacctgaccagcgcgctgaccccgctgctggacctcggccatgacctgcccggcgacgacggcgaatccggcgatgcccggaccgcgcccgacgccgaccgggagtcggaggtccgcgcccgcctggacgacatcagcgacggcgcacccagcgacccggaacggaccctgctggcccgcctgctgcgctcgttcaccaccggcaccccggccggcatcgaccggctcgccgcgctgtttaccgccggcgacgtccccggggtccgcgcccaggcgcacaccctcaacggctccgcctccaacatcggcgccgtccacctggccggcatgttcgccgcggtggaggccgacgcccgcgccggccgcctcccccggaatgcggccaccatggccgccatccgcgccgagtacgccgccgtcgtcccggtctgcgaacgcctcgccgacgagctgtccgctgccacggcccactga

SEQ ID NO: 787 - DNA, 1632 bp, Actinoplanes utahensis
atgggcgtgctgctggatgatcgggagcagcggcgactcgccgcgctccacgagtatcgtctgctcgactcgccggcggggaacgagctggaggcggtcgtccgggtcgcggccacggtcgcccgggtgccgaccgccacgctgaacctgatcgacgagaaccggcagtgccagctgaccacggtcgggttcgacggcggcgactcgccgcgctccgagtcgatgtgcgcgatccgttttcagaccggcgaattcacctatctcccggacgccagcctggatccgacgtaccgggccaatccctgggtgaccggcgtccacgcgaaggtccggttctacgcgtcggcgcccctggtcaccccggacggctacgcgctcgggtcgttgtgcgtcttcgactccgagccggccgagctggacgacgagcagatcgcccggctcaaggacctcgccgacgtgatcgtggcactcttcgagcgccgccggcaggcccggctcaacgccgagttggccgcgatcgccgaggcccggcagcggtggaccgacacgctgctggagacgatcgacgtcgccgtggtcgcctgcgaccgggacggccggctcaccctgttcaaccgtgccgcccgcgactggcacggcctggacgccgacccgggggtcgacccgaacgacttcgccgaccggtacttcctgttcgacatcgacggggagacgccgctgccggccgaccgggtcccgctgctgcgcgctctgcacgagggttcggtcagcaacgccgaaatgctcatccggcgccgcggcggcgacccggtccacgtcaccgtcaacggccgcgccctggtcggcccggacggcatcccgctcggcgcggtcgtcgcgatgaacgacgtcaccaccgaccgtgcccagcagcgcgccatcgaacacgcccgccgcgaactcgccgccgccaacgaggagctgcgccgctccaacgccgacctgaccaacttcgccggcgcggtcagccacgacctggtcgctccgctcgccgccgtcggcggctacctggagctgctcgaagacgtcgtcaccggccagccccgcgactgggtcgacgccgcctcccgcgccgtcacccggatgcgcgacctgatcggctccctcctcgattacgcccgtgccggcagcgcccccatccgccgcaccccgtccgacctcggcgacatcctcaccagtgtgatcgccgacctgaacgccgaaatactcgcctccggcgcccggatcctctcgccggcccacctgcccgtcgtgtcctgcgacccggtcctggcccgccagctcctgcagaacctgatcgccaacgcgatcaaataccgccaccccgaccgccggccgtgcatcgtcatcaccgccgcccgcgcggaagaggcctgggcggtaacggtcgccgacaacggcagcggcatccccccggaccagcgccgccgagtcttcgacatgttcacccgcctggacggcacctcggcgtccggtcacggcatcggcctctccagctgcctgcgcatcgtcgaccggcacggcggcacgatccatgtcaccgacaacgagggcggcgggacgaagatcatcttcacgcttccggaccgctga

SEQ ID NO: 788 - DNA, 1230 bp, Actinoplanes utahensis
ttgtcgatcacaggggacgctcagcagcgggtcggaccggacgaacaggtaagggtggagcaggagcgtctcgcggcgctgcacgagtaccggctgcgggacaccccgccgggggaggagctgcaggccgtgctgcgggtcgccgcgacgatcgccggggtgccctgggccagcctgaacctgatcgacgagcggtcgcagttccagctcgtcaccctgagccgggcgccggtccagtgcgcccgggacgactcgatgtgcgcggtcaccgtcgagtccggccgcttcacgcacgtgccggacgcccggctcgacccggtgtaccggaacaacccgtgggtgaccggggtactcggggacatccggttctacgccgccgcgccgctgatcacgccggccgggcacgcgctcggcacgctctgtgtgaccgacagcgtgccgcatcacctgcgccccgaggagcgggcgcagatcaccgacctggccgcgatcgtggtcgcgttcttcgaacggcgccggcaggcgcgggagaccgccgagctcgccgcgacggtgcaggcccggcagcggtggaccgacacgctgctggagacgatcgacacggcggtgatcgcctgcgacgcgagtgagaaggtgaccctctggaacagggccgcccgcgaatggcacggtcgcagcggcgagggcgacccgcggggcaccgacgtggcccggcggttcggcctgttcgagccggacggcgtcaccacgatcccggacgacgaactgccgctgcagatcgccctgcgtcgggggatcacggtgaccggccgggagatgatgatccgccggccggtgggcgagccggtgcacgtacgggtcaacgccggtccgctgcgcggcccggccggggagatccagggcgcggtgctggcccaggccgacgtgaccgccgaccgacgtcgccgccggttgatcgaggaggcccgggaacggctggccgccgcgaacgccgagctggaacgttccaacgcggatctgaccaacttcgccgccgcggtcggccacgacctgatcgcgccgctcgccgcggtcggcggcttcctggaactgctggcgatggagggttgtccggaggcggccgccggttcggccgaggtgacccggatgcgcgacgtgatcgacggtctgctcgccggagcgctggccgaccgggcgcgcccttcaggaccggcccggggacgccgatag

SEQ ID NO: 789 - DNA, 714 bp, Actinoplanes utahensis
atggacttcctgaagcccttcgttctgcccgtcggcgaccagtctccggaacgccacgagttccacgatctctacctgcccggcgagatcgccgcgccacgcccggcgatcctgatcgttccgggcggccccctgccggccgaggttcgcccgacgcagcgggattggcccgttttccaggggtacgcccggctcgccgcccgccgcgggatgatcggagcggtcgtcgagcaccgcctctacagccccgccgagtatgcgaccggcgccgccaacgtggcggccgtcgtggagaccctgcgcagcgatccgcgggtcgacgagaatcggttggcgatctggctctactcgggttcggccctgttcgccgcggactggctgcgcgaaccgccgtcctggctgcgggtgctggcgatgagctatccggtggtggaggccttcccgggatggccggccgacgagcggttcacgccggtggcggcggtggccgaggccggggacctgccgatcgtgctgacccgggtcggcagggaacagccgatcatcgccgggccggtgaaccggttcgtggaggcggcggtcgcgagcaaggccgacctggagatcatcgacctgccggacggccagcacaccttcgacgccaaggacgacaacgacgagtcccgggcggcgatcaaccgggcgatggacctggtcaccgccaagctggcctga

SEQ ID NO: 790 - DNA, 1887 bp, Actinoplanes utahensis
atgcagagcgccgacaacatgtccgtacgcccgcgccggatcggtgccgcgctgggggcggccctgttgatgaccgtcgccggatgcaccggcgatgacgagaagccgttcgcgggtgagctgccgccgcccggcgcgacctgggagacgctcgacccggcggagcccggaacggtcgacggcagccaggagccgacgacgaacgcccagcagcaggacgggaacgtcggtcaggcgggcgccggatccggcgggatcggcacggctgccggcgggtcgtcgtccggaatcgatcagggtgcgggaggcgacggcggtcgggcgctcggcccgggcggcaccgtggtggccacgccgggggtgcacgggcacggcggtggactcggggtcggcggcaccgtcgtccagaacccgccgctggggccgggcggcaccggtgtcggcggccccggtctcggtggcaccaactcatccaccaataaccccaaaaatccgggcaatgtagcggctccgggagtcggcggcgtgcccggcgtgggtcagcctggcccaggtcagccaggaaccggcctacctggagcgggtcagccgggcctaggccagccgggcgcaggtcagaccggtgcgggccagccgggcgcaggccagaccggtgcgggccagaccggcgggggtcagaccggtgcaggccagacaggtgcaggccaccccggcgccgcacagccgggatccgcccatcccggcggcggcgccccggcagcccagcccggcggccagcacgcccccggccaaggccccgtcggccagccgatcagccatccgatcggccagcagcccggccacccgggccagcccggccacccgggccagtccggcacgggccagaacggccacccggccaccggcccggcgaccccggtcgtcggcggcccggtgatcgtccagccgatcgtcaaccaccgcccgccggccgtcgaacccccggccaccagccatcactcgtccggaaacgttcacagcgaccggccggtgacccacgcgcgcccggcgacgcacgcccggccgtcgggccagcaccgcgcggtccgggccagccggccgacctgggtgcgcgacctggaccggccgatctcggcgaaccgtagctgtgatcgcttccacggcggcatcaccgacatcaccctaaccaacgggtggtgggacaactcgcaggtctgcggggacaccgactcgcagatctacctgttgacgcactccggcatgccggtcgccctgccgcaggcggacgacgattacggccggatgcggcggttccacgatgacctgctggcccggatcaaccatgacgcgttcccgttcgactcgcacggattcggcgacgaccgctgggccggcgggcaccggggcgccggtgggggcgtcggtcaccgccgcggcggctgggacgacgggaacaccgatggcggctggggcaacggtgacgccgacggcggctggggcaacggggacaccgatggcggcgactgggacggcggcgaccgctggaccaccggtgacgcccgcgacctcggtgacctccgggccgcggcgaacggctggagcggcgacgacctgggccgccacgcgtcccgcgactgcgacaagccgtcccgtccgaagcgccgggcgaaagccgccgcggtccggaacgacgcggtcaccagggcggagacgagcgcggcggccgacgacgccgacgcccgacggtccaccggcgacgacccggcggccaccggcgatcgggaccaccggaccgccggagacggatcggatcaggagaaggccacggaccgcttcgacgatcacggcgacggcatcgcgatcacctacccggtgacggacgactga

SEQ ID NO: 791 - DNA, 2520 bp, Actinoplanes utahensis
atggtgagatggccgcgtctcgtcgtggtgccgctcgcgctggccgggatgcttgcgctggccgggctgacgctcggccggatctacgccgacgacctgctgttccggctggtcgccggcgccgcgatcggctcgatcggggccggggtggccacccgccggctgccgtcctggagcgccgcgccggtctccgcggtgctgctggccacctacacggcgctcgcgctgaaactcgccgccgggcatgccggactgaccaccccgttcccgtcgatcgtccgggacgccctggtgaacggcatcccgcggctgcttaccgccctgattccggtggagtccacaccggacaccgtggtcgtgccggtcgtggccacgtggctcgccgggatggccgcggtcgaggtcggcgtgcgggcgcggcgcgtgctgctgggcacgctcaccccgatgtgcctgtacgcgggtgccctgtacgtggtcgggccgaacgccggcccggccgtggcacccaccctcggcgtggtcgccctggtggtggccgcgctcgcggtgtccgtggaccgcgatccggccgccgccgatctgcccgccgccgtgcgtgcgcggtcgctcggcgccgccgccgtgggcctggtcgcggtcgtcggcctggccgcggtcgtcggcccgtggatcagcggtcaggtcggcggcgacccggtcgacccgcgccgctacgtcgaaccaccccaggtggacagcctcgacgagagcccgctcaaccggatctccggctggatgctcgccccgggacagcagcttttcacgtatcaaccggccagcccgccggccggtagggcgaccacggtgcgggtgcggctcgcggtcctctccgactacgacggggtgacctggaaggtcggcgcgctctaccgcaacgccggccgggtgctgcccgagtcgacccgtccgcccggcaccgacgtcaccgagctgcggcagcggatcaccatcgccgggctgaccgggcggctgctgcccgcggtggccaccccggccgaactctccggggcgcgggtcgcgttcgacgccggcaccggcacgatgatccggccggaggggctgaccagcgggctgacctacaccgccacgtccgaggtgccgacccccgacctgaacctgctgccgaccgccgaggcgccggccggcgacgccgtggtgcgctacctgaccgtcggcgacggggtgcccgacccgatccagaaactcgccgaacacctcgcggacggcaacggcggggcgttcgaccgggccagtgcgatcgaacagttcctcgccgggcactaccgggagactccggacgcgccgagcgggcacgcctacccgaacctggcgtacttcctgttcgggccgcgcggacggggcggccaggagggcacctccgaacagttcgcggcgtcgttcgcgctgctcgcccgcctgaccgggctgcccagccgcgtggtggtcggcttcgacgcgcccgccaagggcggccaggtcaccggcggggatgcgatcgcctggcccgaagtgctcttcgacgggctcggctgggtgcccttcgacccgatgccgaccagcgacgacccgagaccggtggaggaggacttcacgccgaaaccgaccacgccgccgacgacaccgccgcagaccgacacgtcgaccggcagcgcgccgccgtcgacaccggcggcggccgcggcggtgcggcccggcggcgggctgtccggccccgtggtggccggcgcggcgtccgggtcggtgctgctggtgctgatggcggccgggctgaccgtgatgcgactgcggcgggggctgcggctgcggcggctcgggaagggcagtcccgaccagcggatcaccggggcgtggcgggagttcaccgacgcgttgcggctggccgggcaaccggtgccgggtcatctttcggccaccgagatggcggcgtacgcggcggcgccgcccgccgcgcgccgcaccgctctgctgcgccgcgccacccccgtcgccccgtcccgcccgtcctccatgtcggccgcgccggcttcgtcggcgtcgcgctcaccctcggcgtccccggtggggccgagcttgtcgtcggcctccacctcggcgtcgtcggtcgcggcttccacctcggcgtggtcggtcgcggcttccacctcggcgtcgtcggcctcggcctcgtcggcctcggcttcggcgaccgcggccggctcgtcctccccttcgtcggtgccttcacccgctcaggccgcggagtcggtggaggtgggcgacgcgggcgcgcagccgccgcttccgccgcttccgccgttggatgcgctggtggatgcggtgaacacggtcgggttcgcgcccggggcggccgccgccgggcaggcggaccgggccggggcgcaggtgctggcatatgcggcggcgctgcgcgagcggcagtcatggtggcggaaaatctggtggactgtccaccctggacccctgcgctggcatcgctga

SEQ ID NO: 792 - DNA, 1113 bp, Actinoplanes utahensis
gtgaccgctcgcggcatcggcctgctggccgcggcggcggtcctgctcgccgcgggcttcggctaccactatccggatctcgccctgctcggcgcggccggcctggtcgccgccgcgggcgcgctcgccttcgccttctggcggccccggctccgcgtgcaccgggtcgccgagcccgaccgggtggcccgcggcgacgccgcccggatgcggctcacggtcggcaacaccagccggttccgggcggccagcatgatcgccaccgaccggtgcggcggcacgagcgtcccggttccgctgctgcgcctgcttcccggcgccgacaccaccgcggagtacccggtgccgaccgggcgccgcggcatcgtcccgatcggcccgctgcggatcacccgcggcgacccgctcggcctggtccggctggcccggacgtacggcgaggtggccaccgtctgggtgcatccgcggatccacctgctgcgggccaccccggccgggatggcccgcagcctcgacggccggatcgacaaggtgccgcagggcacgatcaccttcgacgcgctgcgcgaatacgtgatcggcgacgagctgcgccgggtgcactggcgcagctccgccaaggtcggcgagctgatggtccgcgagcagctggacacggccgagccgacgatcgtagtgctgctcgacgaccgggacaccgcctaccccgatccggaggcgttcgagtcggcctgcgaggcggccgcgtcgatcgtcgcggccgccgtccgcgaggacctcccggtcggcctgcacctggtcaccaccgtggcgaccgggccgtacctggacgtgctgaccgaggtgcagccccgccccggcgatctgacggcgacggtccggcggatgcgcgcccagcgcctcggcgacaccctggtcttcctgaccggaccgggcggccggaccgacctcggcgccgtcagctcgctcaagggcacgtaccccgtgatcctcgccgcgatcctcggcgaccgcgacgcggcgccggtcccggccggcgaccgcctgatcgtgatcgaggccgccgacggcgccgagttcgccgcggcctgggacggtgtacgcggatggtga

SEQ ID NO: 793 - DNA, 1182 bp, Actinoplanes utahensis
atgggtgccgaacgggacccggttgaagacgtactgcaagaagtcgggcgaggaggtgtatgcgttcgtctacaacaacaacaagcgcagcacctggtggatccagatcgactacaaggggaagacgtacatcccctgggcctggctgaacctggacggcggcgacgacctgggcaacctgccgaactgctagatgaggaccgactggtgacttccgaaccgctgcccccgtcgtacgtgtccggcttcgcccaggtggccgggcagctcgccgagcggatcggcacggtcgtgctgggcaagccggaggtggtccggctggccctgaccgcgctgttcgcccaggggcacgtgctgctggaggacgtgcccggggtgggcaagaccaccctggcgcgcgccgtcgctgcatccatccgcgggcagtggcggcgcatccagttcacccccgacctgctgccctccgacgtctccggcgtgacgatcttcaaccaggcgagccgggccttcgagttccaccccggcccggtgttcgccaacatcgtgatcgccgacgagatcaaccgcgcctcgccgaagacgcagtccgcgctgctcgaggtgatggaggagcgccgggtgacggtcgacggccacccgcacccggtgccgcggccgttcctggtggtcgccacccagaacccggtcgagatggacggcacctaccgtctccccgaggcgcagctcgaccggttcctggtcaaactgtcggtcggttacccggacgaggacgtcgagatcgaggtgctgcgcggcgcggcgggccggtcgccggacgcactggaaccggtcaccgacaccggcacgatcggcgagatggtcaaaatggcgctgcaggtccacgtcgccgacccgctgtacgcgtacgccgtgcgtctggccgccgcgacccgcaaccacccgcaggtccgggtcggtgtcagcccgcgcggggtgatcgccctgacccgcgccgcgtgcgcctacgccctgatcaacggccgcggctacgtgctccccgaggacctgaaagccctggtcgagccggtgttcgcccaccgcgtgctgctgtccgccgacgcccagctgcgcggtgtcaccgccaccgacgtgctcgccgacgcggtgaacacggtgcacgtcccgctcccggccagcgcgtga

SEQ ID NO: 794 - DNA, 2616 bp, Actinoplanes utahensis
gtgagcagcgcagacggcgcgtccaagcgccggttaccgagtcgtggctacctggtcacgatgggtacggtgctggcgctggccggtggcctcgggctgacggtgctcggcctcgggcaggccgacaaggcggtggccagcttcgacgccgcctcctgggtgtggagccgggccaagggcgagatgtcccgggtcaacggggtgaccgccaggatcgacacccgggtggatgtgggtcaggcgcgcgggcacgggttggaagtaacccagagtgaccgcttcgtgatcctgcgggatgtcaacaccggcgcgatcggctcgatggacctcaccgacctgcagacgtactggaatcagcgggccgcgccgggcgtcggcgtgagtgtggcactgcacaacgacaccgccttcatcgtggattcggtgcagggcagggtgcagcaggtcgacccggccagcctgcagggcatcgggcagccgatcaccctgccgccggggatcaccggcgggcagttcgacggccggggccggctgtgggtggtggcgcccagcgagggcaccgtcatcgagatcaccccggcgccgcgggccggcgccggcaccgccgcccaggcgcagcgggtgcggaccgagacggtcggcggcgccagccacgacttcaaggtgaccactctggacgacggcgtcgcggtcctcgaccgcacgacgaacgagctggtccgggtcggtgacacgccgaccacgcacgcgacgctgccactgaccgggccgggcacgctggccgcgcacaccgacggcggcacggtcgcggtgaccgtgccggacacccgccaggtggtcggggtggacccgcggggcgggatcaaggccacgttcaccgtgcgcgggggcggcacgcagtcgcagttgcagcccgccgtctcctgggagggcttctactacgtcgcggatgccgacggcggcacggtgcacgtcttcgaccaggccggccaggagcagaaaccgatcgtcttccagcatccgggcggctcgctggagctcgacgtgcgggagggctacctgttcatcaacgcccccggttcgtcgatcgcccaggtggtcgacaaccagcacggcgtccgcccggtcgacaagtatgccgacgacgtccccggcggcaccccgccgaaggtgaccaccccgccgaccccgccacggaagaagccggtcaagccggcggtcaccaagccgggcgcgccgcgcaacgtgcgggccgcggccggcaacgccgaggcccgggtcacctggcaggccgcgccggacaacggcgccgccatcgcgaagtacgtggtgagcggcaacaaccagactttcaccgttggcgccgagcagcgggcctacacggtgaccggcctgaccaacggcgagacgtacaccttccaggtgcacgcggtcaacgccaagggcgacgggccggaccgctccagcaacccggtgaagccgacctcggaggtgcccgacccgccgggcaccccgcaggccgcggcgaaacccgacggctcggtgaccgtgacctggcccgcggcgaacgggcagggcctggccatcgaccggtacacggtgaccgcggtctccgagggtggcaccgccccggtcggtgacgccaaggacacctcgatcagcatcccggccggtcagctcgacttcggcaagcagtacgcgttcaccgtcgtctcggtcaacgagcacggcgccgggtcgaagtcgtcggcgatcagcaacagcgtggtgccgttcagcaagcccggcaagccggacaacctggacgccgccaccgtcgccgaccagcccggcgcgatccgggtcacctgggccgccccggccgacaacggccgcccgatcagtaggtacgtggtgaccgccggcggccggagcaccgacgtcgccgacggcactgcggccacgctcaccgggttcggcgccggcgagacggtcgccgtgcaggtggtcgcggtcaacgaggccggcccgggcgatccggcgtcggccaccgcccgcacggtcgccgccccgacggtcaccatcaccggcaccaccaccacgttcaacgcggcgaccgtcgggttcagcgtgaacgccggtggcggcaccgcggcctgctccctcgcggtgtccggcggcaccggctccggcggcagctgcagcagcctcaaggcgagcgggttgaagccgggcaccgactacacgttcacggtgacggtgaagaacgcggccggcacggtcaccaagcaggccaccaaggccaccgccgacctgtacgggacggccacctgcatcaacggttccaccggcgaccagaagacgtactgcaacgccgacgtcgacggccgcaacggcaacgagatcttcacggtcaccaggcagaacgacgcgcaacaggccggatgggtgccgaacgggacccggttgaagacgtactgcaagaagtcgggcgaggaggtgtatgcgttcgtctacaacaacaacaagcgcagcacctggtggatccagatcgactacaaggggaagacgtacatcccctgggcctggctgaacctggacggcggcgacgacctgggcaacctgccgaactgctag

SEQ ID NO: 795 - DNA, 2655 bp, Actinoplanes utahensis
atgatgctcggggccggccactgggcggtgacccgtgcgcaggcctatctcgatcaggttccgactgcgccggtacgtctcgagcccgcccaccggatgcctcggagcggcctgacccttccgcccgcacccgtcgccccgcccgggccggcggtgcgggacgacccgcccgcacccgtcgccccgcctgggccggcggtgcgggacgacccgtccgcggctgcgcagccgaccgcgacgtggccggtcatcccccaccagggcaacccctggtcgaccgccccggcaggccggcccccggcttcgagtcaccaggacgccgtcggccgagccgccccgaaccgaccggcatcgagtcaccaggctgccccgagtcaggcgggcccggacgacaccgtccggagccggcccgcctccggccacagcgtcgacagcagcgcgcccggcggggccggcgcgccgggcgcggcagctgtgccgccgtcgatcccggcgcagcgagagccgcaggctgccggtcagcaatcgcctgcgatttccgtggcgcccgcgccaccgcgtccgttcggcctgcttccgccgccgagcgcactcggttttccgcccccgcccggcgccgacggtcccgcgtcgtcacccgatgtcgccagcgtgctgccgcccccgccgagcgctttcagcgtgccgccgccgcaacgggaccggggagacacgctggcgcctccgccggtggcgccgttgacgcccggaatcgaggctgccccgggtacgccgtctgtgcagggcgctcagccgcggcaggacgatgcggtgccggaaacgcgcgggacgggacggacccagggccgctcggggtcgccgtgggagccggttccgcaaagcggtgcggagcccgctgggcctgtggagacgccgttccgggaactggaacccggcgtgttcggtgtcgccggggcaacgagcgcgcaggacgctccggcgctctatcaccggggttcgcaggacgccgtggtcgtgcagcggcaggacccgatcgtcatgccgctcgccgacccgccggcgccgcaggcggcgcgtccgaatccgatcacggtgagcggtccggttccggctcacaacgctgtgcccgtacgcccggagccctcccgtgaaagccgatcggaatcggtcgcgcccggcgtatcgggtccggaccggtcggcgtcgccggcatcggaccgggtgatgaagggctcaccgtgggcccacgttccggcgatcgacgagtccacgaaggcgcttccgaccctgtcgacctcgtcggatgcgccgccccgccagaggacgtcctcgcacgtggcgcaacaaacgacgcttgagtcggcgtacgacaatgccccggcgccggagaaggaccctgcggcacgggaagcggcgcggcaggcggcccgggcgggagctgcgcaggaagctgcggcgcaagaggcagcgcggcagtcggctgcccaggaggcggcggcgcaggaggccgcccgacaggcagcgcgcgaggccgctgcccaggaaacggctgctcgggaggcggctgctcgggaggcggctgctcgggaagcggctgctcgggaagcggcgcggcaggcagcgcgcgagacggaggcggcccatcgggcggcgcgggatggtgccggtcccgggggaagtgaaaacctcaccgcctggccggatttcaacggctggccggagcaggccggtggccctacgccgtggagtggccagccggagatccagcacgtcccggccccgctgcctccggtccagcggccggatcagcaggccgcgcaggccgtgtggccggcgaccggccacccgcaagaggccggcccgcagggcggctccgcccggccggacgtgccttcgagcggctaccagcaggagatcgccctgcccgagccgacaccatgggacgcggggcagagcggggccgggcagcgcgaggcggggcagcgcgaggcggggcagcgcgaggctcagcgcgaggcggggcagcgggaggctcagcgcgaggcggggcagtgggaagcgggggcgctggaggcgtttccgcagcgggccgtgcaacccggggtgtatccggcgcagatgccgggcggcggggtctatcaccagggtgcggacggcgtgtggcagggcggcccggctacgccggtgacggggggcgcggcggcggaggtcacggcgtacgacagtgggggaaaccgcaagcgggggatggccctgttcgcggtgatcgccgcgaccatcgcggcggtcgtcgccgtgggcgcgatggttttcaccctggcgcagcagacccgcaagggtgacgacgaccatggtcagccgggtgcgccgacgctgaccggcgcgccgccgggcaatgtgaagctggccgatcggggtaccaggatcctggtcggctggaccgacccgtcgaacgcctcggtgagtttcatggtgaccatggcgcacccgggtgagcagttgaaaccggtcagcacggtggggcccggggtgaccacccggtggatcgacgggctgaatgcgtcacttgactactgcttcgcggtggtggccgtttatgcgaccgacaagttcgccagttcgccacaggtgtgcaccgagcgcggcaagaaatga

SEQ ID NO: 796 - DNA, 1029 bp, Actinoplanes utahensis
gtgggcgaccgccgtacgggtatcggctggtggcggtgggttcgcatccgaagaagcggcacgcgcaggggccggcaggtgttccggttcgaggtggagccggtgacgggcccgcaggtgcggtggatgttcgcgaagcggttgcagggatggagcgtggcggcgatcgcccggagtttgaacgagcgtggtgtgctctcgcccggggcctatgaccgggcgcgtaaccggcatcggcaggcgacgttgtggaccgtgcggacggtcgcggcgatcctggcgaatgcgcggtacaccggtcggcaggtgtggaatcggcagttcactgatcatcgggaggcccggcccggggacaaacggtcgagtctggggccggtgcgggtgtggaacccgcgtgaggagtgggagacctcgcaggagcggacacatccggcgctggtgtcggatgccgatttcctgcgggtgcagcagacgagcgcggtgctggagccggtggacgggagtagccgccggtatgcgctgaccgggcggctgctgtgcgcggtgtgcgggcgccggctggtcgcgcattggatgaataagaagccggggtatcggtgtcggcacgggcacaccaccgcgcatcctacggacgtggctgggccgaagtgggtgttctgggccgaggcgagggtgttcgccacgctggccggtcagcacctggagcttgcggatctgcaggatgccgaggatttggggacgtatctgcgggcgtacgacctggtcgtggtgtgcggactagggaccgtggcgatcgaggctgctgccgtggacgagcccgacttcgcgctcccatcagctgttgttcagccccggcccggcgatcgagcgggcgagccggtggtggccgtgcggcgggagccggtacaactggcgttgccgttggcggagcctcgccgccgtagccgcaggatgatgcttgcggcggcctcagaaggagaggggcagaaagccgaaaaccccaccaggtaccgcgtacaacgcgagtaa

SEQ ID NO: 797 - DNA, 123 bp, Actinoplanes utahensis
gtgaaaggcgacggcatgtcgatcaccgcgattccgaaacgagccgtattgcacgtctaccaccacggcaaccggggaacaatcgccctcaccagcgacaacagcgcagttgattcggaatag

SEQ ID NO: 798 - DNA, 1935 bp, Actinoplanes utahensis
gtgagcatctcggaacctgatcaggacggccctcgagtgacgtcgtcgctgcgggaggagcccgattatcgggccgcggccaccgccttcgaacacttgccggtgattgtgtcgatgtgggagggagccgagctgcgcggtgtagccgggaatcgccttttccgcgcgagtatccgcgaccgcccgttcctcggcctgccgctgcgcgaggcgctgccggagctggccggccaagaggtgttcgagacgtacgagcgcgtcctcagcacgggtgttgcggaggccgtccgagaatggcggatgctccacgaggtcgacggccgcaccatcgaggagttctacaccacgcatttcactcctgtgccggacgacaccggcacggtgcgcggggtcctgcagacgggtgaggacgtgacggcgcaagtgctgcgccgccgggaggccgaggccaaggccgcggtctctcaagagcggtatctggctgcgcaggaggtggtgctcgcgttgcagagcaacctgctgccggccaccctgccggtgttacccgccattgacctggcagcgcagtatgccgtcgctgcggccgagctccaggccggcggcgactggttcgacgccgtcccgctgcccgacgggcgcgtcgccctcgtcgtcggcgatgtcgtcgggcacggagccccggcggcagcggccatggcccagctacgcccggtgctgcgcgaggcgctgcgctccggcgtagacccggtgggggccgtcgaccgcctcgacgcccacgcgagcgagactccggccactcgcgcggcgaccgtctgcctcgtcgttctggacccctcggacggtgccctgaccctggtgtcgcgggcgcaccccgcgccgctggtctgcgctccggacggcgacactcgatacctcgagggcgggggcggcggcccgctcggggtcggtgccggccggtcccgcgcgagcgtgcatcggctgaagccgggagagacggtgctgttgtactcggacggtgtggtggaacgcccgggtgaaccggccgccgagggcgcagcccggctcgctcgtatcgccggcggcgccgtgaccacgcgcagcgacgccgtgccggaacgcaccaccgaccggttgtgcgctttgatcgtcgagcgtgtcacccgcggcggctacgtcgacgatgtcacggtcctggcggcgcagcgcctcgtcgagcctgtcgcgccgctggtcctggacgtgccggccgagcagcaggccctggctgggctacgggatgccctcacggcgtggctcacggcactcggggcgcgccgcaaggacctgctggccgttcccctggcggcgtgggaggcagccagcaacgtcgtcgaccacgcctactcagggagccgcaccggacggctgcgccttgacgcctcggtcgacagcggcgggcggctgcggctgcaggtcgccgacgacggacgctggcgcgagcggacggcgtcgtcgggcgggcgcggtctcccgctgctccgcttgctcaccgacgaggtgacgatagagcgccgggacgacggcaccaccgtgaccatgctgtgcacgctcgggcaccccaccgtcatcggtctcacggcatccacccccacgctcgtcgagcaggagccgttcgacgtcgtgcccgtccggcgcgatccgacggtgctcagcgtccggggacccatcgacgcgagcacgaccgccctcctgcgcaccggcaccctccgccacggcgcggggcttgaggggccagtggtgctggacctcgagcaggtgacgttcctcgcctctgccggggtgcaactcctgcacgagctgacgcatgacggcagagtcgagctcgccgcccccgtgggcagcctcgctcgccatgtcctcgacctgaccgggctctcggcgctgtcgtccgaatag

SEQ ID NO: 799 - DNA, 2859 bp, Actinoplanes utahensis
atggcaggacggtatcaaggcgtcgtcgtcggctcgtcgctcggcgggatcgaggccttgcagttggtgctcgggcgtgtgcaggatctggtcgacgtgccgatcgtcgtcgcgcaccacatcagcccgtcggcgtcccgtctcgagaaggtgctcggccggacgtctcgcctgccggtgaggtgggccacggacggcgggccggtcgagccgaacgtggtgcacctgtgtccgccgcggtcgctggtgcggtgggaaccggacggcaccttcaccgtccgcgggcacgaggccaggtcgtcgctcgggcttgtcgatgaactcttctcctcggctgccgacgcactgggccaccacctgctggcgatcgtgctcaccggagccggcagcgacggcacggcgggggcccggacggtgcgcaacacgggtggcaccgtggtcgccgaggacgaggagaccgccacggccagcggtatgccgggctcggtcgtccgggccgggctcgccgacctcgtcctgcctctcgcggagatccccggaatgctggaccgagtgatcgggctgggccggtccctgccgcttcccgagctcgtggccgccgaagcggtgttcgcctcgggcggcgagatgggcgcactgatggcggcgaccgactggacccactcggcactgggccccgtcgagcgctggtcgccggtgctgcgctcgacgctggcgatggcgctgggcagcgacctggccatgtgcgtgttgtggggccgcgacctcgtgctgctctacaacgacgcctaccgcgacatcatcggcggcaagcacccgacagtcctgggccgttccgcagcgtcagctttccccgagaccgcgcacctgaacgatcccctgttccggcggatccgcgataccgggcgcggcctgctgcagcatgaccagcccacgccctacatgcgcgacggcgagctggaggaagcgttcttcactttcagctacagccctctctacgagggaccggagatcgccggtctgctggccaccgtcgtcgacaccacgcaccaggtgcagggcggccgacggctgcgtgtgctgcaccggctggcgaccggggctctcgtcgagggggacgcggagtcagtggtgtgcgaccgggtcgccgccgtgctggccgacgaccccgaggacgtgccgttcgcgctgctctacctggtggaacgcgctggtatcaagctgcacctggcggcagcggtcggcctggagccgggcggtgttgccgccccgcgccggatgtcggtgtccgatgcgacggcatggccgatctccgccgtggtgcgacgggccgagccgcacgtggtggccgacctgcctgacgggttccgcggcctggtctgcgggccgcacccggagcagcccacgaaggcgctcgtgctgccggccggccggcacccggatggctccaccgcagccgtgatcgttctcggggtcagcgcccggatcccgctcactgtgacctaccgatcgtttttcgacctcgtcgccgagcaggtgggcgcgtccctgaccgccgcccggcgtcgtcaggaggcccgcgagcggatcgccgcactcacggcgttggaccgggacaagaccgagttcttcgccggcgtcagtcacgaatttcgcacgccgttgaccctgaccctcggcccgctcgagcagttgctcgacaccccggccgcgggcctgcggcccgacgaggtgcacaccgcggtccggctcgcgcaccgcaacgcgctgcgcatgctcaggctcgtcaacacgctgctggagttcgcgcagctcgaacacggccgccggcggctgcggctggaggacgtcgacctggccgctctcaccaccgacctcgccggggtgttccggtccgcggtcgagaaggcgggattggagctggtagtggactgtccgctgcttccgcggaccgtgcccgtcgatccggagatgtgggaacgcatcgtcctcaacctcatctccaacgcgctcaagcacaccttcaccgggtcgatcaccgtcgctctgcggctacggccgaatcacgtcgagctcgaagtcgtcgacaccggcatcggcatcgccgccgaccagctgccgctactgttcacccgcttccaccgggtccgcggggcacgagcccgcagccatgagggctcggggctcgggttggcgctggtgcagcagctcgcccgcctgcatcgcggcacagtccgggtgcgaagcatggtcgggaggggcagccggttcaccgtgtggttgccgctgacccagcggcggccgacagaaccgaccgccgacgatcacccggaggcccgaaacgagcaccggcgtgcgttcgcggaggaggcggagctgtggctcaacgggcaagacctgccggcgggcatccaggatgccgcgccgcccgcacccggattgcccggccgcaagcccgcggtgctgctggtcgacgacaacccggacatgcgcgcctacgtgcggcggctgctctccgaccgctacgaggtgaccgcggtcgccgacggccggcaggcgctggacgcgctcgtcgagcgcggcttcgacctcgtgctcagcgacgtcatgatgcccgagctggacggcctggccctgctcacccagatccgtacggatcctcggcaccgcgcgacgccggtgatcctgctgaccgcgctggccgatccgggctcgaccgtcgccgggctggctgccggcgcgcacgactacatcgtcaagccgttcaccgcgcgggaactgatcgcacgggtggaggcccagctcgccctcgccaagctgcgcgcggaccccgctcccgggccaggcaccacatcctga

SEQ ID NO: 800 - DNA, 1158 bp, Actinoplanes utahensis
atgccgtaccaacgagaggttcttgttgcccctcagcgggaggactacgacgagatcgccctgcgctacgccgacgcgtgtgccacggccgacagcgctcgggcggaacggttgcgcgaggacatgatccgcgcggtgctgccgatggcggaacggctggcccgccgctaccggggcggttccgagccgtacgcggatctggttcaggtggctcgggtcggcctggtcaaggcggtgaaccggtacgaccccgagcgtggctcgttcaccgcctacgccgtcaacacgatccgcggtgagctcaagcgtcacttccgcgaccacgcctgggcggtgcatgtgccccgccgcatgcaggaggcgctgctcgagctgacgtgcctggagaacgagctgacccgggaattgcaccggcgtcccaccgatgccgaactggccgggcaggtgggcgtaccggccgatgagatctcgcggatccggagcgccggcagcgcgttccggccggtgtcgctgagcaccccgatcggcgaaggggatctgctgctgggcgacaccctgggcaatcccgacggcaggctcgaggacgccgcggaccggctcactgtcaccgaactgctcgactatctgcccagccgggaacgccggatcgtgcacgccactttctacgagcgccggacgcagaccgagatcgccgcggggctcggaatctcccagatgcatgtgtcgcggctgctggcccgcgcgctgtcgtggctgcgtgcgggtctgctgaccgatcaggtgccgcgctggccggtgaccggcgacgcgccggaagaactgttcgccctgcacacccggctgccggcccgcggtgagctgcagatcagtgtcgtcggcgaggtcgaccgggacaacgccgaccggctgcgggtggcgctgctggagttgatccgccaccagccggcctgtgcccgggtcacgctggaactcggggaggtgccgctgctggacgcggccgccctgcgagtgctgcgatcggtgtacgaggcggcccaggcacgccacgtcagggtgaccgctacgggtgcgagtgccttcctgcgcaggctggctgtcatcgccgggctcggctcgatgctggccgacaacacggccgaggatttgagccggcgatga

SEQ ID NO: 801 - DNA, 855 bp, Actinoplanes utahensis
atgccgtggttgccgagctggcggagtgggtccggattccgtcggtcgcccggagttccggagcatgtggtgaatttgcggcggtcggcgaactggctggcggcggcgttgcgcgagacgggctttccgtcggtccaggtgtgggacaccgaggacggcccagcggtctacgccgcatggtgcgccgaacccgacgccccgacggtcctgatctacagccaccatgacgttcgtgccgccaaggacgaggagtgggacgagaccgcaccgttcgacccgaagatccgtgacgggtacctctacgggcgtggcgcgtcggatgccaagggccaggctcttgcgcacgtgtggggtctgcgtgctcacctggcggccaccggccgcgcccatcccgcggtgaacgtgaaggtattggtggagggggaggaggagacggggtcggcgcacctgcggcagcttctgcaggacaaccgggatcgggtcggcgccgatctgatcgtcttctccgacaccctgctgtggcgggcagatcatccggcggtgtgcgtcagtatgcgcggcacgatgctggcgaagctggaaatcttggggccgctgcaggacgtgtacagcggggcggtgtccgggccggcgccgaacccggtgctggagatgagccggctgctggctcagctgcacgacgacaagggccggatcaccgtgcccgggttttacgacagtgtggtggagccgtcgcagcggttccgcggcgagctggccgcgttgccgtacagcgacgccgaccggctggagcggtcccggacccgcagcgtgggcggcgaggccgggtacatggtgctggaacgtccgccgtaa

SEQ ID NO: 802 - DNA, 201 bp, Actinoplanes utahensis
gtggtgacagcggtaccggtcgcgcgcgccgcgttggactcacgtgctctcggcgaagttcaggagctgatgagtcagcggtatgtcgagcaccgcgcccgggtgggggggcaccgccggggcttcgccgatcacagccggttcaccgccgcttaccgaacctcctacggtcggctgccccgacagaccctgcacacctag

SEQ ID NO: 803 - DNA, 1974 bp, Actinoplanes utahensis
atgagcgacggctcccaacacttggacggcaccggcgaccttgaggctgttcgtgagtcatacgagcagttgccggtcgctttggggacgacgcggggaaccgagcatcgtttcgtggccgcgaacgcggcgtaccgtttcttctccgccgagcgtcccatcctcggcttgcccgcacgtgaggtcttccccgaggttctcgctcaggaagtgttcgtctacctggatcgcgcgctggagaccggcgaggtgcaatccggccgggagtggcacatccagctcgatcggggcgcgggtctggaagacatcttcatcgacttcacgatcagcccggtcgccggggccgacggcgtcaacgccggcgtgaacatcatgctggtggacattaccgaacaagtactggagaaacgggccatgcagcggcgggccgccgaggcccagaggcgctacgaagccgctcgtggtgtcgtcgcggaactccagtcggcactgctgcccaccgcgctgccagtgctgccccgggtacagatcgccgccagctacctgctggcagacgccgacaccgcggccggaggcgactggttcgacgcgttccccctgccgggcggacggctcgcgctgatcgtcggcgacgtggtagggcacggggtggccgcgtcagcgacgatgggtcagctgcgcgtggtgctgcgtgagcggctggcggccaccggtgacctgccggccgcgatcgacgcggtcgaccggatcgccgtcactctccccggcggccgagccaccaccgtgtgcgtggtggtgctcgacccgagctgcggcacgatggtgtactgcacggcgggccatccgccgccgctggtgatcggcgagcaggagccgcggtacctgccggccaccggcgccggcccgctcggcgtcggatcacggttcccggtgagccaggagaagctcggcaccagcgagatactgctgctctacaccgacgggatcctggaacggcccggccgcgacgtgccacagagcaccgtcgaactggcccgggtggcgacggagtcagcggccgaccgcatcttccacggccagttccccacagcggtggaccgtctgaccatccagaccgtggaactactgacccgcggcagcgggcacagcgacgacatcacgatgcttgccgctcagcgagtcaccgcgccggcccggctcgatctgcgagtcccggcccgctccgagacgctgaccgagctacgggtgcggttgcaggcttggctggacaccgcccgcgtcggcgcacatgatgccgacgcgatccggcacgcggttatcgaactggccgccaacgtgatcgaccacgcctggatcgactcgccggacgaacattggttcaccgtcaccgccgacctcaccgacaccggccacatccacgcccaggtcaccgatcggggccgatggcgcgagcccgcaccgtcggccgaccgtggcctgggcctgcacctgagctcgcaactcgtcgacgacctgcgcctgacacacgacgagcagggcaccaccgccaccatcacgtaccgcgtgcaccaccgcgctcggctgctgagcaccgccgacctcgcccccgccccggccgtccgccccgccgcgcagaacgagctactgctgatcctcgaccagccgcacgccccgcagccacgaatccgcgtcgacgggccgatcgacacagtcacggcggacgagttcgaccgcgccgtacgcaccgccggatccgccggcgtgcgaacgctgaccgtcgacctcaccggtgtcacccacctggccagcgccggcgtcgccgccctgcaccggctcaccgccctgcaccaggccagcaagacccgactgcggctctacgccccgaccggcagccctgctgacatgatcctgtccctggtgtcactgacccacgagacggtagatcccggttacccggaaaacaccatccagtga

SEQ ID NO: 804 - DNA, 963 bp, Actinoplanes utahensis
atggaacagcccgcggcacagacgagcagtatcgaacttcgcggcaccgacacggtcgaggagtttctgaacgctgcctacggcaccggtatgcgattgcgggacacgggaacgccgccggtgctgcgccatgagcgggtcgacgccgggacgttcgcggtggagaccgcccatcagtccgccgacctcaagttccagatcgatgctctccgcaagatcgtcgtcacccgtaactcgtcggcccgtctcgaacgcggctgtgacggcaccacccagcgctacgagccgggtgcgctgttcctgatgagtcaccccaatcggccatacaccgtgaggtggcaccccggcacgctggacaactgcatcatcgacgccgactcactcgccaaggtcgcggccaccgcgccgggacggcgcgccgaaccgctccgcttcaccagcctcgaaccggtctcgaagcgggcagccgcgagttggtgggccactcgcacctacgccgctgagctgctcgccggcccgcacccgacgactccgctgatgctgtcgggcatcgccgggctgctggccgcggccaccctgaccaccttcgcgaacaccgcactgaccgatccgacgatcgaggaccgccacgacgcctcgccgtcgaccctgcgccgcgcgatcgcctacctggaagcgcatcccgccgacgacatcagcaccgccgacatcgccgcggccgcgcacgtcacggtccgcgccatccagctggccttccgccgccatctggacaccaccccgacggcctacctgcgccgtgtccgcctcgaacacgcccatcaagacctgatggccgcggatcccgccacgaccacggtcaccgcgatcgccgcccgctgggggttcgccgaccacagccgtttcaccgctctgtaccgcgagacgttcggcaccacccccagccggacgctgcgcccgggatga

SEQ ID NO: 805 - DNA, 426 bp, Actinoplanes utahensis
atggtcgaaaacgacatgccgtccgttcgcctgctcgtagccgatccggcagatccgcacgtcgcgcgggtggaggcgcgagggtcgttcgaccgcggcagctgtcaccagctcacggccgccgtcgagcaggccctgagtaccggtcggcacaccctggtcatcgtcgtgcggcatatcatcgatctcgacgcggcgaccatccgtgccctgctcacctgccgcgagctcgccttgaccggcggcggcagcctccgcgtcgtcaacgacagcggcatcgtcgcccggctcctggacctcagcgacacccgacggctgctgtgcccgcccgatcccaccgcgtccatcccggccgaatccgccgctgcggacaacctcggccgacccgtcgtggcgctgcgtccccgtaccggcgaaggccgttga

SEQ ID NO: 806 - DNA, 843 bp, Actinoplanes utahensis
atggtgcgtcgcgatgtggtggtgatcggcgggtcggcgggctcgcacaagccgttgagacagacgctggcgcggctaccggccgatctgccggccgtcgtgctggtggccgtgcacaccgcgcccggcgcacgaggcgggctcgccgactcgctggcctcgtcgtgcactttgccggtgcgggccgccgtcgacggcacccggctggagccgggctgtgtccacctggcagtcccggaccggcatctgatcatcgacgacggccacgtcctgcggctcagcgacggaccgcggcagaaccgggtacgcccggccgtcgacgcgttgttccgctcggcggcccgatggtgcggtccccgggtcgtcggcgtggtcctttcgggcagcctcgacgacggcgccgccggtctggccgcgatcaccgccgcgggcggaaccgcgctgatccaggatcccgccgaggcccgttttcccagcatgccgcaggccgctctgcggatcgtgccgggcgctgtgaccgtgccggccctcgacctcggcgacaccatcgcggagacgaccggcaaaccgagcaccaccgacggccggccgccggaacccctcatctgggagaccgacatgatcgcgtacggaggatcgaacactcccgaccgtgggcaacccgtcgccctcggctgcccggaatgtacaggcggcatgtacgtgatccgtaccggactggctgcccactacgtctgtcacgtcggcactcgtactctccgcagtcactgctcgcgacgcgcgacaacagcaccgaggaggcgatctggaccgccgtcagcgccttgcaggaaaaagccatga

SEQ ID NO: 807 - DNA, 735 bp, Actinoplanes utahensis
atggcgacctcgcagcatcccgagcatgtcacgcctcatcaccggcctctggccgacgccatcgtcggcttggccgagacgccggaccatgtctccggggtcgaaatccacctgaaggtgatcgccgctctggccgcggaccgggtggccgccgcggactatgcctccgtcacgactctgcagggcgatgagtacaccaccgtcgcggccagcagtgacatcgcttcggccgtcgacgaggcccagatcgccgacggagccggcccctgcctgcaggcgctggagaccggcgaaccggtcggcgtgacggacaccagggcgacgatggattggccaggcttccacgcggtggcacccgccctcgggctgcaagcgtcggtctcggttccgctgtacatcggccgcagcacgccgatagccgtgctcaacctctacggccgcgacagcagcacgatggaaccgctgatcgtcggagtcgctcacctctacgccaccagccgtgaactggctttgggaatcgatcccccgccggtgcgggatcccggagctgcgaagttactcgacgggtacgcgcgggcgctcgcggtgcgcacctgcatccagcgcgccgtgcgtctgctcaccgagctcgggggccacagctccgatgacgcctacacgaccctgtgcgagcgtgccgcggagcacggcaactcgctgagcgtcgaggcgaaggatctcatccaccgcaagtga

SEQ ID NO: 808 - DNA, 111 bp, Actinoplanes utahensis
gtgtcaatcgatggcgcctttgatcttgttgacgatgctggcgacctcatggcttccgacaccatggagttgtccggccgcagcatcaaggtcctgcgccggcgcacctga

SEQ ID NO: 809 - DNA, 654 bp, Actinoplanes utahensis
gtggcgtcggccccggcggtccgcaccgcgctgctcaaatgcctggtcgagcagccggacgcgctcgtggtggacctggccgagatggtcgtcaccgaggccgccgcggcctcggtgttcctggccgccgcccgccaggcctcgcactggcccggcgtcccggtcctgctggcagcaccggatccgcagctggcacagctgctttcccagggatatcggcgcctcaccgtgcaccccagcgtgcagcaggcgctgaacgcgccgatccggcagcagacctccaccatcaaggacaccctgctacccacctccggcgctgcccggcacgcccgcgcattggtcaccgaaggctgcctgcgatgggagctgccgcacctggtcggcccggccagtgtcgtggtcggcgagctggtcagcaatgcagtcgtgcacgcccagacgatgatcgacctgcggctttccatgggccgccgctacctggtcgtggcggtgcgcgacggcagcgacgccctgccggtactgccggcaccagcctcggcggaccccctcgacgtgcgagggctgctgctcgtgcaaagcctggcccacaggtgggggacgctgccggcccacggaggcaaggtcgtctgggcgaccctgtcccgctcgacctga

SEQ ID NO: 810 - DNA, 486 bp, Actinoplanes utahensis
atgcgaagggtcttcaacagcgaggacgacgtgagcaccgccgggcaggagccttccgtgacgttcgcttattcttccgcgccgcgtctgcacatcgacggcatcacacctgccgccgacggctccgtccatttgtgcctcatcggtgagctggaccaggaagagaccgaccggctgcacgccggcatcacggacctcgcccaccgctacgcctccgcgccgatccacatcgatgcgacccggctgacgttcctcgactccgccggcatccgcgccctgctcatctgccgcaaaagactcgaacaggccggctcgcggatgtcgatgccgcgggtgcacccgcacgtcttccaggtcctgcagatcaccggcctgctcgacgtcttcggcgtcaccgagcagaccgccggccctgccggcgagccgaccggccacgccgacgagttcatacctgccgcttccggcgacgagcgcgaagcaggctga

SEQ ID NO: 811 - DNA, 1005 bp, Actinoplanes utahensis
atggcaaccatgatcaccgccggccggccggtcacccggaccatgccggcgccggcgctcaccatcggcgtggaggaggaattcctgctgctcgacccggtcaccggagccaacctgccgattgccgatcaggtggccgccgcactgccggagtcggtgcggccgcgcagccgccgcgagatgcggcgcagcatgctggaactggtcaccggagtgtgcaccggcctgaacgaggtccgggcgcagctgtccgagcagcgccgggccgccgccgacgcggccgaggcggccggggcccggctggtggccgtcggcgccacaccggtcgccgagctggattcgagtatgcccgccgggcagcgctatcacgatcttgccgaccggtacggcccggtcgccgcggacccggccgcgtgcgggctgcacgtgcacgtcggcgtcgccgaccgtgaactcgccgtgcaggtgtgcaaccacctgcaggtgtggctgccggtggtccgtgcgttgacctcgaactccccgttgttcctcggggtcgacaccgggcacgcgagctggcggtcggtgcaactgctgcgctggcccagcatcggaccgacgccttatttcgcctcagcgcgcgactacggccgtaccgtcgaagatctgatctcttcttccatggtgctcgacgaagcatcgatctactggtacgccagactctcccccacctacccgaccgtcgagatccgggtcggcgacgtctgcaccgacctcgacgacaccgtcctggtgaccgcgctcgtgcgggccgccgtcgccacggccatcgccgacatcccgggccgggatccccgcagcgcggccccgcgactgcgtgctggccgccgcgaactggcgctcggcccgctacgggctcagcggcgacctggtcgacctgcggctcgggcgcgcccggcccgcgtgggagctcgtcgacgagttcttcgccacggtcagccccgccctgttgaagtccggtga

SEQ ID NO: 812 - DNA, 585 bp, Actinoplanes utahensis
gtgggccggtgtgggcgaccggccggggttcgagccggtggagcggctgctgcagttcaagttcgcgacggccgtgagctgatcctgctcggtcagctcacttgccgtgaccaccacccggtggtgctggcggagttcgagcgcgggttcgcggcggggcaggcgcagtcgaccatcgcgcagctcaacgcgtacggcgtgcagtcgtggctgccggaagtggaggggccggttgacctgggtgaacccgagcatcgggcggtgctgagcatgctgggtcaccagtcgcagcgtgaggtgctgcgcaatcggttccgcactgcggcggcgatggcggcgcaggtccgggcgcagggccggcatctgggtggtcggccgccgtacgggtgtcggctggtggatgcgggcccgcacccgaacaaagtccacgctcagtggggccggcggtggcatcgcctggacattgatacggtgacggcgccgtgtgtggcgctggcacccttgaggtgcatgacgcgattcttgaaccggcggacgaagggctcccggtggcgccaccgggcgtcagggccacgggttccatga

SEQ ID NO: 813 - DNA, 840 bp, Actinoplanes utahensis
gtggcctttgctatcgccgccttccatagcgccgaaggccggcaggcggtccaggcgctgctggcgcgttcgggtcacacggtggcgcatttccgtaccggcgcggccgccgtcgccggggccctcgccaaacgaccggacataatgatcgccgacacccggctggcggacatgagcccggtacaactcggtgacgccttacgggcccggccggagactgccggcatcccgctcatactgtgcggatcggtagacgccgagtccaagcggatggcgcaagacctgcaccaacgggtgttccgggcgctgctgaccccccgaagcctccaatcggtgatcagcgccgcgctcgcggtgcgaggcggcagcccggatgccgcggtagccccgagatcggccggcgacacccccaccgccgccgcgcccgccacgggtgagcagtggagagtgctcctggtggaggacgatgactccatcgccgatccgctggtcgaaggcctcgcccgatatgggatcacggctgaccgggtagccaccggagtcgcagcgctcgccgccccgccggcgaccatggtgttgctggacttagggttgccggacatcgacggcatcgacgtcttccagcaactacgccacaccaccgacgtacccgtgatcatgctgacggcgcgcggtgacgaagccgaccgggtgcgcggcttggagctgggtgcggacgactatctgggcaagccgttcagcatccgcgagttggtggctcggatgcgggcggtgaaccgccgcagcacgacagccgcggcgaaccaaggccggatcactgcgccgacaggactccgatga

SEQ ID NO: 814 - DNA, 1425 bp, Actinoplanes utahensis
atgacccgccgactgctggcaacctatgtaacgtttgccctgctcatcctcctgggcctcgaagtgcccctgggctacgcacaaagccgcaacgagcaaaaccaggctttcgagcagctcgaacacgacgccgaggtactcgccgccttcatcgactccgcgctggcgcgcaacgacatgctccagatcgaggtgctcgcgcgcgagtcggcgcaacgccttggcggaaacgtggaagtcatggacgcccacggccagattctggccagcacataccctccggagcgaccggctgacagccccacagcacgctccgacgtcgatgcggtgctacgcggacaaggcagagtcagcgcacggatgtcgacggcagcggacgtgcggacgatgtcagtggtcgtgtccgtacacccgggtctgcagccacacggcgcgctggaagtcaacgtgccggccaccgcggtgacgacacgcgtgcagcactttgaactcatgctggccgcagccggcatactcctgctggcggcggccgccggcacggcgtttgcgctcgcgcgatggatcagcagaccgatccgggcgctggaactggccacccggacgttggcagacggcccgctcccggtgacgctgcccgtcgactcgggcccgccggaagtgcgacgcctggcagtcacctacaagacgaccgcggagaggttgaacacgctgatcacctcgcaacgctcgttcaacggccatgcctcccatcagctgaaaacaccgctggcagccctgcgcctacgactggagaacctcgaacccgacatcgcggccgacggccacaacaacctgcaagcggccttgcacgagactgaccgtttggcacggatggtcgagctgctgctggcgatggcgcgagctgagcagagcgcattgccccaggaagacggtttcctgaccgataccatcgacaggcgaatctgcttctgggagcccttggccatcagccgcggtatccacctggccacatccggcccggtggatgtcggcgttcgagcggtccccaccgccatcgaacagatcatcgacaatttggtttccaacgccctccgcgttgccccccacggaagcacggtcaccatcagctggcacgtgatagaccaggccgactcagccccggaggtcgaactccacgtcatcgacgaaggacccggactcaccgcagaacaacgaacacaagctctcgtgcccttctggcgagcacccagcgccggcacggggggaaccggactcggcctcgccctggtacgtgccctcgccgtagccagtggcggtactgcggaactgcgaccaagcggaaccggtggtatcgacgcagtggtcagactccccgccggctctggccgtagccatcaacagctctccgcgatgccctcgaactga

SEQ ID NO: 815 - DNA, 2166 bp, Actinoplanes utahensis
atggccaggagtcgcggtggcaagaagctggtcagtgcccgcgagcagtccgttgacgcgttgtttggtacggagtcgttcggtctcgactactaccagcgcgagtatgtctgggaggagccgcaggtcgcgcggctgatgaacgatctctcccgaaagtttctcgaccaattgagtgatgagcattcgctgggtgacgtgaagtcctacgatccgtacttcctcggtccgtacatcatctgcaccgcggacggacgcacctcgctggttgacggccagcagcgcatcatcacgctactgctgttgttgatctatctccatcggcaggcggtggcggcgccgaaggcgaggagcaaggccggccagcttttgaccttgatcatgtccgagcggttcggcaggcgcacgttccgcgtggatgtcgacgagtacgacgcctgcttcaacgctctgctgaacggtcgtgggttcgatgttgccggtgcccggccatcagtccggcgtatctggcaggcgtaccagtacatcgatcttcattaccccgcacagctgcgcggcgatgtcctgatcatgttcattgactggttgctctaccgggtctccctggtcgtgatggatgcgggggaccgggaacgtgccgaggagatgttccagtcgatcaacgactgcggggttcgtctctcgccgatggatcatctcaagcgctttctgctcagtgatgccgaagaggatccaagcgagatcgaaggcgcgtggaccacgatggtgtcggctctggaggacgtcgagaaaggggccgctttcgcctatttgcgcgccgtcttccgggcgaggttccctgaggccgtgggaaggccggggccgagcctgaacgatgcgactcacgagtgggtgcgggtgcacgagcgcgagatctggcccaaccgcaagagcggcgatcgggcccgcctggtgaccgaggtgctctacccgttccacaccacgtacgtcaccatgctacgcgcgcgatccgagatcaacccgggtctgcgggcggtgcggtacaacgctttcaacggcattgccgaacagttcgatctcacccttgccgcgctgaggtctggcgattcggagatcgagcgaaagcagaaggccggtctggtagccaattttctggaccttttctatgtgacgcagacgcttggtgacgaatcggtcgagcaaaggcacgtcgatgagcttgtctcctcggtgatgcccgcagtgcggctgtccgagtcggttcaggagctcggccgtgtactcggggaccaggccgcagactggccagtccggctggacctcatctcggaactgcgctacgacaccaagcgaagattcgtgcattacgtgctgacccgtctgaccgcgtgggtcgagatgggcgcgaccaatggggaaacggatcccaccgaccgcttcctgctgcgccggcaccatgaccgcgacttcgagatcgagcatctcttcaccagcacggcgtcgaagtatgcacacaaggtgccggacgctcgctactacggcttcctgcggaatcggatcggggcgcttctgctactggacggcctggacaacggaagctatggggggatgctcttggaggacaagctcgcgatgtaccggaaggacacgcgattggccgggatgctcaacccggacttcttccaacgaggcaacgtccggctccggaagttcctcaccagcgaaggcctgttcgccatgatcgccacctatgacccgagcaccgcgttggagccgttcatcgacgctcgcggtcgtttctaccgcgaaatcgccaagaagatctggagcctggatgcgctcggactggcgccgccaccggcgcccggaccggtggcgactgggaggcgcacccgctacggagtccggttccaggacttggtccagaccggcttactgagcgcgggcgacagactcttcggccgccgacgtggccagatgtactacgcccgggtccgcccggacggacggatcgagactgcagccggcgtcgcaagcgcgcccagtaaggcgatggaggacgcggtgggcgtggctggcaacggctgggccttctggtcggccgaagataccaaggagcggctcgatgcgattcggcagcagtacctcgatcggttcgggcgatag

SEQ ID NO: 816 - DNA, 666 bp, Actinoplanes utahensis
ttggatacgacaatcctcgtcaagcagttcgcggacgatcatggagccgtattcctcgaggtgatccgaacctcgcctgagccgatccgcgcgcaagccatcaaggcgctgctggtcgaggccggtgtcaagaaggcagatgtcgatcgccgttggacggcttttcagcgcgccctcaagctgcatccacagatcaccgccgccaacggcaagtacggctggtctgtcgagcggaagcccgcccgggactccctcgacgtgctggcgggaaacctactcgcgaagctgccgccgtggttggttcaacctctcgtgcagaatgtggcggctgctctcgatgccggcgagtcgaccgtctccgggccgacgagtcacgagttcgaggaggccaggctggtcgccgatctcgccgtggctgttgaggtcctgcagtctcgcggcgacaccattgctgaggtggcgaagctcttgatggatgagacgcgccgcaagcggctctggccgctgggccggcccggtgagacggtcccgttcgacccggactctcacgaggccgaagtgacgatgcccaatccggggaccgttgtccgggtcgtgcgctccgggtacctctggcgtggcggcggtgaaccggtggtggccgccaaagcggtcgtggccctgtag

SEQ ID NO: 817 - DNA, 183 bp, Actinoplanes utahensis
gtgttgtgcggcagccgggcgttttggctggtggtggccgtggcgaggtcggttccgctgccgccgctggttccccggctgaccctgccggaccggcaagggcagcgccgggaggccgtcgcgctcgtctatgccggtcagccgaaacgccgaacgacgccggcgcgaccgctcgctacgtga

SEQ ID NO: 818 - DNA, 198 bp, Actinoplanes utahensis
atgaacagcagcactatctggttcaagagcagctacagcggcgccgccggccactgcgtcgagaccgcgttcctggagaacaacaaggtcggcgtccgggactcgaagaaccggtccggcccggcgctgatcttcacggcggccgagtgggatgccttcgtagcgggcgtcaaagccaacgaattcgaccggcggtaa

SEQ ID NO: 819 - DNA, 693 bp, Actinoplanes utahensis
atgggacggagtaagaccttgacctctcggaaagcgctgactgcggcaacactggtcacgaccgtagggctcaccctcgccgcctgcaccgttgaacacccacgaggcgacaagaccacccctcccgcagccaacggcagtgccggcacaccatccatgacgttcgacgaggcataccggaaagtgccgatgaacgggaccgcaaaccaaccgatcacctgggatgtgaccagcacacccgacactgaagaggtcctcgccgcccggcgcagtttcgcgttcctccattgggagaagcaggccaccgactgggctcccatcctcccgatcggacgctacctgtacaccgatgactactacgcatcggtattcgccccgttcataacctccacgtcgccgatcgaggacccctgggccggcccgatctgggtcaagagcgtgggcgtggaacagatggcccccgatcgccagcgggtcaccttctgcgccgacctcggaaactggcaccacggcagcgagaagccctacgccgccccgggccaccgcggcgtcatccagtcgtacgaaatgcagaatgtcgagtccggagacggcgagcgccattggctcaccgaccgcgtgttcaaccccgacatcgaccgccaggcaaagtacggctcggcgtgcaccaagtgggccgtacacaagccctga

SEQ ID NO: 820 - DNA, 429 bp, Actinoplanes utahensis
ttggtcgagcaggtgatgggcaaagtgaccggcaagatcccggtaccggtcgtcggcgacctggccaacaactacgtcaacgacctgctcacgcaagcccagcaacgcgacatggtcgacaatcacggccacgctgtcttcaaagtcgccgatgcgctcggcgccgcccggaacacctcggcccacctcaccgaacaatccctctacaacagcggtaaacttcacgacctgccggacagcctcatcgtcgacggacatccgaaaccgagagaaacctggacccacaacgattttcaggactggcaggagtacaaaaatgggcgcggccagagcgttgtaggcattgccgccgaccatggagcagatgcctatcaaaacggctggacgtgggcgagaaccatccttggtggtagtgatgggacggagtaa

SEQ ID NO: 821 - DNA, 2034 bp, Actinoplanes utahensis
atgagccacctgacgttgcgggatctgctcgagttcgacgccgcgccgtggcatgccgcggccgatgcctggcagcggttggcccgcggtattgatgccacgtcggagcagctactcgccggcacccgcgatctcggcgaagtgtggcccgagggcgagggatctgcggcggcgctgcggaaggcggccatgctgcgggccgaggtggagaattcctacctgccggcgaaacgcctggccgatgctttcgaccaacacgcgtacgcgatgaaagccatgcgggatatcgccgcgggcatcatctactcggcgcagcaggccgggtacaccgtggacacggcggcggtgacgatcaccgcgcccgcgacggcgtacatgggtggcaatctggaccggaccggccgggagatcggctcgctgctcgccgatctgcgaaccgtggtggagaacgcccggtcgcaggacgtttcgacagcagccgccatcaacagcaacgtaccgtcgccgaagaccggcttcggagcgagcccggccagtgcgatcactcgggcccaggagctggcgaacaagctgaaggacccgacgtacgagcccactcgtgatgaactcgacgagctgcgcaacctgatcatgctgtacggcacggacaaggccttcgcccacgacgtgctgaccgctctgggcccccaaggactgctgcagctcgacggcaccttggcgacctaccagctcgattatccgggcaaggacgtcaacagtgcgttgttcagccgcgacaccgccgacatggtgcgcgacctgcagaacggtctcggagtcatgctggcgacggcgaccacgccgaccggcacgaggaccggcccgcacggcgagacccggctgcccgggcagtacgacctgcccagtcagtgggtcagcgacctgatgacagccgggcgcagcacgatgaacatcggcgatccgagtagcccgggccgtttcgtcgaaggtgtctacggctatcagctgctgggtccgctgctgcaccatggtgactacgacgcgggattcctgtccaccgtcggcggcgacatggtcgacttcgagatgtcgaagggcgagaacagcgccctgtggaaccacgcgcatcgtccggacaacctgcgcctggactggacccagggacacgacgacaaccatgttccggccgggcttgacccgatgaacggcctcatggaagccctgtcccacaacggtgccgccggccgtgacctgctcaccggcgtcaccagcttcaccagcgacggcccgctcggcggccgcctcccccggctcgactacctgctcaccgaccggaactggagtgcgaccgcggacgttgcgggcggcccgggctggaccgccgacgtgctgcaacacggcagcgactaccacaacaccgcactggacaacttcggcgtcgcactacaacacgccaccatggaccaccccggaccgcaagcccggcacatcgtcgagtcgatcatctacgagaccggcgtcgacgagcaggcccagtactaccccaacggcgtggtccccggtcacggcacgagcaccgacttcaagtcgaccgacctgatcaacccgcagctgcgccagccgctggccaccatcacgtcgggctacatctacgagatcaacgccaacatctccgaatcccacgaggcgattcccggcgtcaccatcgaggtcgaccggaaccatctcgtgcgcttcctggcagacctcggcaaggacccgggcgcgcacaacaccatcgccgacgcggaggccgcctacgccctgggcagctacgacgacatcctgtccggccggcagaacccgcacgccgacatgaccgaccacctgaacgcgatggagcacgtctcgcacaactacggcagcgtgctgggagccctcgaccacggcgccgccgcagccacacacacacgcagagcgccgaactggacgcgatcgccgacaaacacgtcgaggaccactacaaggtcgtggacactttggtcgagcaggtga

SEQ ID NO: 822 - DNA, 327 bp, Actinoplanes utahensis
gtgatgttcggatgggggatgccggtgctgcaggttgatgccgaggcgttgggtggtatcgggcggaatgtggctgatgccttcaccacgctgcagggggcggtgacggcatccggcgcccggctggcgcccgcgccttggccggtttcggcggctgctacggcggcgcaggcggcggagaaggcgtggtccgctgatctgcggcggctcaccggcgagatcgatgagtacggccggagcctgaccgccgcggcgcagacctaccagggcaccgaccgcgacaacgcccatgatctgcacggcggtggggcaggggcgggccgatga

SEQ ID NO: 823 - DNA, 441 bp, Actinoplanes utahensis
atgctgattgccacgctcgcctactttccgaccagttgtgacccggccgaccattcctgcgccccgttgccggtgggctccagttcggtgattttctcgccgttctggggcgggttcctgctggccgggtacctgtcgtaccgggcccgcgtcacggtggacagcgagggtatccgcgtgaaggctgtcctggacaacaaactgcacccgtggtcgaccatccacgatgtcagggtggtcaaggtacggcgatacaccaactacttccgcacggggaccgaacgccggctggagatcaggaccgagggcaggagggggatcgtctcctgggaggagctgccggtgcccaaggccggcctgctggtcggcaagaagaagttcgatcggcaggccgagctgttctggcgggcctggaatgcgcagcgcagctcccggtactga

SEQ ID NO: 824 - DNA, 570 bp, Actinoplanes utahensis
atgcccgttggtccggcgtcgagtgcggatctatggttgtcggcgggcgtacgtgtccggccgccctcggtcccgtccgtggagtcagtcgtggcacgtttcgtcgtcgttcaggaagtccgcgtgccggccaccgcgacctggacagccctggtggactggccccggcatggccggtgggccccgctcaccgccgtacgaaccgtcactgaccgtccggacggtgtcggcgccgccttcgttgcccgcaccggccgtggacctgtggccttcgacgacccgatgacggtcgtcggctgggaaccgccgcagggcgactcgcccggtgatcggcccggccgctgcgaggtggagaagaccggccgggtcgtacgcggccgggcctggttctcggtgacgccgctgcccgattcgcggagccgcgtggtctgggccgaggacgtcactgtctccccgcaccgggtcacccggttcgcggggccgttgttggccctggcgggccggctcggcttcgccgcgacgctgcgtgcgttcgcccgcgacatcgaaggcgtcgcaccgcgccgttga

SEQ ID NO: 825 - DNA, 402 bp, Actinoplanes utahensis
atgatctccgctgaccggttcgcgccggacggcctcgacgtcagcacggtcatcgaccgggccaccccggactgcaccgccgcgaccgctctggcgttgcgcaccgacccgctcctcggcacgttcctcaccggctcggacccgggcagcatcctcgtgtgcaactcggtgccgttgcggttccggttccgcacggcggcccgggtggtccggctcacctacgcgggcgagggcgagcacacgttcgttgcccagctcaccgacggcaccctggtcgactgcccggtcggggcggcaccgcaggtcagctacaccgcgccggaggggaaggcgatcgcgtcggtggtgttctcggggggtgacccggtggcggtcaaacaactcgcctataccgagggttga

SEQ ID NO: 826 - DNA, 855 bp, Actinoplanes utahensis
gtggatcgagccgagcgtccaaggctgaggcccgccccggtcaccgtctcccttcaaccggaccggctcgacctgcgaccgggccgcagcggcgacgtcaccgtgcgcgtcaccaacaccggcaccctggtgagccactacgacctggtggtccgcgggatccccgccgggcaagcggtggccgacccgccgcgggtcgagctcaacccgggtgacacccgtaccgtcgccctgcggatcaccgtgggtgagccgggacccccgtacgccggtcgccacgtcctcggtgtggtcctgcgcgacgccgcgagcgcccgctgcgaggagctgaccgtcaccgtcgccgaggccgcgtccctcgacctgaccgtgcgccccgaggccgccgacggcgaacccgccgcggagtacgagctcgccctgacgaacaccgggaacacgccgctggccacccgcctcggcgcccagatcgccgaccggggcgtcgagtgcaccctcagccccgcgacggtcacggtcgggccgggcgccaccgccaccgcccggctggcggtcaccgcgccgcgcccgtggaccggcaacgccacccgctccctgggcgtcgtggccgccgccggatcgctgcgggccgagaagcaggtgctgatgcggcagcggccccgcatcccggtcggtctgatgtgggtcgccggcccgctctcggccgcgctggtcctggccgccacgatcggcggcaccgccctcgtgctgcgccgtccccgccgaaggccgccccgaccgcgccggcgccggcgccggcgcggtcgccggcccagttcatcctcgacttcgaccgcacgcccggcgacacgatga

SEQ ID NO: 827 - DNA, 2334 bp, Actinoplanes utahensis
atgggtcaatccgcgcgtcgaaggctaagcgtacccgcgcggcgggtggtggccggtctctcgacgctgaccggcgtcgccggcctggccgccgcggccgtcctcggcgccggtcacggctaccacgccgcggcgccccacctgctggcgggcgcggcctggctgccgtcggccgggccgggggaggtcgaactgctcgacgggagcaacgccgaggtcgccgcgcgggtgccggtcgccgcggcgacgcacgacttcgacgtcgtgcagcacgggtccgacgcgtacgtggtggacgccgtgaacggcatggtgagccgggtcagcggcgccacgatgaccgcctcgccaccggtcgccctcgttccgggcgccaccacgggggtgcgggtcttcgccggcgacggcgtgctgtacgcggtcgacaccgtgcacggcctgctcgccgtcctcgacccggagacgctcgccctccgggggacaccccgcccgctcgcggtggccaccgacccgggcgcggccgtgctggacgcgcacggcgtgctctgggcgttggacaccggggccgggaacctcaccgtcgtccggggcggcgagagcgtcgtacggcggcgcgtcgtcacggccggcgcgggacggctgctgctcgccggcggcaagccggttctggtcgacctggccaccgcggaggcctccaccctcgaccgggacggcagatccacggcgaccgtccgcatcgacctgggtgacgaccgggacccggcgatcggcggttcgccggacgacgcccgggtctatccgaccctccggggtacggtcagcgtctgcgagctgaccgtgaacgggtgcggccgggcgatcacgctgaccgccgccgccgatcggctcggcaccccggtggagaacagggggcggctcttcgtccccgaaccggcgcacggccgcgtccacatcgtcgacccggtcagcggacatgtcatccggcgcacggtgctgcggccgccgggcgacctgcggctgttcgtccacgacggcatggtgttcttcaacgacccccggacgtggcgagccggagtcatccgcgaggacggctcggtggtgaccgtcgccaagtacgacaagaggacgtcgtcgcgggcgaccatgtccccgaacgctccggtgccgaccgaaccggcccccacgccgagcagaagcgtcacctcgaccccgagggtgcacgttgcgggggagaacccgaggcggccctcgtccagcccgccgccggtgacaccggaggtcgccgtccaggccgcccggcccaccgtgatggtgggcgaacccgacgagctgaacctgatcgtcacgcccggcacgccggcgccgcagagcgtcatctggaccttcggcgacgagattggcgccgagggcccgggggttgcccacacgtggccggtaccgggcacctacgacgtcgaggcgacggcgaccttcgcccatggtgtcgtcgtctccgcccgcacgtccgtccaggtgacggaccgtcccacgctcgccgtgaacgccccggccggcgggacggtcaccggaccgggcatcgcctgtcccggcgactgcgacgagcccttggacggcaggtccggcaccctcggcctcactgccgtccccgccgccggattcgtgctggccggctggagcggcgactgcgccgggaccgccccggagtgcgtcgtggacacgacgacgagccgtaccgtcggggtgaccttcaagcggctaccgatctccctgatcgagctggcgccctccgcgacctgggattcgggcgagggaccggcccaagccgaagccgtccgggcccttggcccgccgggctcggagccggctccaccgacgaatccgccggtactcgtctatgcctacgcgcaggggctgatcccgctgaatgacggtagcgcccctgcggtgttggagctccaaccgtcgaccttgtacgacgtgaaagatccactggacccctggatccagggggatttcgcgttgccttctccggtggtgtccggagaccagttccggagtcggatcgcatttcgtgttcgcccggaatgggaaggtaacgtcaccgacggtgatccggtgcccggggcgctcttcgccgtcgaagccctcatgccggacgaccattggaaacagatcagcggctatcagttcagagcgcccgaagcgacgattcatgacttcaatttcgatctcggcccggccgagggggctaccaagattcgcatccggatctacgccggcgaactgccggggcgggagcagtttctgtggatcgagccgagcgtccaaggctga

SEQ ID NO: 828 - DNA, 2361 bp, Actinoplanes utahensis
atgaggcggttcgcgcgtcgcctcgccgccggcgcccgggtcctgaccggcgtggtcggcgtcggcaccatggccgtcgtcggcgccgggcacggctatccggcccaggccccgcacctgctgaccggctcggcctggctgccgtcgaccggccccggcgaggtggagctgctcgacggggtcaacaccgaggtcgccgcccgggtgccggtcgtcccggcggcgcacgacttcgacgtggtccagcagggcgcggacgcgtacgtgctggacacggcggacggcacagtccgcagggtcgacggcgccacgatgacggccacgccggcggtcggcgccgtcccgggcgcgaccaccggcgtgcggatcttcgccggcgacggcgtgctctacgcggtcgacaccgcgcacggcctgctcgccgacctggacccggcgaccctcgcgccgcggggccggccgcgtccgctggcggcggccaccgacccgggcgcgaccgtgctggacgcgcgcggggtgttgtgggcgctggacgcccgcaccgggaacctgaccgccgtccggcgtgaccgccggatcgtccggccggcggccgtgacccccggcgcgggccggctggtgctggccggcggcaagccggtcctggccgacctggccaccggcaacgcgtacgccctcgaccgggacggcaagaccaccacgacggtccgcctggagctgggcggcgagccggacccggcgatcggcggctcacccggccgggcccgggtctacccggcctaccggggcaccgtcagcgtgtgtgacctgaacgccgacggctgctcgcaggccatcaccctgaccgccgcgaccgatcggctgggcactcccgtcgagagcggcggccggctgttcgtccccgagcccgcccacggccgcgtcttcgtcgtcgacccggccaccggcagcgtcgtggcccagccgacggttctgcggccggcggccgacttccagctggtcgcccgggacggccaggtcttcttcaacgacccgcgcacccgccgagccggagtcatccggatggacggctcggtgctggccgtggccaagtacgacaagaacgccgcgggcccgggcgcggcaccgaccaccacgccgccgccgaccggcccccggccgcaaccctcggcgacgtcggctccggcgccgcagccgacgaggcatcacccgtcgccgccgtcctccccggcccccgccgaggacccgaccggcagcgcgatgggtcagtccggacccccgtcgaagcccgccccgtcggccagcccggcaccgccggtgaagcccgcggtcaccatcgaggcctccgccccgacggcgatggtcgaggacctcgtcaccctggacctggtcgtcaccgccggctcgctcaagccggaccacatcacctggaccttcggcgacggcaccgacgacaccggcccgcgggtcgaacaccagtgggacaagccgggggagttcaccgtcgaggcgacggcgaccttccccggcggcgccgtcgcctccgccgacgtcaagatcgtggtgaccgtccgtcccgttctcgccctgatggcggtctacggcgggaaggtcaccgggccgggcgtcgactgcctcgccgactgcctgatccctttcgacggcgcaccgacccggaccctcaccgccgtccccgatcccggtttcgtcctgttcagctggggtggtgactgcagcgggaccgatccggtgtgcgtcgtggacaccacgaagaaccaggtggcgtcggtgaccttccaccgggtggcggtgtcgctgaccgagatggcgacggccgcgacctggaccggcggccggggcgcgccggcctcccgcggcgagatcttcgacccgaattcgaccgcccagaaggcggggggcagaggcttcgccctggtgcacccgcccgggagctggatcctggaggacggcgtcgcccccgcacccgagtatctggagacccacccgtcgtacacggagccgggatcgacgcaggacggctggatccagggcgacttcaccctgccgtcgccgatcatcttcggcgatcacttccggagccggatcggcttcatccagctcgacccgagatccggggtctcggtcggtgaggccgacttcgcggtatcggtcgtcatgcccgacggcaccgcacacgaggtcttccggacgcgcgacaaagcctccgaccgcgtgatgcccgacgtcgacgtctcgctctcctcgtggccgggcgccaccacgatccgcctccgggccgagaccgacggtccctcctcacaggactggtgcgcatgggtcaatccgcgcgtcgaaggctaa

SEQ ID NO: 829 - DNA, 2826 bp, Actinoplanes utahensis
gtgggtgcacccgctggtcgacaccgtgtacccgctgccgaccggtcgcagccaggaccaggacgggccgacctccagcgtggcgccgcagggcggaatcgccttccacagccttcgcgagtacgtgcccggcgacgactggcggctcatccactggaagtccagcgcgcgtaccggccagttgatggtgcggcacaacgtggtcccgaacgagccgcgcctcatgatcgtgctggacaccagcgtggccgcctacgacgacgagtcgttcgaacacgcggtccgggccgccgcctcgctgtcggtggccgcgctgcgcgccgggttcccgctcgaactgcgtacgaccggcggcgaggtcaccgtcgcggaagaggacgggccgggccgcacgtccgtgctggatctgctggccgccgtccgcctcgacccggccgaccggggcctggccgcgctgcccgcgctcgtccccgaacagagcgccgtctcgctgggcgtggtgaccggccggcccgcccaggccgagctggccgtgctcccgatgatcagaccccggttcctgatgctcagcctggtgcagttcgccgcgaccttccaggccgagacgcggctgcccggcgtcgtgtcggtcgccgcgaccagccccgccgaattcgccctcgcctggaacgagttggtacgccgatgagaaccggtcctctgcaccaagccgagatcgcgctgggtaccgcggccgtcgcggtgaccgcgccggtctacggcgccttcttcgtcggccggggctacctgctgccgctgctggtcgccgccgcggggggcgccacgatggccgtgctcgccgcgctgacccacctgcggcacgcgtggaccgcggtggccgtcaccggcgggttcctggtcgtggccgtctacgccgtgctgccgggcacgctgcgctacggcatcccgaccggcacgaccctgagcacgctcggcaccggggtgagtttcggctggatccggatgctcacggtgggcgtgcccgcggacgtccggggcgagttgctgatcacgccggcgctggtcctctacctgtgcggtttcgcggccgctcagctgtcgctgcgtacccggtcgctgttcgcgcccgcggccgtacccccgctcgccctgctcgccgcgctgccgctgaccgccggccggacagccggggccatgacgatcaccgcggtgatgctgttggccgggctgacccaggtgctgatccgcgcggtccggaccgagggcgccgagggcgggtcccggctggccggccgggcgctgttcgggctgccggtggtggtggcggtcgtggccgcgggaaccggtttcgcgaaggtggcgccgatcgccgggcaccagcggttcgacccgcgcacggtggtgccggtgccactcacgatcgaggacacgatcaacccgctggccgcgctgaagagccggctgcgggagaagaatccccccacccttttcacggtccggggctcaggcctggaccgggtccgcacggccgtcctggacacctacgacggcgccgagtggacctcccacgaccggttcctgctcgccgggcacgagctggcgcccggtccgggaacgccccacggtgtccaggtcggtctgcacgtgcggatcgacgcgctggaggagccgtacctgcccgaggccggctggccggaacagatcaccggatccggcatcgggtacgccgtcgcgtccggtgtgctggcgacgcccgcgaaggatcggcacggcctctcgtacgacctggtcgccaccgtccgcccgcgggacgccggggcccgcaccgcgcgaccgttcgtgccgtccccgcgctacctcgcgctgcccgccgacttcccggtcgagctgcggcaggaggcccagacgctcactgcgggcacggccggtgactacccgaggctggtcgcgctggagacgcgcctgcgggcgttgcgctacgacccggccaccccgcccggtcactcgctgcaccggctgcgcgggctcttcgggctcggcaccaaccaggtggccggatacgcggagcagcacgcggcggcgttcgccgtcctggcccgctcactgggttacccggcccgggtggcgaccggctacctgctgcggcgcaggtcacccgcgcacggcgtctacaccgtacggtccaccgacgcgtacgcctgggccgaggtcagcatggccggatacggctggatggcgttcgaccccaccaaccccgacaaccgccacaccccggcgcctccgccgaacccggtgccgaagtcgcaaccgcaggtgcggccgggcgacgtcgcaccgagcatggtggtccgccccgacctggccgcgcccgtgcagctgtcgccgtgggactgggcgctgatcgtggcggccgccctcgtcgccctcgccatcctgttgccggtcctggtcgtcgccgagaagcagcggcgcacccgcaggcgtcgtcgcggcaccccggcccagcgcatcagcggcgcctggcgggagagctccgaccggctgcgcgaggccggcgtgccgatccaccgcgcctggaccgtcctggagaccgccgaccacgcccgccgccgcctcggcgacaccacggcgccggtcgccacgctggcgcccctggtcggcgccgccctgtacgccgccgaaccgcccgccgccgaggccgcggaggaggcgtggcgcgccgacgccgccctgcggtccgcgctgcgccgcgagcgcggactgcccgccaccatggccgcgtggatcgacccgcgtccgattctgatccgcgatcggagcaactga

SEQ ID NO: 830 - DNA, 987 bp, Actinoplanes utahensis
atgacggcaccgggcgagtcggggacggggaacctgtcctgggtccgcgatcgggtgcgagccctcgtggacaacatcgagcacgtggtgcacggcaacaccgaggtggtccgcgccgcggtgacctgcctgctcgccgaggggcacctgctcatcgagggggtcccgggggtcgcgaagaccacgctcgccaaggcgatcgcccactcgatcggcggccgggtgcaccgcatccagttcacgcccgacctgctccccaccgacgtggtcggcgtcaacatctacgacgcggccaaccagcgcttcgagttccactccggtccggtgttcgcgaacatcgtgctcgccgacgagatcaaccgggcctcgccgaagacccagtcggcgctgctggaggcgatgggcgaacgtcaggtctcggtcgacgggcgcacctacgacctgcccgcgccgcacttcgtcatcgcgacccagaacccgtacgaccaccagggcacctacacgctgcccgaggcccagctggaccggttcatgatgcagctgcggctcggctacccggcgccggagcacgagatgcgggtgatcggcgacgcgatcgaccgccgcctgcccgagcagctcagcgccgtcaccgacaccgaggagctgctgcgcctcatcgaggtcgcgcgcacggtgcacgtggccgagccgatccgggcgtacgtggtcgcggtcgtcggcggtacgcgcaaccagccggacaccgtgcgcctcggcggcagcccccgggccggcaacgcgctcgcgatggcggcccaggcccgggccgcgaccgagggacgcgagtacgtactgcccgacgacgtgaaggcgatggccgttccggtcctgcggcaccggctcgtgctgacccccgaggcggcgatccggggcgccacggccgcctcggtcctggacgggatcctcgccgccgtgccggtgccgcagacggcgacggcccggtga

SEQ ID NO: 831 - DNA, 171 bp, Actinoplanes utahensis
atgttccctctgggggtggacatcggcggcaccaccgtcgccgcggccgtctggcgtcgcggccgcgccgagcaggcgttgctcgccgcccgccggcccggccgggacaccgtcctgccgctgctcggcaccgccgcgccggtgctggtccgcggcgtgccacgggcctag

SEQ ID NO: 832 - DNA, 759 bp, Actinoplanes utahensis
atggcccagttcgccgcggagcagctctacgccctcgcgcgccgcgccgggttcggaccggacgcggccgcgaccatgaccgcgatagccctggccgagtcgggtggcgacagccgggccgtcggcccgcagggtccaggcctgtggccgatcgacccggcgtccttccccgaccttgccgcccgccacgacctgaccgacccgcccggctgcgccgccgccgcgttcgagctgtccggcggcgggaccgacttctccgcgtggcgctcgacccacgccgagccggtggcccgcttcctgcgccaccgccgcaccgcccaggcggcggcgaccgcctacggcgacggtccgggtcgaggtctctggaccccggcgtccccggccgtcgagcccccgccggaccccggcgtcgagcacccgctggactccggcgtagagcccccgccggactccggcgtagagcccccgccggactccggcgtcgagcacccgctggactccggcgtagagcccccgccggactccggcgccgagcccccgccggactccggcgccgaagccgcgcggggcggcgtcattgcggccccggcgagctgccccgctggcgccgaaggcgtacagggcggcggcatcgcggacccggcgagctgcgccggcggcaccgggggtcgcgcgggagccgatgaccgcgacccggcgcgacgtgctggagctgctgtcccgggccgggctcgcggacttccccccgccgctagctag

SEQ ID NO: 833 - DNA, 1920 bp, Actinoplanes utahensis
gtggacgacgcaccggcgtgggaggttctcgccgacaccctgctgcagcgggaagccctgatctgccggatcgccgagggccggccgccgcacgactccgccggcctctacccgggacgcgacgacgacctcgaccgggtgctcggcggcctgcccggcctcgacgggccgggcagcgccgccgccgactccgtccgcgagcacctggcgccggagctggagcgggcccgcaagctgttcaccgaggcggtcgacgccggccgggacgtgttcgcgctggtggtgcaccgggccgggctgacgctcgccgaggcgcaggtgctcgccgtgctctgtgccgtggacctgtccccggcccggatgcggctggtcacgtacgtgcagaacgacatccggctcccccgtcccacgctcgccaccctcgcccggatgaccggcgacgccggttcgctgtcccccgacgcacggctgcacaccaccggcctcgtcgagaccccgcgggacggcccgtgggcacggcgttgccccgtccccgccgaccgtctgctctggtcgctgcgggggatcggcgatccggacccggacctgccgcacggcgcccgcctgatcggccggaccgcggccacgcggccgaccgcccccgttctcctgctggccgccggccgggacgccgagacccggacccgcgccgtgatcgaccgctgcccgggccggggtctgctgatcacggccccgccgcagaccgacgccgcctggtgcgccgtggtccgggaggcgaccctcggcgaccgggtcgtggtgctcgacctccctggcgagccgggcccccgcgcgggtcacgagatcctgcgcgccgcccatctcagctgggctctgacctccgccgtcgacctgccgctcgccgccctcccccgggccctctgggaggacctgcccgcagccgatccgcacgccgacgcgggcgactggtcggccgccttcgggacggcgccgggcgggcggctgacgcgcgaccagctcgggctcgtggtggcggcggccggcgggaatccggcgcggctgccgcaggcggtgcggcggctcgccggtgggcacctcgatcacctcaccacccggttgcgcccgcgccgccgctggtccgacctggtgctgccggaccggcaggcggcccgcctgcgcgaggtgatcacccgctaccggcgccgtgcggtcgtctacgacggctggggcttcgcggcggtcccgtcgaccggtgtcgtagcgctcttctccgggccgtccgggaccgggaagacgctcgccgccgaggtggtggccgccgagctgggtctggacctgtaccgggtcgacctcgccacggtggtcagcaagtacatcggggagaccgagcgcaacctggaacgggtcttcgacgcggccgccgccggcgagctggtgctcttcttcgacgaggcggacgccctgttcggccggcgctcggaggtgaccgacgcccgcgaccggtacgccaacatcgaggtcgcctacctgctccaacggctggagaaccaggacggcatcgtgatcctcgcgaccaacctgcaccgcaacatcgacgacgccttcctgcgccggatctcggtccacctcgacttcgagccgcccgacgaggcggcccgacagcggatctgggagctggccttcccgagcggcgcaccggccgacgacctcgatctgccattcctcgcggcgcagttccgggtcaccggcggcaccattcgcaatgccgctctcggggccgctttcgaagccgcggaaaacgggacgacgataaccatgggccatgtcgtacgcgccttgcggcgcgaattcgacaagatgggccggctgtgcaccgaggccgatttcgggcgctactacgcactcatcgacttgacctga

SEQ ID NO: 834 - DNA, 654 bp, Actinoplanes utahensis
atgctggatctgctcgacgaggcgctggagagctttctgcgtgcggcggtgccgctcggcgcggacgtggcggtctccttcgacgcccccgaccgggactgggccgcacggctgtccggccggccgacggtcaacctctacctctgggacgtgcgccgcaacctgggcgagcaggaggccggcgaggtgctgaccaccgggccggacgggcgccggacgcggcgcggcgcgctgccccgggtcgactgccgctatctggtcaccgcgttcaccagcgaggttcgtgacgaacacgccctgctgggccgggccctggccgcactgctgcgggagaccgagatcgacgcccggctgctgcccgagccgatcgccgcggtccgcccgctgccctcggtacggatcgcggcgagcgacggccgggacaactcggacttctggtcggcgctcggcggtcagctcaaggccggactcgacctgctggtgaccgccaccatcgacgccgtcccgctgccgcagccggccgggcccgacgtcgtacagcgggttctgcgcctgcacgacaagtccgccgcaacgctgctggaaacgataaacctcccgaacgggggaaccgacgagtcgctgccgggggccgcggtgccattgccggaataa

SEQ ID NO: 835 - DNA, 3309 bp, Actinoplanes utahensis
atgtccgtgccggtcctgcccaccgtcgagccggacgaggccggccggacgacggtcccccggacggtcccggcctcgaccgccggagcgcccacctcactgatcccggacgtcgtgctcgacgggatccacgccgcggtcaccgcgatccccggctacccactgctcacccaggtgatcggcgtcgacccgatcaccggtcacgcggtcaccacggccccgcagcagctcgtcgagtcggtgctcaccggtgcgggcccgttcggcgcggccaccggccgggtgctcgccgcggccggggtcgtcgacgaggcgctcgccgcgatacacgtgcggctggccgcgcaccggatcaccctggcccgcatcggcgacgagatcgccgccgcctgggcggagctctcggtgaccgcgggcatcgacggcaacgcggccatgctcgggcgccacgtcggcggcatggtcgccgacgtccgggccgccgtcgccgagctgatcgagaccgtgctgtccatggtccgccgggtcgtcgccgacctggccggcccgctgctgcagcgacccggggtgcggccggtgtgggagctggccacccaggtcttccggtacgacccgttgcgcggcgccgaggtgcgggtgccgaccgtcgagatcctcaccggcttcctgaccgtgatcggccgcgagcagaccatcgaccaactgcgcgaacgcggcgtcctgcagtccgccgccgactggctcgacacccgcctggagacgttcgccgggatccgcgacgacgcggtgcggctgttcgccgacgcgtgggccgccctgagcccggagagcctgccccggctgctcgacacgctcccgcagctcgccgagcgggcgatcaccctgatccggcggatcctgtcgttcggcgccgacctgctcggcaaggctctcgcactggtcaaggacgcgctgcgcggcgcgctcgcccagcgggccgcccgggtgccgggttatccgctgctgaccgtgctcatcgagcaggatccgctgaccggtgcgcgggtaccccgtaccaccgcgtccctgatcgaaggttttctgggccttctgccgggagtgggcgcggccgccgccgagcgattggccgaggccggtgtcctgaccgaggcggcggcccggatcgaggccgaggtggcccggctcggcatcggcgcggacatggtcaccgggctgttccacggcatctgggactcgctggaactggccgacctgctcgacccggccggcgcatgcgagcgggtggtggcccgattcggcgagccgctgggccggctggtcgcgttcgccacggtcgtcgtcgaggtgctcatcaccaccgcgctcaagctcatggacttcccgcccgagctgctcacgtcgatcgtcgccgacgtcgccggcgcgctcgccgacatccggcgcgacccggtcggcttcctgctcaacgtggtgcgggcgctgcggctcggcttcgcggcctttctcgacggcatcgccgggcacctgctgcgcggcctcggctcctggctgctgcgcggcctcgccgggctcggcgtagcggtcccggacggcccgatgaccacctcggccgtcctggacatggccatgcaggtgctcgggatcagcgccgagaccctctgggagaaggtcgccgtccggctcggccccgagcgcacagccgcgctgcgcaacggcacggcccgcctgggcgaggcctggcaattcgtcaccgacctccgcgaccaggggctgagcggcatcctggcgcacctcgcggaccgggtcggcgcgctctgggacaccctgatcggcctcgccaccgactggatcatgacgcaggtggtgcagcgggccgcggccagattgctgtccatgctggatccgaccggggtgatggcggtcgtcaacgggtgcgtcgcgttcttcaccgccgtccggtccgcgatcgagtacctgcgggacatcctgcggatcgtcgagggctacacgcgcacgatggcccggatcgcccgcggtgagctgacgcccggcgccgaacaggtgacccgggggctggccgacgccgtcccggtggcgatcggtttcctcgccgcgcaggtgggtctgggcaacgtgccggagaagctggtcgagctgatcgagagcctgcgcgccctgatcgaccgcgcgatcacctggctcttcgaccaggccgtccggctcggcagcggcgcgctgaacgcgctgcgcggcgaggcacccggtgcacccgcagggcacgagggcggcactcagctggccgagctcgccttcgccctgccgttcccggtcgggcccgaggagcacgaactgatcgcggacgtcgaccctcgacgcctcgtcgtccactcgaccccgacgacgatcacggatctcatcgccgccaaccccgggaccaccctgcaggccgaccacgatcgctatgtggccgcggtggacgccttcaagcaggcactcgacgagcgggcacgaaccgggtccgacgccgcgtgggccgacgccgagaagacggcgaagaagaagctggcggcggtgaagaaggccatggagaccctggtcgccaccatcactccgctgaagggcttcgacccggccgtgcccggcacgagcgctccgggaatcggcaccgaggcgtactgggacgggaaccggccgctgagcctgcagaacggctcgctcaccgcccaccggatctggcacctgaccgccgagcacgtcatcccgttcgacctcggcgtcaagctgtggaacgcggtcgccctcggcgcgcccgaacgcgacggcggcaaggaggtgacgtcgcagcggatcatcatgatctatcgcggcgcgggcgacctgaagacgaccaggagggatccggtcaccggcttcaccgaacgggagatcagccggctgttcggcagagccgtcaaggaagccgactttcccgcccgggtcagatccatcggataccgggacgacggtcccgtgccgggcgcagcgacccaggccgagcaggccagaagggaactgctcgacgccatcgaccgcgccatgtgccaggccacccaggtgtccgtgggccgaacccggtgggcggtcgagaccgagtgggcgtcgcgggggaacggcttcgccaccaccaacggccagcggcgcggcgagagcgcgccgacgcccaccggaagtcagatcgaggccaccgcggacgtgcagcgcagggacatcctgctcctggtcacccacgccgtggagcacgcactggaacaaatcgaacggagcgagtga

SEQ ID NO: 836 - DNA, 435 bp, Actinoplanes utahensis
atggtggatctgatcaccacgcagaccttcgtcctcgagatcgacagcgtcgaggtgggcagcttccgcaaggtctccgggatcgagtcggagaccgagacgatcgagtacaaggaggtgaacaaggacggcaagatgatcatccgcaagcagccgggcgcgatgaagtgggcggacatcaccctggaacgccggatcgacgtctcccaggtgctctggaactggcgcaaggacatcatcacgggcgacgtcgacaagggccgccgcaacggcgccatctcggccaaggactccaagggcgacgtcgtggcccgctgggagttcgtcgcgggctggccgtcgaagtggaccggcgccgacttcgacgccggcgccaacgacatcgccaccgagaaggtcgtcatcacgcacgaggggctggtccgcgtcaaatga

SEQ ID NO: 837 - DNA, 225 bp, Actinoplanes utahensis
atgagcctgcacaccgagttcccgttcacgctgccgaagggctacgtcgacgaggagggcacgctgcaccgcaccggcgtgatgcggctggccaccgcccgggacgagatcgagccgctgcgcgacccccgggtgcgggagaacgagtcctacgccacggtcatcgtgctggcgcgggtggtgaccgaactcggcacgctgccccccggatcaacacgggagtga

SEQ ID NO: 838 - DNA, 138 bp, Actinoplanes utahensis
gtgatcgagcggctcttcgccagcgacttcggctacctgcaggacttctaccaactgatcaacttcggggatcccgccgcgctcgacgccctggagcccggcgcccctttcccccgggtctcggtggaggtggtctag

SEQ ID NO: 839 - DNA, 471 bp, Actinoplanes utahensis
ttgctgcccggtgaccaccgtgtcccggacccgccgtggaccggacggttcgtgctgagcgtcgacggcctggagatcggcacgttcgtcgaggtcggtggcctgagcgtgaccatcgaggtggaggagatcaccgagggtgggcagaaccagcacacgcacaagctgcccggccggatgaaatggccgaacctggtgctcaagcgtggcctcaccaacgccggcaacctcttcggctggttcacctcctgctcgggtgagggtttcacccgcaaaggcaaccagcttgacgtccgcaacggcgaggtcgccattcgtgacggccgtggccgtgccgtacagacatggcggttcaccgacgcgtatccggtgcggtggaccgggccgaggctggccgcgacctcccgggacctggccgtcgaggagttggaggtctgccacagtggtttcacgatggcggccggtcgctga

SEQ ID NO: 840 - DNA, 672 bp, Actinoplanes utahensis
gtggaccagcccgccaaggcctacatcgaggtcgagcgcaccggcgagcggatcgactgcctgttcaacccggccgagctgaccgtcgtgaaggcgaacacctggcaggccggggaagcgaagggcgtcgacgcgccgctgctgcggttccaggccggccagtcggcgaccatcgcgctcagcctggtgttcgacaccaccaggacgggaggcgacgtaacctcgtacacctcgaaattgttgaatctgctccgggtcgatcccgatctgccgtcgaacgacccggcgcgcgcctccggccgcccgccctgggtgaagttccactggggtgagctgcacagtttccgcgcggtgatcgaccggctgcaggtgcggtacacctacttcgcgtccagcggacggccgctgcgcgccaaggccgacctcaccctgcgccagcttcaggacgagcacgagcatcccctgcagaaccccacgtcgcacacccccgcgccgcactccgtccacgtggtccggcccggagagacgctcgaccggatcgccgccgcgcgatacgccgatcccggccaatggcggctgatcgcggcggcgaacggcgtcctggacccgctggatctgccggccggcacctcgctggtgatcccggagaggccggtacgccgtgaccgctga

SEQ ID NO: 841 - DNA, 1641 bp, Actinoplanes utahensis
gtgaccgctgaccgggggctcgacaccgtggcgatcaccgtcgacggtgcgccgctgccgacctcgctctatccccggctgatccgggtccgggtccaggagtcgatccacctgcccgaccagttcacgatccggttcgaggacgcccacttccagctcttcgaccagcaccggttccgtcccggcacacgggtggagatcgcgttccggtccgacgccgacccggtggtggtgacctccggggaggtcaccacggtcgaggtggcgcccggcgtctccggacgtcacgagctggtgctcaccggcctggacctggcgcaccggctcgcgcgcggcccgcggacccgcagtttcaccggcatgtcggacggcgatgtcgccgcccggatcgccgccgaccacggcttggacgccgatgtggacgcgaccggcgccgcgcaggactacgtgctgcagatcgccgagaccgacctcgcgttcctgcgcgggctggccgcccggaccgggttcgacgtctgggtcaccggtgggacgctgcacttcaagcgccgcccgtcgagccgggtcacgccgcccccgatgcgctggggcgacaacctgctcgacttcagcgcccggttcgcctcggccgagcactgcgacgaggtcgtggtgaccgcctgggacccggtggagaagcggacggtgaccggacgggcggccgagccggagtacggcaccgacgcgccggccgccgcccagtcggcggaggccgcccggggcgcgttcggccgtaccgtccgccggaccggacaggtgccggcgagcgggctggccgaggcggaggcctacgcccgatcgctgttgtcgaaggcctccgggtccgaggtggtgctgcgcggcctcgcgaagggcaacccgctgatcgcggccggggcccgggtgcagctggagcgggtcgggcagcggctggccggcggctaccgggtgacctcggccgagcacgacttcggggccggcggcccgtacctgaccaggttcgtctgcggcacccgggacgcgggtgagctggccgacctgctgcgcccggcgcccggcgccgagccgcggtcgctgatcagtgccgtggtgacctcgaacgccgatccggaaaagctcggccgcgtacgcgtacgcttcccgaccctgtccgagcaggacgagagcgcctgggcccgggtcgtgacgccgggaggcggtccgggccggggcatgcagtggctgccggaggtcgaggacgaggtgctggtcgggttcgagctcgatgaccggacccgcccgtacgtcctcggtggtcttttcaaccgccgtgacgtgccgccggatccggacgtggcccgcgacggcgcggcgacccggcgggtgctcgcgagccgctgcgaccaccggctcaccttcgacgacgacagccccggcgcggtggagctggcgctgtccgggggcgactcggcgctgcgcctgaccggggacgaatcggcgctgcgggtcgccggcgccctgaaggtcaccgggcgcacgatcgagatcgccgccaccgaccggctcgtgctgcgcgcgccgaccgtcgagatcaccgcggacgccgagctgcgcgccgccggccggccgatccggctcaactga

SEQ ID NO: 842 - DNA, 396 bp, Actinoplanes utahensis
atgccgaacgcggcccgggagggcgacccggtcaccgggaccgacacccacctcgtgctggtgcccgggccgggcgggccggtgcccgtaccgcagccgctgcccttcgccgggacgctcgtcagtgggctctccccggacgtgctgatcgacgggcgaccggccgccgtcgtgggcagcggggtggtcaacagtccgggacacctgccggtcccgcccggcacgggcttcgtcaacccgccgctcaatcggggcaccgtactgagcggctcgctgaccgtgctggtcaacggcgcgggcctggcacggctgggcgacccggtgacgacctgctgtgacgtcccgggtgcgcccgccacgatcaccgcgggctcgccgggcgtggtggcgggatga

SEQ ID NO: 843 - DNA, 399 bp, Actinoplanes utahensis
atgagcgacctgatcggcgccggctgggcattccccgccggggtgacgcccgcgggcggggtgcgcctggcccggggcggcgacgagctggacggcgcgatccgcatgatcctcggcaccgcgccgggcgagcgggtgatgcgcccggacttcggctgcgcgctctgggagcaggtcttcgcgccggtcaacccggcgacgctcgggctgatcgagcaggccgcccgggaggccctggcccgctgggagccccggatcgtggtcgaggacgtgaccgcctccgcggacggcgaggccgccgtgctggtcaccgtcggctaccgggtccgggccaccaatgaccgccgcaacctggtctacccgttctacgtgatccccggtgaggagccgaccgagtga

SEQ ID NO: 844 - DNA, 1944 bp, Actinoplanes utahensis
gtgagcctgcccgcgcccgacctggacgaccgcacgttccaggacatcgtcgacgaggccaagcgccgggtcgccgccgcctgcccggcgtggaccgaccacaacgtctccgatcccggcgtcgcgctgatcgaattgttcgcctggatgaccgagatgaccatctaccggctgaaccaggtgccggaccggctctacctcaagttcctcgaactggtcggcatcacgctcgcctccgcgaccccggcccgtaccggcctgctcttccgcctcgatggaccggctcgggacacggtcgtcgtcccgcgcggcacccgggtcggcaccgcgcgcggccgcgacggtgaccaggtcgtcttcatgaccgacgcggacctgcgggtcactgtccccgaggtgatcgcgtgccggaccaggaccggcgggaccgacaccgaccacaccggtgagctgcgagccggggaggcgcgcatcgcggtcttccccggggtggccgccggcgacgcgctctacctcggcctgagcgcggaccacggcggcaacctgctgcagctcgacctcgccgtcgcgggcgcgcacggcgccggcatcgacccggagcacgccccgatcgtctggcagtactggaacgggggcgggtgggaggacgtacgggtactcaccgacacgaccggcggcctgaaccgccccgggaccgtcgagatgctgatcggcccggtgcagggtgagctggtgatcgggggcgtgccggcgcactggctgcgctgcgtgctgcgcccggccgccgggcagaccggataccggacctcgccgatcctgcggtcggtggcgatcgggggctacggcgggctggcgccggccctgcacgccgagcccgcgccgggcgagctgctcggagtcagcgacggccggcccgggcagacgttcgtggtccgccgcgcacccgtgctaccccgggccgacggcgagaccgtgctggtggtccccggcaacggtgccggccaacccgaggagtggaccgaggtggcgtcgttcgccggcgccggaccggacgaccggcatctcacctggtgcggcgccaccggcgagatccggttcggcccgcgggtcatcgaccggcacggccaggcccgcagtttcggagccgtgccgccggagaacgcgcagatccgggtcaccggataccggttcggcggcggggcgcgcggcaacgtgggcgccggaaaactcacggtgccgctctccgccgtgccgcagctgcgcacggtcaccaacccggaggccgccacgggcggcgccgacccggagaccacggacaacgcccggatccgcgggccgctggcgctgcgcagcgccgaccgggcggtcaccgcggccgacttcgagcggttcaccaccgaggtctccggcgtggcgcgggcccgctgcctcccgccggacgagccgggcgggccggtccggctgctggtggtgccggcgaccgcgcggtcgccccggcacctcgggctcgacgatctccgactgccggaggcggtcggcgaggacatccgtcaggagctggacggccggcgcctgctgagcgtgcgggtccgcgtcgaggttccccgctaccagggcatccgggtcagcgccggggtacgggccaccgccacggtctccgcggacgtggtcgggcaggacgccgaggacgcgctctaccggttcctcgacccggtggccggtggtccgggcggtcacggctggccgttcgagcgcgcgctcggggtcggcgacatctacctggtcctgggcgcggtgccgggagtggccgccgtgacctcggtcaatctcacgctgaccgatctgtggggtgagcgcgaggacgctcccgggggccaggaggtaccgctcgtaccgtccgcactcttcctctccgaccggcacacggtggcggtggcctggtga

SEQ ID NO: 845 - DNA, 504 bp, Actinoplanes utahensis
gtgacctggctgctcgcccaactgccgcagacgatggcccgtgacccgttcctggccgggttcgtcaccggttgccagcaggtggcggactccgtccgggcccagatcgacgacctggaacacgagctcgacgtcgacctggcctcaccggagatgctcgcgtacctcgggtcctggctcgcggtctcgctgcggccggccaccaccccggccgagctggacgaccagcgtcggctgatccgcgcggtcggatcggtgatcgggtaccggggcacctgttacgggctcgaacgcctgctgagcgcactgaccggggcccacgtcacgatcggcgacccgggcggggtggcgttgcccggtgaaccggaccggccgggtggtgacgtacggatcgagatgtccggcaccgggaggtgtgacgtggcccaggtgcacgcggcgatccgggaggagctgccggtcggcgtcggctaccggctcgtcgtggccggccgggagcagtga

SEQ ID NO: 846 - DNA, 234 bp, Actinoplanes utahensis
atgatcggcatgaccgccgacgaacacgccgcccgcgccgccgagctcatcgacgaggcggagcgcctctaccagatctgcctcgtcgactatcacaccaacatcaacgaggacgatcactccgaggagccgtacgtgccgggcgcggacctggcgatgctcaccgccaccacgcagctcgcccaggtccacgccactctcgcactgcgcggcccggccgccgcgaacggctga

SEQ ID NO: 847 - DNA, 399 bp, Actinoplanes utahensis
atggtgcccttgatcttgtctcatataaagatcatctttatattgggcggcatgacggaaccgatgcgcgaccccagcttctgggttctcaccgccctggcgcccgagccgcggcacggctacggggtgatccgggaggtgaaccgactctccgacggccaggtgacgttgcaggccgggaccctgtacgcggccctcgaccggctcacctcgctcggcctcatcgaggcggaccgtgaggagacggtggacgggcggccgcgacggtactaccggctgaccaccgacggcgccgccgcgctggacgccgagacggagcggcggcgggcggcggtcgccgcggccaccgcgcagctgtcggcgcgccgccggctcgggctgagcctgagcacctcgtga

SEQ ID NO: 848 - DNA, 1410 bp, Actinoplanes utahensis
gtgagcgagcggctggcccgccggtatgcccggctgctccggtgctatccgcccggcccccgccgcgccgagatgctcggcaccctgctggaatgcgcgccgcccggacgcgaccggccgaccgcggtggacatcgtgaacctgacccgttacgggctgcgggcccgcctcggccggcccgcgagcaccagcgtggtgctgctgtccctgctggtcgcgctcgtctgcgggctgctgggcgcggccaccggcgcccgcctgggctggatgctgcagaagccgctgccctcgggggcgcaggcgcgagagctcacgacggccgccttccccgggctgccggtgctcggtggcggcgacgccccgccgttcgtaccggcctccggcgcggacggcggtgaggtctacggcttcgccgagtactgggtgcgcaacaccccggagacccgcgacgtgccagcctacaccagaggcgtccgggaccggctggccggtgcgggctggcagatccgcgacgacgtcaccgccgagcaggacgacgagcaagcgtcgtggagcgccgggttcaccgccacccgggacgacctgatcctgaactacagcgcctactacgtgaaggaccacccctggtacgactcggacggctcggccggcttccagttgtcccgcacgacgccaccgtggccggcccggttcgcggtgccggccgggctgctcgcggcatgcgccggctggctgctgttcggctgggcgagccgacgcagcgagggccgtccggcccggaccagaggcgccgtcctgctcgtctggtcggcgatgctcgtggtcgcggcgagtctgtacttcatctgcctgtggtacacccagcccgggccgctggagggccgcccgctgtggacgaccctggatcagctgtccggggcacccaccacgctggtgttcggcctgggcatgctggcgctggtgacggccgccctgccggcccggcacaggatcctcgcggcggcggcgctggtgctgttcatggtggtcgccatgaacggccggccgagctggacacgaccgggatgcaccccgtccgggccgcccgccgcgctgccggccgccgaggtggccaccggcctgacggcccgcgtctacgtgaccggcgacgcctccgccgaacagcgcaacatcgcccaggccgcgatctggcatgtgccgtccgtgcggtccacggcctggtccggcgacgtgaccgaccaggactaccgcgacgcgtactgcggcggcggccggatcaccggtgcctcgcgggcgacgctgcccgggttctggctggtggagctgagcagccccggcgggttcgacggcctggtggccgaggtgggcggcctgcccggggtggcggccgtccggcactccgccccctga

SEQ ID NO: 849 - DNA, 1455 bp, Actinoplanes utahensis
atgaccggcctgcggtcggtgcgcgcccgatccgcgctggcggccgccgcggcggccgccgtgatactgaccggcgggggactgtgggcccggcacttcgtcggtcagcagcagctggaagcgggccggcgcagcgccgtccagcaggtcaacgccatgggtctggcggcgaccacgatcgggacgggcggcgcggaggaactgcggcccgccttctaccccgacgtcaccttcgaggtggtcgacaccaccggggcggtgctctcggccagccccgacctggccccgtacgagagcgacgggcgggccgtcatgccggcggcggacccgctgcccggcgacatttcgatggacacgccggaggtctccgccacggtccggctggccgacccacccggagaccacgccctcgacggccggaccgtcaccggcgtccggatccagggcgcccccgtcagcatgaccgaccacccggaactcgggccgacgttcgccgtctacgtgttcgtcaccccgctcgccgcggagcgggcggtggccaccgtcgaccggatcctcgtcggcgccgtcccgctggccgtcctggtggtggccctggtcgcgtggttcgccacccgccgggcgttacgccccgtggaggccatccgggcccggacggcggaggtcaccgccagccggctcgccgaccgcgtcgaggtgccggccaccggcgacgagatcgcggcgctggccaccaccatcaacgccatgctggaccggctgcagcgcgccgatcgggcccagcgccggatggtctccgacgccgcccacgagctgcgcagcccgctggcgatcctgcgggccggcctggaggtggcccaggcgtatccggaccgcacggactggccggccaccgcggcgaccgcggtggcccaggcccagcggctcaccggcctggccgacgacctgctcctgctggcccgcctggacgcgggcaccgcgccaccgcaaccggaggtcgacgccgacgtcgtcgccgtgctgtcccggatggcggtcgagaccatcacccgcgacggcgtcacggtgaccggccccgccggcccgcccgtgccggtacggctcgcccgggtcccgttcgaacgcatcgtccgcaacctgctcgacaacgccgtccggcatgccggacggcgcgtcgagatccggatcaccgccgacccggccgccgccgggcggacccggctgcgggtcgaggtcgccgacgacggcccgggcatccacccgggcgaccgtgaccggatcttcgaccgcttcacccgggtggacgccgcgcgggaccggcacgccggcggcgccggcctcggactgtcgctcgcgcgggagctggccacccagctcgggggaatcctgcgggtggcggaccggcccgtccccggggcgacgttcgagctgaccctgaccgtcaccgccgcctga

SEQ ID NO: 850 - DNA, 693 bp, Actinoplanes utahensis
atgctgcacgccatgcgcctgctggtgatcgaggacgagcccgagttggcgaccatcctgcaacggggactgacggccgaggggtacaccgtcgacgtcgccggtgacggacgggtcgcgctggacctggcccgcttcgaggactacgcgggcatcgtgctcgacctgatgctgccgggactcaacggctaccgtgtctgcgcgacgttgcgccgtgaggggatccgcaccccgatcctggtgctgaccgcgaaggacggcgactacgaccagatcgaggcgctcgacaccggtgccgacgacttcctgagcaaaccgttctcctacccggtgctggtcgcccggctgcgggcgctggtgcgccgcggtccggccgccgtcccggtccggctcaccgtcggcgacctcgtcctggaacgggccgcgcggacctgccggcgcggtacggtgccgatcaccttgaccccccgcgagttcgcgatcctggacctcctcgcgcaccgtgcgggcgagccggtcaccaaactggagatcctgcgtcaggtctggcccgaggacgtggacgacccgaacctggtcgaggtgcgcgtcggccggctccgccgcaagatcgatctgcccttcgggcgcagcagcctgcgtacggtgcggggcaccggttaccgcctcgtcgacgaccgggcggcggcatga

SEQ ID NO: 851 - DNA, 1389 bp, Actinoplanes utahensis
atgatcgtcctcagccacgacgtggtcccggcggcgcgcgccaccccggtgcgccgctccggcgccgtgctcgcctggtccggcgccggcggactcgccgtgatctacctgctgctgtccctgctcaaccatcggcggctccggaccaccgggttcgacctgggcatcttcgaacaggcggtgcgttcgtacgccgcgggccggcccggcctcgtaccgctcaaggggcccggtttcccgcagctcggtgaccatttctcgcccgtgctggccctgctggcaccgctctaccggatctttcccacaccggtgacgctgctcgtggcccaggcgctgctgctggcggtcgccgtcgtaccgatcatgtcgctcgcccaccggcggctcggcgcgttcgcggcggtgaccgccggggcgggctacggactgtcctgggggatcgcgtcggccgtcggcttcgacttccacgaggtgtgcttcgcggtgccgctgctgtcgttcagcctcgccgcgctcgccgaccggcggctgcgggcggccagcgggtgggcgctgcccctgctgctggtcaaggaggacctgggcctgaccgtggcggtgatcggcctgctcgtcgcggccttcggggcccgccgcctgggtggcgggctcgccgccgccgggctgctcggcaccgcactggcgatgggggtcgtcgtccccgccctgaacccggacgacgcctacgcctattcggcggcggtgggttccgggctgcagcatccggtgacggcggtcaagctgctgaccgtgctcgccctgctggcgccgaccgccggcgtcgcgctgcgatcaccgctggcctgggtcgcggtaccgacgctgctctggcgcttcgcctccggcaacccgaactactggggcaccggcttccactacagcgccgtcctgatgccggtcatgatgctggcgttcgtcgacggcctgacgcgccggcggcccgccgcggaccgcaccggtgccgcggcgacccggctcgtgctggtggccagcctcgccgtcaccgggttcctgctgccgcggtacccgctggcgcagttggcctcggcgccgatctggcggggcgacccccgcggtaccgccgcgcatcgggtcctcgacctgattccggacggcgcgacggtgtccgccgccaaccggctcgttccgcagctgaccggacggacgacggtcacgctgttcgggctggactatccgggcccggctccccggtacgtcgtggtcgacctggaagtcgacgactggccgctgccgcgcgacatccggctcgccagggtcgaggccctggtggccgccggctaccggacggtcaccagggacagtggattcgtgctgctcgaacgtccctga

SEQ ID NO: 852 - DNA, 462 bp, Actinoplanes utahensis
atgtcctcacctgggagtccgctcttgtccagtcgtcagttcgtcaccttcgaggtcgccggtcagttcttcggcgtggatgtggacgccgtccaggaggtgttgtcctacagcgagtacaccccggtgccgatggcccccaccgcggtcggcggcctgttcaacctgcgcggtcaggtgatcgccgcggtggacctgcgggtgcagttcggtctgccccgccgggacatgaccggcctggtgatgaacgtgatcgtccggcacgacggcgagccggtgagcctgctggtggaccgcatcggccaggtcgcgtacctggacgcgcagatgttcgaggagccgccggcgacgctgaccggcccgtcccgggcgctggtcaccggtgcgtacaagaccgagggccggttgctgctggtgctcgacgtcgccgagtgcgtgaacacctcgcgcgtcaccgcctga

SEQ ID NO: 853 - DNA, 825 bp, Actinoplanes utahensis
gtggagctgggcaccgcggtcatcccgatcggctacgagagcccgttccgcctcgccgaggacctgtcgctggccgacgtgctgtcccgcgggcgcctgcaggccgggttcagcgccgggaccccgccgcacgccgagctcctcgggccgctggtgttcgacggcgactggcgcggcttcgacctgtcgcacgggcggatcgcccgcctggccgacaacctgcgcggggactacctgggcgggccggatacggtgatccggtcgccgggcaacacccagcggccccggctgcagccgcacaatccgggtctgatcgaccggctctggtacggcgtgggcagcgccacgtcggcccgctgggccggggcgaacggcctgaacctgctcagcggcaacatcgtcgccggcgagcggcacgacgacttcgccgccgcccagctgcacctgctcgaggaataccggcgcgacgtcgcgccgggccggccggcccgggtcgcgatcggccgggtgatcgtgccgaccgacagtgccgatcggaccacccgggaccgctatcgggcgtacgcggcgagccgtcacgaccgcaccggcaagccacagggcgagcggcggatcctgttcgcccccgacctcgtcggcccggccgcggagatcgtcgagcggctcaccgccgacccggtgctggcccgggtgtcggagctgaggctggagctgccgtacgaattccgccgcgacgactacgagcagatcctgcacgacacggtacggctgatcgcgcccgccctgggccggcgcggcgccgcaccggccgccgcccgggcctga

SEQ ID NO: 854 - DNA, 630 bp, Actinoplanes utahensis
atgagtgcgacgtgggagcagccgcagccgtgggctgtgccactggtcagtgtgtcgctcggtggcggtgaggcgcgcacctgccgggtcacccggcaggccgacggcaccctgcgcctcgggctgaccgggttcgcgatgatcggggtcgacgccacgctgctgtggacccagaacaatcgcgggtgcagcatcgacggcacggtgatcgccccgccggccggcagcctccccggcgtctacctgcgggtggacggggcggccggcggcatccagcggcggcggaccgagcgggtgcgggtgcagttgccggccgcggtgcggctgccgtccggacagctgttccccggccggacggtcgacctgtcggccggtggggcgcacgtgaccgtcgacctggaggagatcggcgacgaggcgctgatccggctcgtcgaggacctggaacgcgacgtcctgatcgaggtgcagatcgggctgccggacgggctggccgggatcacctgtcaggtccgggccggcggcgacgagccgggcgacgtgcgcctgctgttcatcaacatgaaccccgaggtccgggcccgggtcgtccggttcgtcgaggcgagtgccccggccgtggtcggctga

SEQ ID NO: 855 - DNA, 1245 bp, Actinoplanes utahensis
atgctggaaccgaccacaaacaccgacaccacggctgcggtacgccccctgcgccgccgtacgctgctcaccgcgaccctcgccgccgggatcggcctggccgcgggcatcggacccgctgtccccgccgctgcccgtcgtcggtcgaccgggggatacgtcctgcccgcgccgaccggcaccgccggggtcggcaccgtcgccctgcacctgcgggacacgagccgcatcgatccgtgggtgcccggtcgccgggcccgggagatcatgatccagatctggtatccggcccgggaccttcgcggccatctgccggagccgtggctgtcacccggcgcggtgccgcatttcgccgagaccttcggcctgcccgccgaccggatcctgagcacccgcacgcacggccggaccggggcgccggtcctgcgcaggaccggcggtcacccggtgctgctgtattcaccgggcctgggcggcgatcgcggcaccggtaccgtcctcgtcgaggaactggccgcccacggctacctcgtcgtgaccatcgatcacacccacgacgcctccgaggtcgagttccccggcgggcgggtcgaggtcgccgccctcccgccggatctcaccgacgaggtcgtcgtccaggccgccgccgtccgtgccgccgacacccggttcgtcctcgaccagctggccgtcctcgacgccggtggccatccggacgtcggccgccggcggctgccggacggtctgcgcggcgcgttcgacctgcaccgcatcggcatgttcggtcattccctcggtggcagcaccgccgccgccgtgatgcacgacgatcgccgcgtcaaggccggcgtcaacctggacggcaccttcgtcggccccgccgcggccggtggttcgacccggccgttcctgctggtcagcagcgaccacgggcccggcgccgaggatcccacctggaacacgttctgggccgcccaccgcggctggaagcgccagctgagactgcgcgactcggtccacgggtcgttcaacgacggcatcgccctctatccccaggccggcaccgagatcgggctcaccccgcaacagctggcggacctggtcggaaccctcgacccggcacgatccatcgggatccagcgcacctatctgcgcgccttcttcgaccggcacctgcgaggccgggacggtcgcctgctcgccgccccggacccgcgttacccggagatcgacttcgtccggtga

SEQ ID NO: 856 - DNA, 1092 bp, Actinoplanes utahensis
gtgccggccggcgcggcccgcacctggcgggttgccgtccacacgctcgcgggcctgccgctcggcgtgctcggtctcgcgctgaccggcgtgctgccggttggcgccgtctactgcgcgggctggagcctgctgtacgccggccccggcgactggccggcgactgccgggttcgtgctgctcgccgtggtcgcgccggggctggcaccggaggccgcgcggcgcctgaccggggtgcagcggcggcggttccgggtgctgctcggcgccgacatcccaccgccggtccggccggcccgcgggcggcagatcgcctatcacctgctggcctgcttcaccggcgtggcgttcgccgttctggtgctcgtggcgccctggacggccgcccgggtggcccgcgccgacacggccctggcgcgcgccctgctcggccccggccgccgggcggagctgtcgatgcgggtggagtcgctggcccggagccgggccgacgtcgtcgccgcgaccgacgccgaacgccgcaggatcgaacgcgacctgcacgacggcgcccagcagcggctggtgtcgctcgcgatgaacctgggcatggcccgcgccaccctcgccgggacatccgggccggcgatgcgggcgatcgaggacgcccacgacgaggccgttcaggcgctcgccgagatgcgcgagttcgtccgggggctgcatcccgccgtgctcgacgaccgcgggctggacgcggcgctgtccggcatcgccgcccgggccccgctgccggtccggctgctcgtcgacgtgccggcgcggtgctcgccggtggtcgaggcgatcgcctacttcgtcgtctccgaggcgctcaccaacgtcagcaagcatgccggcgccacccgcgccgaggtgatcgtcgaacgcgccgccgaccggctccgggtcgtcgtcaccgacgacggccggggtggcgcgaccaccggcggcgacggcaccgggctggtcggactggcccggcgtgcggccgccgtcgacgggacgttcgcgctgcacagcccgaccggcgggccgaccacgatcaccgtggagttgccgtgcggatcgtga

SEQ ID NO: 857 - DNA, 642 bp, Actinoplanes utahensis
gtgcggatcgtgatcgccgaggattcggtgctgctgcgggccggtctgaccaaactgctcaccgacggcggtttcgacgtcgtcgaggcggtcgccgacgccgtcgagctgctgcgcgcggtagcggcgcaccggcccgatgtggcgctcgtcgacgtccggatgccaccgtcgcacaccgacgagggcatccgggccgccctggtcatccatcacgagttcccggccgtcgccgtcgtcgtgctgtcccagttcgtcgaggagcggtacgccaccgacctgctgtccgtccggaccagcggcgtcggctatctgctgaaggaccgggtggcacacgtgccggacttcctggccgccatgcgccgggtcgccgccggcggtaccgcgctcgaccccgaggtggtcgcccagctgctcgtgcggcatcgggccgacccgctgcagcggctcaccccccgggagtcggaggtgctgcggctgatggccgagggccggtccaacaacggcatcgccggcgagctgagggtcagtcacagcgcggtggagaagtacatcggcagcatcttcaccaagctggatcttccgcacaccgactccgaccatcgccgggtcctcgccgtcctccggtatctgcgcccctga

SEQ ID NO: 858 - DNA, 348 bp, Actinoplanes utahensis
atgcgccacatccggattaagggcgcgcccaccggtcttgagcgtggtgtgactatcgatccggcgccgctgttcaccccgtacaagatcggcgatatcgatcttgccaaccgcttcgtgatggcgccgatgacgcggcagttctcgcccggtggggttcccggcgaggatgtcgcggcctactacgcgcggcgcgccccgcacgtcgggctgatcgtcaccgagggcacctacgtcgaccacccgtcggccgggtccagcgaccgggtcccgcgcttctacggcgcggacgcgctggccggctggcgggccgtcgccgaggccgtccacgcggccggcggcccctag

SEQ ID NO: 859 - DNA, 654 bp, Actinoplanes utahensis
gtggccgcgttcgccaccgcggcccgcgacgcgcagctcgccggcttcgacggcgtggagctgcacggagcacacggctacctgctggaccagttcctctgggcgggcaccaaccaccgcggcgacgggtacggcggcagcctcgccaaccgggcccggctcggcgccgaggtggtcgccgcggtccgggcgaccgtcggaccggacttcccggtgctgttccggttctcgcagtggaagggcacccatttcgacgcgcggatcgccgacacccccggtgagctggagcagatcctcgccccgctggtcgacgccggggtcaccggcctgcacgtctccacccggcggtactggacggcggccttcgagggttcgccgctgaccctcgccggctggaccaggaaggtgaccgggctgccggtcgtggcgatcggctcggtcggggtcgcgcaggccttccgcggcgagaccgaggagccggcaccgaccctcagcgtcgcgccgctgctcgagctcttcgaacgcggcgagttcgacctggtcggcctgggacgcgccctgctctccgagccggcctggccgacgaagctgcgcgcgggccggttggccgacatccgcccgtacgacaaggcggacgaggcccgcctcagctga

SEQ ID NO: 860 - DNA, 444 bp, Actinoplanes utahensis
gtgacccgtgacgatgccggcgccgcgctcgcggatctcgccgacctgatcctcaacgtcggccgcctggtgcgcgcccgcacgccggacgagagtccggacgtggtgccgttgaccgagaccgagcggcaggtgatgcgcatcgtcgacctccacccgggcgccgcgcccagcgagatcgcccggcgcacccggctgcagcgcaccaacgtcagcacggcgctgcgcgggctggagggcaagggcatggtgtcgcgtgccgcgaccgccggccgcggcgtcgccgtgcacccgaccgagctggccgcggccaacctgcgggtgctgcgcgcggcctgggcgcgcgagctcgccggcgacctgggcgacgacctggacgcggtccgccggtgcaccgacctcctcggccggttggagcggcagctcaccgccgacgagccctga

SEQ ID NO: 861 - DNA, 1185 bp, Actinoplanes utahensis
gtgtccataactcaagctccgcccacggcgcggcaccgggcgcggctggccctgatcctgggcgcgttgagcgcgttcggcgcgctcaccatcgacatgtacctgccggccatgcccgggatggccgacgagttggacgccggcgcgaccctggtacagctcaccctgacggtgttcgtcgtcgggctcgccgtcggccaggtgatcgtcggcccgctctcggacgcctggggccggcggcggccgctgctcgccgggatggcgctctacgtgaccggatcgctgtggtgcgcgctctcccccaccgccggctatctgatcggcggccgcgtgctgcagtcgctgggcgcggcggccggcaccgtcctggcccgggccatcgtccgcgacctctaccagggcaccgccatgacccgcttcttcgccaccctgatggtggtcaacggggtcgcaccgatcgtcgcgccggtcatcggcggccagctgctcaccttcaccacctggcgggcggtgttcctggtgctggccgcggtcggcgccatcctcctggtcactgtcgccctcgccctgcccgaatcgctgccccgggaacggcgtgcgccggcacacccgcgggcgaccctgcgggcgttccgcacgctcggcaccgaccggcactatctgcgctacgtcgtcgccgcggcgctgatgttcgcggccgtcttcgcctacatctccggctcgtcgttcgtcctgcaggacgcctacggactcagcgcgcagcagttcagcctggtcttcggcctcaacgggctcggcatcgtggtgttcgggcagatcggcggcatgctcgtcggccgggtcaccggcgagcacaccctgctgcgggtcagcctctcgatcgccgtcctcggctcggccggggtgctggtctgcgccgtcgccggcctgccgctgcccctgctgctggccttcctgttcctgccggtcgccatgctcggcatcgtgctggccaacgccacctcgctggccctggccgggcacgggtcggccgccggggccgcctcgtccctgcagggcctgctgcagttcctggtgggcagcctcgccgcctcggcgatgacgctggccggtccggcgaccgccatcacgatgggcgccaccatggtgatctgctcgatcgccgccctcgccaccctgcgctga

SEQ ID NO: 862 - DNA, 1608 bp, Actinoplanes utahensis
atgatgatcgcacgaatttttgcgccattgatgctggcagtcaccaaccgccgggtcggcaccaagatactgctggcggtcgccacgatggcgatcgcgacggtggccgtcggcatcgccgcgatctccggcatgcggcagatgcgggccgccgccgactacgtctaccagcagaatctggtgccgatcacccaggtgacggcgatgcagcggtcggccggcgtcaccaaggccagcctgctcaccgcggccttgtcgcggcagggcgtcgaggcccgcttcgaccagggcgaggatgccgctttcgacgccgccttcgcggcttacacctcctccgacatgcgcggccgggaggcggaggtggcgaccgtgagcgatgccgtacacacttatcggaaattgcgcgacgaacaattgttgccggccatccgcaatcatgaccgggccgcattcgtcagcgtctggggcggcgcgatgacaaccacctcggaccggctggacggcagtctgcagaaactcgtcggcatcgagaccggggtggcccgggagaagaacgccgccaccgcggacaccttccggcaggcggtgatcgtcctcggtgtggtcagcgtggtggggatgatcgcggccgggctgttcggggcggcggtcgccgggtcgatctcgcggaggttgaaccggtgcgtgacggtgctgcgcagcatcgcggacggcgacctgaccgcccgcaccgaggtgaccggcagcgacgaggtggccgggctggccgcgaccctggaccggacgaccgccgccaccgcggccatggtcggcgggatggcggacgacgcggccttcttcgggtcggcgtcgcagcagctctccgaggtgtcgacgcacctgtccacggcggcggagcagacctccggccgggcggtcgcggtctccgcggcggccgaggaggtgtgccggcacgtgcagaccgtcgccgcgggcgccgagcagatgggcgcctcgatcgccgagatcgccagcaacgccaccgaggcggcccgggtgtcggcgcgcgccagcagctcggcggagcgcaccaacgacgtgctcgcccagttggaccactcgtcggcggagatcggcgacgtcgtgacgatcatcaacgtgatcgcgcagcagaccaacctgctcgctctcaacgcgaccatcgaggcggcccgggtcggtgaggccggcaaggggttcgcggtggtcgccggcgaggtgaagacactggcccaggagaccgccaaggcgacgcaggacatctccgagcgggtggccgccattcagcgggacgcggccgaggcgctgaccgcggtcgccgagatcgccgaggtgaccgggcagatcaacagctacgcggggacgatcgcggcggcggtcgaggagcagagcgccaccaccgccgagatggcccgcagcgtggcgcacgccgcgaccgggtcgagcgacatcgcggtggcggtggccgaggtggccgaggtggccgccggcaccgcgaccagtgccacccagacccgggcgacggccggcgggctggcggagcgggccggcgtcctgcagcggaccgccaccagctatcgcacggcgtga

SEQ ID NO: 863 - DNA, 612 bp, Actinoplanes utahensis
gtggccgggcgacgcgagcacaacaagcgggagacccgccggtcgctgcaggacgcggcgcgccggctgttcgaggaacgcggcttcgacgaggtctgcgtcgaggacatcgccaccgaggtgccggtgtcgcggcggaccttcttcaactacttcgactccaaggaggcggcgctggtcgacccgggcccgtcgcgggtcgacacgctcgccgctctgctggccggccgcccggcggacgaaccgctgctcaacagcctgtgcacggtgcacattcagtttctgatgaccgacccggaggatctcgccgcccggatgcgcctggtgcgggccaacccggcgctgcggcaacggtggatcaccgcgatcgagaccttcgacgccgaggtcgtccgctgggcctgtacccgtaccgggctgcccccggaggcggtgtatccgcagttgctggccgggatcgccggcaccgtgtcccggctcgccatggagcactgggacccggacaccgcacccgagcggctcgccgaggtgatctcctgcatctaccgcctgctggccgcgctgggcaacgacgcggacctgccgccggccgaccgcggctgcgagcactga

SEQ ID NO: 864 - DNA, 1845 bp, Actinoplanes utahensis
atgaatttccggcaatcggcggtcgtcgttcacggcatccatgcggcgtacattccggtggcttatgcggcggtgaccctgtccgccgtggcggcggccgtggcgccgccgcgcatgctgatgttcggcatgctggcggtcgggccggcgttcgtcgccgccaccgcccggccggtggcggtcctcggtgtgggcggctatgcgctggccgccgcgttcacggtctccacctggcagggcctgctcggcaccgccgaccaggtcctgcgactgatgctgatcgtggtgatgaccgtggtcagctggtcggtcgcccgacacctcggactgctgctgcgcgccgccactgtcgccgcccaggagcggcagatgctggcggccgtcgtcgagcagtccgccgacgggatcatcgtgacctcgctcgacggggtggtgacccactggaacggcggcgccgaacagctctaccgccagtcggccgaccaggtcgtcgggaccgggttcggccggttcctgccggccgaccggcaggccgccttcgggcgggcgctggcctcgctggccgccggtgagcgcgtccacctcgacgaggcccgccggatccgcgccgacggcgccgagatgctggtctccgtcgcggtgtcgccgatccgcgacgagaccggcgaggtggtcgcgacggcttccaccgagcgcgacatcaccgaggtcaagcggcgcgaggcggaggagcggctggcccgcgaacggtcggcgcgggccgcccggctggaaagcctcggacagctggccagcggggtggcgcacgacttcaacaacctgctcgccatcatcctgaactacgccgacttcctcaccgaggaggtcaccgaggacggcagccgggacctggcccggatccgcgacgccgcggaccgggcacgcgcgctgaccggacagctgctgctgttcgccaagcaggagtccgccacggtggagatcgtcgacctgaacgaggtggtcagcgcgtccagcgagctgctcacccggaccatcggggccaacatcagtctgctctgccggccgcacccgcaggccctcccggtcagcgccaaccgggggcgcctcgaccagatcctgctcaacctggtgatcaacgcccgggacgcgatgcccgacggcggggtggtgctgatcgagaccggccgggcgccgggccgccgggtgcggatgacggtcagcgacaccggatgcggcatgtcaccggaggtcaaggaccggctgttcgagccgttcttcacgaccaagccggccgaccgcggcaccggcctgggcctggccaccgtctacggcatcgtcggcgacgccggcggcagcatccaggtggactccacgcccggggtcggcaccaccttcgagatcctgctgccgctggccggcgacaccaccgggcaggagccggagccggacgcgcaccgcccggtcaccgggcacggcgagcggatcctgctggtcgaggacgacgagttcgttcgcgacctggtggtccgcatcctgaacggcaacgggtaccagaccgtcccgctcgacgagaacgccgccggggacgccgacgtggccggcgccgcggtactgctcagcgacatcatgctgcggttccggtccggtccggcgatcgccgatcaactgcgtacccgtcatcccgatctccgggtggtgttcatgtccggttacagcgatgaggagctccgccaccggtacgacctcagcgcggcgaccggcatcctgcagaagccgttcaccgccgtggaactgctcgccgccgtcggaacagcgctgacccccgcggtcagccggcgtggctag

SEQ ID NO: 865 - DNA, 1713 bp, Actinoplanes utahensis
gtgaggaaaccctggagcgcgcgagcgatcctcgcgccggtcgtggcggctaccctgatcgggaccgccgcgtgcagcgggtcgagcggcacgaccaccaatcaggctgccccgccgccgaaggcgagcgagaaccagatcaacccgaagtcgcgcgaccaggtcaaggacggcggcacgctgacctgggcgctgagcggcttcccggcgaacttcaactactacgagctggacggcaccgacgtcgacgccagctacgtcaacctggcgatgatgccgcagctgtacaactacgaggctgacgccaccccggtctggaacaagaactacctcgcctccgagccggtcctcaagaccgacccgaagcaggtcgtcaccttcgagctgaacccgaaggccacctggaacgacggcgccccgatcacctgggaggacctctactggcagtggaagtccaccagcggggcggacaaggcgtacaacatctcggcctccaacggctacgagaacatcgagagcgtcgccaagggcaaggacgaccacgaggcgatcgtcaccttcaagacgaagtacgccgactggcagtcgctgttcaccccgttctacccggcgtcgacgaacaaggacccgaagaccttcaacgcgggctggcagaagtccccgctgaagaccaccgcgggcccgttcaagttcgactccgcggacgccaccgcgaagaccatcaccctggtccgcaacgagaagtggtggggcgacccggccaagctcgacaagatcgtcttccgggcgatcgagccgaacgcgcaggtcgacgcgctggccaacggtgagatcgacttcgtcgacatcggctccaacgtggacgcctaccagcgcgccctgaagatcagcaccgcggagatccgcaaggcggccggcccgaacttccggcacctgacgatcaacggcaccagcaccgtgctgtccgacgtcaaggtgcgccaggcgctcgcccaggcgatcgaccggaccgccatcgccaaggccctgaccggcccgctcggcatcgatcccaaggcgctcaacaaccacatcttcatgtcgaaccaggccggttaccaggacaactccggtgacatcggcaagtacgacgtggagaaggccaaggcgggcctggacgcggccggctggaagctcaacggcgacacccgcgagaaggacggcaagaagctcgagatcaactttgtgatcccgaccggcgtcaagtcctccgagcaggagtcccagctggtgcagaacatgctggcccaggtcggcgccaaggtgaagatcaacgcggtgccggtcgacgacttcttcgacaagtacgtcaccccgggcaacttcgacatgacggtcttcgcctggatcggcacccagttcccggtcagctccgccaagtcgatctacgcgaacccgaccaagaacgccaagggtgagctggacatccagcagaactacgcccgggtcggctcgcccgagctggacaccaccttcaacaacgcgaccgccgagctggacaagaccaaggcggccacgctggccaaccaggccgacgcccagatctggcaggaggttcactcgctgaccctctaccagcgcccggagctgatcgccaccaagaaggacctggccaacttcggcgccaagggcttcgccagcgtcatctacgagaacatcggtttcgtcaagtaa

SEQ ID NO: 866 - DNA, 2142 bp, Actinoplanes utahensis
gtgaccgacgcgatcgtgacccggtatccctcccccgccgggggcagtggagccggtgccgtcgagccgctgctgcgggtcgacgacctgtcggtgaccttccgcagcccggcgggcccggtcaccgcggtccgggggatcagctacgacgtgcgacccggtgaggtgctcggcatcgtcggcgagtccgggtccggcaagtcggtgtcgtcgctggccgtcatgggcctgctgccggacaccgcgacgatcaccggctcggccaccttcgagggccagcagctgctcggcctcggtgacaagcagctctcccgggttcgcggccggcggctctcgatggtgttccaggacccgctctccgcgttgaccccggtctacacggtcggtgaccagatcgccgagacgatccggatccaccaggacatcaagcgcgaggcggccgccgagcgggcgatcgagctgctcgacctggtcggcatcccgaacccgcggcagcggtcgaagggcttcccgcacgagttctccggcggcatgcggcagcgggtcatgatcgcgatggcgatcgccaacgacccggcgctgatcatcgcggacgagccgaccacggcgctcgacgtgaccatccaggcgcagatcctggaggtgctgcagaccgcccgggaggcgaccggcgcggcgatcgtcatgatcacccacgacctcggcgtggtcgccgggttcgccgaccggatgctggtcatgtacgccggccgggtggtcgagaccggccaggtggagaccgtctaccagcggccccggatgccgtacacgatgggcctgctcggctcgatcccgcggctcgacatgggcgagcggcagcggctcaccccgatcgacggcgtcccgccgtcgatggtggacctgccggccggctgcccgttcgcgccgcgctgccccatgaagatccaggtctgcgaggagaccgagccggagctgctcggcgtggtgatcgacggcgccgggcacctggccgcctgccaccgcagcccggagatcgcccgcaaggaactgaccaacgtcgacgtcttccccaccacggtggtgccggaggccaccggcccggcccggctgccccgcgagcagcgccccgtggtgctcgaggtcaacgagctggtcaaggagtacccgatcaccaagggtggcgtgctgcgccgcaaggtcggcagcctgcaggcggtcgccgggatcagcttcgacatccgcgagggggagacgctgggcctggtcggtgagtccggctgtggcaagaccaccaccatcatggagatcctggagctggccaagccgacctccggcacgatcgcggtgctcggcaaggacaccgccgcgatgagccgcaaggagcgtttcgccatccggcgcgaccttcaggtggtcttccaggacccgctggcctcgctggacccgcggctgccggtcagtgacatcctggccgagccgatggccacccacggggttccggccgccgagcgggagaagcgggtccgggagctgctgcgcctggtcgggctgcgccccgagcacgccgaccggtacccggccaagttctccggtggccagcggcagcggatcggcatcgcccgggccctggccctggagcccaaggtgctggtgctcgacgagccggtgtccgcgctcgacgtctccatccaggccggcgtgatcaacctgctcgagcagctgaaggtggagctgggcctctcctacctgttcgtggcgcacgacctgtcggtggtccggcacatcgccgaccgggtggcggtgatgtacctcgggcggatcgtcgagatcggcacggccaaccaggtcttcgaggcgcccgagcacccgtacacccaggcgctgctctccgcgatcccgctgcccgacccggtcaaggagcgcagccgccggcggatcctgctcaccggcgacctgcccagcccggcgaacccgccgtccggctgccgattccggacccggtgccccaagttcgccaacgagctcgacgacgcgcagcggcagcgctgcctcgacgagtccccggcgctgaccgtccgggacaccgtggtcccggaccacgagtccgcctgtcactacgcggctccggtcaaggcgatttaa

SEQ ID NO: 867 - DNA, 909 bp, Actinoplanes utahensis
atgactaccgacaccgaatccgtggtggtcggcgctccgccggcgccccgctccgtctcccgtaaccgcctggtgctgcggcgcttcctgcgccagcggctggccgtcgtcgggctgatcgtggtcgtgctgatggtgctgatcgcctacctcggcccgctattctacaagtggaagtacgaccagctggacttcgaggccttccagtcgccgcccaccccggagcactggttcggcacctaccagaccggcggcgacgtcttctcccgcaccctgcgcggcctgcagaagtcgctggtcatcggtctgctcggggcgggcgcctcgaccgctctggccgccgtggccggcgccttcgccgggtacttccggggcagcaccgacatggtgatccgggtgatcatcgacctgatgctggtgctgcccagcttcctgatcatcgcgatcttctcgaccgcgctgcgggacgggagctggctgctgttcatcgtgctgctggccggcttccagtggatgatcaccgcccgggtggtccgcggcatcacccagtcgctgcgcgagcgtgagttcgtccaggcggcccgcttcatgggcgtacccggctggaagatcatcctgcggcacatcctgccgaacatggcgtcgctgctgatcatcgacgcgaccgtcggcgtcagcagcatcatcctggccgaggtcgggctctccttcttcggcttcggcgtgcagccgccggacgtctcgctcggcaccctgatcgccgacggctccggcgcggcgctgaccaactggtggcagttctacttcgtcgcgggcgtgctggtgctgctcgtcctcgccgtcaacctggtgggcgacggcctgcgcgacgcgctggacccgaactccgagatcgaaggtgcgaagtga

SEQ ID NO: 868 - DNA, 999 bp, Actinoplanes utahensis
atgggcaaattcctcctgcgtagggtgggttacctcgtagtactcgcgttggtcgcgaccgtggtcgcgtaccttctcgctgcgacgcagctccatccgcggagcaggtatgaggggcgtaatcccgccccggcggcggcggtcgtcgaccagcggctcaacgagctcaacatgaacgacaagacgccgctcgtcgaacgattcaccacctgggcgaagggggtcgcgcacggcgatctcggcaagacggtcgacggcgagtcggtgaacaccgagatgagccggcggatgtgggttagtctgcggctgatgctgatcggctcgatcctgggcacgctgctcggcgtggtcgccggcgcgtacggtgcgatcaagcaacataagtggtctgatcagacattaaccggcatatcctttgtcctactatcggtccccaccgtggtgctcgccgtcctgatgaagaacggcggcatctggttcaaccaggcgtcgggccacgagtcgaacccgctcgtgttcaccgtcggtgagatcacgccgggcctggacacctggtcctgggccggtctgagtgaccgtttcgggcacctggtcctgccgacgatcgtgctcgcgatcggcgtcaacggcttcgccttctacagtcggtaccagcgcaactcgatgctcgacgtgctcggcagcgacttcctgcggaccgcacaggccaaggggctgcggcgctggtccgcgctgacccggcacggcctgcgcaccgccctgatcccgatggcgaccttcttctcctaccagttcgcgctgctcttcgtcggtgccaccttcaccgagaagatcttcggctggcacggcatgggggagtacttcgtcgactccatcaccaagaacgacatcaactcgacggccggggtgaccctcttcgtcgccgtgctggttctgatcgccggcctgctctccgacgtcgtctacgcgatgctggacccgcgggtccgggcgagctga

SEQ ID NO: 869 - DNA, 159 bp, Actinoplanes utahensis
atgaccacccggcggtgcgcggtgaagatcccggccggcggcaggagcgcggcgaacgcggtgaccggcccgcacctgcgagggcgcggtgccgaagcggcgctgcagccgcggcgcgcgggcgcgggtcccggccggcccggagaccggcgctcataa

SEQ ID NO: 870 - DNA, 432 bp, Actinoplanes utahensis
gtggtcatcgccgggggagctcgcctccggcgtggtggccgggatcaacgccacccgcccacccgggcggtcatgccggtcgccctcgcggcgtgcggcttcgtccggctcatcggcggcggccccgcccggcacgccccggcaggatggtcgaccacggaacctccacctccggttcacgctcggcgcggtcgccgtcgtggaccggggtgttcgtgccgaccaccgggcagcggccgccggccgccgcggagccgcgacggcggcggcgcagtcgccccgacgaggtcgccgacgaatgcggcggcgttccggacgtcatcgacttcgaaaaggagttcgatcgtcggtaatgcgctaggggtcagcgtccgaccgcaggggttgttgcccgatttcgatccacctagagttgtcctacaagaaagctga

SEQ ID NO: 871 - DNA, 912 bp, Actinoplanes utahensis
atgctcgaaatgggtgtgacaacgcattcggacgacattgtcacggcgtacctcgcaccggcggaatccgccgacatggcgcggcgggcccggcgtgagatcaccgggaccggcgcgccgggcgactgtttccggcgcgccggccggcacgccgggatcctgcccgcccggctccgcgaggcgctggcccgactgcgggccggcagcctcgacgcggtggtggcacacgggctgcccgccgacccgaccgacgccgacgcgccgccgctgctcggactgacctggctaggcatgctgaccaggcaactcggccacgagttcgggtatcccgcggagcagaacggcaccctcgtgcaccacgtgcggccgcggcccgaccgcgccgccacccagtcgaacgcctcctccgcggtggatctgcggctgcacaccgagatcgcgttccacgacgtccggcccgacttcgtgctgctgtacggcgtccgcagccccgagccgcgcccggcgacccgcctcgtccgggtcgccgacgccgtccggaactgctccccggaaaccgtgcagcggctgcgccggccacaattccgaatcaacgccccggacagtttctcgcccggtcaggccgtcgcggaaaatgtcgctccgatgggcggtacgctgcgccagccgaccatccgctggcacagttcgataaccggtgtcgacgacgtcgatcaatgcgctattgcggagttccaggccgccgccgaccgcgaggaacacctcgtccggctcgcccccggcagctttctggccttctccaacagccggtgcctgcacggccgggacgccttcgaggcgcactacgacgggcacgaccggtggctgctgcgcacctacgtgcggcacgacctcacccgggggcgcggatga

SEQ ID NO: 872 - DNA, 1122 bp, Actinoplanes utahensis
atgaacaccgcggggatgctcgacctcgacgacttccggcgggcctgccagggcgtgctggacgcggcccggtggtcctacctggccggcggcgccggtcacgacgacgcggtccgggagaatgaggcggcgctgcgccggctgcggctgcggccccgcccactgaacggcgtcgccgacccggacctgaccgtggacgtgctgggcttccccgccgcgatgccggtgctgctcgcgccgaccagcccgctgcgcctgttccatccggacgccgagctcgcggtgtcccgggccgcccggcgggccggggtgctgccgatcgtcagcaacgacagccaccacagcctcaccgagatcgcgaagcaggggccgtgctggttccaactgtactgctacggcagccgggccgacgtggtgcgcacgatccggctggccgagtccgtggacgcccgggcgctggtggtgaccatcgacaacagccacccgtcgcggcgggtcgcgatgctgcggtccggcttcgccaccccgcccgaggtggagttcggcatccaccgggagagcggcttctccgacggcgcggtgccgcccgacacccggctgccccgctggccgttgacctgggagctgctcgacctgatccggtcgcagacccgcctgccggtggtggtcaagggcgtgctgcatccggcggacgcggcgctgctcaccgatcggggggtggccggcctgatcgtctccaaccacggcgggcggcagctcaacgactcgatcgcggcgatcgacgcgctccccggcgtggtggccgcggccgccggccggctgccggtcctgctcgacggcgggatccgcaccggtggcgacgtggtcaaggcgctggcggccggggcggccgcggtgtgcctgggccggccgtacgtctggggcctgaccctggacggcgaggacggcgtgctcgccgtgctggaactgctgcgggcggagttgctcgacgtcgcccggcagacgggactgcgcgcgctgcgcgcggtccccgcggacctggtggcaccgccaccgccatcgttcacggggagaggaggtggaccacatgatccagcgcatcaaggcgcgcttcgcgcgtaa

SEQ ID NO: 873 - DNA, 1203 bp, Actinoplanes utahensis
gtgaccacggcgccgccggtcccggccaacctgtcccgggccggcctgatccaggagtacgaccgggaccggctcggcttcgtgatggacgcggtccgccggttcggcccggtgaccgagctcagccccggcaccgtgctggtcgccgacggcgaggtcgcccacgacgtgctgcgccgcaccaaccgggacttcctgatggaccgcgaccgggcgtggcggcccaccggcagccggcgcggcgaggacgcgttggagagctggatgtcggcacgccgggcgatgctgtccgccctctccggcggtctggtcgccgaacacctgagctggtattcgggcgagctgaccgggctgctcgacgcgtgggcggcgcgcggcggcaccggcgacccgctgaccccgctggtgcggctgagtaccgacgccttcctgcggctgtgcgccggcccgtcgagtcgcggcgccgaccggcgcgagccggccgccgccgtcgccggactgctggactcgctcacgccgatcgtcggctcctcctacgagctgccctggttcctcgaccggctcaccccacgccggcgccgcgccgtccgcgcccagcaccggctcgcggagagcctgggcgcgctcgtcgaccgggccccgtccggcgggctggtcgcggcgctgcgcgacgccggggtgccgcgtgagccgctggtccggatcctgatctcggccaccatcgcggggcggttggtgccggccgccgcgaccgcgtggacgctgcgcgcgctggccgtgcaccagccggacgacgagccggcgcacatcgtcgacgaggtgctgcgcctctggccgcccacctggctgatccaccgcaccacacacggcgaggagatcagcggggactggcggttccccgcgcgtaccgccgtgatgatctgcccctatgccatccaccgcgacgagcgccactttccggacccggcggcgttccggccggcgcgctggcgcgacggccgcctgccggccggcgcctacctgccgttcggcggcggcccccgctggtgcgtcggcacccacctggccaaggcgcagctcgtcgaggcggtccgggtgttccggcggtaccgcctgaccgacacctcggacgccgtcaccctggacacccgctccaccctgtatccgcgcggcctcgccctgggcgtcggccgtcccgcatga

SEQ ID NO: 874 - DNA, 1950 bp, Actinoplanes utahensis
gtggaccctggacacctgggccgacgacctggccgcgctggtggacacgctgggcctggagaagccgtacctgctcggcacctcgttcggcgggttcgtggtgcagcggttcctgggccggcacccggagctcgcgggcggcgcgatcctgatcggcaccggcgcccggcaggccagccacgacgagatcgtggaacgccaccgggtgctcggcggcgaccgtgcggccgcggtgatgcgccggtcgctgaccgaccactcgcccgaggccgagcgggagtgggccgaggtctgcgggccgctggcgatccggcgggcgcccgacgaggcgtaccagcgggtgctccgggaccggatcaccactccggagatcaacgccgggttcatcgcccagctcgaccggctcgacctgcggcccgatctggccgccgcgaagtgccgggtgatggtcctggtcggcgagcacgatccgctcatcccgtacgcggtcgccgaggagatcgtggacagcctgcccggccgcgccggcgagctgcacgtcgtgcccggcgccagccaccaggccgtctgggacgcgccggcggccacccacgcgctgatccgcaagttcacggaggagtcgtgaccgcgccgttcacgcagcccaccgccgaggagttccgggccgccaccaccgagctgcgcgagctgaacgcgccgtacgcccgggagcggctgatcttccggccgccggtcgagtcgcccggacaggtgcgccggctggaggccgcctgccaaaccgtcttcgaggggctggacgcggtactgcgcgaggtctgcggcggcgacgtgctgcggatggcgcggctgtgccgggccaccgagccggaactgcagttcctcacccaccagacggatcagaactggtcgacggtggcccgcccggacgtgatcagctccggcggccggaccgtcgtcgtcgagatcaacggggactcccccgccgggctgttcggcctgcacgacatcatcgcccgcgcccaggcggcgttccagcggccggcaccgcaggccccggcccgccccgcggtggcgatgcgcggcctgctggacagcctggaacgcagcttcggccggctgaccggcacggtggcgatctgctactggcggcacgagcagcaggccgggccgctggactggcagtacgagctgttcgcccgcgagctgcgccggcacggcgtcgacgcggtgcactgcgcgctcgaggatctgcggatggatgacgccggcgtcgcctaccaggggcgcccggtgcaggtgatctaccgctacttcgaatcgccggaacccaccgaacatgacgagttcaccctgctcaagcagctgttcgcgctggccggcgcgggcctggtcgggctgttcaccgggtatcgcgccgaggtgctggcgtccaaggcggcactcgcggtgctctccgacgagaccgtggtggaccggctcgacgcggacctgcgcgaccggctggccgcgcacgtaccgtggacccgggtgctggaaccgcgccggaccaccgtcgagggcgccgacgtcgacctgctgccctgggtggccgcgaaccgggaacggctgatcgtgaaaccggtgcgcgggcacgccggcaagggcatcacggtgggccgcgaggtgtcggcgcgggcgtgggccgaggcggtcggcgccggggtgcgcggcggggccggcgaccacccgtacatcgtccagcaggtcttcgaaccggaccggctgccggtggcgttcaccgacgcgaccggccgggccacggtcaccgagacaccgtcggtgaacggtgtcttcatcgtggacgggcgggcggtggcggtgctgcgccggtacgcggtgaacgccaccggcaccatcaacatcaacccgttcagcgggtacgccccgtcgccggtctggaccgcgtcatga

SEQ ID NO: 875 - DNA, 1512 bp, Actinoplanes utahensis
gtgggccgaggcggtcggcgccggggtgcgcggcggggccggcgaccacccgtacatcgtccagcaggtcttcgaaccggaccggctgccggtggcgttcaccgacgcgaccggccgggccacggtcaccgagacaccgtcggtgaacggtgtcttcatcgtggacgggcgggcggtggcggtgctgcgccggtacgcggtgaacgccaccggcaccatcaacatcaacccgttcagcgggtacgccccgtcgccggtctggaccgcgtcatgaggtggcatccggctcccacgctgttcgccgccggcgcctcggccagcctcggcgacggcatccgctacgccgccttcccgctactggccgtgcacgtgaccaccaacccgatcagcgtgggcgcggtctcggccgcgctgtccgccgcgcacctgctgttcggtttccacgtcggtgcggcggtcgaccggttcgaccgggtccggctgctgcgctcgatgcagctcacccggctggccgtcgtgctggtgctgttcggcgcggtgctgaccggcaccgcgtcgctgcccctgctgctggtgaccgcgtttctgctgggcgcggccgagctggcggccgacaccgcggtgcagtcgctgaccccggtggtggtccgcgacgccgggctggaacggctcaacgccgggctcaccgccgcccagtcgatcggcgaggacttcgccggcccggccgcgggcggcctgctgttctcgctcagcccggcggcgccgttcgcggtcttcgccgcggcgatcggcggcagctgggcggtgctgacccggctgcgggtgccgggccgggtggcgccgccgccgggcgaccggccgtcgctgaccgccgaggcccgggagggcttccgctacctggtccaccacccgtcgctgcgcgcccaggcgctctgggcgaccgcgatgaacctcggggtcgcggccgcgaacgcgaccctggtgctgtacgtcgtgcagcggctgcacctgggcgacagcgcgtacggcctgctgctgaccggggccgggatcggcggcgtggccggcgcggtcgcctcgccgtggacgatccgcctgctcggccggctcggcaccatgatcaccgcgagcctggtggccggcgtggtcaccctcggcatcgcgtgcaccacgtcggtcgcggtgatcgtcggctgccagttcctcgccgggttctccggggtgtcgttctcggtggtcggccggtcgctgcggcagagcatcaccccggacgccctgatgggccgggtgaccggcatctaccgtctgatcgggttcggttccctgccgctgggcgcgctggccggtggcgcggtcgcgcactggctgggcctgcgcaccccgttcctgctggccggcgccctgatggtggtcagcacgctgaccctgggcctgctgacccgccgcgcccagccgccggccgcgaccacggcggcgacggccggacggcaggtggccggcgtccccggatga

SEQ ID NO: 876 - DNA, 810 bp, Actinoplanes utahensis
atgatctggttcatcaccggcgcttcccgcggtttcggccgggagtgggcggccgcggccctgcgccgcggcgaccgggtggccggcaccgcccggcagccgtgcgacctggccggcctggccgaggagttcccggagacgttcctcccgctgcggctcgacgtcaccgaccgccccgcggcggtcgaggcggtgcgccgcgccgccgcccacttcggcggtctcgacgtggtggtcaacaacgccggttacggccacttcggcatggtcgaggagctcgccgaggaggagatccgggcccagctggagaccaacgtgctcggcctgctctgggtcacccaggccgcgctgccgatcctgcgggtccgcggcggcgggcacatcatccaggtgtccagcatcggcggactggtcgcgttccccggcctcggggcgtacagcgcctccaagttcgcggtcgaggggctcacccagtcgctcgcccaggaggtggccgcccagggcatccgggtgaccctggtggagccgtccgggttccgcaccgactgggccggccgctccgcccggcacagcgccgagtccccggagtacgacctggtccgcgcggcccgcgaccgccggcccacggcccgccgggtgggcgacccgcgggccagcgccgccgccctgctggccgtcgtggacgatccgcggccgccgctgcgcgtcttcttcggcagcgcgccgctggacatcgtcacccgggagtacgaggaccggctggagacctggcaggcgtggcagcacctggcggtcgcggccgagtcctga

SEQ ID NO: 877 - DNA, 1230 bp, Actinoplanes utahensis
gtgacggacctgaagtcatccccggcgccgtctcgccggttgatcctgctcatggccctggcctgcggcgtcggtgtggccaacgtctacttcccgcaggcgatcaccccgctgctcgcccgggacctgcacatctcggagagcacggcgaccaccgtcgcgaccatggcccagctgggctacgcggccgggatcttcctgctcgtcccgctcggcgaccggctgccccgccgccgcctgatcgccaccctgttcggcgtcgtggcggccggcctgttcctggccgggatctcctcctcggtgccgccgctgctcgcgttctgcgcgatcgtcggcgcggccaccgtggtgccgcagatcctcatcccgatggccgccgacctggccgggccgaccagcgccgccggcaccgtgggcatcctgcagggcggcctgctcggcggggtgctgctggcccgcaccttcggcggcacgctcggccagctgctgggttggcgcgcgccgtacctgatcgccgccgcgctcgcggtgctgctcgcgatcgccctggtggtggcgctgccggcgaccgcaccctcgtcgaccgagcggtatcccgccctgctggccacctcgctgcggctgctgcgcacccagcccgccctgcggtggtcctgcctctaccagttcctgctgttcggcgcgttcaccgcggcctggaccagcatcgcgctccacctcaccggaccggcgttcggttacggcaccagcgtcgtcggcctggtcgccctggtcggcgcggccagcgtcttcgcggtgccggtggccggccggcagatcgaccggcgcgggccggacgtgatcagcgtgctctgcttcggcggcctgctgctggccgcggcggtgctgctcaccgggacctggcacggcgtgcccggcctgatcgggctgaccgccggcatgctgctgctcgacgtgtcggtgcagaccagccaggtggccaaccaggcgcggatcttcgccctggtgccgggcgcccgcagccggctcaacagtgtgtacatgaccgccgtcttcctgggcggcacctgcggctcgtgggccggcgcccggatctacctgcacttcggctggggcgcggtggccgcgctggtggccgtcgccggggtggccgccctcgccgggcacctgctgcgcctgcggatcacggcgccggccggccgccgggagtcggcggaggccgccgcatga

SEQ ID NO: 878 - DNA, 717 bp, Actinoplanes utahensis
ttggccacaccgacgccgcaggccagggccatgagcaggatcaaccggcgagacggcgccggggatgacttcaggtccgtcacgacaactcctcgtaagtgggtatggaacctatataaccggttcccggggaacgggtcaaaccggttcctgagatacggtgcaggggtggcagccgaaccgttccgtcaaggcgccgggcgcctgtgcctggacttcacccgcacgctgcgccgtcgcggccatcccgacgccgtcgaggagctgcccaccccggccgcggtcctcgcctgggtgacgcagttcggcccggtgccggccaccgtcgcgagccttccgccggccgacgtgcaacgctttcgggaggcggtgttcaccctggtcaccaagggaccggcggggtgcgcggcgaccgacctggacctggtcaaccggatcgccgcggcaccaccgccgatcccggcggtccagccggccggcacgctggactggaccgccggcgacccggtcgccgccaccctctcgctggtcgcccgggacgccctcgacctggccaccacgccggccgcgagccggatccgggagtgcgccgacccggcctgcagcgcgctgttcgtggacaactcgcggcccggcacccggcgctggtgcgcgatgagcgcatgcggcaaccgggcgaagaagaccgcctaccgcgaccgggccaccgcaggctga

SEQ ID NO: 879 - DNA, 507 bp, Actinoplanes utahensis
atgtcggtgaccacgtccgacttcaccagtctgatggcccgggtgcccgggccggtggtggtggcgaccacggtggacccggacggccggcggtggggtttcaccgccagcgcgttcagctcgctgtcgctgagcccgccgctggtgctgctctgcctggcgaagtccgccagcacgcacgccgcgttcgtgcgcgccgagcgcttcctggtcaacgtactggccgccgatcaggcggcggtggcggcccggttcgcccgctccggcgaggaccggttcgcggccggcgacatgcggccgtacgagctgggtctgcccggtctgcccggcgccgcggcccgggccgcctgtgccctggacagtgtcctggagggcggcgaccacagcatcctggtcggccgggtgctggcggtcacggtggccgagccggccccgctggtgcactgcgaccgcgctttcgcccggccggtgccgctcgatcaactcgcggtggcccggtcgcggtag

SEQ ID NO: 880 - DNA, 1413 bp, Actinoplanes utahensis
atggagcagcgatcgtacgacgcccgcttcgtggtcgtcgccaatcgcctgccggtccagtcccgggtggccgcggacggtgccctgctctgggagcgcagcccgggcggcctggtcagcgccctcgaaccgttcctgagccggcggcacggtgcctgggtcggctggcccggcgtcgccggcgtcgacgtcgcgccgttcaccgacggcggcaccaccctggttccggtccggttgagcgaacaggacgtccgggaccactacgacgggttcgccaacgccacgttgtggccgctgtaccacgacgtggtggtccggccgaccttcgacagccgctggtgggccgggcacgtgcgggtcaacgagcggttcgcccgggtggcggcggagacctgcgcgccgggcgccaccgtgtgggtgcacgactaccagttgcagctggtgccggagatgctccgccggctccggcccgacctgcggatcggtttcttcctgcacgtgccgttcccgccggtggagctgttccagcaggtgccgtggcgggccgagatcctgcgtgggatgctcgccgcggacctcgtcggtttccaggtcccggccgcggcggtggggttcgccgaggcggccgtgcggttcgccggggcgcgccgggccggtcccgggtcgttgttcgtcgaggatcgggcggtacgcgtcgacgccttcccgatctcggtggacgcgccggcctgggaccgggtggcccgccgcccggaggtccgcctccgggccgcgcagatccgtgccgagctcggcgacccggcccgggtggtgctcggcgtcgaccggctcgactacaccaagggcatcgacgtgcgcctgcgggcgatccacgagatgctcgccgacggccagatcaaggccgccgacacggtggtcgtgcagatcgccaatccggcgcgggaacgggtggaccagtatcgggcggtgcgcgaccgggtggagcggctggtctccgcggtcaacggcgaccacggccgggtcggccgcccggtggtgcactacctgcacaccatggtggaccaggccgaactggccgccttctacctggccgccgacgtgctcacggtgacgccgctgcgcgacggcatgaacctggtggccaaggagtacgtggccagccggcacgacggcggcggcgtgctggtgctcagcgagttcgccggcgcggccgccgagctgccccaggcgctgccggtcaatccgcaccacggcgacgacgtgaaggcggcgttccgccgggcgctggaactggatccggccgagggcgtgcgccggatgcgggcgatgcgcgagcacgtcttcgcccatgacctgactgactgggcccaggccttcctggcccggctcgacgatccggcgggagaggggtga

SEQ ID NO: 881 - DNA, 1068 bp, Actinoplanes utahensis
atgccgaacatgaaggcagttcagctgctcgcaccgcgcaagacggtgctcgccgaagtgccggtgccggcgaccccggccgacggcctgctgctcaagacccgctgtgtctccatctgctcgaccgacatctcgttcttcgagggtcacctgttcccctccgagtacccggtgatcctcggccacgagtacctgggcgaggtcgtcgacatcggacccgagttcgacggcggcggtgtcgacgtgcggatcggcgaccgcatcgtctactgggggcagaccgactacggcggcttcgccgagtaccgcagcctgcggccgatcttctcgggccagatcctcgaggacgtgttctgggccgaccggcacttcttcgacgacgaccgggccgccgcggtcaaggtgccggacgacctcagcgacctggaggcctcgttcatcgagccgaccaccggcgcgctgcgctcggtgctgaccaacccgccgcaggtcggcgaccgggtgctgatcctgggcaccggcccgatcgggatcatcgcgggcagtgtcatccagcggctgctggcgccgaaccggatcgtctcgatggacgccaacccggcccgcaaccagcacgccgaggagcacttctcgcagcacgcgtatctgccgcacgagctgatcgacacggtgccggagagcaccttcgactacgtcttcgacacgctgccgacgatcagcggagtgccggaggagaacgacccgcgccgggtggcgatgcgcaagctgaagccgggcggccactacgtgctgtacggggcgtcgcaggagatgcagaagttcgacacctggctgatgctcgccaagggcatccggatcagcgccgcgccgttcgacgtgacgcacttcccgatgcacaagaccgccaacgtgatcacgtcggcgatgcagatgctgcgttcccggatcgtcgacggccggcggctgctctcccacgtctgccggttcgacgactacgacggcctggtcgacgtgctggagaactaccggcacaccaccagcctgaagaccatcgtcgacttccgctag

SEQ ID NO: 882 - DNA, 1176 bp, Actinoplanes utahensis
gtgctgtgggaaccccccgagaccggggaacaatcggaatggctgtcccgggtggcggcgctggcgccgctgatcgaacggcaccgcgccgaggccgaccgggagcgccgcaccccgcaggccgtcttcgaggcgttgcgcgacgccgggatcccgcggatgtgggtctccaccgagttcggcggcggccaggtcggcctgcacaccggatcgctggtgatccaggcgctggcccggctggacgcctcggtcgcctggcagatgggtgtgcagggggcgatcggccggatctccgactacctgcccgagcagaccgcccgggagctgttcaagcagagcggcggtctggtggtcggcgcggtgaacccggcggggcgggccgaggagaccgccggcgggtaccggatcagcggccggtggggcttcgcgagcggctcggcgttcgccgactggctggtctgtgccgcgccggtgcaccgcgacggacagccggtgctgcgcgggtccgcgcccgagctgcggatgctgttcgtgccggtgtccgcggtccggctcctggacaactggcacacgctgggtctgcgcggcaccggcagcaacgacttcgaggccgacgacgtcttcgtgccggccgagtacacggtggaccaggcggcgatgctgcggccgccggccggccggttctcccgcgcctacccgatcggctactacgacttcggcccgttcacttccgcctcgaccgccgccggggtggcccgggacgccgtggcgacggtgaccgagctggtccgcggcaaggtgcagaccggcggctcgggcagcctggcccgtagccacgtggtccaggaccgcctggcccgggccaccatgcacgtgcacaccgcgcggacgctgctgcgggacaccgccgagcgggtcaccgagtccggtgagagcggcggcgaacgcctgaccgccaccgtccggctcaccgcggccaccgtcgccgaactggccgtgcaggccgtggacatcgcgtacgacctggccggctccacctcgctctatgagaccagccggctggagcgggcgttccgcgacgtgcactcggcggtcaagcacatcaccctcgctccgcagcacttcgagatggtcggccagtacctggtcggcggcgaactgcgcgtccgccgctga

SEQ ID NO: 883 - DNA, 1164 bp, Actinoplanes utahensis
atggtgtacggggacgacagtgtgcgatcgccgcaggagacccgggtctccgcattcgtcgacgagatgttcggtgatctgggccgggccgatcagcgccggtgggcgcgaatctatctccggggaatgctcaccgcacgcggcaagaaaaccgttcaggaaatagcccgctcggtcggcgcggaatctttcgtcgcgcgcggcctgcgccagttcatcaatttcagcccgtgggactggggcggtccgcggcgccggctcgccgagatgctctgggacgccgcgcccgggcaggcgctcaccgtcgcggtgtcggcgatcccgaaacgcggctcgcagagcgtcggggtgcagcgccggttcgtcgtggcggccggccgcacggtcaactgccagctggtggtgagcctgttcctggccaccgggcggcagctggtgccggtggactgggagctggtgctcggcccggagtggggcgccgaccgggcccggcgggcccgggcccggatcccggactcggtcgaggcgcgaccggtgtggcggcacgtgctcgacgtcgtgcggcgatcggcccggttccgcgccgggctgccgctggtggccgacctgagcgagctggacgaggtgtggccgctggtggtggcgctggccggacgccgggagctggtcatcgcggtgtccccgggccagcgcatcccggcgtgccgggcgggccggccgggggacgggacctcgccgacggtaggcgagttgctgcaggccgcggcggccggtcgggcccggcacagcgtcaccgtgccggacccggacggcacgccgcggacggtggcggtgcagtcggtggcgctgcgtggcggccggggcgccgacctgtggctgctgggcgagtggtcgccggaatcccgccggttcacccggtactggctgaccaaccgggccgaccggccgggcaccacgctggagctgggccggtacgccgaccggaccgccgggacactggccgaactgcgccgggatttcggcgtgctggattacgagggacgctcgttccccggctggcatcaccacatgacgatggtgtccgcggcgtacaccttgcaattgattgatgtctgctcggccgttctgcaggccgccggggcagtttttcccggaacgatttga

SEQ ID NO: 884 - DNA, 1545 bp, Actinoplanes utahensis
gtgaccgagattgatacttcgctggccgcggattacgtcgtggtgggcgccgggtccgccggatgcgtggtcaccgagcggctcagtgcgtccggcgagcacaccgtggtggtcctcgaggcgggcgccaccgatccgcgttcgatcccggagctgcgcatcccgatgctgttcccgcggaccttcggcagtgaggtggactggggtttcaccaccgtgccgcaggccgggctggacggccgggtgatcccgtacccgcgcggcaaggggctcggcggatcggcctcgatcaacgcgcagctgtggacgatcgggcaccgcgccgactacgacggctgggccgagcagggctacccgggctggggctacgccgacgtgctgccgtacttcgagcgggcggtcgccgagcggctgccgctggccggcatccggtacccgagcccggtgaccgccgactttctcagcgccgccgcgctggccgggcacgccccggccggcgagcagcaggaggggacgctgctggcccgggcgaaccatgtcgacgggctgcggcacagctccgccgagggctatctggaccggtgcgccgagcgggacaacgtgcgcgtggtgaccggtggtcgggtgcgccggctgatcttcgacgggaccaccgcgaccggcgtcgaggtggagatcgacggcgagatccggcaggtccgggcgaaccgcgaggtgctgctggcggccggcgcggtcggcaccccgcacctgctgatgctctccggggtcggcccggcggggcacctggccgagcacggcatcccggtggtggtcgacgcgcccgcggtcggccgcaacctggccgaccacctgctcgtcccgctcgcgttcgcgggccgcggcttcgagtcgcccggggtgtcggccggccccgaacagatgcgcgcctacctgcgggaccggaccggcccgctgaactcgatcgtctccgaggcgctgaccttcctgcgcaccgatccggacctgcccgggccggacatcgaggtggtcttcctggtgctgccgtacggggagcacaagacgagcgccgagcacggcttcgcgctcggggtcatcctgctgcggccggagagcaccgggtcgatcacgctgcgctcggccgacccgtccgacgccccgctgatcgacccgggctacctgagtgaccgcgccgacctggacaccgtggtggccggggtccgcgccgcgcagcggatcctggagcagccggtgctgagccgctggcggggtgagccgctcaccgacggcgcgctctccaccgaccgggcgcagatcgagcggtacgtccgggccaccggcctgagcatcttccatccggtcagcacatgccggatggggccgggcgacgactcgccggtcgatctgtcgttccgcgttcgaggcgtgcgggggctgcgcgtggtggacgccgcggcgatgcccagcatcgtccgggcgcacacccaggcgccggtcaccatgctcgcggaacgcgcgagtgaggtcatcatcagcggccgttga

SEQ ID NO: 885 - DNA, 1338 bp, Actinoplanes utahensis
ttggcgaccgggctgctgctcggcgcaagcctcgccgtgccggccaccccggcgctggcgaccacctcggcactcgcggccgacaccacccggacgccggccaccccggcgtacacggtcgatctgaccagcaacggcaccggcggcacctggaccgggcacgagagtgtgaccttcagcaacgcatcgccgacgccgctgaccgaggtctatctgcgactgtgggacaactaccacggcagctgcccgtcgacgccgatcacggtgagcaacgtgaccggcgggacggcgtcggcgctgaccgtcgggtgcaccgccatgaagatcacgctcccggcgccgctggcccagggggcgagcggcagcatcgggttcgacctgtcgatcgtggtgacctccggggtggaccggttcgggcacgacggcagctactacttcatcggcaacgcgctgccggtgctggcggtgcgcgacgcggccgggtggcatctcgacccgtacaccgacaacggcgaatcgttctatgccctggccagtgactacacggtgaagctcgaccaccccagctcgatcgtggtgccggcgaccgggacgtccaccgacgtcgccggcggcagcgggcggacggtgaccacggcggtcggcaggcaggtgcgcgagttcgcctgggcggccgggccgttcgcgaagacgtccggcacgacggcggccggggtcaaggtcaacgtctaccgggtgggttcgatcggtgcgggcagcgccacctcgatgctgaacaccgcgaccgcggcgctcgacgcgcacgccgcgcggttcggcgcgtacccgtacggggaggccgacgtcgtcctcgacaacgggttctggttcggcgggatggagtatcccggcttcgtgctcgacctggtcagcaccacggcgctcgcgcacgagctggcgcaccagtggttctacggcatcgtcggcgacgacgagtacaccacgccgtggctcgacgagggcttcaccgactacgccaccgacctgtacttcaacaagaccgggtcgggctgcggcatcacctggcagtcgtcggccgagaaggtgacgaactcgatggcgtactgggacgcgcactccagccgatacagcaccgtggtctacgggtacggcaagtgcacgctgcacgacctgcgccggctgatcggcagcacggcgatgaccaacctgctcaggtcgtacgccgcggcgcactggtacgggatctccaccgtggccgacttcaaggcggcggcccaggccgcagccggctccaccgatctgacctcgttctgggcggcacaccgcgtcgaggggtga

SEQ ID NO: 886 - DNA, 717 bp, Actinoplanes utahensis
atgcggattcatgcggccgggacgctgctcgacggggacctcaccgttccgccggacgccgcgggcatggtgctgttcacccagaacggcccgcgggaccgggcggtcgccgcggcgctgcacgaggtgagcctggcgaccctgctgatcgagccgctgaccgcgccggagcggggggacgacacccgccgcttcgacgtcgacctggtcgccgaccgggtgatcggcaccctccgctggctccgcgcccagcccgtcacgacgtacctcccgatcggtcttttcggagcgggcgtcaacgccgccgccgcgctggtcgccgccgccgcccggcccggcgacgtgcagaccgtggtcacccgcggcggccgggtcgacctggccggcggggcactggcccagctgatggcgcccgccctgttcatcgtcggcgaacgcgatcagcggctgcgcctgctcaacgaggaatcccgtcaggccgcccgctcgcacgccgacatgtgcgtgatcccgggcgccgaccggttcttcagcggcacgcaagccctacggcaggtcaccgtgcaggccgcggactggttccggatccacctggcggccccggtgccgcagcggccgccggagatcgacacggcgctgccggtcgagcactcgagcctgatcgacatgttcccggcgccgtccaccacccaggaacgctgccccgacgacgcgtga

SEQ ID NO: 887 - DNA, 450 bp, Actinoplanes utahensis
atgacccgcagcgtgaccaccgagaacctgggcgcctggctgctcaagggcaacgccgacacggccgacctggccggccggttcgcccgcgagccccgggtcgagcggtggtgcgtccggcccggataccggctggacctgatgcgggccgggcagccggtgctcttctgggccagcggcagccggcggcgtgacctgccgtatgggatctggggctggggacggctgcgcgggccggcacgccggggcgggccggaggccggctggtgggtgccgctcgacctggtcatcgccgagccggggcggcggctgcgccgggacgagctgcgcggggatccggtgctggccgggctggaggtgctgcggcagccgcagggctccaatccgtcgttcgtgaccggggcggaactggcggcgatccggcgccgatggatcagcgatgatcgataa

SEQ ID NO: 888 - DNA, 555 bp, Actinoplanes utahensis
atgtccgacgagcccacggtggcgacacccggcggcgatcgatccgaccagcctgaggaggcgaccgtcgcgttgccgggggcggcggccgaggcctcgttgacgaaagccgataaatccgaaatttcggacggggcggatgaggcgaccgtcgcgttttccggcagcacgccggtggacgacgagaagaccgcggtcctgagcgagcccgccgaggccggcaaggccgccccggtcggcaaggccgccgcagcaggtgcggccgccgcggcgggcaaggcgacggaaaccgcgaaggtcaccgcccctgtcaaggccgtgggaaccgccgggtccgcggacgaggccaccacggtcctttcccccacgggcaccgatgacgaggcgataacggtcatcccggcgtcgagcagggcggacaccgcggaggaggccacgacggtgatgccggcgggcgccgccgcgcagccgccggaggagaacacggtcgccctcccggccgcggaccggatcatcgcgctccccgcgacccggccgacccccctagctagctag

SEQ ID NO: 889 - DNA, 462 bp, Actinoplanes utahensis
atgttctgcatgatcggcaaccaggtgctcggccacgaggaggtggcgaagatggtcaccacggccggccaccagctcgccaaccacacctggagccaccccaccaagctgggcgagaagccgagccgggtggcccgcaaagagatcgagcaggcccaactcaagatcaaccggaccaccgggtacaccccgaagctgttccggtcgccgggcggcgactggtccccgcagctgctgcacgacgtggcgatggccggcctgctaccgctggactggagcgtcgacccgcgggactggacgatgccgggggtcccgaccatcgagaagaagctgctggccgcccacccgggtcagattctgctctgccacgacggtggaggcgaccgctcgcagaccttccagtcgctgagcgtggtgatcccggcgctcaaggcccgtggcctgaagttcgtcgccctctga

SEQ ID NO: 890 - DNA, 1317 bp, Actinoplanes utahensis
atgcttccggaacaggtcggtgactgggtgctgcacgaactgccccggctgaacgaagcgatcctgaaccaacacgcgccgcccgagctcctggtcaccgagttgtgcgagcacgtgctgcccggcctgccggacccgacccagctgaccccggtgcaggcgcagcggctcgtggtgcatctgggcttcgccggggcgtcggtggcccgccactaccaggagcacactccgggcggcaccgaacatccggaacgggccttcgacgtgttgacggcgggtgaggagcggatcccttttcgccgctacttcgccgggctcgcccagcacaccggcaccggccactacgaccgggacagctacgcgtcgctggtccggtggaacgtcggcacggtccgggtgcggctgcacggcgaggtggtcgccgaactgcccggtgtcttcgacgacgggcggatccgcagctacaccggcacggccggggaggaacgcttcttcctgctggtcaagcagggcgaggcgatcgagctggcggtcaactgcgcgctggagccgctcaccgccgagcacgccagcctgatctgtgagaaggcccggcaccgggtccgggaggccaccgtgctgctggccgagctgcgccggctgttccgtgacttcgcgtcccggccggccgaggagacgatggcggccgacgcgttcatggacgtgttccggcagttcgccgcgcactggacgccgggcgacatcccgccgagcggcgcgctcgacccggaggcgctcaaacgcgacttcctgctcggcatcgacgaaccggagtacgaccggcaggcccgtcgcctcttcccggcgctgctcgaccaggaacgtacggaaatcgggaatctgatgtcggactgcccgctgccgtgccgggtgctcgccgaggtgggcgtggacgaagccgatctgcgcctgtccgacgagggtgacctgcgccggctggtggcccaccacccggcgctgatcgactggcaccggctgctcaccatgcacgcccaggtctccggcgcgcacctgatgctgagcaagaagttcctgttcaagccacagcggcagcgggacgccgcgggcctgggcgaccagcacctggtgtcgaaccgggccggcaccaccgggatgaccgaaacctacctggagcgcctgacccgggcccggcagcggcacaccctcgccgcgctgcgccccgtgctgattccggaaaaccgggatccgggcgccgatccggcggtacggtccgaccggggagcggccgcgccggtcgtactggagctgaccggatga

SEQ ID NO: 891 - DNA, 1929 bp, Actinoplanes utahensis
atgagcggaacggacgacggggtacgtcagggcacccgcgagctgcccggtcgtgatcagctgatggcgctgatcgaccacacctcgtcggtgatctacatgcgcaacgccgacggccgctacatgctggtcaaccgggagtacgagcggctgttcgggctgcgccgcgaggacatcgtggggctcaccgaccacgacctgttcccgccggcgaccgccgacgcgttccgggacaacgacctgcaggcgctggccggcggcgtgccggtgcagatggaggagcgggtgcccggggacgagggcgaacgcatctatctgacggtcaagtttccgctgatcaacggggacggcacgccgtacgcggtggccgggatctcgaccgacatcaccgagcgcagtcgggccgaggccgcgctgcgcgacagcgaggagcggttccggctgctcgccgagcacgcccaggacatcatcttccgctaccggctggccccggagccggcgatggagtacctgagccgggcggtcgagcagatcaccgggttcaccgccgaggacttctacgccgacccggagctgatcgagaaccggatcgagccggaggaccggccggtgttcgagcggtcctggcggatgccccgctccgggacgaccagtttccggctgcggcgccgcgacggggaggtggtctggatcgagcagcgggccggagccgtcaccgcgccgggcggtgcactggtggcggtcgaggggatcctgcgcgacgtcaccgagcggatggccgccgaacgggaacgcgccgagctggaacgccagctgcgccagtcggagcggctcgactcgctgggccagctggccgggggcatcgcccacgacttcaacaacatcctcgcggtgatctccggctacgccgacatgatgatcgacgagctgggtgacgagcaccccagcaagccggacgcgaacgggatcaagcaggccgcggcccggggcgccgcgctgacccgccagctgctgctgttcagtcggtccgagccgtcccgctccgagctgctcgacctgaacgcggtcgcctccgacatgctgcggctgctcggccggaccctgggcgaggacatcgaactgggcaccgaactggtcgcggacctgccgccggtggtgatggaccgcagcaagctggagcaggtggtgatgaacgcggtgctcaacgcgcgggccgcgatgccggccggcggccggctgacgatcagcaccgggcgtgagcacggcggcgccggcgacgaccaggtgtgcctggcggtgaccgacaccggctgcgggatgacacccgaggtgctggcccgggccttcgagccgttcttcaccaccaagggccggggcagcggcaccgggctggggctggccacggcgtacggggtggtcaccgacgcgggcgggacgatcaccctggagtcggagccgggccgcggcaccacgctgcgggtccggctgccggccggtaccgaggacgccgccggggtgaccccggccgccccggccgcggaggacgcggccggtgacgggcggcggatcctggtggtcgaggacgaggagatggtccgtgacatcgtctgccggctgctggtcaaggccggctaccaggtcttcgcggccccgcatccggccgaggcgctgcgcatgtgccgggacgaggcgctcgccttcgacgtcctgctcagcgacgtgatcatgcccggcatgtcgggcacccagctcgccgccgagctgcgccgggaccggcccgggctgccggtgctgttcatgtcgggctacaccagcggaccggcgcccggcggccaggaactgccgaccgacgcgccgctgatccgcaagccgttcgagcggcagaccctgctcgacgaggtgcaccggctggtcaccgagcgggtctga

SEQ ID NO: 892 - DNA, 366 bp, Actinoplanes utahensis
gtggtggccccggccggcgtcctctcgccggcgtcggtaagcatcccgctggccgatgccgcggccctgccgatcgtcggcctgaccgcctggcaggcgctgttcgaccacgcagagctcaccgccggccagcgggtgctgatcaacggcgcgggcggcgcggtgggcggttacgcggtgcagctggccaagaacgcccatgcgcacgtgatcgccgccggcccggtgcgcggcgcggacgagaccatcgatcacaccgccaccgaggtcccgtcggcggtgcgcgaaccggtcgacgtggtgctgaacctggcgccggtcgaccccgcccggctggccggcctgctcaccgtcatgcgcgactga

SEQ ID NO: 893 - DNA, 303 bp, Actinoplanes utahensis
atggcacgagtgagcaccgcggcgaccgccgcatccagccaggtgaacgggccggacgggagccgggcgccggccggggaggtgcacgcctggctgcccggcaccaatcagacgctgtgcgggctggcgctgagccggacccgcctggtccggttcccgcaccagcggttcgactaccgggccagcgacgtgaccggggcgggggacgacatcggcttcatctgcccgaagtgtgtggccgcgaccaccccgcgcgatcagcgggacggccgcggctggaagcgggtcgccccacgcccgtga

SEQ ID NO: 894 - DNA, 507 bp, Actinoplanes utahensis
atgcggatggtcctgatggccgacacccacgtgccgaaacgggcgcgcgacctgccggccgccctgtgggcggcggtcggcgcggccgatgtcgtggtgcacgccggcgactgggtcgacgccggcctgctcgacgcgctggaggcgcgctcggcccgactgctcgcctgtcacggcaacaacgacggcccggcgctgcgggcccggctgcccgaggtggcccgcgccgagctggccggcctgcggctggccgtggtgcacgagaccggaccggccaccggccgggaggtccgctgcgcggcccggttcccggacaccgacgtcctggtcttcggtcactcgcacatcccgtgggacagcaccgcgccgggcgggctgcgcctgctcaacccgggctccccgacggaccgccgccgccagccgcactgcacctacctgaccgcgacggtcaccgccggccggctcaccgaagtgaccctgcaccgcctgccggtcagaccgtcttga

SEQ ID NO: 895 - DNA, 516 bp, Actinoplanes utahensis
atgatcttaaccgcgcatccggagatcactgtcgattacgaaccgaccgccgccgaagtcgatgccgcgctgcggggcaacagcgagcgcacgcgacgccagttcctcctcagcgtcgtgctgctgctggccgccgggctgggcctgatcgcgctgggcacgaccggatcgggcgcgttgtttgtggtgctcggtgtggtctcgctgctcgccggcctgttctgcgtgctgctggtcgccggcatcaagcaggtgcggcagcggatggccgcccggctgtgcgtgcccaccacggtcaccctcggcgccgaacggtacagctaccagatggccagtggcccgggcgagacccggtgggagttcaccaccgtggcgatctcggccgcctgctggacgctggccgccgccaaccggatcgtcctggtcatcccgaagcgggcattgaccgaggtccagcaggccgagttcggcgccttcctggccggacgcgacccgaagctggtcaagacggtctga

SEQ ID NO: 896 - DNA, 1029 bp, Actinoplanes utahensis
atgcccgccgacgagacgcccgcgcgcccgccgaccctcaaccaggtggccgcccgggccggggtgagcctcaagaccgcgtcccgggcgctcaacggcgagccctacgtctcgcgggccaccgaacgccgggtccggcaggccgccgacgagctcggctaccgcctcaacggcctggcccgcgagctgcgcaccggtggcacctcggcgctggtcggcctgatcagcggcgacctggccaacccgttctactccgcggtcgccagcggcgccgaacgcgagctgcgccggcacggcctgctgctgatcaccgtcaacaacgacgaggacggcgacctggagagcagccaggtccaggccctggtggaacgccgggtccgggcgctgctggtgatccccagcggcggcggcatcgacgcgcacaacgtcccactggtcttcctcgatcgcccgccgccggccggccgggccgccgacagcgtcctgatcgacaacgacggcggcgcccgcaccgcggccgcccacctgctggccggcggccaccgccggatcgccctggtcgccgacctcgcccggaccgcctcccagcaggcccggatcaccggcttcacggcggcgatgcgggcggccggcaacgtggactgggagccgtacgtgcgcaccgacgtccacgacgcggccaccgccggccgggtggtcaccgagctgctcgccctgccgttcccgccgaccgccctgttcaccaccaacaaccgggtcaccatcggcgcgctgcgcgccctgcgcgaccacccggtccggccggccctggtcggcttcgacgacttcgagctggccgacgtggtcggggtgacggtggtcgcccacgacacggtggagatgggccgggccgcggcccgcctggcctacgaccggatcggcggctacaccggcccaccccgcaccgtcatcatcccgacccggctgatcccgcgcggctccgccgaacgacctgcgggcaggctcttgcccggcgggccgccgtcatag

SEQ ID NO: 897 - DNA, 3099 bp, Actinoplanes utahensis
atgctccgtaccctggccgtggcgaccgtcctcgtcgccgccgcgttcgcgacacccgcaagtcccgcccaggccgccgacgccgacctcacctcgtacgtcaacccgctgatcggcaccgacgactccaactcccccaacccggtcggcggcggcgccggcggcagcaccttcccgggcgcgatcgtgccgttcgggatgacccagttcagcccggacaccccgaccgcctcgccgtcgggttaccgggaccgggaccggacgatcgagtcgttcagcctcacccacttcaacggggccggctgcccgaacaacgaggacctgccgatcctgccggtcaccggcgccctcggctcctcgccgggcaacgcctggacgtcgtacgccagcggctacaccaaggccaacgagaccgcttcgcccggttactacaagaacaagctggacaagtacggcgtgaccgccgagctgagcgcgaccacccgcaccggggcactgcgcctgacctatccggcgaccaccacggcccaggtcctgatcaacgacagccgctcggcgaccggcgaccgggccggcaatgtgagcatcagcggcaaccgggtctggggcgagcacaccgcgggtgggttctgcgggggtcgtacgtacaagatctattattcgatcctttttgatcggacaccgaccggcttcggcaccttcagcggcggcaccgtctcggccggctcggccaccgcgagcggcacgcagaccggcgcctacgtcaccttcgacacgtcgtcgaacgccgtggtcaacgcgaccgtcgggatctcgttcgtcagcgtggccaacgcgcagaacaacgcgaccgccgaggccgcctcgttcgacacggtcaaggcggccgcgaacgcggcctggaacagcgcgctgaaccgggtgcaggtgaccgctggcggcgccaccgacctgcagaagttctacaccgcgctgtaccacgtgttcagcaacccgaacgtggccagcgacaccaacgggcagtacatgggcttcgacaacgcggtgcacacctcgtcgttcccgatctaccagaactactcgggctgggacatctaccgctcgtgggccgcgctggtcgcgatggtcgcccccgaggtgatgaccgacatcgtcaagtcgatggtgctcgacggccagcagggcggcctgctgcccaagtggtcgcagcagagcatcgaggacttcgtgatgcccggcgacccgggaccgatcgtcgtggacgaggcgtaccagttcggggtgcgcggcttcgacaccgcggcggcgctgaccctgatgaagaagagcgcgaccggcggctcgacgcagggctacgtgctgcgcggcaacgagggcacgtacgagagccagcactacatcgccggcaacccgtcggagaccctggagtacgcgtcgagcgacttcgcgatcagccggttcgccctcgcgctgggcgacaccgccacctacaacacctacgccacgcactcgcagtactggcggtcgctgttcaacggcgagtcgtcgtacatccacaaccgctccggcgggttcccgtggccgctgaacccggccaccgagtcgccgtacaccgagggcaacgccgcgcagtacacctggatggtgccgcacaacctgggcggcctgatcaccctgatgggcggcaagagcaccgcgatccagcggctcgaccaccacttcacccagctcaacggcggactgtcactgccctacttctacgtcggcaacgagccggagcacggcgtgccgtgggcctaccacttcgccggcaaaccgtccggcgccagtgacgcggtgcggcgggtgatgagcgagtcgttcaccaccggcgccggcggcctgcccggcaacgacgacctgggcgccacctcggcgtggtacgtgtggtcggcgctcggcctgtacccggtcacccccggcgcggacaccctggcggtgcacggcggcatcttcccgagcgtgctgatccggcgctccaccggcgacctgaccatctccggcggcagcgcgaccagtccgtacgtccagtccctgtcggtcaacggaaaggcaacgacacacaactatctgcggtacgccgatctcgcctccggtggcagcgtgacgtactcgatggggtcgtcgccctccgcctggggcaccggcagcggtgacacgccgccgagtttcggtgacggcgccaccccgccgatcgccgaacccgacctgggtgcgaacctcgccgccggcaagccggtgattagcggctcggccgagtgcggcagcagcgagaccgcggccaaggcggtcgacgggctgctccggaacaacagcaagtggtgcaccggcggcacgccgaaaacgctgaccgtcgacctcggctcggcgcagaacgtgtcctcggtggtgctcaagcacgccggcctcggtggcgagacgaccggctggaacaccgccgactacacgatccagaccagcaccgacaacgccacctggaccaccgtggtgaccgtcgccggggcccggaacagccgcagctacctgccgttcccggcgcgtgcggcgcgctacgtccggctggccgtcaccaccccgagcaacaacggcgacgccgccgcccggatctacgaattcgaggtgtacgggcagtcctccgccccggccgacctggcgctgcgccgcgcctcgtcggcggactcgtcgtgcgccgccaccgaaagcccggaccgggcgttcaacggcagctggctcggcggctggtcggacaagtggtgctcgcagagcacctcccggtggctgcagaccgacctgggcggcaccacccacatcggctcggtggtgctccggcacgccggcgccggcggcgagtacccggcctggaacacccgggacttcgacgtactcacctccaccgacggcagcacctggacggtccgtgcctcggtgcgcggcaacaccgccgactccaccacctcgacgatcaacgccgacgcccgctacgtccggctcgacgtcatcaccccgacgcaggacggcagcgccgcggcccgcatctacgagatggacgtccgcggctga

SEQ ID NO: 898 - DNA, 1611 bp, Actinoplanes utahensis
atggcggagacatcagccaccacgtcctcgtcgcccggcgggcgcccggcagcgacgatcggccggaaactggccctcatcttcgcgagcatcggcgtgctgttcgggctggtctccgtggtggtctaccgctccgtgaacacgctcacggacaccgcgggcaaggtcgagcacacctatcaggtgctcgaccggatcgacgcgctgcggtccagcctcaaggacgccgagaccgggcagcgcggctatctggtcaccgggcaggacgcctacctcgctccgtaccagcaggcactgaccgacctgggcaccgagcagcagcaactccgcagcctcaccgcggacaatccgaagcaacagaaacggctcgacgatctcgcgccgctggtcgatgcgaagctcgccgagttgcaggagaccatcgggctccgccgggacaagggcttcgaggcggcccgcacggtggtgctcaccgacaagggcaaagccgtcatggaccagatccgggcggtggccgaggcgatgagcaccgaggagagcagcctgctcggcgtgcgcgccgcggcggcggcctcggccaagcgcacgacacaggtgaccatcgtcgcggggctcgtcgcgctgctcgccggaatggccgcggctgccacgctgatcacccggcagaccagccggcgggtgagccggctgcgggccgcaatcaccagcctggcaggtggtgacctcacctcggcgagcgggctgaccaccggggacgagttcgggatgatgggccgcgatcttgatcacgcggtcgactcggtccagacgatgatggccgagctggccgccacggtgaccgagctctccacctcggcgcaccagctggcccagctgggcggtgacctcaacagcggcgctgacgaggcttccggcaaggcgatcgccgcctccgaatcggcctccctgatcaacgccagcgtcgagtcggtcgcggcgggcgccgagcagatgaccgcgtcgatccgggagatcgccggcacctccgcgcaggccgccgcggtcgccaacgagtcgctggagatcgcgagcagcaccagccggcagatcagtgaactggggcagtccagcacggagatcagcgacgtggtgcggctgatcacctcgatcgccgagcagaccaacctgctggcgctgaacgccaccatcgaggcggcccgggccggggatgccgggaagggcttcgcggtggtcgcctcggaggtcaaggacctcgcccaggagaccgcccgggcgaccgaggacatcacccggcggatcgccgccatccagtccagcagcgaggccgccggcgtggcggtacagcggatacagcaggtcatcgggcagatcaacgactacagcaacacgatcgccgcggcggtggagcagcagtcggcgacgaccaacgagatgacccggtccatcaccgaggccgccgagaacagccggctcgtgcgcaccagcttcgccgcggtcgcccaggtgacgtcgaccacggccgacgccgcccaggccagccggcgcgccgctgaccacctctccgcactggccggcaagctcaacagcgtggtcagccggttccgctactga

SEQ ID NO: 899 - DNA, 2073 bp, Actinoplanes utahensis
atgtcatcccgtgcccgttgggcggccaccgccgccgcactactactggggctctccctcgccccgctcccggcccaggcgcgaccggccaccaccgtggccgcgcccgcgatctcgctcgacgccggccagcacgccctgatccgcttccggctcaccggccaggcggccctcgaccgcctggtcgcatccggcgccgacctggccgcccacccccggtccgaccgcggcggcatcctggccgacgtggtggtcgacgccgcgcaactggcgtcgctgacccgcggcggtgcggtgccggtccagctcatccagcaggagacgcaccgcgccgtcgcatcgcgcgggatcgccgtggcggccgccgacacgctgcatttcctgcaggcctactggtggaccaccggcgggaagacgttcctgcagacccaggtggcgaccaccgccaccggcgatccggacgtcgagatcaccgtgacctggacgaccgcggacgggaagaccggcacgtacccgctgatccggttcgaggactccggcgaataccagtaccactacgcgttgccgcagccgctgcccggcagaccggtgaaggtcaccgcgagttccagtctcggcggcgtctcccgcccggccaccccggcgacctggcccggcgccaccccgccgcccgcgccggccgggtatcagaaggacttcgtcgcggcatacatgacgcccaccgacatccgggcgcggatcaagcgactggcccggcagtacccgaagctcgtcgacgtcatcgatctgccgaacaggacccagggatatcgccgtacggcggtggcctacctcggagatcccgccgcggccgccgtggtcgtcgagtcggtgaagttcggtgaccagggcgggaacgggatccaggtgcgcaccgtcgacccgggtgcgccgaaccggccgctcgccgcgtcgtacgccgaccgggtgctcaccgtgcggctggccaccgacgccgccggcaagacgatcagcaccaccgacgacgtggccgcggtcatcagcgcgaagtacccgcagcggttccgggccaccgtcgagaccgggtcggccgggctgccgatgccggtggtcgccccggtccggctcgacgacgggctcaagggcaccgaggtgtcgaagaagccgtggaccgtgcaggccctgcggatcggcaaggtgcgggacggctcgaagatcggggtgctggcgtattcccaggaacacgcccgggagtgggccaccccgctggtcaccctggagttcgccgagcggctgctggccaactacgccaccgacccggccacccgcgacctggtcgacaacgtggacgtgttcatcatcccgacggtcaacccggacggggcgaactactcgttcaacgacttcaacttccagcgcaaaaacctggtcgaccactgcaccggcgccagccgggacccgaagtaccgggactcctggggtgtcgacgtgaaccgcaactacacggtcggctcgttcttcgacgggtacgtcggcggcagcgcgaactgcctgtccggcacctactccggcaccggtgagctgtccgaggcggagagccgcaacgtgatcgcgctggccacggcgcacccgaacatcaggttcgcgatgaacgtgcactcgtacggcggctacttcatgtggccgcccggggcataccgggcggacggccgggtcaccctgccccgcccgtcgatcgacgagtcgaagttcttcctggacagtgcccggcgcatcgtgggcgcgatcgcggcttcgcggggcacggtgacctggccggcctacaccgggccggtcgccgacgtgctgtactccgcggccggcaactcggccgacgagctctactacgagctgggcatcgacgcgtgggacttcgaggtcggcaacgaccgctggaacgacaccacccagcagtgggagggggtcggcttccagccgccgttcgacgaggcgcacgccgaatcccaggagtacgccggcgggctgatcgaactggtccgggtcgcccgcgacagccaggccgccgttcactga

SEQ ID NO: 900 - DNA, 1011 bp, Actinoplanes utahensis
atgggctcaaccatgcggttccggatcggcctggccgacctggcgtcggcctcgctggcgtattcgccgttgcaggaggcggcgctgagcctacggatgtggtcgcatcccggctattacgtcgagcagaccggctggttccagcggatgcgcgcggatttcgacgcgctgcccgaccgggatctgctgcgcgcgctggtcgcctccaaccggttcgtcccggacttcctcaccccacgcccggccaccacccgcccggccctcgccgacgagctggccctgctccgggccaccccgcccgagctggtcgggccggacctggagcggaccttccggccgcacgaccgggaggtgccacccctgctggcggagctggccgccgatccggaggcgatgctcgaccggatcgcccgtgcgctggccgggtactgggatcgctgcctcgcgccgcgatggtggccgcgggcgcggtcggtgctggaggcggacctgatctaccgggcccggatgctcgccgaggggggcgccgacgcgctcttcgccgacctgtcgcaccggttgtactgggaggacggcgtgctgacgatccgctgggacgggccactggagatcgcccgcgaccgggtcgacgtgaacgggcgcgggctggtgctgctgcccacctgtttcgcccggggcgcgatcaccgcgatcgacccggacctccggccggtgatcatctatcgggcccgcggcctgggcacgatgaccgagagcctgcggccgccgccggcgttcccggcgctgcgccggctgctcggcgagccgcgggcccgcctgctgctgatgctcgacgagccggcctcgaccaccgagctggcgcaccggctcgccgtcacgccgggcgcggtcagtcagcatctgcgggttctctacgagagccggctggtcgaccgcgcccggcacgggcgggtggtgctctacttccgcagcgcgctgggtgactccctgcgcgccggcacggatcagtga

SEQ ID NO: 901 - DNA, 1239 bp, Actinoplanes utahensis
atgggttccacagtggccgaaaccgccaccagcctgctcccccgcgatccggtggtccgccgcctcgccgggatggtcctggtcaacacactcggcaacggcatgttcatgaccgccagcgcgctctacttcacccgggtcgccggcctcagcgtcgcgcgggtcggcctgggtctgaccatcgccggcgcgtgcggggtcgcggcgagcctccccgccggccgggccgcggaccgctggggcagccgccgcgtgctgttgctgctctgcctcctgcaggccgtgggcatggcggcgtacaccctggtgcacgggttcatcgtcttcctcgcggtggtctgcgcggagaccgcgctggaccgggcggccggcacggtacgcaacacgctgtacgccgacactctcccgccggagacccgggtgccgggccgcgcctatctgcgcgcggtcaccaacgtggggatcggcgccggcgccgcgctggccgcggtcgccctgcaggccgacacccggggcgcctacctggccctgattctgggcaacgcggccaccttcctggtggtggccgcgatcctgccggccatcccggccaagcgtcggccggttcggggcaccgccgccggtccggccgtcgccagccgccgcaacgcgctcaccgaccggccgtacctgctggtcaccgccctgaacgcgctgctcagcatgcagttcgcggtgctcaccgtcggcatcccgctctgggtggtccgggagaccaccgccccgcacgcggtggtcggcgcgatcctgctgctcaacaccgtgctggtggtgatcttccaggtccgggccacccgcgccgcgcggaacccggcccaggcggcccgggcctgccgccgcgccggctggctgctcgccgtctactgcctgctgatcgcgggcagccacggcttcggcgcggtcccggccaccctgctgctggtgctggcggtcaccatcggcacggccggcgaggtgctctcccaggccggcggctggctgctcagctacgacctggcggcggagcacgcggccggcgcctaccagggcgtcttcaacgccggcagttccgcgggcatcatgctcgcgcccgccctgatcacggtgaccgccatcgaccacgcgccctggggctgggcggtgcccgccgccatcttcgcgatcagcggcgcggccctggtccccgcggtccgctgggcgaccagatccccggcggcctga

SEQ ID NO: 902 - DNA, 996 bp, Actinoplanes utahensis
gtgggcccgatgaccgcgctgttcctggcggccgacggcggcaactcgaagaccgacctggtcctcggtaccgcggacggcgagatcctggcgatggtgcgcggcggcacctcgtcgccgcacaacatcgggctggacggcaccatcgaggtgctcggcaagctgatcgccgcggcccgggccgaggccggcctggcggcggacaccgcgatcgacgcgatcggcgtctacctggccggcgccgacctgcccgacgaggtgaccgccctgcacgaggcggtcaccgcgcagggctgggcgcggcgggtccgggccgacaacgactgcttcgccctgctccgggccggcgccaggctgccggacgcggtcaccgtggtctgcggcgccggcaacaactgcgtcggccgggccgccgacggccggaccgcccggttcgtcgctctcggcccggtctccggggactggggcggcggccacgacctggccgactacgccctgcgcgcggcggcccgcggggaggacggccggggcgacccgaccgcgctgtccgcggcggtcgccgggcacttcggcctgcccacggtcgaagcggtcagcatcgccctgcaccgcggccacctgtcggccgcccggatcccggaactggccccgatcctgttccaggtcgcggccgccggtgacgaggtggccgccgcgctggtggcgcgccaggccgaagagatcctggcccagcaccgggtcgccgccggccgtctcggcctgctgccccggccacactcggtggtcctgggcggcagcgtcctgcaggcccggcatcccctgctgcacgaccgggtgctggccggcgtccgggcccaggcgccgttcgccgaggtcaccgtgctggactcgccgccggtgaccggggcggcgttgctcgccctggacgcgctggaggccggcccggccgccgagcgggccctgcgcggcatcttctccgggcgggtgccggcgtga

SEQ ID NO: 903 - DNA, 1257 bp, Actinoplanes utahensis
ttgaaaatcgcggtcgtgggtggcggatccacctataccccggagctggtggacgggttcgcccggctcggcaccatggtcaccgaactcgttctgatcgacccgtccgcggagcgcctggacatcgtcggggcgttcgcggcgcgcatcttcgcgcagtacgggcatccggggaaggtgacctggacgaccgacctggacgcgggggtgaccgatgccgacgccgcggtcatccaactccgggtcggcgggcagcgggcgcggatcagcgacgagtcgttcccgctggaatgcggctgtgtgggacaggagacgaccggggcgggtggcctcgccaaggcgctgcggacggtgccggtgattctggacgtcgccgaacggatccgggcgcgggccaggcccggggcgtggatcgtggacttcaccaacccggtggggatcgtgacgcgggcgctgctcgatgccgggcaccgggcggtgggactgtgcaatgtggcgatcgggttccagcgacggttcgcctcctatctggaggttccgccgggctcggtggtcctggaccatgtggggttgaaccacctgacgtgggagcgggcggcgttcgtcgacggcgttgatcgacttcccgaactgctctcccggcacctgtcggacatcgcgggacaggtggatgtgccggcggagatcatctccatgctgggcagcgttccgtcttactatttgtcatacttctatcgccatgacgggcatgtgcgcgaggcgttgggggcgcccacccgcgggcagcgcgtggcggagatcgaggcgaccctgctggacatgtaccgcgatgtcaccctgaccgagaagccggccctgctcgccgaacgcggcggcgccttctactccgaagccgccgtcggcctgctcgcctccctgttcggcctcgacgacgacgccgtccactcggtgaacgtccgcaacctcggcaccctgccgttcctgcccgccgacgcggtcatcgaggtctccgcccgcgccggccggaccggccccgatccgctgccggtcaccgctctgccgcccgacctggccggcctcatcacgcacacctggtcgtacgaggaactcgccctcgacgccgccctgcgcggtggccgcgaccgtgtctaccgggcgctgctggcccacccgctgatcggccagcacgaaagggccaccgccctcaccgacaggctgatcgccgccggccgtgaccacctcgcgtgggcccgatga

SEQ ID NO: 904 - DNA, 870 bp, Actinoplanes utahensis
gtgagtctcgtcctggaccgcccgatcgtgcgggccgcggcagaacggcgccggatccggctcgcctggatcgcccggcacagcatcgcgatcgcgctcggcatcatgttcatcaccccggtcgcgtacctggtgctgctctcgctgatgaccagcgaccaggcgctgaccagcgattactggccgaacacctggcacccggagaactacgtgcgggtgttccaggcaaccccgctgccgcactatctgttcaacacgatgctgtacgcggtgtccgccaccgtcttcaccctcgcctccagcgtgcccgccgcgtacgccctggcgaagttgaagttccgcggccgcaacgcgctgttcctcacggtgatctgcgtgatgatgctgcccccgcaggtggtgaccgtcccgctgtatctgatgtgggcccggtacggcctgaccggctcgctcgccccgctgatcatcccggccctgttcggcgacgcgttctgcatcttcctgctgcgtcagttcctgctcaccattccgagcgaatatctggacgcggcccgggtcgacggctgcggcgagtggcgcaccctgctgcgcgtcgtgctgccgatggcccggccgggaatcgcggcggccggcctgttccagttcttctactgctggaacgactattacgggccgctgctctacaccagcgagaacgagaactcgtggacgctctcgctgggcctggcctcgttccggaccgtgcaccacgtcgactggaacctggtcaccgcggccaccgtgctcgccatggcgccgctgatcatcatcttcttcttcgcccagcgcagcttcgtgcagggcatcacgctgacaggattcaagggttga

SEQ ID NO: 905 - DNA, 927 bp, Actinoplanes utahensis
atgctcggcgttcgcctgcgccggggcgcggtcaccctctcgtttctggcgcccgcgctgctcggcatcgggatgttcttcgtctaccccctgatctcggcggtctacttctcgttcacgaaattcgacctgctgaccgtgccgcagtgggtcgggctggacaactaccggcggatggccggcgatccgttcctgctgcaggcggtgcgcaacacgctgtggatggtggcggtcttcgtcccggtgcggatgctcttcacgctcggcatggccatgatgatcgcgcagttcaagcggggcgccggtttctaccgcacgctgttctacctgccgtcgttggtcccgccggtggccgccaccatcgccttcgtctacctgctcaagccgggcaccggcccggtcaaccacgtcctgtcgatggtcggcatcgacggcccgctctggttcaactcgccggcctgggccaagccgtcgctggtcctgctcggcctgtgggcctgcggcgacctgctgatcatcttcctggcggcggtgctcggcgtcccggagagcctctacgaggccgcgtcgctggacggcgcgaacgcctggcacagattccggtcgatcaccctgccgacgatccgcccggtgctgctgttcgcggcggtcaccggcgtgatctacacactgcagtacttcgaccaggcggcggtggccggctcgatcgccagcgggcaggccaccgtcggcgccggaatctcccagtccttcggctacccggagggctccaccttcacctatccgctgtggctgttcaccgtcgggttccgctacagcgcgctcggctacgccaacgcgctggccatcgccctgttcgtggtcgcgctcgcgatcaccgtcgtcctgctgcgccgcgccaaggcgttctccggggaggaatcgtga

SEQ ID NO: 906 - DNA, 1305 bp, Actinoplanes utahensis
atgccctatgccctttttgccctagctagtgcggctttgctggtcaccggctgcacccccgcgcccaaggagaccaagatcgccgatcccgggacgcaggtctccgggacggtcgagctgtggcacttcttcaccgagcgcgaggcgcaggccatcgaccaggtggtcggcgacttcacggcgagccacccgaacatcaaggtgaccgtcaaatccggtcaggacgactcgaaggtgacccaggcgatcggcgccgggaacgggccggacatcgggctgtcgtactcgaccgacatcgtgggcaaattctgctcgtcgggcgcctgggtggatctcaccgcgtacatcaaccgggataaaatcgacctcaatcagctgaacgcgacgacccggtcctacaccgagttccagggcaagcggtgcgccatgccgttcctggccgacgcgtacggcatgttctacaacaaggacctgttcgcgaaggccggcatcgccgggccgccgaagacgctcgacgagctgaccgaggacgccaagaaactcaccgtgcgcaatgccgacggctcgctcaagacggtgggctttcttccgctgtacgactattacgagaacgccgcggcccacctggccccgtccaccggcgcgaaatggctgaccccggacggcaagagcgcggtcggcgccgacccgaattggaagaccctgctgaactggcagaagagcctggtcgactggtacgggtacgacaacctgaccaggttcaaggccggtctcggcgacgagttcagcgccgacaacgccttccagaagggccaggtggcgatcaacatcgatgccgaataccgcctcgccttcctcaaggatcagagccccaagctgaagtacggggtggccccgctgcccaccaccgacccggcccgatacggcggcggttacgtgaccggcaacatcatgggcatctcgaagaacgccaagaaccccgaggcggcgtgggagctcatcaaatatctgaccaccgatgacgccgcggtgaccaagctggccggtctgctcaagaacgtgccgaccaccaccaaggcgatcgccgacccgggcctgaacgccgatccggacttcaagacgttcatcgacatcttccgcaacccgaactcgatgaccaccccgccgtccgcctccgggccggcctaccaggagaccttcgggcagttcctgaccagctaccagtccggcaagggcggggacctggaccaggggctggccgcggcggaccagaagatcaacagcgtcatgagcctgggcggctga

SEQ ID NO: 907 - DNA, 1164 bp, Actinoplanes utahensis
ttgacgcgtctggccggctcgtccaagctgctccgcgccatgaacgagagcgcggcgctggcacacctgctcgacccgggcatgctcacccgggccgacctgcgccggctcaccgcgctgtccaccccgaccatctccgaggcgctgcgccggctcaccgaggccggcctggtcaccgtcgtcgggcacgacagcggccggccggggccgaacgccgagatctacgcggccgacccggacgccgcgtacgcggtggccgtctcggtccgcgacgtcggcgccagcggcaccccctcgctggccgccgcgctctgcgacctgaccggcgaggtgcgggcccggttcgagtcccgggtcgacttcctcgccgccgacccggtcgccaccctgaccgacgcggtcgaccagctgctcgtgacggccggggtcccggccgaccggctgcggcacgtgcaactcggcgtccccggctcgtacgacgcgcgcaccgagaccatccggctggtccacgtccccggtttcggccggcccggcctggtcccggcgatcgccgcggcgctgggcaccgaggtgggcgtcgacaacgacgtgaatctggccgcggtggccgagcgccggcgcggcaccgggcaggacgcggagggcttcgcgctgctctggatcggccaggagggcctcggtctggccatcgacatcaacggaacgttgctgcgcggcacccgcggtggcgccggtgagatcgggtacatgccggtctacgccccggactccgccgaccgcaagctcgacctgcaggacctcttcggcggcggcgcgatcctcgagctggcccgcgagcacgggctggccggggacacgccggccgaggtggtggcggccgcgccggccgagttcctggaggtgctggctgaccggatcgtggccggcctggccgccgtggtcgccgtcctcgacccctacctcgtcgtgctcgccgggccggtcgcccgggccgggggcgacaccctgctcgccgccgtgaaccgggccttcctgcgggccgccccgctggagagctcgttcgcggtgaccgccatcgacgacgacgcggtgctgctcggcgcgctggacgccgggctggccgcggtccgcgaagcactgatcaccgccatccgcgactcctga

SEQ ID NO: 908 - DNA, 834 bp, Actinoplanes utahensis
atgccccttcacattcgcagaaggacgatcgcctacgccgcattgtccctgctcatccccggtatcgcagtcacctacggcctcctgccggccgacgccggcacggtcacaccatcgacggtcgtcgccgtcgccagcaaaaatctcgacgatccggcgaagaaggaggtcgccatggagatcgtttcggcggctgagaactcgtcgctcgactggcgcgcccagttcgcctacatcgaggacatcggcgacggccgcggctacaccgccggcatcatcggcttctgttccggtaccggcgacatgctggagctggtcgaggcgtacaccgccaccgaaccgtccaacggcctcgccaagtacctgccggccctgcgcagggtcaacggcaccgactcgcacagcggcctgggctcgaagttcgtcaaggcgtggcgggcggccgcggccgacccggtcttccaggccgcccaggagtccgagcgggaccgggtgtacttcaacccggcggtcgccgacggcaaggccgacggcgtccgcgcgctcggccagttcgcctactacgacgccgccgtcgtgcacggctacgagggtctgcgcgccatccgcaagcgcgccctggccaaggcgaaaccgccggcccagggcggtgacgagcgcaaatggttgaacgcgttcctggacgagcgggtggtcgagatgaagaaggaggaggcgcactcggacaccagccggatcgacaccgcccagcgggtcttcctgaacaagggcaacttcgacctgaacacgccgctggacttcaaggtctacggcgacccctaccacatcggttag

SEQ ID NO: 909 - DNA, 648 bp, Actinoplanes utahensis
atgctgggcgacgacgacgcactcgacacctcggtcctgaccgagcgccagcgccggatcctcggggtcatccgggattcggcgctgcgccacggctactcgccgtcgacccgggagatcgccgacgcggtcgggctggcctccacctcggcggtcgcccgacacctgcgggccctggaggatctcggcttcctgcggcgcggccgggcgacccgtccgatcgacatccggatgttcctgcgggccggcgacggaccccgccgcgatccgggcaccatcggggtgccggtgctcggggagatcgcggccggcgccccgatcccggcgcaggagaccgccgacgaggtgctgtcgctcccccgggatctggtcggccggggcagcggcctgttcgcgctgcgggtgcgcggcgactcgatgatcgacgcggcgatctgcgacggcgacctcgtcgtggtcaagcagcagccggaggcgtacaacggcgacatcgtggccgcgatgatcgacgacgaggccacggtcaaggtgttccgccgccgcgccgggcacgtcgtgctgcagccgcggaatccggcctacgccgacatcgacggtgaccgggccaccatcctcggcaaggtcgtctcggtgctgcgcagcgtctga

SEQ ID NO: 910 - DNA, 696 bp, Actinoplanes utahensis
atgcgccgcccggcctgcgttcgtaggctcgatgccatgacgatcgacaccgggccggcgatccgcaccccggcctcccgagccgccgcgctgccggtcgcactggtggccgggctgctgctcggtgtgctcgacttcctctggatcaaattcgtaccgggcccgttcggcgggctggggaactcggtcgcggtctgggcggtcgccgcgttcctgctcaccttccgccaccggtggaccctgcgggtcagcctgctggccgccggggtgcaactgatcgtcgcggtccccgcttaccacctggccgccgctctgatccagcacgacgacccggcgaacgcctacgacaccaccgccctggcctgggcgggcctgggcgtcgtcgcggcgctcgtgttcggcaccggcggcgcgctggcacgcggggcgaggaccccggacacggtgcggcatctcgcgctcgccctgcccggcgcggtgctgttcgccgaggcgggcctgcagctgcgccggatcggggaaccgtcctactcgacgggcgcgctgaccgcgtacgccgcgattctgctcttcctgggcctgctgacgaccgtgctgatggtgccggcctggcgccgtcgcggcctggttctggccctggccctgccactcaccgcggccggtttcgtcgcgttcgacctgaccggcctccactga

SEQ ID NO: 911 - DNA, 483 bp, Actinoplanes utahensis
atgcaaggtgacgcccgtgtcatcgagttcctcaacgagcagctcaccgcggaactgaccgcgatcaaccagtacttcctgcacgccaagatgcaggacaactggggttacaccgtgctggccaagcacaccagggccgagtccatcgacgagatgcggcacgccgaggtcctcaccgaccggatcctgttcctcgacggcctgccgaactaccagaagctgttcgcgctccggatcggcgagtcggtcagggaacagttcgagtgcgacatgaagatcgaggtggaggcggtcgaccggctgcgccgcgggcacgactacatgcggtcggtcggcgacatcacctcggcccggatcttcgaggacatcctcgccgacgaggagcaccacgtcgactacctggagacccagctcggcctgatcgagaagctcggcgagccgctctacctgcagaacgtgatcgaacacccggaagccggctga

SEQ ID NO: 912 - DNA, 192 bp, Actinoplanes utahensis
atgttcgtctgcatctgtcaccacgtccgcgaacgcgatgtgcgcaccgccatccgctgcggcgcgcgcaccgaggcgtcggtcggcgacgcgtgtggcgccggcaccgggtgcggcagctgcctggaccggatcgccgacctgatcgaggaggagggctgcgccgacacgcgactaccctccgctgcctag

SEQ ID NO: 913 - DNA, 1356 bp, Actinoplanes utahensis
atgtcccccgtatcccccggcaccagatggctggccgccgcggccgccggcgccaccgtcgcggccggcgccgtcctgctcaccaccggcaccgccgaggccggcacgatcagcggcccgctctaccgcgacccggacaccgcggtggcccgctgggtcgcggcccacccgaacgactcccgcaccgccgcgatccgcgaccggatcgccagccagccggcctcccgctggttcgccgacttcaacctcggcaccatcggctcggaggtcgccggctacgtgaacgcggcgaacgcggccggacagatcccggagctgaccgtctacggcatccccgaccgggactgcggcggggccagcgccggcggcgcgccggacctcaaccagtaccagaactggatctccgcgatcgccgcccacctgggcaaccggaccgcgatcgtgctactcgaaccggactcgatcgcgctgcagacctgcctgagcgccgaccaggtcaccgcccgcgacgaggccctggccaccgccacccggacgctcaaggcggcgaatccgaacgccaaggtctacctcgacgccggccactccgcctggaacagcgcgggcgagcaggcgaaccggctggccgcggcgggcgtcgcgaacgcggacggcttctacagcaacgtgtccaacttcaacccgacgtcggccgaggtcagcttcggcaaggcggtgatctcggcgctgaacgggcggggcatctccggcaagcaccagatcgtcgacaccagccgcaacgggggcgcctccggggactggtgcggggacgacaacaccgaccgccggatcggcctctaccccaccaccagcaccggggacggcgacgtggacggttacctgtgggtgaagccgccgggcgaggcggacggctgccggtacgcggccggctcgttccagccggacctggcgttcagcctggccaacggcgtcccgaacccgccgtcgcccagctcgccctcgcccggctcaccgtcgcccagctcggcctcgcccggttcctcgccggcaccgaacccgggcggtgccgcctgctcggcgacctaccgggtgaccagctcctggcagggcggctaccaggccgcggtcaccgtcaccgcgggccgggcgatcaccggctggacggtcggctggaccctggccggcggccagacgatcagccaggcctggaacggcacgctgagcgtcagcggctcggcggtcaccgtccgcaacgtgtcctggaacggctcgctggcgtccggcgcgacggcggacttcggactgatcggcaccggcgcggccaccacgccggcgctgacctgcaccgcggcctga

SEQ ID NO: 914 - DNA, 1173 bp, Actinoplanes utahensis
atggacatcgccgggcgtcatgagttccgtgttctcgccgccgcgcaccccaggctgccgctcctgctgaccgcgggtcggctggcccgccggctgcgccgggtgccgcgggtcggctgggtgaccgccgacccgctgaccgcccggcggatcctcaacgatccggagcatttcaccctgctcggcgagggcggggtcgggcatctctgggcgcaggtgctcggtgactgggtctacgagatcttcgacgggcccgggcaccaccggctgcggacccggacccgggacctgttcaccgacgagagcgcccggcagctgaccgaccgggtgatcgggccgcggctcgcccgggcgggtgcgcagctgcgggccgggcgcacggtcgacgtggccgatctcgcccgggtgctggtcggccggatcgtcgcggacctgctgcggatccccgcggcggaccacgacgacgcgtaccggcagatcttctcgaccggcgaggaactcgccgccctggctctgggcaccaccgcctccacgcacctcgcgccggagacggtcggccgggccagggccatcgtggcccggctgaccgccaacgtcgccgggtcgtggcgcaccgcgccgccggagaccgtgctgggccgctgccgggagctcggcctcgaccagcggcaggcggaggggctggccacgctgctgatggtggccggcaccgagaccgcggccagcgcgatggcccggaccgtggcgctgctgcacgacaccggggcgcagcaccggctgcgggccgagccggaccggctgcccgacgcggtccgtgaggggctgcgggtgaccacaccggcgccgctgatcgggcgcgcggtcagcgcggacgtgaccgtggacgggcggcggctgcgggccggggagcgggtgctgatgctgacctggaccgcgaacaacgcggccggcggcttcgacctggaccgcggttacctgccggagcagcggcagctgtggttcggggcgggccggcacctgtgcctgggggcgccggtcgcccgggccgagatcgccggcctgctgcgcaccctgctggccggcgacgggccgtggcggatcgggcggcgaacgtaccgccgtagggtgctgatcccgtcctacgcctcgctgccggtgtcgatcgcggcgtag

SEQ ID NO: 915 - DNA, 480 bp, Actinoplanes utahensis
gtgacctcgcccacccccggccgccaggccgccggctgcgcgagcgggctgggctgcggcgtcgtggtgctgatcgtggccgccgcgccgctcgccctggtctggctggtgctgcgctgggccggcgtgcatctgcccagcctcgtcaccgtgctgcacgggccgccggccgggaccggctggctggcgctgagcacgatcgccgcgctcgccgtcctggtggtcggtgccgggctggtcgcctggatgttcctcagcgactcggtgcccgagccgctgccccggcgggtgtacctggtctggctgatcccggccctgccggtgctggacctggtgtcgatcgtcgtggcctggatctgccgggcgctcggtcaccccgacgcggcccgcctgctcggcaccggcccgtggctggccggcgctgccctggccacggtcgccgcggtcgtctacagcggcctggtggccaacgaccgctga

SEQ ID NO: 916 - DNA, 453 bp, Actinoplanes utahensis
gtgacgctggagtcgtggctgcggcactggggatcgcggggcgcggtggcggccgagctgttcgtgcacccgcagacggtcagctaccgcctgaaccgcctgcgcgacctgctcggcccggacctggacgacccggccgcccggttcgagctgctggtggtcctgacccaccgggcgacgcgaaattcgatggccgccggcgccgtccctgacgaggatgcagcgatgtccggcacacctgagggattcacctaccgcatccgtaagaacggcgacgtggagatactccaccacggccggcccgccggcgtgctgcgcggcccggtcgcggcccgcttcctggccgacgtggacaccggcgacccgcaggagctgatggcccgggtcaccggcaactaccgccacggcaacgagcgcgcggccaggaaccatccgcgcaaccggggccgttga

SEQ ID NO: 917 - DNA, 486 bp, Actinoplanes utahensis
gtgacgactccctggcggcgggtgccggccgacctcgccgccgccatgcggccccggctgccggccatcgtgccggcgatcgccgaggcggtcgcggccgccgacccggccgtcgcggagaccgccggggcgaaattcgaccgggacgtgcacaccgcggtccgggtcgccctggaccgcttcctcgacctggccggcaccgacgatccggcgctgccgccgcggatccgggaggtgttcgtcgcgctgggcgccgccgaagcccgcgagaaccgggggccggagctgctgctcggcggactgcgcacggccgcccggctgctcctgcgggccgcttcccaggctctggtcgatgcgcgggccggtgcgccggtggccgtcgaggagatcatcgatctgtccgacgcgaccagcgcgttcgtcgacgagctcgccaccgcctgcaccgacgggctggcccggcagctgcgcgagcaggccggctag

SEQ ID NO: 918 - DNA, 2391 bp, Actinoplanes utahensis
atggcggcggcgaggtcggccggcacccgccgccagggagtcgtcacaccgggattttgtcaccccgtgctaacaaccggccagcagatcgcgcgccggaccacggtgcttcataccctgatcggagtgacgatggtgccggtcacacccgacacaccaggatcggatcccgccgtgaaacaccggatgtcccgccggcacgtggtcgacatgtgccggacgatgctcgaccgcggctacctgaaggcgaccgagggcaacgtctcggtgcgcatcccgggccacgagctctacgccgtcacgccgagcaactacgactacgacaggatgcgcgtcgaggacgtctgcatcgtcgacttccgcggtcggcacgtgccggacgagggcggcgcgggcggcctggtgccgtcgatcgagtgcgggatgcacgccaacatctaccgggagcggccggatgtgaacgcgatcgtgcacacccaccagccgtacgcgtcggcgctggccttcctgcgcaagccgatcccaccgctgaccgacgagcaggtgcgcttcctggggcgcgaggtggcgatcatcgactacgccccgtcgggcaccgggttcctggccaagaacgtccagaagaaggtgaagagcggggacaacgccttcatcatcgcgaaccacggggtggtcgcggtgggcaccgatccgtcgcgcgcggtgttcaacatggcgctgctggagaaggtgtcgatcgcctatctgatggccctggcctcggaggcgggcaaggtctacacgatcccggcgacgatccgcgagatcgcgttcagcaagctgaagagggacgaggcgcggatcgcgtcgcagatcgtcgacgcggtggagccggtccgggttgccgaggacgaggagctgccgtcggtcgccgaggtcgtcaccgcgcagacctccgacgagtcgcacggctacatgatcagtgaatacctcgacgtgccggacaccatgcggcgcctcaaggccctcgtcgaccagccgatccgcgggctgcggcacgacgcgctgctggacacgctcgactacttcgcgaccaggtgcacggccagcagagagatcaccgagcgggccaagaggttcattcccggcggcgtccagcacaacctcgccttcaactacccgttcccgctggccatcgacaaggccgagggcgcgtacctgaccgatcgggacggcaacgtctacatcgacttcctgcaggccggtggtccgacgatcctgggcagcaactatgccccggtgaacgcgaaggtggccgacgtgatccgggagagcgggccggtcaccggcctgttccacgagtacgagctgaagctcgccgagatcatcaaccggtacatgccgcacatcgagatgtaccggtcgctgggctccggcaccgaggccgtgatggccgcggtccgggcggcccgggcgcacaccggcaagaagatggtgatcaaggtcggcggggcgtaccacggctggtccgacacggtcgtctacggcctgcgggtgccgggcagcttccggatgaacgcgaagggcatcccgtggggcgccaccggccgcacccgcgaggcgttcccgcacgacctgggcaccctcaagcgcaagctggtcgagaaccgggcgcgcggcggcaccgccgcggtgatcgtcgagccgttcggcccggagtccggcacccggccggtgccgcacggctacaacgcggcggtccgcaggctgtgcgacgagttcggcgcgatgctgatcttcgacgaggtggtgaccggtttccggaccgggatgggcggggcggccgggtacttcggggtgacccccgacctgaccgtgttcggcaaggccgtctcggggggctacccgatggccggcggcgtcggcggcggcgccgacgtgatgagcgtgttcggctccggcctggacggcaagagcggcgcgcacatccaggtcggcggcaccctgtcggccaacccgctgtcctgcgcggccggctacttcgcgatccaggagatggcccggaccaacgcgccggtgatcgccggccgggccggcgaccggctcacccgtggcctgcagaagctgatcgacaagtacgggctgccgtacgtcgcgtacaaccagggttcgatcgtccacctggagtgcagcggcgtgatgctgctcgacatgcgcaacccgctcaaactgctcaaggagaacaaggcgcgcaagaccctgatggagcagatgggcgcggcctacgcggcgcacggcatcatcaccctggccggctcccggatgtacacctcgatggccgacaccgacgaggtcatcgacgacgccctgtcccggttcgaccaggtgttcgcgctggtcgagggggtctag

SEQ ID NO: 919 - DNA, 1590 bp, Actinoplanes utahensis
gtggccgtccctccgcagattctcgccgtcgacctgggcacctccgggatgaaggcggccctggtggccgcggacggcacggtcaccgggtgggccgaacgcccggtgccgctcgtggtgctgcccggcggtggcgccgagcaggatccgatcgcctggtgggacgcgctcgccgaggtcgtcgccgacctcggccgggcattcccggaccacctgcgcgcggtcaccacgatctgctcgtcgacgcagggcgaggggaccatcgcggtcgacgcggccggggcgccgctgacccgatgcatctcctggctcgacatgcgcggggcggcacatctgcggaggcagttcggcgggttcccggcgtacgacggcatctcggtccggaggatcgcccgatggctgcggctcaccggtggcatgccgtcggtgaccggaaaggatccggccgcgcacatgctcttcgtgcgggacgagatgccggcggtctacgcgcggacgcagacctttctgaacgtgctggactggatcaacctgaagctcaccggccgcacggtcgccaccgtcgactcgatcctcacctcgtgggtcaccgacaaccggaaggccgacgccatccggtacgcgccgtcgctggtcgccgccagcgggatcgaccgggacaagttcccgccgatcgtgtcgtgcaccgaggtgatcggcacgctcgcccccagcgctgccgatcacctcggcctgcccgcatccgttcaggtggtggccggagcgatcgacaacaccgcggcggccatcggggccggcacggtgcgcgacaacgagccgcacctgtacctggggacgtcgtcgtggatcgcggcgcacgtgccgaggaagaagaccgacgtcggcagcggcatcgcgtcgatcccgtgcgcgctgccggaccggtacctgatgacggcgctgcaggcgaccgcgggggcgaacctgacctggctgcgggacaagatcgtcgagttcgacgacccgctggtgtcggccggccatgtcagccgcgacgagggcaccatcttcgacgcctttgacaagatcattccaagtgtgccggccggggcggacggggtgctctacatgccctggctctacggcgagcgggcgccggtcgacgacccgcacctgcgggccggattcctcaacatctcgctgcagacgactcggtcggacctgctgcgggcggtgttcgagggggtcgcgctgaacacccggtggatggcgaaggcggtggaccggttcctcgggacaccggtgtccaccatggtgatcaccggcggggccgcgcggtcgagctcgtggtgtcagatcttcgccgacgtgctggggatcgagatccggcgggatgccgatccggtggtggtcaacgcgcgcggggcgggttggatcggtgcggtcggggctggcatgatcaactttgccgacatctcggacttagcgcgcaacgaccagattttcaccccggggccgaatcacgccgcctatgacgacatttataagatctacaccactctgcacaagcggctggcgccgatctaccgcagcctccaccagaaaacctga

SEQ ID NO: 920 - DNA, 3033 bp, Actinoplanes utahensis
atggggccgcggactgttcttgaggtgttggctgagctcgcgccggctgccggggagcggacgctggacgtcacgcgcggggcgcagccgttcgtctggctggagacggcggagaaggcgccgcgggatacgaccgtggagcggctggcggggttggcggcgctgcaccgggacgagcggatcctgcatcgcgggtgggggttcctcgccgggcgggccgaggtcgacgggaaggtgcgcaggatccggctgccgctgctgagccagccggtgcggctggaccggtcgctgctcgcctacaaggtggtgccggccggggatctggaggtcacgccgctggtcgaggaccgggagctggccgcggcgctggaggcggcgcccgggctggcgacgcccgggtggctggaggcgaccggcagccggtcatggttgcaatcggtcgcgggggccaccgggttcaccgtcgaccgggtactggaacaccggcagcggatcccggccgaaggactgcacctgatcgccgcacccgcgttgttcgtggtccgggacgtgttcggggtcggactcgcggacagtctgcgcagctgggccgggcgcgagctgggcgggacggcgctggccgcgatctacggcgcaggcgcagcaccggccgggaccggcgacgagccggcggggcgctgcggtgacccggtcatctcgccgctgccgttgaccgggccgcagcggcaggttgtcgtgcgggcgaggtcagaaccggtcacggtggtctccggcgcgccgggcagcgggaagagccacacggtcgtcgcagccgcgctcgaagtggtggatcgcggtggatcggtgctggtggcaacacagtcgccgcatgccgcggaggtgctggcacgactactgagccggtatccggggccgccaccggtgctgttcggcagcggtcatgcggcgttggaggcggagctgaccgcgggggcgggtcagggcgtcccgctgtcgctggtccgttccggccgggagcgggtccaggccgccgctgcggcggtacgtcgtcagcaggccgagattcgtcacgccctggcggtggaggcggcggccgcgtcccttccggatctgcaggccgatctgccgcggctgtccgcgatcgcgcccggcgccttcgacggcagcgtcgacctcaccgagatccgacgcctcctcgatgccgccggcgcgggcggcggctggacgagtccaccgggcgccgggaatgcgggcgccgggaatgcgggcgccgggaatgcgggcgccgggaatgcgggcgccgggaatgcgggcgccgggaacgtggatggtgggcaatccggtggctggtgggggcggtggcgggcgaagcgggcgcggcggaaggcttatcggctggccggggctgccgacgacgtaccggcgagcgtcctggtgcaggctttgaccgtcgcgaccgcgcagcgggcggcggcgcagctcgccgccaccggtgggaccgacctcggtgcgccatgggcggcgctgcaccgggccgaggcggagttgcggaccctggccggcgcggcgatgcgggatgcggcgcgcagttcggtccgctggacgccggacgcgcgccgggcggccggggcgctggccaccgcgctgcgggccggtcggaaccggcgccgggagttgctcgcccggatggaggcggcgccgctggtgggggcgctgccgctgtggatcgggacggtcgccgacgtggaggatctgctgccgccggagccggggttgttcgacctggtggtgatcgacgaggcgtcccatgtggatcagatccgggcggcgccggtgctggcccgggcgcggcgggcactgatcgtgggtgatccgcggcagttgcggttcgtgtcgttcgtcagtgatgtcgatgtgacccaggtgctggaccggcacggcgcggacgagcggctggacgtgcgacgggtcagcacctacgacctggcggcggcgagcgcgccggcgacctggctggccgagcaccatcgcagtgtgccgcacctgatcgatttcccggcgcgcaggttctacggcgatcgggtgtcggtgatgacccgcaccccgccggcggacgcgaccgatgcggtcgacgtggtccacgtgcaggccgctgagctggtcaagggggtcaacgaggcggaggtggaggcggcgctgaagcaggtggagcgactggccgcggccggggtgcgggggatcggggtggtcagcccgttccgggcgcaggccgaggcgctggaagcggcgctgctcgccgcgctgcccgccgaacggatcggggagctgcgcctgcgggtcggcaccgtgcacgccttccagggcagcgaggccgaggtggtgatcgtctcgctggccctgctggacggggacccgccgagccgtcggcgattcgtcaccgacgcgcagctgttcaatgtgatggtgacccgggcccggcggcggctgatcgtgctgacctcgctgacccggccggccggactgctcggcgactatctggaacacgccgaagagccgcgccccgtcgccccggcgccggtcgagcccggcggctgggccggggagctcgccgccgagctgcgccggctcgacgtcgaggtccgggccggataccgggtcgggccgtggatcgtcgacctctgcatcggcggtgcggtgccggccgtcgaagagcggggcgaaggggcgcgagagggtgcggtgccggccgtcgaggagccggggaagagggcacgagcgagtgcggcgccggccgtggcggagcgagatgcagggatgcgggagggcgcggggctgaccggcggcgggcagttcgtcggggtgctgtgtgccgtgcacccggacggccccgaggtgcacgcggaacgccaggcggttctgcaccgcgcggggtggcggctggtcgacgcgtttcccagccgctggcagggggacgtccggcgcgcggcgctggagctggccgcggcggtgggctcagggcgtaccccggcctga

SEQ ID NO: 921 - DNA, 588 bp, Actinoplanes utahensis
gtgcgctctgagacccgcacggcgtcacccccggtcgccgtcaaaatcgtcatcagcggcggcttcggcgtcggcaagaccaccttcgtcggcgccgtctccgaaatcgagccgctggtcaccgaggcggaactgaccgagaagtcgatcggcgtcgacgacacctcggcggtcgcccagaagaccaccaccaccgtcgccctcgacttcggccggatcaccctcgaccagacgctgctgctctacctgttcggcacccccggccaggaccgcttcgccttcctctgggacgacctggtcgacggcgccctcggcgccatcgtgctggtcgacacccggcggatcgaggactgcttcccggccatcgactacttcgaggaccacgacatcccgttcatcatcggcgtcaacaccttcgacgggtcgcggcacttcgaccatgcggagatccgcgaggccctcggcctcgccggcgacctgcccctcgtcgactgcgacgcccgccgccgggactcggtcaagaaggtgctggtcgccctcaccgaacgggtcctcacccgccgcctggaacgcgccgccatgtcgtag

SEQ ID NO: 922 - DNA, 336 bp, Actinoplanes utahensis
atgaaccccgacgacgggccgatcgtccgtccgttcatgatcaccggcggccgcaccgagccgatgcacgacggactgcggatcgagacgcagctgtacgccgcgccggccgccctgtccgccccgctgcgcttcgaatcccgccggatcgtcgaactgtgccagcgtccgatgtccatcgccgacctggcctccgcggtcggcgtcccgctcggcgtcgtccgggtcgtcgtcgccgacctgatcaccgacgggttcgtcctggtcgaccaggcccccggcgaactgtccaccacgctgatcgagaggatccgggaccgtgttcgtgcgctctga

SEQ ID NO: 923 - DNA, 426 bp, Actinoplanes utahensis
atgagcgtggaagcgcccgccgatcggcaccagttcaactggatgctcggcaacttcgtccaccagaccgacggggtgcgcgacgcggtcgccgtctcgtccgacgggctgctgatcgccggctccgacggactcagccgcgccgaggccgaccaactcgccgcgatcgtgtccagcatggccagcctggcccgcaccgcgtcccgacggtacgagttcgacgggctgaaactgatcatgatcgagatgcgccgcggcttcctggtcatctcggtcatcccgggcggcagctgcctcggcgtggtggccggcggcgacagcgacctcggactggtcggctacgagatctcccgcctcgccgaacgcttcggcgacctgctcaccccggcgctgatcgccgagtcccggcggagcctgccccgatga

SEQ ID NO: 924 - DNA, 2190 bp, Actinoplanes utahensis
atggcgcgcaggaccgaacgcgatcagaccatccggggccgggtggtccgcatgctggccctgcccctcgcggcgatgctggccctgctggcggtgatctacggcaacgagatcggccgctaccgcaacgcgaccgccacggcccaccgggtcaccctgatcctcggcctgcagagtctgatccaggaactgcagaacgaacgcggcctgaccgtcgcggtgatcggcggcaacaccgccttccgggaccggatcgccccggcccgggcccgcgtcgacagccagcgggccaccgtgcgctcggccctcggcggcaccgccagcgccgccctcgactccctgaccgacctgggccggatccgcgaccgggcggacgccggccaggacgcccgggacgacaccttcgacgcctacaccaaactgatcgagggcctcggcgacgacacccggcacctggagatcgtcgacgacctcgacctgcgccgcgacgccgagtcgctggagatgctcaccgaggtcaaggaggccaccgcccaggagtgggtgttcctggacggcgtgatcaccgccggccgcttccagaccggcgaattctcccggctgctggccatcgccgccaaccgcgacctggcactcggcgagttcgacgagttcgccgacccgcaggccgcggccgccaagaccgccctgctgtccagcggggccgcccagcaggcccgggccgtcgaggcggccgccctgcgcgccggcgaccggcagcggctgcaggccgacgccggctcctggtgggcctcggtggccacgatgctcgacgagatgaccgcgctcgccgggcagatcggcgaccacaccctggcccgcgcccaggatctgcgcgaacgcgccaccctgcggctcggggtgctctccgcgatcgtgctgctctgcctggccggatcggcctacctggcgatcggggccacccggtcactggccgagccactggccgcgctggccgccgaagccgaccggctggccggcgagcggctcccggtggcggtccggcgggccgcggccggcgacgacgccgggccacccgacccgatcccggtcatccccggggccagcgccgaggtgcgccgggtcgccgacgcgctggaccgggtgcggaccaccgcgtacgcgctcgccaccgaacaggcccggatccgtcgcggcactgccgaatccctcgccgacctgggccggcgcaaccagaacctgctgcgccggcagctcggcttcatcacccggctggaacgcgaggagtccagcccgggcggcctggccaacctgttcgagctcgaccacctggccacccggatgcggcgcaacgcggaaagcctgctggtgctggtcggcgcggccagcccgcggcagtggcccggcccgctgccgctgtccgacgtgatccgggccgcggtctccgaggtggaggagtaccggcgggtggtgctgcgccggctcgacgacgcgatggtgcagggcaccgtcgccaccgggctggcccacatgctggccgagctgatcgagaatgggctcaccttctcgccgcccgacgtcgaggtcgagatccacgggcggcggatcggcgacggctacctgatcgccgtctgcgaccagggcgtcgggatgagcgaggaggacctggcccgggccaaccagcggctgcgcggcgagggcgacttcatgaccggaccggccaagtacctcggccactacgtggtcggccggctcgccgccgagatgaacgccgacgtgcggctcaccccgtccgcggtgaccggggtgaccgcgcggatcagcctccccgccgacctgctcgccgccgacctgccgatcgccccctccccggcgcccgcgccgccccgggagcaaccgcgcaccaccgagccggtgcggatccggccccgggcgctggaagtcgactacgtggtggtcaccgaacggcagaccccgccggaactcggcggacccgaccgtaccgccaacgggttgcgcaagcggatcccccgggcgcgccgcgcggaaccggcgcccgcgcggacctcgcgcgacgacaccaccgtgaacctcattgactcacccgacgcggtacgcgaccggctgaccgcgctccgcgacggcatacagcggggcaccttcgtcacgacctccgaggagcatcgatga

SEQ ID NO: 925 - DNA, 3162 bp, Actinoplanes utahensis
atgcgccgacgctgtctgcagttcaccgccgccctctccgcctccctcctgaccacggcagtgctggtccaggtgagcgcaacgccggccaccgcggcgttcgcgagcaacgactactgcctcggcgagtgctccgacatcctgccgcccgggcagaacggcgacgccgacctcgcgcagatcctcgcccaccaggtgctgggcaccatgccgccgcacgccgacgaccagctggcgccgtacgcgaatctggcctaccactacaccggcctcacgccgcagcagatcaacaccttcttcaacgactcgtcgtacggcgtggccgcggcgaacgtggccagcaccgtcacgccccgctcggacgtcagcatcgtgcgcgacaaggcgctcggcatcccgcacgtcaccgggaccacccgggccggcacgatgttcggtgccgggtacgccggcggccaggaccggctgttcctgatggacctgctgcggcacgtggcgcgcggctcgctcacctcgttcgccggcggcgccgtgggcaaccgggagctggagcagagcgtctggcgcaactccccctacaccgaggccgacctgcaggcgcagatcgacgcgctgcgcgccgccggcacccgcggggcgcagctgtacgacgacgtcgtgcagtacctggccggggtcaacaggtacatcgacgactgcatggcggcccgggactgccccggcgaatacgtgctgaccggccacctggacgcggtgaccaacctgggcgggccggagcacttcacgccgaccgatctgatcgccacggccggcgtgatcggcggcctgttcggcggaggcggcggcaccgagatgcagtccgcactggtccgggtcgcggcccgggcgaagtacggcgcgaccgccggagaccgggtgtggcggcagttccgcgagcagaacgaccccgagacggtgctgaccctgcacaacgggcagagtttcccgtacggcgcgggagatgtgaacgccacgggtgtcgccatgcccgacccgggtcccaccccgcagccgatcgtcttcgaccggaccggttccgcgctcaccggcggcgggaccagcacgatcgccgggtcgctgggctcgctcacgatcggcagcgcgagccggggcatgtcgaacgccgcggtggtctcggcggcgaactcggccaccgggcacccggtcgccgtgttcggcccgcagaccggctatttcgcgccgcagttgctgatgctgcaggagctgcagggtccggggatcagcagccggggcgtggcgttcagcggcctcaacctgtacaccctgctgggtcgcgggccggattacgcatggagtgccacgtcgtcgattcaggacatcaccgacacctacgccgtccgtctgtgcaacctcgacggcagcgtggcgaccacggcctccacgtcctacctctaccacggcacgtgcaccgcgatggagaacctgacccggaccaactcgtggaagcccaccacggccgactcgacggccgccgggtcgtaccggctgaccgtgcagcgcacgaggtacggcctggtcacctggcggggcacggtcggcggggcgccggtggcgttcaccgggctgcgcgccacgtacggccacgaggcggactcggcggtcggcttccagatgttcaacgagccggagcagatgggcaccgcggccgccttcaccacctcggcgtcgcacatcgtgttcgcgttcaactggttctacgtcaactccacgcagaacgcgatgtacacctccggcgcccagcccgtccggccggtcggcgccgatccggaactgcccacctggggcgacgccgccaacgagtggaccggctggaacggcgccaccgcacacccgcaggcggtgaaccaggactacttcgtcagctggaacaacaagcaggccggggacttctcggcggcggacggcaacttcagcttcggcgcggtgcaccgggccgacctgctggacgcgccgctcaaggccggggtggcggccggcgtcagatacgaccgcgcctcgctgctgaaggtggtcgagcaggccgcgctgaccgacctgcgcggcagagaggtgctgccggtcctgctccgggtgatcgacacggcgacggtcaccgacgccgcccaggccgcggcgctcgccaagctgcgcgcctggttggcgaacggcgcggtgcgccgggagacggcggccgggagcaaggcgtacgtcgacgcggacgcgatccggatcttcgacgcctggtggccgaagctggtgcaggccgcgttcaccggcgggctgggcgatccgctgttcggcgcgctggtggacgcgctgcagatcaacgagtcgccgtccggcgggcagaccgggccggtgtccaccctgcccacctcggcgaacgagtcgcaggcccacaagggatcggccttccagtacgggtggtggggctacgtgagcaaggatctgcgcgccgtgctgggtgacccggtgccgggctggtccaccacctactgcggcggcggggcggtcggcgcgtgccgcggcgcgctgctgtccagcctcggcgcggcgctgtccgagcccgccacggtcacctatccgggtgatactcactgctcggccggcgatcagtggtgcgccgacgcgatcctgcagtcaccgctcggcgggatcacccacggcctggtcggctggcagaaccggccgacgtatcagcaggtggtgtcgtttccggcgaggcgcggcgacagcgtggccaacctggcggccggccggcccggcaccgcgtcgagcaaccagtccgggtatccggccggcaacgccgtggacggccggccggacacccgctgggccagttcccgggccgacaaccagtggctgcaggtcgacctgggcgcggccaccccggtcgcccgggcggtgatcagctgggagtcggcgtacgcgaagacgtaccggatcgagacctcgccggacgggaccacctggaccctggtggccgctgttgccgcaggcgacggcggcactgacggggtcgccctgacccccaccaccgcccggtacgtccggctcaccgggctgacccgggcgaccggttacggcttctcggtctacgagatggaggtctattcccgttga

SEQ ID NO: 926 - DNA, 372 bp, Actinoplanes utahensis
atgatcttcgggcgcatctcggcggccttgatcaccgcgtcgaccgagccgacctcgacggcccgctggatgctgtgcacccggtcgaactcgccggccacctcgcccagcttctcggtgcgcaccgccgcccgcagctcgtccagctcggcggcgagcgaactgcgctcggcgccggtggccgcgccgacccgggcctccaggtcgcggatccgcgggtcggccgcggtccgggtggccacgtcgccgctgaagacgaccgcggccgccgaggcgccgcccagcaccgaggcgaacgacccctccaccgcgagcaccgtcatcgacgggttgagccgcttggagaacaccacgaacgcgccaccgtggtag

SEQ ID NO: 927 - DNA, 996 bp, Actinoplanes utahensis
atgcgtcgggccccactgccgttactcgtgttgacacacatcagcgggacgcctagctggtgccgcacggtcgatacaaatgatgatggactgatgccgcgccgacgttacgagctgcgcgaccggatcgcgggtctggacccggaacgcgaccacctggagatctaccagctgtccgcggggcgcgaattcccctgggactacacccgggcgctggagttcgcactgttccgcacctactgcgtgccgagcatctcgcggctgctggcggcgaccggcgagttccggctgcggccgcagaaacgctacgacgacaccgcgctgctgatggccgagatcgcggcgcacggttacgactcgccccgcggccgggaggcgctcaaggtgatcaaccgggcgcacggccgtcattcgatcggcaacgacgacatggtgtacgtgttgtccaccttcgtctacgacccgatcgactggctcgaccggttcgggtggcgcccgctgcacgagcacgagcgtctcgccgccttccactactaccgggaggtcggccgccggatggggatccgcgacatccccgccggtttcgcggatttcgccgcgttcaagcgggactacgaggcccggcacttcgtctactcggacaccaaccggcagatcggcgactacacggtcgggttgttcgccgcgtggttcccgcgattgctgcgcccggccgtccggctggcggtgcggggcatgctggacgagcggatgctggccgccttcgggttcaccccggcgccccgctgggtcggcgcggtgggggaagccgggttgcgggcccgggcccgggtcctccggttcttccccccacgtcgtacgtcagtcctgggaatctcacccggcaaccgcacctatcccggctatccgcgcggatatcggcctgccgacctgggcgtcagcccttcttcaggaccggcgagcgctgcagacgggccagcacccgccgcgcggtga

SEQ ID NO: 928 - DNA, 1314 bp, Actinoplanes utahensis
atgagcacgcccgatgtcaccgtggtggtcgcggtctacaacaccatgccgtacctgaccgagtgcctgaactcgctggtccggcagaccatcgggaccgggcggatgcagatcgtcacggtcgacgacggctccaccgaccggggcggcgccgagctggaccggttcgaccgccgttacccgggcctgttcacggtgatccaccaggcgaactcgggcggcccggccgggccgttcaaccgcggcatcgaggcggccaccgggcggtacgtgttcttcgtcggcgccgacgaccggctcggcccggaagcgctggagcgcctggtcaaggccgctgacgagtacggctccgacgtggtgctgggccgggtggtcggggtcaacagccggcacatctatcaggacatctaccagtccagccagcccgacgtcgacctgttcgactcgccgctgccgcggtcgctggccaacaccaagctgtaccgccgggagctgctgaaccagcacggcatccggtacccggaggacatgaagatcggcagcgacctgccgttcacgctggccgcgtgcttccacgcgcggcggatctcggtgctcgccgactacgactactacttcgcggtccgccggttcagcgccaccaacatcacctacctgagccggcacggtctgcggatcgagaccgtcgagaagatcatgacgttcgtggcgaacctgatcgagccgggcgagcgccgcgacgcgatcatggtgcaccgcttcgaccacgaggtggcccggctgctcgaggacgacgtgctgaaactcgaccggcccacccaggagcagctgcaccgcaccgtcggccggctggccggggagtacctcaccgaccggatcgccgcccagctcgggccggagacccggatccggctcgcggtcgcccggcacggcacggtcgacgacctgatcgcggtgatccggcaggacgccgaggggggcgtcccggacacggtcgagcgcggcggccggcgctacgccgcgtaccccggcttcggcaccctgcccgacgaggtcttcgacgtcaccgacgtgcccgactgggacgccaagctcgacgccaccgggttcacctgggccggcgaccaactggtgatcaccgcgaacggcggctcgccgggcagcgtcagtgccgaggagatcccggcccgggtggagcgcaccggcaagggtgtgacgatccggctggacgtggccgaggtgctggcccgctccggcgactccgggcagcggcgggcggtctcggcccagcccggcgacttcgacccggcctag

SEQ ID NO: 929 - DNA, 1266 bp, Actinoplanes utahensis
atgctcgtcgacaacggcgtgaacggcgactcgcgggtccagaagaccgcgcggtcggccgccgaggccggttgggacgtcacgctgctgggctgctcgcccgaccacgaggaacaccgctggcagatcggcccggccgaggtgcggctgctgccgatgggcggtggcggtggcgcgtccggtgggggcggcggcctcaagcgcaggctggtggagcgcggcgggctgccgctggccctggcccgcaaggcgcgcaaaccggtcgaacgcgcccaggtcaggtactggctgggtaaagagggcgaccgcgcatggcggcgcctggagcccggcctgtggaactacgagcgggcgttcggtccggtgatcgacgagctggcgccggcgctgatccacgcgcacgacttccggatgctcggggtgggcgcgcgggccaagcagcgggccgccgcggccgggcggagcgtgaagctggtctgggacgcgcacgagttcctgcccggggcacggccgcggcgggacaacgcccgctggctgccggcgcacctggcgtacgagcgggagtacgtgccgttcgccgacgcggtggtcaccgtctcggacgcgctggccgaactgctgcagcgcgagcacgggctggcgaccaggccgggcgtggtgctgaacgcgcccgcgcaggccggagctgacgacgtacccgatctgcgtcttctgtgtggtcttgatccggcgacaccgctgctggtgtacagcgggtcgtccagcccgcagcgtggcctggacaccatcgtcgaggcgctgcccgagctgcccggggtgcatctggcgctggtcgtggagaatccgtcggcaccgcacatccaggccctgaccgccgcgtccgaccgtgtccacgcggtgccctacgtgccggctgaccaggtgttccgcttcctgtcgccggccgatgtcggggtcatcccgatccatcactggccgaaccacgagatcgcgctgatcaccaagttcttcgaatattcgcacgcccgcctgccgatcgtggtgagcgacgtgaaggcgatggccgaggcggtccgggcgaccgggcagggcgaggtgttccgggcccgggacgcggccgacctggcccgcgcggtccgggcggtgctcgccgacccgaagcggtaccgggccgtgtacgacgctccggacagcccgctgccgggctggacctgggaggcgcaggccgaccggctgaacaccatctatcaggagctactcggatga

SEQ ID NO: 930 - DNA, 1602 bp, Actinoplanes utahensis
gtgcaccgatccgactcccctgccgacgttctctacctggccctcggcccccggcgcctcaccgccgccggggcgcacaccgcccgcctggccgccgaggggcactccgtcaccttggccgtgaccagcgagaacgtcaacacccccgcgggcgtcacggtgcgccgggtcacctcgccggcgcaggcccgggcgctggccgaggccgccgaggtcacctatgcgggcgacgccgaagcgctcgccgcagtttacggactcgccacccgcctcgagccgtcggccgacccgcggcgccgtcccggccccgccgacctggccgtcgtcaccccctggtacccgtcgcccgacgacgcgttcgccggcgccttcgtccgcgccgccaccggcgcggtccgcgagcacttcgcccggatctcggtgctgcacacgcagagctggttctacccgcccggccggctgcgcggccagctcctcggcgtggccgccgaacgccaggcggtcagcagcggaaacaccgtcgtcttcgacgacgcggagggggaggtcgcgcgcgtcgcggtccccactccggccggcggggactatctggcgtacgccgacgagcagaccgccgcgctccgcagcgcgctgcccaccggccggatcgaggccccggtggtgcacgcccacaccgggatcatgggcggggtggtcgccgcccggctcgcccgtcccgacgcccggctggtggtcaccgaacacgccacgtatctgtccaaggtcttcgcccagcccggcgcgcggcaccgctacgcccgcatgctggaccgcgccgacgctctgctctgcgtcagcgccagcctccgtgaccagctcgccggcttcttcccggcgcacaccggcaaactgcacgtggtgccgaacgcgatcgatttcggcgcgttcaccgtccgcccggagccgccgaaggccccgcaccgctggctgtacctgggccgcctgatggagcacaagggcgtcctcaccctgatcgacgcgttcgccgcggtcgccgccgaggacccggcgctcaccctcaccctggtcggttccggtccgctcaccgacacggtcgacgccaggatcgcggcgctcgggctgaccgggcggatcacccggcgcccgccggtcgagccggaccgggtgaccgccctgctgcacgagcacgacgtactcacccacgccagcgtccgggagaccttcggcatgacgatcgtcgaagcggtggcgaccgggacgccggtgctcgtcgcgctcagcgagggcccggccgagacgctggccgggctgtccggggtggcgggcgagacgttcgcgccgaccaccgacccggcggtgatcgtggcggcctaccgccggctgcgcgacggcttcggcaccctcgacatggcggccgcccgggcggccctcgacgcccgatacgggcgggcggcggtcgcggctcagctgctcaccgcgtaccgcggaggttcttccggcgggacgccgatgccgatcccggcacgcccgcagcgatccggcgcggtgctgccggaggcagcgacccgtgcggcccgccgcgtcatccgcaaattccgctga

SEQ ID NO: 931 - DNA, 573 bp, Actinoplanes utahensis
gtggtgctggtcctgctgcggcacaccggtgaccgggcgctggcccgggcgatgcgcgccggcctcgggctgtccacggtggggatgctgctgccggtctactggatggcgaccagcatccaccagcggaccgtgctcgacgcgaacggccgcccggtgacgatgtatcaggggcacggggtgggcggcgatccggacgggaccgggatgccgatcacgcactggaacgcgaccggcggcgacatccgggtgccgcacttcgtcgggctgcacgctgttcacatgctgctgatcaccgcggggctgctggcggtggcggcccggacccggccgtggctgaccgaggcggtgcggcggcggctggtcgggatcatggcgctagcgtacggcggcctgatcggcatgctggcctggcaggtgaaccgggggcagtcgctgatccacccggacgcccgcacgctgatcggtctcgccggatgtctcgtgccggccgccgttgcggtgaccgcggtgatcatgagcgcgcggcgggtgggggagccgcatctgatggcggcgcccaccaccgcgtag

SEQ ID NO: 932 - DNA, 672 bp, Actinoplanes utahensis
atgccgaccgacggcgaggcggcggtgccgagcctgccccgggcgccgaacctgtgcgagatcatcggccgccgtgttcccaccgacggcctcacgagccggaatcatgcggggacagaaccggctcagcatccgctggtccacttccgccgcccgccgagctgctcgtgggcagagttccacggtagtgtggatgtcatgacggcggcgttcgaggatcttccgttcagcgagttcctgcaccggccggcggcggcggccgagcgcctggaggtggtgcgggcgctgcggctacgacgccgggatgcggatgacctcgccttgatgcgggtggagcagctggaccgggacggcgtggtggtggatttgaccgcccggctgctggccggcctggttcgcacgcagccgccgggagcggtgcgggcagtgctggccgaggcgttgccctgggtgacgttcctgcccgaggccgatgtcgaccagttgctgatggagctgatcgcggtggcgcagggcgcggcgtcgctggcgaacctgtcaccggtggcggtcttgctgacccagtggcggcacaccgcggaggtgcacgccgaccccgccctgctggagatcctcacccgggaaccggaaggagaccttgggcaggccgtcgtggggaccgaggtgcagtga

SEQ ID NO: 933 - DNA, 1668 bp, Actinoplanes utahensis
gtgctgttcaacccggccacggccgacttcgcgcggttcgacgcggagacccgccgcctgctgcgcgccaccgtcgacttcttcgaggcgcgcggcaagcgggcgctgatcgacagctacatcaaccggacctggtacgccgacttcctggacttcgcggccaaggaggggctgttcgccaccttcatgacccccggcggtgacggcgacaagcggtgggacaccgcccgcaacgccgcgctgagcgagatcctcggcttctacggactcgattactggtacgtgtggcaggtgaccgtgctgggcctcggaccggtgtggcagagcgcgaacgcggacgcccgcgcgcacgccgcccgcctgctcgacgagggtcacgtgatggcgttcggcctgtccgagaaggggcacggggcggacatctacgccaccgacatggtgctcaccccggccggggacggcacttggcgggccaacggcaccaagtactacatcggcaacggcaacgtggccggtctcgtgtcggtgttcggcaagaccgacgacggctacgtgttcttcaccgccgacagccgccatccgtcgtaccacctgatcaagaacgtcgtgaacaagcagatgtacgtcagcaccttcgagctgcgcgactacccggtgcgcgagcaggacatcctgcacaccggacaggccgccttcgacgccgcgctgaacacggtgaacgtcggcaagttcaacctgtgcacggcggcgatcggcatctgcgagcacgccatgtacgaggcggtcacccacgcgcaccggcggatgctgtacggcaagccggtgacgaatttcccgcacgtgcggcgggaactggccgacgcgtacgtccgcctggtcgccatgaagctgttcagcgaccgcgcggtcgactacttccggtcggccggccccgacgaccgccgctacctgctgttcaacccgatgaccaagatgaaggtcaccaccgagggcgagcgggtgatcgacctgatgtgggacgtgatcgcggccaagggcttcgaggcggacacctacttcgacaaggccgcgatggacatccggggcctgccgaagctggagggcaccgtccacgtcaacctggcgctgatcctcaagttcatgccgaactacctgcaccacccggtttcctacgacccggtcccgacccgggacgatcccgcggacgacgagttcctgttccgccaggggccggcgcgcgggctcggggcgatccggttccacgactggcggatcgcctacgacaagttcgccgagctgccgaacgtggcccgcttccgccggcaggccgacgcgctgtgcgagctgtcggtggctccggagcagcacgccgacctggacttcctcctgtcggtgggccagctgttcgcactggtcgtctacgggcagctgatcctggaacaggccgagctgaccggcctcgacgctcagctgctcgacgcgatcttcgaggtgctggtccgggacttcgcgcagtacgccacggacctgcacggcaagacgacgaccaccgacgagcaggcggcgtgggcgctcgcccaggtgctccgcccggtcgccgacgaggcccgcaccgccgcggtgtgggagcaggtgctggcgctggtgggtgcgtacgagatgcgctga

SEQ ID NO: 934 - DNA, 549 bp, Actinoplanes utahensis
atgatgccgggcatggccctggaacacgcgatcctggtctccctgctggagcggcccggctcgggatacgagctggcccgccgcttcgagcggtcgatcggccggttctggaccgccacccaccagcagatctaccgggtgctcaagcggatggaggcggacggctgggtcaccgcgctggaggtcggccaggacgggcggcccgacaagcgggagttctccgtctcggacaccggccgcgcggtgctcaccggctggctgcacgagccggtgcagcccgaggcggtccggcacgacctggcggtcaaggtgcgcggggcggcgttcgacgacgcggccgggcgggcggcgctgatcgacgaggtggtccgctaccgcgccgagcatgaggatctgctggcccgctacctcgccggagaaaaacgcgatttctccgaaaaaaagggacagaagcttcagcacgtcgtgctgcgcggcggcatcgcgtacgagcggatgctcctcgcctggctcgacgacgttctcaccacgctccgagaggaattctga

SEQ ID NO: 935 - DNA, 816 bp, Actinoplanes utahensis
gtgagcgtggacgagccgatcaggatcggtctggcgctgggcgggggtgcggtccgcggggccgcccacatcggcgtcctggacgcgctggaccgggccggattgtccccctcggtggtcaccgggacgagcgcgggcgcgctggtcggtgcgctgtatgcggccggtcgcacgccggccgagatcgcctcactggcgcagacgttgcggtgggcgcggctggtgcgccccgggcgtacccgcaaggcgctcttcgagacgagcaagctcgggctgttcctcgactcgtcgctggcgagcgtggacttcgccgatctgaagctgccgttcgcggcggtggcgtgcgagttgaccaccgggcgggaggtggtgatgaccgacggcccggtggcgtccgcggtgctggccagcgcggccatcccgggcgtcttccccccggtggagcgggacgggcatctgctggtcgacggcggcatggtgaccatggtcccggccgccgcggcccgccggctgggcgccgacctggtgatcgcggtggatgtctccgggccgctgccgcgccggccgccgaccacgctgctgcacatcatggtggcggtcagcacgctgcagcccggtggcaccgaccggctggccgaggagtccgacctggtgctctgcccggaggtggacgagtacgcgttctgggaactgggccggatcccggaattcgaacaggccggccgggtggcgaccgagcgggcgctgccgctgctgcgggcgctgatcgaggcgtggtcggcgcgccgggcgtgggaacgggagcggaatcgctga

SEQ ID NO: 936 - DNA, 2262 bp, Actinoplanes utahensis
atgacccggacccgcctcccatggcggatactggccggtaaccccgatcggaaggtggtggacgtgagccacacggcgtatcgcacgtgtccgctctgtgaggcggcctgcggcctggagctgaccgtcgacgagggcacggtgaccgcggtccgcggcgaccgcgaccatgttttcagcggcggtttcctctgccccaagggcgcgactttcgggcggctcaccgacgatcccgaccggctccgccggccgatgatccgccggaacgggcggcacgaggaggtctcctgggctgaggcgttcgccgcggtccaagaaggccttcggccgattgtcgagcggtacgggccgcaggccgtcgccgcatacctgggaaacccgaacgtgcacacgatggccggcgggctgtatgtgacgccgctgctgaaagcgctgggcacccggaacgtcttctcggccagcaccgtggaccagatgccgaagcacgtctcgtgcggctatctgttcggcagcccgctggccattccggtgccggacctggaccgtaccgactacctgctggtgctcggcgcgaacccgtgggagtcgaacggcagcctggccacggcggccgacttcccggggcggctcaaggccattcaggcgcgcggcggccggttcgtggtggtggatccgcggcggacgcggaccgccgagcacgccgacgagcacctgttcatccggccggggaccgacgcgttcctgctgttcggcatcgtgcacacgttgttcgccgaggggctgacgaagctgggcgggctcacgtcgtacgtcaatggtgtcgacgaggtgcgccgcctggccgggagtttcccgccggagcgggtcgccgcggtctgtgatgttcccgcggagcggattcgcgggctggcccgcgagttggcggctgcgccgaccgccgcggtctacgggcggatcggcacctgcacggtcgagttcgggacgctgaccagctggctggtcgacgtggtgaacgtgctgaccgggaacctggaccggccgggcggggtgatgttcccgctggccgcgcatctgcggcgcggctcgtccggcgggcgtgggttccgcaccgggcggtggcgcagccgggtgcgcgggctgcccgaggtcaagggcgagctgccggtggcgacgctggccgacgagatcgagacgccgggtgacggacaggtgcgggcgctgctgacggtggccggcaatccggtgctgtcgacgccgaacagtgagcggctggaccgggcgctggccggcctcgacttcatggtcagtgtcgacccgtatctgaacgagaccacccggcacgccgacgtgatcctgccgccgctggacgcgacccgcaaggggcactacgacttctcgttcctggccctcgcggtgcgcaatttcgcggcgtactcgccgccggtgctgccgccgcggcccgacgagcgggacgagtgcgacatcctggcgcagctgacgctgatcgtttccgggcgcgacggggagccggctgacctgcacgaggcgctgctgagcggagcgctcggcaaggtcgccgaggcgaccggacggccggtggacgaactgcgggagttggtcaccggggacggcccggcggagcggctgctcgatgtggcgttgcggaccggggcgtacggcgacctgttcggcgccgcgccggaggggctgtccctgcggcggctgatcgagtccccgcacggggtggacctggggccgctgcggccgcggatcccggaggtgctgcggacgccgagcgggctggtcgagctgtgcccgccggagctggccgccgaggcggaccggctgctggccgcggtcgaccgcccccggccggagatggtgctgatcggacggcggcacctgcggtccaacaacagctggatgcacaacgtaccggcgctggtgaagggccgcgaccggtgcacactgcaggtgcatccggccgacgcgtcccggctggggctggccgacggcgggtccgcggcggtgtcgtcgcgggccgggagcctggcggcgccggtcgaggtgaccgaccgggtgatgccgggcgtggtgagcctgccgcacgggtgggggcactcgctgtccggggtgcggctggcggtggccgcggcgcatcccggggtgaactccaacgtgctgaccgacgagctggtcctggacccgctgtccggcaactcggtgctgaacggcatcccggtcgagctgaagccggcgtga

SEQ ID NO: 937 - DNA, 660 bp, Actinoplanes utahensis
gtgacgacgaccgacatccggccatacctgcgcggcctggccgtgttcgccggcgacctgcccggcttcgacccggccgccgccccgccgcaccccgagaccctgttcgtcgactggctcgtcgcggcggtcgacgccggtgtccgcgagccgcacgccatgaccctgtcgacgatcggagacgacggcgtccccgcggcccgggtcctgatcctcaagaacgtcgacgccaccggctggcagttcgccgtccacgcggccagcccgaaaggccgggatctgagccggcacccgggcgcggcgctcaccttctactggccggcgcaggcccgtcagatccgggtccgcggaacggtccgccccgaaccgcccgaccgcagcgccgccgacttcctggcccgcccggccggctcccgcgccgaagcctccctcggccggcagagccgacccctcaccgaccgggaaaccctggactcggccgtgcgggcggcccacgagcggatcctcgccgaccccggacacgtcgttccggagtggacgctgcacaccctgaccgccggcaccgtcgaattctggcagggcgaccatcagcgccggcacacccgcctccgctacacccgcaccgaccccacctggacccgcgacctactctggccctga

SEQ ID NO: 938 - DNA, 861 bp, Actinoplanes utahensis
gtggacgctgcacaccctgaccgccggcaccgtcgaattctggcagggcgaccatcagcgccggcacacccgcctccgctacacccgcaccgaccccacctggacccgcgacctactctggccctgacgatgcggttgtcggagggcgctgtggacgtggccggtggccgggagctcacgtgggacgggtgtgtcaacgttcgcgatctgggcggcctcggacgggtgcggcccggcgcggtggtccggatggaggcgccgacccgtctgagccggcacgggtgggcggcggcctgggcgcacggggtccgcaccgtggtcgatctgcgccatgcgagcgagtgccggccggaggtcgcgtcgagaccgccgggcatcaccacggtgcgggtcccgctggagccgccgggtacaccgttctacgagcgctggcagaggatcgacaatctggcgtcaccgctgcactacccggcgatgctggccgagcaccccgaactggtggtcgccgccgtccaggcgatcgcgaccgccgccccgggatgcgtggtgttccactgtgccggcggaaaggaccgtaccgggttgctcgctctggtgctgctgaccttggccgcggcgacacccggggagatcatcgccgactatctgctgactttcgaccggatgaggcggcggtatgccgaactcggtgccggtgaccagctcaccgctgtcaacgagctgctcaacggccacgacaccaccatcgcggcgtcactgaccgcaactgtcgaggcactgacaatgcccgactatctcctcgacaacggtctgcccgaggccgacctcgtggccctgtacgcccgcttgacaacatgttga

SEQ ID NO: 939 - DNA, 579 bp, Actinoplanes utahensis
atgccgattaccagtgcccggttcgtctggccgatcggcgacggcctggtcctgatgccgcgcaccccggcgatcgccattgcgtaccacgccctgctggccgccaaccatgcccgcctggcgctctggtcgccgggtctcggtgaaccgaccccggaaggcacccgcaccgccctggcgaccgccgcggccgcctggctcgccggcacacgcctgcccctcgccatcggcgtgcccaccggcaacggccacaacctggtcggcgcgacgaacctgaccatcgatgcgccgaccgcatccgccgagctcggcttctgggtcgacgccgccgccgagggccgtggaatcgtcagccgcaccctgcacgccgtgctcgaccacgccttcggcgacctcggcctgcaccgggtcgagatgcgcacgctgaccaccaaccaccgcagccaccgtctggcggaccgcctcggcttcctccgcgagggcgtgctgcgcgacgcggtccgcttccccgacggcccccgcgacgtagcggtatacgccctgctcgccaaggatttcaccccgccggccgcgaggtag

SEQ ID NO: 940 - DNA, 471 bp, Actinoplanes utahensis
gtgagcgggctgcggagcagccaggtggccgaggcggccggggtgaacctgcagaccctgcgctactacgagcggcgggggctgatcgcggaaccggagcgcagcctcggcgggcaccggctctatccggcagaggcggtcaccgtcctccgggtgatcaaggcggcgcagcggctcgggttcacgctcgacgaggtggccgagttgctcgcggccggtcggcatcggcatgggcggccggacgccgggcttcaggagcgggcgaaggcgaagcttgccgaggtgcaggcgaagatcgccgacctggaggtgatcgccgggacgttgcgggcggcggtcgatgccggctgtgacgatctggtcgcctgcgccgggcaaccgtgctgtccgattccgttcgtcaccatcgcgggggccgccggatcagcggccgggccgatgcggggaggagtcgaggatgtctctcgctga

SEQ ID NO: 941 - DNA, 264 bp, Actinoplanes utahensis
atgtctctcgctgaccgcgtgcgtcgcctgctgcccgccgggctggtcggtctcgccggactggcgtgcgccgcctgctgtgccattccggcgctgctcgccgccggtgccgtctccggggccggctgggcggccgccggagaccggatgccgggggcggctgtcgtgctcgccgtggccgccggcggcgcctggtggtggacggcgcggcgacgccaccgcgccggatgcgccggcggcggatgcgcctgcgcgacacggtga

SEQ ID NO: 942 - DNA, 1104 bp, Actinoplanes utahensis
atgggtgtcgacctcggtggtggaatcgagttctacgcgggccccccggtgttgggggcgccggacgacctggacgcggtcatccgcgggttcatcgacggtgcgaccagccggctgctgatcgcggtgcaggagctggactcgcggctgatcgcggagaacatcctggccgcccgggcgcggcgggtacggacgcagatcatcctggagggcgactacctgcgggaggagaaaccggtcgccgacccgtgggcggccaccggggagaacgagggcaaccgggtgatccacgcggcgctgctgcgcgccgggatcgacctgatcaccgacctgaacccggacatcttccatcagaagttcatcgtccgggacccggggaagccgaccgcggcggtgctgaccggctcggccaacttcacccacaccgacaccggcaccaacccgccggacatgctcgacaagccgggcaacaacctgaaccacgtggtggtgttgcacggcaggcaggcgaccgacctctatctggccgagttcgagcggttgcgcagcggcacgttcggggcgctgcacgagcgggtcgagccgcgcccgagcgagttccggctcggcgggctccgcgtcaaaccggtcttcgcgcccgatcaggggccggagatggagatcatgaagcagatgctgaaggcgaccgagcgggtcgacttcgcgatgttcaccttcgcccagtcgtccggcatcgacgacacgatgggctggatgctcaaggccggcatcccggtccgcggcgtcctcgaccgggggcaggggtcacagaagtgggcggccacggtgccgttgaagaaggccggggcgcagctgtacgagaacacgccgggcaacggggtgcgcaaagtgcaccacaagctgatggtgatcgatcggcggctgaccatcgtcggcagcttcaactacacggcgccggccgccaccctcaacgacgagaacatcgtcgtcctcggcgacctggaggagaccgacccggccgcgatcgccgcgcaggagaggctggccgggtacgcgctggccgagatcgaccggatcatcaccgagctggcccgccccgcgtga

SEQ ID NO: 943 - DNA, 744 bp, Actinoplanes utahensis
atgcgcaagttcgtggccggaatggcggccatgacggcggcgctcacgctggcggcctgcggcaacggcaagagcgacgagccgtacttcgtcggcgaggcaagctcggcggcgccggccagcgccgcgcccggccccgcggagtcggccacggcggagagcagcagcgcgccggtcacggcgaagagcgcgagccccaagcccagcgccaccaccccggtgaacgtcaagtacgtgttcccggtggtcggcaacaactcgtacgcgcacacgcaccacgactacccggccagcgacgtgatcaccaactgcggcaacacgttccgcgcggtcaccggtggcaccatcctcgccgtcacccgcgtcgacacctggaaggcctcggtcaacgccggcgccacccgcggcggcctgtcgatctcgctgctcggcgacgacggcgtccgctactacggctcgcacctgtcgaagatcgacgccaaggtgcaggtcggcgcccgggtcaccgccggtcagacgatcggcaaggtcggcgataccggcgacgcgagcgcctgtcacctgcacttcggcatctccccgccgtgcgcccgcaccggcgactggtggaaccagcgcggcaccgtctacccgtggccgtacctggactcgtggaaggccgggacgaacaagtcgccggtcgacacggtcaagaagtggaaggccgcgcacggctgcccgaccaagccgaccgtcgacggctga

SEQ ID NO: 944 - DNA, 360 bp, Actinoplanes utahensis
atggtgccgctggcggtgctctccaccaccgctctgctgccggtggccgcccacccgccgcggccggtggtgctggcactgctgttcgtcagcggcctggccggcgcgttcagcgtcccgctgaactcgctgttcggccgggcggtgccggccgcctaccgggcccgcgcgttcggcgtggcgatgtccggcctgtgcggcatccagggcctggccatgctggcggcgggcgcggccgccgagtcgctgcgcccgagcctggtggtcggcaccgccggcctggcggcgaccgtggcgatcctggccgtcctgctcacctggccgtcccgccggccggcccccgtcgcgtcacccgcctga

SEQ ID NO: 945 - DNA, 129 bp, Actinoplanes utahensis
ttgcccggacagccggccggataccgcgagatcttcgccgtccgcgaataccgccacctcttcgccgcgaacctgctgtcgctgatcggcgatcagctgaccgcggtcgccctggccttccgcgcctga

SEQ ID NO: 946 - DNA, 1437 bp, Actinoplanes utahensis
atgcgctggccccgagccaccgcgccggcgtggatcgtgcacgccggcttcgtgacgtccgcgctcgccggcggcgtcgggtacgcgctcggcggggcacatgcccgggcggtcgtctacacgctgatcgtgctgctgtcgatcgggctgttcgggcaggcgctgctcgccgggcacctgacccaccggcggccgtggctggtcgcgatcggcggtttggtgctgctgctcgtcgaccacctgatctggccgtactggatcatcgacggccacctgggccgggccgagggccgaccggccgacctggtgctggccgccgcgcacggactgttcctgatcggcgcgtcgatggcggtccggcaccggatgagcgcggacgccggcggcatcgtcgaagccgcgatcttcggggcgtgcaccggcggggcgctgtgggcatgcctgttccagccgcacctggcggccaccgccaccccgatcggggcggcgcaggtgctgaccgacgtgctggtgctctgcgccgtcgccggctgcctgctccggatggccgtggtcgccaccggcccggcccgcggcaccctgggatatctgctgctcaccgtgctgctgaccgggtcggcgctggccgtggggtcggtcggggcaccgcaccgcggcacgttgtccggcctgttgatgctgatcgccttcctgaccatcgggttcggcgcggtgcacccgggcgcacccgccacggtcgaacccgacacggtcaccgaacgccgccccggccgcttccggctcagctggctcggcgccgcgctgagcgtcaacccggcgatcgccgcgatccaggccgcgcacggcgtcgccgcccccgacccgcagctgcccgtcgccaccctgctggtcatcccgctcgtgatggtccgtttccgccagctcaccggccagcgggaacgcgccgaggaggtgctcgcctaccaggcctcgcacgacgagctgaccggcctgttcaaccgccgccggatcatggccgagatcgacaccgcgctgaccggtccgcacgacgtgaccgtcctgctctgcgacctcgacggcttcaaaccggtcaacgaccggcacggccacgccgccggcgaccacgtgctgcgcacggtcggcgagcggctcaccaccctcaccggcccggcccacgccgtcggccgcctcggcggcgacgagttcctggtcctctgccgcggcggcaccccggacgagatcgccgcgctgcgcgccaccatccaggccacggtgctcgccccgatcaccctgcccaccggatcggtcgcggtcggcgtcacgatcggcacggcccaggccccggccggcggccggaccgaccgggcgacgctgatcgcccaggccgacgcccggatgtacgacgccaaaccccgccgccgccatcccgccgcctga

SEQ ID NO: 947 - DNA, 561 bp, Actinoplanes utahensis
gtgggatcgagcaggctggccggcatggatgcgcctgagatgatcaacgcgggggagcttgtcctcaaacgctgggagccggagtgggccggcgagctgaccgccgcggtgcgggagtcgctgcccgagctgacgccgttcctgccgtgggcgcacgacgactacggtccggaggacagccggtcgttcatcgccaggtcggtggagaactgggacgccgggaccgagttcaactatgcgatcttcacgaccgtcggcgaggtgatcggggcgatcgggctgatgaccaggctcggtccggggacgctggagatcggctactggctgcgcaccccgtgggccgggcaggggcggatgacggtcgcggtcggcgcgctgacccgggtggcgctgacgctgccgggagtgcggcgggtggcgatctgctacgacgaggcgaacaaggcgtccgccgcggtcgccgcgaaagccgggttcgtcgaggtcggccgggagcaccgggagccgaccgccccgggcgaaacgaacatcctggtcaccgccgaacgcaccgccgcctga

SEQ ID NO: 948 - DNA, 669 bp, Actinoplanes utahensis
atgctgcagcgtttgatccacatcggagcggcggtgatcatcaccgcggtcgccaccacgggatgcgccgccccgaaatacacctacgtcaagaactccgagcagaagacgtacttcaaagttccgcacgagtggcacgcgaccgccaccggcgacctggacgacgttctcagcggcaccaaccccgactcggccaacgcggccgcccgccagcagatgtggtggtcggtggcgtacgacgcggacgccgacccgaacgccgggcacctgctcaccgggcgggtcaccgaccagccgatcgtgtacgcgcgggtcgccgagctcaccgagcaccagcggaacgcgatgtcgctggacacgctgcgcgacctgttcctgccggtcaccgccgacgcccgggagtcggccgcgcagaccagcacgctcagcggcttcgagctggtccgcgacgaggtgctcaccccggccgccgggctgcacggggtgcgggtggtcttcgactacgagctgtccgacggggtgctgcacaccttcgaccagaccgcgctggtcaacaacaccggtgacaagctgtatctgctgatcatccggtgctccaccagctgctacaaggaccggtccggcgagctggacacgatcgccacctccttcacggtgaggagcaagtga

SEQ ID NO: 949 - DNA, 2373 bp, Actinoplanes utahensis
atgccacgcgtcacccgtaagcggctgccgttctgggaccgggtcaaattcctgctgctgttcgcgatcgcgttcttcgccctggtctggacggacatggcggacgacccgctgctgccgttccaggatgcgctctacaaccggctgcacagcggcgtcggcgtcggcatcatcgtgctggccggcctggaggtgttgcgccagctgcactacctgcactccgagcacgccgcctggtatcaccgactgtggacgcacggcatcttcggcggcgtcgagcggctcacccaccgggtgttctccgactggacccggttccggctgctgcgggtgttcaagtggctgctgttcctcggcctgctcgcggtggtgctcggcgcggtgctggacacctcgccggccatggccgtcttcggtatcccggccctgctgtggcgggccgccccgatgttcctgcaggtcatcttcatcctgttcatcgcggtcggccagttcgcggcgatcttctggttcctgtcccggggcggcgtcgaggtctactacccggacgacgtgaagacccgcttcaccgacgtgtggggtcaggaccacgtgctggaacgggtcaaggagaacatcgtctacctggagcggccggaggcgatcgagggccagggcggttacgtgcccggcggcatcctgctgtgggggccgcccggcaccggcaagacgctgatggccgaggcggtggccggcgagaccggccggccgtacgtgttcgtcgaccccggtgcgttcatcaacatgttcttcggcgtcggcgtactcaaggtcaaggggctctttcgcaagctgcgcaaactcgccctccgctacggcggggtgatcgtcttcttcgacgaggcggactcgctgggcaaccgcggggcgctcgcccagggcggtccgggcggcggcttcccgcgcagcaccccggccccgttccgggacggctgccacggcttctcctacctctccgaccagtcccgctggaacctgacccgcgactcggtgatgtacggcggcgggatgggtggcggcggtggcggcatgggcaccctggaggcgttgctcaccgagctgtccggcctgaagaagccacgcggtttcgtcaaccggcacgtgcgccgggcactgggcatgcggccgaagccgccgccgaaataccggatcctggtgatgatggcgaccaacctgccggaggctctcgacgaggcgctgctgcggcccggccggatcgaccggatctacaaggtgggttacccgtcgaaggccggccgggtgcgcacctatcagggctacctggcgaaggtgaagcacgagctgaccgaggagcaggtcgacaagctggccacgatcacgccgtacgcgaccggcgccaccatcaaggacaccgtgaacgaggcgctgatcaccgcgatccgcgacggccgggacaccatcacctggcgcgacgtcatcagggccaagcagctcaaggagctcggcccggcggagaacgtggagtacatcgagcgggaacggcacgcggtcgcggtgcacgaggcgtgccacgcggtggtcgcgtaccgaacccggcaccacatggagatcgacatcgccacgatcgagaaaggcagcggctacctcggcatggtcgccagcatcccgccggaggaccagttcaccacctggcgcagccactacgagtcggacatcctggtctcgctcgcctcgctggccggggaacggatgttcttcgacggggacagctcgtccggggtctccggcgacctggagtcggccaccgcggtcgccaccaacatggagggcgtctggggcatgggctcgacggtgtcgtcgtacgccgcctccagccggctcggcaccggtaccccgggcgcgctgcccaagggcgacaagaacgacctgtccgcccggcgcgcgctcgccgaccggatcgaggacagcctgggcgagatgctggaacgcgccgcgaccatcctcaaggagaaccggcgcgaggtgctggcgctggcccacgcgctggagacgcacaagacactgaccggtgaggacgtcatcgcggtgctcgagggccggccgggcccgctgatcgacggcaccgtctacgccgacgaccggttcatcgccgaggtggagagctaccaccgggccgcgctggcagcgcatcgcgggcacggccggctgagcaccgcgctgccgtcgcgggccgtcccggagccgctgccggtcccggtcgacgggccggccgacctgccgaccggcagtgagatctggcgccgccccgacccggtcgacgccaacggcgccaccccggaaatcccgcagcaacgagactccggcccctcctga

SEQ ID NO: 950 - DNA, 333 bp, Actinoplanes utahensis
atgagtgctgatgcgatcgtgacctaccggacgagcgcggacggccgcacgctgcacgcgctgctgctcgccccggagctggacgtcgacgtcgccgacgagctgcgcgacagcctggagaaggcggtcgccggctcaccctgccgggagctcgcgctggacctggccgaggtgaccttcatcgactcgtacgcgctcggcgccctggtcggcgcccgcaactcggcggccgccgcgggcctgacgatggtgctgacccggccctctcccccggtccgtcaggcgatcgcggtcaccggcctggccgaggtgttcggcgtcgagccggtctga

SEQ ID NO: 951 - DNA, 744 bp, Actinoplanes utahensis
gtggatctccaacatgccgcgctgctgctgctcggcggcgtcggctccgggctgaccgggtcgatcgccgggctggcttcgctggtcagctatccggtgctgctggccgcgggcctgccgccggtggccgccagcatgaccaacacggtcgcgctgctggccgccccggccggcaccgcggccgccgcccggcgtgagctgcgcgggcaggggccgcggatcgtccgggcgagtgtggtgtgcgcggccggcgggatcaccggcggggtgctgctcaagatcacgccgtcgtcggcgttcgcgctgatcgtgccgttcctgatcgtgctgggtgcgctggccctgctgttccgcgagggactgcaggactggtacacgcggcccggccggcggccgccgctgtggctggccacgttcctgatcggcatctacggcggctacttcggggcggccgccggggtgctgctgctggccgcgatggcggtcgccgccagcgaaccgttcgcggtcaccaacgcggtgaagacgatcgtgctgggcgccgcgaacctgaccgccgccgtcctctatgcgctgaccgggccggtcgactggccggccgcgctgctgctcggcgtcggctgcatgctgggcagcagcctcggcccggccgtcgtgcgccgctccccggaacgcccgctgcgcatcgcgatcgccgtcgccgcggccggcctggccgtctatctctggtcgcaggccctctga

SEQ ID NO: 952 - DNA, 312 bp, Actinoplanes utahensis
gtgtctaacggcggcgccaaccagcagtgggacttccgtagcaccggcagcggctgggtccagctgatcaaccggaacagcggcagatgcctggacgtggcgtccggctccatcgcggacggcgccgacatcatccagtacacctgcggcaccggcggcaaccagcggtggcagtggctcccgaccggcggctactaccagctcaaggcccgccattcgggcggatgcctgaccctggcggccgacgcggtcgacctggaacaggccacctgcgccaccggtgcgacgacccggcagtggtcgcgggcctga

SEQ ID NO: 953 - DNA, 1176 bp, Actinoplanes utahensis
gtgcgccgagcgatcgtcagtctgctggtcgtctgtcagagcacccaggcgttgatcttcggcgggatcgcgctgttcctgccgctgatccggaccgatctggggttgagcttcggccaggccgggaccctcgccgcggcgagcagcctgacctacgcgctgatgcaggtgccgtccggcttgctggccgaccggttctcgccccgcgtgctgttcctgaccgggctgctcgggacgaacctgctggccgcggcgttcgcggtgctcacgtcgtacgacatgctgctgttgaatcaggctttctccgggttcttccgggcgctggtcttcgcgccgggcctgctgctgatcagccgggagtttccggatgatcgacgggcgaccgcgatgggcctctatgtggccggcggcttctcgtcgaacatcctgctcagctcgacgggtccgctgctggtcggcccgctcggctggcggctgctgttcgtgctgttcgccggcgccgggctgctggccctgctgctctaccggcgggccgccggcccggccgagccgaggccggcgaccgaccacccggcccggatcggcgacctgcccggcctgctgcggcaccggatcgtctggctgaccgcggtgatccagttcgcccggctcgcggtggcccagggcttcaccttctggctgcccacctggctggtggtcgaccgcggacagtccctcgcggcggccggcctggtcgcggcggtcggtgccgccctgaccgccccctcgaactacctgggcggttacgtgtccgaccggatcgggcggccgctgctggtgatcagcggctcgctcgcggtgctggccgtcggcttgacgctgctcacctacgtgcccggcctgccggcagtgctcgccgtggtcggggtgatctcggtggtcgtgcaggtctatttcggaccgttgttcgcgctgccgatcgcggtgctcggcccggagcgggccggcctgctcagcggtttcggcaacttctgcgccaacctgggcagcttcgccttcgtctacgcgctcggcgcggtcaaggacgccaccggctcgttccgggccggcttcctcagcctggccgccctctgcgtgctggccctggtcgccgccgcggtggcccgccgcgtcccggccccggcccggcaggtctga

SEQ ID NO: 954 - DNA, 2958 bp, Actinoplanes utahensis
atgcgaagccatctggcgggcgcggtcgccgtgctcgccgtcctgtcccccgtccccgcccactcccccgcccccgcccccgcccccaccggctacctctccacgcacgccgggccgggccgtttcccgctggccggcgctcccctcctgaccggcgccggcgattacccgggggtgctccgggtggcgggtgacctgcggtccgacctggccgccgccaccggcgccacggaaaagggcggccgcgacccgatcatcgtcggcacgatcggccactccaccctcatcgacaagatgatcaacgcgggccggctcgacgtccgcggcatcgccggcaggtgggagacctccctcgaacaggtcgtcgaccacccgttgcccggggtccgccgggcgttcgtgatcgccggcagcgaccagcgcggcaccatctacggcgcgtacgacgtgtcccggcagatcggcgtctcgccctggcacttctgggacgacgtgccggtgccgcacgccgacgccctgtacgtcctgcccggccggcacagccagggcaccccgaaggtcaagtaccggggtttcttcatcaacgacgagaacccggacaccggcacctgggcgcccgggttcttcggcccgggcaaggcccccggccatccgggcgggctgaacgcgaactactacgccaaggtcttcgagacgatgctccggctcaaggccaactacctgtggccggccgtctggggccgggcgttcgccgaggacgacccggccaaccacgccaccgccagctattacggcgtggtgatgggcacctcgcacgaggcgccgatgatgcgcggcatcgaggagtggaaccggcatcccgccggcaccggcgagtggagtttccgccgcaacccggacgcgatcaaggactactggcgggccggcatccagcggatgcacgatcaggacatcgagggcgtggtcacgctcgggatgcgcggcaacggcgacgtgggcctgcccgacggcgacggcatcgacctgatggactcgatcatcagcagtcagcggcggatcctcgccgacgcgggcatgctcggcgtgccccaggtgcagaccctctacaaggaggtgcagcgctactgggatcagggttaccggccgccggacgacgtgaccgtggtcttctgcgacgacaactggggcaacatgcgcaagctgcccgacccgtcgctcccggcccgtggcggcggctacggcatgtactaccacttcgactacgtcggcgacggccgcaactacaagtgggccgacaccgtgaacctgaccaacacctgggagcagctgaaccgcgcctacaccgcgggcgtggaccggctctgggtggccaacgtcggcgacctgaagaacgacgaggagcccacccagttcttcctaaactacgcgtgggatccggacgcgatcccggtcaccgggatcaacggctgggagcgccgctatgcggcggagaacttcggcacgtcactgtccgccccgatcgccgaggtgctttcccggtacggcgttctgcagtcccgccgcaagccggagctgctcaatcgccggatcacggtcgacccggcggtggacccgaggacggatccgagcgcggtgcgctacgacgaccagggcaatccgttcagcctcaccgcctaccgggagatggaccgggtggtcgccgagtggcagacgctcgccgcccggaccgagcggatccgggcccgggtgccggaggccctgcgcgacgcgttcttccagctcgtctactaccagatcaaggccaccgcgaacctctacgagctgcgccgcgcggagttcaccaacatcgcgtacgcggcgcagggccgggccgcgaccaacgacctggccgacgaggcggaggcccggttcgccgaggaccaggcgctgaacacctactacaacaccgtgctggccggcggcaagtggaaggactggcagctgcagccgaagatcggctacggcaacgtggcccggtacggcccgaacgcgccgtggcagcagcccgagaagaacaacgtggcgctgcccgacgagatctacccctacctgaaacggatcgaggtgccggccggggcgtcgctgggtgtggcgctggacggcggggacccgagctcgctgcccgagttcagtccgtggcaggcgcagccgggacagtacctcgacgtctacaacagagggacgacgccgttcgcctacacgatcaccgccgggcagccgtgggtgcacgtcaccccggccggcgggaccgtcaccaagcaggtgcgggccttcgtcacggtggactggcggcgcgctccggccggggtcaccgacgtaccgctgcgggtggaaggcgcgggaggcgcggtcgtgctgcgcgccccggtccgcaagccggtgaccacgccgcggggcttcgcggaggccaacgggtacgtgtcgatcccggcgaccgggttcgatcaccacaccggccggtggcgggtgctgcccgggatcggcaagagcggggacgggatcaccccgctcgccgccttcccggccgccgggcagccgggcagcgtcggtgaccgcggccagctcgactacacgatgacgctgaccagcgccgggccggtcaccatcgacacgatgctgatgccgcgcaacgggcggcagcggtacgcgatctcggtggacggcgcacccccgcagaccgtcgacgcggtcgccgcgaccggggcgaacgacaccacgatgaaccgccagtgggcccgcaacacctcggacaacgtcaccgtcaccgccaccacccaccagatcgccgcggccggtccgcacaccgtgtcgttccgggcgctcgatccgggcgtcgtcctgcagcgcctggtcgtcgacaccggtggcgtcaaggacagctatctcggcccgccgaccagccggaggtaccgaccatga

SEQ ID NO: 955 - DNA, 1236 bp, Actinoplanes utahensis
atgaaacgacgtgccctgctggccggctccgccggagccctggccgccggcgtgccgctcgacaggcaccggccggaacccgcctgggtgcacacctggaccgcgatgccgcagctcaccgagccgggtaacctgccgccggcgccgttcaccggcagcgccgcggtgctggtggacaccacgatccggcagaccgtgcacacctcgatcggcggccgccggctgcgggtccggttctccaacgcgttcggcaccaccgacctgccgatcgacggggccgcggtcgcgctcccggtggacggccgggccggcgtcgcggcgatcgtcccgaacagctcccgtcggctcaccttcggcgggcagccgtcggtggtggtgccggccggggcccaggtggtctccgacccggtgccgatgccgatcgcggcccgggccgacctgaccgtctcggtctactccggcgccgggcaggccgggttgaatctgacctcgcatcccggctcccggaccacctcgtggctggtcaacggcgacgcgctggagcagcccgacctgaccggcggcgccgcggtcgaccactggtacctggtcagcggcgtcgaggtgatcgcgagccgggcggccggcgtggtgatcatcggagattcgctgaccgacggccggggctccaccatcaacggcaacgaccggtggcccgaccagctgaccgcccggctcggcgacccgcggctggccgtgctcaaccaggcggccggcggcaaccgggtgctgcacgacgggctcgggccgaacgtgatggcccgcttcgaccgggacgtgctcggtgtcagcggggccgcctgggtgctggtgttcgagggggtcaacgacatcgggacggccgcggccaccgaggccgagcagggccgggtggtggcggcgctgaccgcggcgtaccggcagatcgtgcagcgcgcacacgcccgcaacctgcgcgtgtacggggcgacgatcacgccgttcggcggcaacaccgggtacgacgatccgggcgggctgcgcgaacgggcccgggtggcggtcaacggggtgatccgcggcgggatcttcgactcgcacgtcgacttcgccgccgcggtcgccgacccggccgcgccgtcccggctgcatccggcctacgacgtcggcgaccacctgcacctgaacccggcgggatacgcggcgctggccgccgccatcccccgccggctgttctga

SEQ ID NO: 956 - DNA, 513 bp, Actinoplanes utahensis
ttggtccggcacgcccgtagagtcggcaggccgccgggtcatctgagggcggtcaccgtgacacccggcatagggtggggctgcccccacccgggtgggcggtcagacggatggtcgcgaccggtcacgctccgtaggttcatcggcatggatatcgcgatgaacgcccagcccaccgccgcccgggtcgagacggccaccaaggtcgccaccgtcctcagcacggtcgcgctggccggcaccgtcgccgtggccgcgcacggcggcacggtgaacaccttcatgtgggtgcgcggcgccctgctcccgatcgtcgcggtggtcctctaccggatggcggccggcgggtccccccgcgccctcgaccggatccgcgtgctcaccgtgatcatgccgatcgcgatcgtcggggtcgacctgatccccggcgtctgcccgctctggtacgccgcggtccaggcggtctgcatgatcccggtcgtcgttgccgcggtcctcagccgccgcgtctga

SEQ ID NO: 957 - DNA, 1980 bp, Actinoplanes utahensis
atgacccggcggcctgccgactctacgggcgtgccggaccaagtgttcctgctggccaacctggtgatcatggtcgcctacgcggcgatcacggtggccatcgtggtgcccgtccgccgggccggtcagctgcgcagcaacaagctggccaccgcgaccgcactgatcttcttcagctgcgcggtggggcacggtctgcacgcgctgggcggcatcctggccctggcgcacggctcgccgcacccggcccggcaccccggcttcagcgccctctgggacgccttcaccgccggggtggcctgttactactggagcctgcgccgcagttacggggtgttgctgagcaaaggcgcgatctatctcgacccgtggagccggcaccggctggacgaggccggcgcccgcgagcgggcggcccgggacgtggccgaggcgcaccgggccacgctggccaccgtggtcgagcacagcgacgacgcgatcgtcggactcgacccggacggcctgatcaccgcgtggaaccacggcgccgagcggattctcggctacgccgccgaggaggtgctgggccggccgatcacgatgatcgccgacgacgcgacgggtgccgcggaacagcgcgaggtgatggcgctgatccggggcggcgcgcgcgggcacagctacgaggcacggcggctgcgcaaggacggcaccccggtcgacgtggcgctgaccatcaccgcgatccgcgaccagaccggcacgatcaccggcttctccacggtggcccgggacatcaccgccgccaaggagagcgctgagcggcagcgggccgtgcaggagcgcacccagcaggcgcagcggatggagagcctgggcaatctggccggcggggtggcgcacgacttcaacaacatcctggcgatcatcgcgaactacaccgagttcgcgatcgaggagaccaccggaaacccggccgtgcaggccgacctgatccaggtgcgctcggccgcggagcgggccgccaacctgacccggcagctgctcaccttcacccggggcgacgcgatccagccccgggacgtgccgttggacgccgccctggccgaggtgcacgggatgctggagcgcaccatcggcgagcacatccacctggtggtcacgccgccgcgcacgccgctgaccgtgcacgccgacccgggccagctccagcaggtgctgctgaacctggcgatcaacgcgcgggacgcgatgccggagggcggcaccctggtgctcgaggcgaacaccgccgacctggacggcaacgaggtgaacatgcagccgccgctgccggccggccggtatgcccggctgctgatcagcgacaccggcgagggcatgtcgccggaggtggcccagcgggtgttcgagccgttcttcaccaccaagccgcgcggcaagggcaccggtctgggcctggccaccgtgtacggcatcgtcaccgaggccggcgggagcatcaacctgtactccgagccgggggtgggcaccacgttccggatctacctgccgatggtggacgcgccggccgtcgccgggcccgccgatcgcccggacgacccgccgcgcggtgccggccgcaccgtgctggtggtcgaggacgaggtcgcgctgtcacggatcatcacccggatcctgaccggaaacgactatcatgtggtggtcgcctcagacggccggcaggccctggagctggccgcccagcacccgtgcgacgtgctgctgaccgacgtgatcatgccggggatgtccggtccgcggctggccgagctgctcaccgcacggcatccggggctgccggtggtctacatgtccgggtacagcaacggtctgctgggcagcacccacgtgctcgacgaggacatcgcgttcatcgagaaaccgttcaccgccgccgacctgttgcacaagctcggcgccgcccttgacatccatcagcacgtatatcgagactga

SEQ ID NO: 958 - DNA, 93 bp, Actinoplanes utahensis
atgcggatcctgaccgcggcgctgccggggcggcaggcgcggcgcggtttcaactgcgccggggcgggcatgcgcggcgcatgcccgccctga

SEQ ID NO: 959 - DNA, 993 bp, Actinoplanes utahensis
atgcccgccctgaccgacacgccgccgctgcccgcccacctgcaggttgaggtcacctcggcgtgcaacctgcgctgcaccatgtgcctggtccggtaccggccgccggtgaacaagctggccggcgcgatgcgcccggagctgttccacgccctggtagccgagctcccactgcggcagctgaccctgcaggggctcggcgagccgctgctctccccgtacctgcccgagatgatcgcgagcgcggtgcggcgcggcgtccgggtcgggttcaacaccaacggcacgctgctcagccggcgccgggccgacgagctggtggccagccgggtggactggctgcacgtgtcgctggacggcgccggcccggcggtgtacgaggcgatccgcgagggcgcgcacttcgacacggtgatcgccaacctggccgggctggtcgcggcgaaacgggccgcgggcagcgccaccccgtggatccgggtggtgttcgtcgcgatgcgggacaacgtggccgagctgccggccctggtccggctgctcgccgggatcggcgtgaacgagctccgcgtgcagaacctgtcgcacagtttcgacgacgcgacggccgactacaccgagatccgggacttcaccgcggcccaggcgctgtggaccggggccgacctggaccgggcccgggccgccttcgccgaggcgtccgccgccgcccgggacagcgacctgaacctgcgcctgccgcacctggacgagcgggaggcgacgggtggcggctgcacctggccgtgggatgccgcgtacgtcaccagtaccggggtggtccagccgtgctgcatggtgatgggtgacgaccgggtcagcctcggcgacctgaacacggcgagcttcaccgagatctggcacggcgagccgtaccgcgacttccggcggcggttgaacagcgcggagccaccggacgtgtgccgagggtgctcgctctaccgccacaccttctga

SEQ ID NO: 960 - DNA, 2004 bp, Actinoplanes utahensis
gtggtgacgcttttctccagcaaccgtcccaccaccgtggacgagtacaccgagtggaacgccaaggcgctggcccgcgaatcggtcagccgccggtccgccctcaaggcggtcatggccggcgccggcggcatcgccgtcgcccagttcaagctcgccgacgcggccttcgcggccggtggtggcaccgccggcacggccggtgtggtggtctccggccgccacctgtccttcgtccccggccgggacggcatcccgcaggccgccatggcggtcaccgcgcagctggtcagcaagaccggcagcctgccgaagaacctgcgggccttcgtcgaggtcggcattgccccgggccactacggcgcccggcacgaggccgacatccagcacctagtcgggcagtacgcgatcccgggcgggccgatcggcagccagttctacctcaaggcgaagatcaccggcctgcgcccggaccacatctaccactaccgggtgcggctctccgacggcaccgtctccggcgacgcgcacttcaccaccgcgccgggcagcggccaccacagcggccacttcgggctggagccggccaagccgttcaccttcaccgcgttcggtgacgtcggcaccaacaacgcgccggtcgacccggcgtacgcctggggccaggacccggcctcggtcaccgcgaacggcggcgcctggccgaagggcgtcttcgacaacaactactacaacgcggccgacccggtcggcggcgccaccggcaccgatccgaagccggccgtcacccagaccaacctgatggcctcccagcacccggtcttcaccctgctggccggcgacatctgctacgccgacccgtccggctccggcctgccggcggacaacaccaacgccctcgcgggcggagcggcgcccggcacgaacctgtacaacccgtacgtctgggatgtgttcttcaaccagatcgaggcgcaggccgccttcaccccgtggatgttcgccaccggcaaccacgacatggaggcgctgtacagcgagaccgagttcctcggcggcagtgacacgcacggctacgccgggcacctgaagcggctcgacatgcccggcaacggcccgaagacctgcccctcggtgtaccgcttcgtctacggcaacgtcggcgtcatctcggtcgacgccaacgacctgtccgcggagatccagaccaacaccggatactccaagggcgcccagctcacgtggctggaggacaccctcaaggcatggcgcaccgacggcgggctggccgaccggatcgacttcatcgtcgcgttcttccaccactgcgcgtactccaccaccaacaaccacgcctccgacggcgcggtccgctcggcgctcgacccgctgttcagcaagtaccaggtcgacctggtcgtgcagggccacaaccacctgctggagcgcaccgacccgatcaagaacggacgccgcaccaagggcgccccggacggctcgacgatctttccggccaccgacggcgtcacctacatcaccgccggctccggcggccgcccgcgctacccgttccggccggcccccagcgccggcgcccccgcacccaccgggatcactccggagggcgtcgagctgctgcccgagggtcagcgctaccgcggatatcagccggccggcggcgtcaacaccaccgagaacaacaccgagaacatcgtgaacagctactactggtcgacggagggcacggcgatcaacgcgtccggatacccgtccgggacgaaggtgccggagaccgtcgactggtcccaggtccgctacgacgactacgcgttcatcgcggtcgacgtcgtcccggcccggcgcggccagcgcaccacgttcaccatccggacgctggcggacgcgctgccgggcagcggccagccgtacagcgagatcgaccggatcaccctggcccggaccgccggcctcagccggatccgcaccctgcaccacggccactga

SEQ ID NO: 961 - DNA, 150 bp, Actinoplanes utahensis
atgcagcagggggatttcatgttcagcaccaagcgttcccggatccgcgctctggccctgaccggtagcctcgccgccgccggcgtcaccatcggcgcggtcaccttcgacgcctcggccgccgagacggccgcacccgcccctagctag

SEQ ID NO: 962 - DNA, 465 bp, Actinoplanes utahensis
gtgccgccactggtcacggcggtgccgaaggacatccggccgccggacgggtcgcagccgatcggggcattcgtggtcaccgccggcacccagaactacacctgcgtggtgccggccggggcgaccaccggcggctacaccggcaactcggtgccggaggcgcagctgctcggcaccggcggccggatccaccacttcgccggcccgagctggcagtcggagcgggacggttccctggtcaccgccaccaagaccgcggcgctgccgccgcgcgccggcgcgatcccggagctgctgctgcaggtgaagacccactccggcagcggcatcctggaccgggccgactacatcaaccggctctacacctcgggcggcgtggccccggccaccggttgcaccgcgggccagacggtcagcgtcccctacaaggccctctacgtcttctgggacgccccggccgcctga

SEQ ID NO: 963 - DNA, 342 bp, Actinoplanes utahensis
atgagatcgatccgttcccgtgatccggaggcgtccgacatgacagtacgttcggtgatgtcgcagatggcgctccatgtcgagagcggcgtgacgctggccggagccggtcgggaggacatgctcctccggctcggtgagcattcgttgatgatcggtgtggatcgcgggacgcatcggatcaggtaccgcctgccggcccgcccccgctgggacgacaacggcgagccgctgccgcccgagattgcgggcaacctgcgggagatcgtcacggagatctcgctgttctgggggcaggagccggaattcctcatcgaggagttcgggcgccccgacgtctga

SEQ ID NO: 964 - DNA, 984 bp, Actinoplanes utahensis
atgacgctgacgctgccgcacgagctcaccgagccgctcagctggatcgggctggaatggccggaggctgacgaggatcagctccaggccaccggcaaggcgtggatcgaccacggcacccggatgcgggcgcacgccgaccaggccaccgccgccgcccgccaggtgtggctggagaacgagggcgccggcgtcgacgctttcgaacgctggtggaacggcgacgacggccccggtaggcacctgcaggaatcggcgaccgccgcggagatgatcggcggcgcgctggtcgcgatggccggggtgacgctcgccctgaagatggcgttcatcgcgcagttgaccgcgctggccgtcgaggtggggcaggcggtcgcgacggcgaccgtgaccgcgggggcgacgctcgcggagattccgggatggatcgcgctgacccgggtcgcggtgcggaagctcatccacgaggcgatggcgctgatcgagcgcgagatcgccacgctgctccgcaaggccgcgaagatgatggagaaggccggcgccagaaccctcgccgagaagaccgtcgtccgcggccagaggacggctttccgcggtctgatgcatgaggtcgagaacgctgacgtgcgcagtccgctccatggcgcgaacttctactccgggttgcaacccggtggcgagaagatgcgcgcctatgcggagaagcaggtcaacggcacaacctcgctaactttggaaatgacgccgggcggcaagcggttcgacgacatgaagctgttcgagtccggctcaccggtcaacggcgatcaggcgatggatgtctggaagaggttgtccgagcgttacgcgcagaacgcctccggcgaggcgaccgcctggacccatgaggcttggtcgggaagtgtctggtacaccagggagaagccggcattgcaagtgaacccgaacatcacgaagatcaatgagatcgatccgttcccgtga

SEQ ID NO: 965 - DNA, 612 bp, Actinoplanes utahensis
gtggtgaccggacggctccggctcgacccggaccgggtcgccgacgcggggcgcgacctggccgcgatcgccggccggatcgccgacgacgtgacctccctcgaagcggcggtcggcggcgcgcacccgtggggcgccgacgagacgtcaagcgtgttcgcgctcgcctaccgggcggtggcggagacggcgttggacgccatggcgtcctacgccgaacaggtcggctacgcggcggcggcgctggtcatgcaggcgcggtcggtcgcggcggcggacgccgaggccgcctcttcgctgtacgcggtcagcggcctgcccggggcgaccccgccggtgcccggcgccgacccgaccaccccgacgccggctccggcaccgaacgcgccgggcggcgtcaccggcgaaaacaccggcgggtcgtcggcacacccggctcccgcccctgccccggcccccgcccccggcgtcctcacccccgcgccgggcactgtctcatcgcccggcccggccccgtccgcaaccgggctcacggcaccgtactcatccggccccacctccgctccggcgtcgtccggggccggacccgcggctgccaggagcggggtgtaa

SEQ ID NO: 966 - DNA, 534 bp, Actinoplanes utahensis
atgggcgacaactcgtacggcggagcggcgggcggctcgtacggcggggggcccgcgggcggttcgtacagcgggccttcggtgggcggctcgtacagcgcgcctccggcggggggctcgtacggcgggccttcggtgggcggctcgtacagcgcgcctccggcggggggctcgtacggcgggccttcggtgggcggctcgtacagcgcgcctccggcggtcggcgaagcggctgacggccgggtctggctcgaactcggcggcgacggccggatcgccgagctgtacctcgacccgcgggtcgtccacctgccgctcggtgaactgcgcgacgcgctggtcaccgcgttcaccatggcccaggacgcggtgcgggaccgggccgaggcggccaccgcccggtacgccgagacggtcgtcccggaccggctgaaggccgcgctggccgaggcgtcggacaccgcggaacgccggttcgccgaagtctccgtcgccttgtacgacctgagccggcgggcggaccggccgtggtga

SEQ ID NO: 967 - DNA, 678 bp, Actinoplanes utahensis
atgccgctcaccccagctgatatccacaacgtggccttcaagaagccgccgatcggcaagcggggttacgacgaggaagaggtcgacgcgttcctggacgaggtcgagcaggagctgatccgcctgctcgaggagaacaacgcgctgcgcaaccaggcccagcgcggcggcggcaacccggccgccaccatggtcatcaccaacgagttcgccgacctgcaggcccaactggagcggctgcaggaggcccgggcccgggccgagcagaacgcccgcaacgtgcagtcgcagctcgagcgcgcccgcagcgccgccccgtccggcgcgatgccgaccatcggcgacgacgaccgcaacgcccgggtgctgatgatggcccagcgcaccgccgacgagcacatgcgtgacgcgcagcgcgagtccgagtcggtgatggagggtgcccgtgccaaggccgagcagctcaccgccgaggcgcagatgaaggccggcaccatcgagagcgacgcccgacgcaaccacgccgaggcgatggacagcctcgtggagaagcgggccgccctggtcgaggagatcgacaagctgggccagctcgcctccggctaccaacaggcgctgaccaaccacgtcacccagcagctcatggacctgacgagcggcccggacgccgccgagtaa

SEQ ID NO: 968 - DNA, 1227 bp, Actinoplanes utahensis
gtggacaacagcggcacgaccgaccaggccaggctgaaccgtgaggacgaggaggaacgcgacctcgttcgcccgccggacgtcaaccgtgccgcgaaccgctcggccacccgcctcgaactcttcttcgacctggccttcgtgctgttcgtcggccgctgcgccgacctgctcgccgagcaccagaccctcagtggcggattccggttcgtggccgtcctggtggccggctggtgggcctgggccagcaccacgctgtacgccaaccggttcgacaccgacgacgcgatcttccggctgctcaccctgaccgggatggccggcgtgatcgccatggcggccgccgccgaacaggcgatcggcgcccacgcccgctggttcgccgccggctacgtgctgctgcgcctcatgctggtgctcggctacctgcgggtctggtggaatctgccggacgcccgggccgggatccggccgtacctgtggggtcacgccgcgggcgccgcctgctgggcggtgtcactggccgtgcccggcccggcgcgctacgccctgtgggccgccggcgtcctggtcgacctgctcggccccaccctggccacccgggtgccggacgcgcctccgctgcacatggaacacctgcccgaccgcttcgggctcttcgtcatcctggtgctcggcgagtcggtggccgccgccgtggtcggcctgcacgacggccggtgggccgccccagtggtggtcgccgccgcctgcgggttcctcgccgcggccgcgctctggtggtcgtacttcgacctctccggcggcgccgcgaaacgccgcctcgtccaggagggcggcgaacgcacccggcgcggggtgcacgacttctacgtctacgcccacctgccggtcgcgatcagcctggcggccgtcgcggtcgggctggaacacgccatccggcacggcgccgacgaccacctgccggccggcacccgggcggtgctcggcgccggactggccggatacctgctcagcgccgcggtgatccaggccgtcctctccggccggcgccgggccgccctgctctggcccggcctcggtgtgccgttggtgctgatcctcaccctgctgcccgggctgtccccggtcgcgctgctggcgtcctgcgcggccgtcctggtgggtggagtgatcaccggggtgctccagcaccgggccggggtgatccgggtcgccaaggtctga

SEQ ID NO: 969 - DNA, 1221 bp, Actinoplanes utahensis
gtgacccagacaaccgtggtcctcatcctcgtggtcatcaccgccctcggattcgacttcaccaacggcttccacgacacggccaacgcgatggcgacctcgatcgccaccggcgcgctgcgtcccagggtggctgtgctcctgtccgccgtgctcaacctggtcggcgcgttcctctcggtgcaggtcgcgctcaccgtcaccaacgcggtggtcagaatccagaacagcgacggcaccccgaaggcggatctgctcgccgacggcggccaggccctgctgctgatcgtgctggccggcctggtcggcggcatcgtgtggaatctgctgacctggctgctcggcctgccgtccagctcgtcgcacgcgctcttcggcggcctgatcggcgccgcggtggccggcctcggctggagcggggtcaagtggaccggcgacggcaccaaactggacggcgtgctcggcaaggtgatcctgccggcgatcatgtccccggtgatcgccggtgcggtcgccgcggtgggcacctggatcatctaccggatcaccgtcggggtggcgcagcgcttcaccgagaacggcttccgctggggccagatcggttcggcctcactggtctcgctcgcgcacggcaccaacgacgcgcagaagacgatgggggtcatcacgctcgccctgatcgcctccggcgagtggaccgacaccgggaacatcccgctctgggtcaaggtcgcgtgtgcgctggccatcgccctcggcacctacctgggcggctggcgggtcatccggaccctcggcaaggggctggtcgagatcacctcgccgcagggcatggcggccgagaccgcctcggccgcggtgatcctctcctccagccatctcgggttcgcgctgtccaccacgcacgtggcgaccggctcgatcctgggctccggggtcggcaagccgggcgcgcgggtgcgctgggcggtggccggccggatggtggccgcctggtcgatcacgctgcccgcggcggccctggtcggcgcggtcatgtggtggctcggcgacctggtcggcggcctcggcggcgcgctgctgatcttcgcggtcctggtcgcactctccgtgttcatgtatctccggtcgcgccgcgaaccggtcgaccagcacaacgtcaacgacgagtgggacaccccggccgcccggccgcgggagaccgccggcgcggcgagctga

SEQ ID NO: 970 - DNA, 318 bp, Actinoplanes utahensis
gtgcacaatctgaccctggccttcgagggcgcctggaaggtgctgctcgccggcctcattctgggcgccgggctgccggccgtcttcgccctgggcatccggtcgctcgcctacggcgcgggcggcgacgccgaggtgcacgcggccggcgggagcgggccgaaaccgcaccggctcggcacggccggcggatacctggcgttcgccgtggtgctgctcggcatcgcgctcggcatcaccttcatcgtggccaccggcttcggcaaggcgctcagcttcgagcacctctacccgacgatcatcgacaggaagcactga

SEQ ID NO: 971 - DNA, 321 bp, Actinoplanes utahensis
gtgaacgagcaacggtcgaacttcgtcacccgcgccctcgggtggctgcgcgccggctatccggagggtgtgccacgccgggactacgtggtgctgctggggctgctgcgccgcaagctctccgaggacgaggtccgcagaatcgcccaggagctggccgcgcaggcacaacccggggacgggccgatcaccggcgccgacatcgaggagatgatcagccagacgatgctgcaggaggccaccccggccgacgtcgtccgggtgtcggcgcacctcgcggccggcggctggccgctggcggatcccccaccggccgactga

SEQ ID NO: 972 - DNA, 906 bp, Actinoplanes utahensis
gtgacgctcacccagcatgctccctcggtccgcacacagcccgggccgaccgacaaccaggccgtgctgatcgtccacggccgggaccgcaccggaatcgtcgccgcgatcagcgcggtcctcggcaagcacgacgccaacatcgtgtccctggaccagtattccgacaatccgcacgggggcgccttcttccagcgcaccgtcttcgccctggaccatctgaaggcccggctcccccaggtcgaggccgacctgcaggcgaaactcgccgagggtttcgacctggagtacacactgcgcgacctgtccgtcccgaaacgcgtcgcgatcttcgcctcgaaggatgaccactgcctgctcgacctgctctggcgacaccgccgcggcgagctcccgatcaccgtgtcgatggtcatctcgaaccacgccgacaccgccaacgaggtccgcttcttcggcgtcccgttcttccacgtgccgtccgccggcccggacaaatccgcggccgaggcccagcacctgcagctcctgcagggcaacgtcgacttcatcgtgctggcccgctacatgcagatcctgtccgggaccttcatcgagcgcgtcggcgtcccgatcatcaacatccaccacagcttcctgccgtccttcatcggcgccggcccctacgccaaggccaagcagcgcggcgtgaagctggtcggggcgaccgcccactacgtcaccgaggatctggacgaggggccgatcatcgagcaggacgtgatccgggtctcgcacgccgacacggtggccgatctgcagcgccggggcgcggatgtggagcgggcggtgctctcccgggcggtccggtggcacagtgaggaccgggtcatccggcacgagaaccacacgatcgtcttcgcttag

SEQ ID NO: 973 - DNA, 1425 bp, Actinoplanes utahensis
atgtcgttgccgccaccgttgagcgacagcagggtcggtttcggatcgagggcgagcgcggcgtccagctggtcggtgacgatcggctgcaggaggcggccgcggatggccaggttcgcgtaccggatcggctcgccgagcccggcggcgaggccggcggcgaccaggtcggcccacccccgttcgctgccgtccggctgggtgtcgcccatgccctcggtgaagctgtccccgatcgcgacgtaccgcatccccgcactcccgccgtccgcaccccagttgatcagccccagcgtaaccagcgccgatccgcgcctcgcaggctcgcgccgaccgggtgatcaacgactcgccggggcgccgcggtcccgcaccacctcacgatcgaggactcgccgggaggcgtgcagtcaggtggacccccatcagccggtgccggccttctccggccgcacccctggacaaaacccgcttttccggtacgtcatgagccgtcccggcctgccccgcccacccctttctggtacgaggtggaacgtgaccgcaaccctggattcgcagcgctactgcccgcctcctcccgtgacccacggtgaccgcatcgcgtggtgggacgtgacggtcgccgaggtgcccggctaccgcccactcaccctggacctgttccgccccaccgccgtcggccacccgctcccgctgatcgtctggatccacggtggtggctggctgttcggcggcaacaaggacgccgcgcacgggcggatcgccgaccgaatcctggcggccggtttcgcggtcgcccgggtcacctaccgcctcagcgccgaggcgcggttcccggcccagctgcacgacgtcaaggcggccgtccgctggttgcgccgcaacgccgccgggctcggcctggacccgtcccggttcggcgtctggggcgagtcggccggcggccacctggccgcgctcatcgcgctgaccggcgacgacccggacccggcgctgaccggccgcagcggcgtgccgggcgtctccgacgcggtgcagtccgcggtgctctggtacgcgccgagcaacctgctcagcatggcggcgcagaaccatccggagggccggccggaccacgacgcgcccggctcgccggagagccggctggtcggcggcccggtgcaggagctgccggccgagtcggcggcggccagcccggtcacctacgtcaccggggacgcgccaccgatgctgctgctgcacggggccgacgaccggacggtgccggccgggcagagcgaggagctgcacgaccgactggccgccctgtccgcgccggtctgcctgcggctgatcccgggcgccggccaccgcttcaccggggtggacctggatcccctgatcagcggctcgctgcagcacttcacggccacgctctcgtaa

SEQ ID NO: 974 - DNA, 798 bp, Actinoplanes utahensis
gtgaacctgcgccgttccgtctgtctcgccgtctcggccgccgccgccaccgtgaccctgctgtcgatgtcgggcgccgcgcacgcggcgtccgcgcagaccgtgcagaggtccaaaccggccgccacgaaggacaccgaccgggacggcatgccggaccggtgggagatcgcgaacgggctgaacccgaagaagaacgacgcccgcgccgaccgggaccgcgacggcctgagcaaccgggccgaataccgggcggggacgaacccgcgcaccgcggacaccgaccgggacggcatgccggacggctgggaggtcaccaacggcctcgacccgcgcgccgacgacgccgacgacgacgccgactccgacggtctgaccaacacccaggagtacgacctcgacgacgacccgcagtccgaggacagcgacgacaacggcgtgctcgacggcgacgaggacgccgaccgggacgggctcaccaacgcgcaggagtacacgctgcccggctacgaccccaccgacgcggacagcgacggcaacggggtgtccgacggcgacgaggacctcgacgacgacgggctgaccaacgcgcaggagttccagctcggcgacgacccgcaggccgccgacagcgacgacgacggcgtgctcgacggcgacgaggaccacgacggcgacggcaccagtgacctcgacgagctgaccgacggctccgacccgctcggcggcgacgacagcggctccccggacgacaccaccgacccggccggcccgggcgacgacgccccggcgaactga

SEQ ID NO: 975 - DNA, 852 bp, Actinoplanes utahensis
atgaccctggaccggcgggccgagctcggtgacttcctgcgttcccggcgggcccggctcgacccgggcgagctgggcctggccagtcacgggcagcggcgggtgccggggttgcggcgcgaggagctggcgcggctggccggggtcagcgtcgaccactatgtgcggctggagcaggggcgcaccctgcacttctccgagtcggtgctggacgcggtggcccgggcgttgggcctcgacccggtcgagcgggcgcatctgtaccggttggcccgcccgttcccggcgggcggcggcgcgggcgggcagcgggtgcggcccggcctgctgcggctgctgcacgcggtcggcgacgtgccggcctacgtgatcgggcgcaacgccgacgtgctcgcctggaacccgatggcctccgcgctgctcaccgacttcggcgcggtggacccgcgggtgcggaacatggcccggctggtggtgctcgacgaggggatccgccggctctacgcggactggccggcgaaggtgcgggatgtcgccggctatctacggctcgacgcggcacggcacccgggcgacccgcgtacccgggcgctggtcgacgagttgggtgcggcgagccgtgagttccgggcggcctgggcggagcacggtctgaaggacaagacccatggggcgtacgtctacctccaccccgtcgtgggccgcctggagctgggtttcgaggcgttgcgcctgccggacgacccgggtcaggcgctggtcgcgcacacggtcgaggcgggttcgccgtcggagaccgcgctgcgcctgctcgcggcctgggcggcgccggccgttccggcgacgaggtga

SEQ ID NO: 976 - DNA, 1059 bp, Actinoplanes utahensis
atgagaacgcgagaactcggcaccaccggaatggagctgtccaccaccggactgggcgcgtgggtgatgggtggcgccggctggcagtacgcgtggggcccgcaggacgacgccgactcgatcgccaccgtgcacgccgccgtggcggccggggtgaactggatcgacaccgccgccgcgtacgggcacgggcattccgaggaggtggtcggccgcgcggtcgccgcgctgccgccggccgaccgcccgtacctgttcaccaagaccgggctggtctgggacgacccggcccgccgggacaccccgccgcgccggctgatgaccgccgcctcggtgcgccgggaactggaggcgtcgctgcgccggctgcgcaccgaccacatcgacctgtaccaggtgcactggccgggcgacgggcggctgctcagctggggcccgccggacggggccgcgccggtcggcgcgaccgaactggaggagtactggcagaccatggccgacctgcgcaccgagggcaaggtgcgggcgatcggactgtccaatcatggcgtcgccgagctggaccgggccgcgagggtggcacccgtcgacgcgatccagccgccgttctcggcgctggtccgcgagcccgccgaccagatcgcctggagcgcggcgcacggcaccggggtgatcgtctaccagccgatgcactccggtctgctgaccggcgccgtcgacgcgcggcgggtggccgccctgccggccgacgactggcggcgcgggcatcccgacttcaccaccggcctggaccgcaacctgcgggtggtggacgcgctgcgcaccgtcgcggaccggcaccgggtgccggtcgccgccgtcgcggtggcctggacgctggcctggccgggcgtcaccggcgcgatcgtcggtgcccgccgccccgggcagatcgccggctggcaacccggcgcggacctcaccctgaccgggcgggacctggacgaggtcgccgccgccatcaccgcggccggcgtgggcagcgggccggcccggcccgggactactgtcggaccgtga

SEQ ID NO: 977 - DNA, 498 bp, Actinoplanes utahensis
atgacggcggagggcgccgtcccggacggcgcggcggtgcgcttccgggacccggcgatccggctgccggagctggccgccgacgagatcgacgtggtgtgcccgcactgcgggtgccgcgccgtggtcagcgccgaccccgtccagggcgccgtcgcgatgcactcgccgcgacggttcgtctgcacccgctgcgtcaccgtcgcgcagtggccgccgaaggtcggggtctcccgctggggtgggccgatcgatccgtacttccacctgccgctgtggttccaggcgcgatgctgcggcggacgcacgctgtgggccttcaacgaggcacatctcaccctgctggccgactacgtcggggcgaaactgcgggaacgccacccgcgggagcccggcctgacgatggtggcccggttgccggggtggttgaaagcggcggacaaccgcaccgaggtgctccggacgatcgcccgcctgcgccaccggccgacgcgctag

SEQ ID NO: 978 - DNA, 864 bp, Actinoplanes utahensis
atgccgggtcaacgggggtgtcagcatggcggtgccgcttcgcgggtgcggttcggtgcgatgctgagccgccgcgccctgctgcgcaccggcctggccggcctcgccggggtggccgtcggcgcggccggggcccgggagatcccgcactggctgggctgggaccgcccgccggtgctgggcggctacgccgcggccgccgaccagctggacggcctgcaccagccgggtgtcgcggtccgctacttcgtcgacacctccgagccactggtcgcgttcaccttcgacgacgggccggccccgcactggacgccgatggtcctcgacgcgctggacgccgcgggcgtgccggccaccttcttcatggtcggcagccgcctggagcgccacgccgacctggtccgcggccggatggaccggcacgcgatcggcaaccacacctgggcgcacgacgacctggccaccctggacctgggcgcggtcacccgcaacctgcagcgcaccgagcaggagatccgccggcacttcgaccgccaggtgaccctgctgcggccgccgttcgggcacatcggcggctccaccatgctggccgccgaccaactcggctacgacgtggtgctctggtccaaggcgatgcgcgagcagctgttccacgacgacccgatgggccaggcccgggacatcgtcgactcggtccgccccgggtcgatcatcctggcccacgacgagggcgacgacaaacgcctggtgaccgtccacggcctggccgccatgttcgacggcctgcgcaagcgcggcttccggatggtcaccgtccccgacctgatcgccgccggcacctcaccgagccagggcagtcactag

SEQ ID NO: 979 - DNA, 537 bp, Actinoplanes utahensis
gtgggacacccgcccggccggaggacgcgggatcgggaacccgccggtagcctgtccggcatgtacccctcgccgcacgtccgggtgtcggactccgaccgggaggcggtcgtcgcccggctcagcacggcgaccgccgagggccgactcaccatcgaggagttcagcgagcgctcccggtccgcgtatgccgcccgcacctggggcgagctgtcccgggtcctctacgacctgcccggcgacgagctcgtggcgacaccggccgcggccgccgccgggagccggctgccgctgctcgccctgatcgccggggcgctgccgctgccgctggcgctctgcgcccaggtggtgctgcccgccccgatctgcgcggtcaccgcggtggtgctgggcatcatggcgctgcgcggcccggcggacacggtgcgacacggccgccggatggcgatcggcgggatcgcgctgggcgggctcggcgtcctggccatcgtcacgggcatcgcgcagttcctcttcgggggctccctcgacgcctag

SEQ ID NO: 980 - DNA, 603 bp, Actinoplanes utahensis
gtgagagtggcgggcagaaccctggtggtcaccggtgccggcgacgcgatcgggcgggccgtggccctcgaagcggcccggcgcggcgcccgggtggccgcggtcgacaccgacccggccgagctgcgcgaaaccgcccggcaggtggtcgccccgctgttgctctccacccacctgctcagccccggcccggccccgaccggcatcgaggcgctgccgcgggccgtgctcgaccgctggggtcaggtcgatgccgtcatccactgtgcgcccgacgggacgccggtggtggcccgcgccttcctgcccaccctgcgactgcggcccgaggcgcacctggtgcacgtggccgacagccggtcgccggccgccgaccgggccgcggcgaaggccttcgcccacgagctgcgcgccgagaccaccctgttcgtcgccatggtgttccccaccgatccgcgccgcccctaccaggccgcccgggacatcctcgacgggatggaacgcaacgcgtaccccgcccggatcggctccgaccggcggatccgggacgtgcgcggcgtcgcggccctgctgatggcgcgcctgcgggaactggtcgcgtaa

SEQ ID NO: 981 - DNA, 1197 bp, Actinoplanes utahensis
atgaggttgtcgcagcgcgccctgtcggccgagccgttccacgcgatggcgttcgggcggcgcgccggtgagctggaggcggccgggcacgacgtggtccggctcggcctcggcgaaccggacttcggcgcgccgcccgcggtccgcgaggcgatgcgtcgggtgatggacgggcggccgctgccgtacaccccggccttcgggttgccggcgctgcgcgcggcgatcgccgggttctaccgcgagcggcacggggtgcaggtcgatccggcccggatcgcggtcacccccggagcgtccggagcgctgctgctggtcgcggccgcgaccaccgacccgggcgacgaggtgatcgtggccgacccgtcatacccgtgcaaccgccagctggtggagacgttcggcggcaccgtggtcaccgccgccaccaccccggagtcgcgctatcagctggacaccgccgcggtcgacgcggtctggagcgagcggacccgggcggtgatggtggccagcccggccaacccgaccgggacgtccctcccgttcgccgacctggtcgaggtctgcgcccgggcccgggcgcgggacgcctggcgcatcgtcgacgagatctacctggacctggccgacccggccgcggacgggacgccgccgcgcacgatcctgtccgccgacccggacgctctggtgatcaacagtttctccaagtacttcgggatgaccggctggcggctcggctggtgcgtgctgcccgaggcgctcgtgccggcggccgaacggctggcgatgaactacttcctgtgcgcctccaccccggcccagatcgcggcgttggagtgcttcacccccgagtccctggcggtgtgcgagcagcggcggcgggagttgctggcccggcgggccatcgcgctggaggggctggccgggatcgggctgccggtgccggtgccgccggacggggccttctacgtgtatttcgacgtcagcggcaccgggctgggggcgtgggagttctgccgccgggccctcgaggaagcgttcgtgtcggtgaccccgggccgggacttcgcagtggccaccgcggagagccacgtccggctctcctacgcggcgtcccgggaggccctgcgcgagggcctggcccggctcagtcggtttgttcagcaacttcggcgggaatcggctccgggtcgctga

SEQ ID NO: 982 - DNA, 1101 bp, Actinoplanes utahensis
atggcgtccaccttgagcaccagcaagacccgggcggcgatgcgtgacgccgcccgggtctccgcgcagaccctgctgatcctgctgctcctgtacgtgttcctggagctgctcgggatggcctggtcggtgctctggccgctggtggtggccctgctgctgaccaccctgacctggccgccggtgcgctggctgcgcggccgggggtggccgccggcgctggccgcgtcgctggtcacgatcctgttcctggccctggtcgccggcatcgtggtgctgatcgcggtgccggtctcggcgcagagcggcaagctgggccagggtgtggtcgacggcatccagacggtccgtgactgggcgtccggcccgccgctgcggatcagcgacgaccaggtcaacagcggtctcaacagtgccgtcgacaagctgcaggccagcgtcggcagcatcgcgaacgccaccctggccggggtgagcacgatcgtgaacggcctggtcaccacgatcctcgcgctgttcctgatgttcttcttcctcaaggacggcccacggttcctgccctggttgtcccgtcagctgccgggccggctcggcgacgacgtcccggcgatcgccgggcgcagctggaacacgctcagcgcgttcgtccgctcgcaggcgttcgtcgggctgctcgacgcggtcttcatcgggctcggcctgtggatcgtcggggtgccgctggtgctgccgctggccgtgctcaccttcgtcaccgcgttcgtcccgatcgtcggcgcggtcttcgccggcctggtcgcggtgctgatcgcgctggtcttcaacggctgggtaaaggcgctgatcgtgctcggcatcatcctgctggtgcagcagctggagggcaacgtcttccagccgatgatccagagccgcgggctgggcctgcacgcggccgtggtgctgctcgccgtgaccctgggcggcaacctggccgggatcgtcggcagcctgctcgccgtcccggtcgccgcgatcgtctcggtgatctggaactatctgcgcgagcagctcagcgacccggagccgattcccgccgaagttgctgaacaaaccgactga

SEQ ID NO: 983 - DNA, 1194 bp, Actinoplanes utahensis
atgcccgggaggcattgcgtgacgttctaccgccaggtcggcagcattccgccgaagcggcacacccagcaccggcggcccgacggcgggctctacgccgaggagctggtcggcgaggaggggttctcctccgactccgcactgctctaccaccggggcatcccgtcggcgatcgtcgacgcgcgcccgtggcagctgcccgaccagagcctgaccccgaacaccccgctcgtcccccggcacctgcgcctgcacgacctggagtacaaggacgccgacccggtcaccggccggcggctggtcctcggcaacgccgacgtgcggatcacctacgcggtgtccagcgaggcgtcgccgtactacaagaacgccatcggcgacgagtgcgtgtacgtggagcggggcagcgccaccgtcgagacggtgttcggcgcgctcaccgtcgggcgcggcgactacgtgatcattccgcgcaccacggtgcaccggtgggtgccggacggcggcgagccgctgcgtacgtacgccatcgaggccagctcgcacatcgcgccgcccgcgcgctacctgagccggtacggccagttcctggaacacgcgccgtactgcgagcgcgacctgcgcggcccggtcgagccgatgctcgccgaaggcaccgacgtcgaggtctttgtcaagcaccgcggcggcggcagcatccacgtcgtgcccgagcacccgttcgacgtggtcggctgggacggctgcctctacccgtacgccttcaacatcgccgacttcgagccgatcaccggccgggtccaccagccgccgccggtgcaccaggtcttcgccgggcagaacttcgtgatctgcaacttcgtcccgcgcaaggtcgactatcacccgctggccgtcccggtgccgtactaccactcgaacgtcgactcggacgaggtgatgttctacgtcgacggcgactacgaggcccgcaagggctccggcatcggcaagggctcgatctcactgcacccgggtggtcactcgcacgggccgcagccgggcgcggtggaacgctccctcggtgcggagttcttcgacgagctggcggtcatggtggacacgttccggccactcgacctcggcgaggcggggttggcctcggacgacggccgctacgcgtggtcctggtccggccgcggtccgtccgcatga

SEQ ID NO: 984 - DNA, 1011 bp, Actinoplanes utahensis
gtggtcctggtccggccgcggtccgtccgcatgaccgcgacccccgcgccgcccccgtcgcgggccgccgccgacgtccctgcgcaccccaccggcatcccgccgcactccggtgccgaccttcctccgcactccggcgcccgtcacccggaccgctccggcgagcgcgatcctgagtcggttttcgatcctttcgcccttttcgcccggttctttgacgatgccgcgctgttcccgcccggcaacgcaccgatggcggcggccgtcccggccttcctggatcgcctcgccacgccgcacgccccgctggtcgggccgttcatcgcgcccgcggcccgcctggccgaggtcgccgcgcacctgcggcccgccggtccgccgctggacatcgccctgatcgccgcccccgccgacctcccggccgccgtcgacaagatcgacaaaacgccaggaatgcgcctggtcgcggtcgaggcgccggtcgcggtcgacgccgcacacacccgatcggcggtacgcgtcatagcggactcgcttccccccggccttccggccgcggtcgaggtgccacgcaccgccgcccgcgacgaggtcctggacgccctggccggcacccgctgccgcgccaaactccgcaccggcggggtccgtgccgacctgttcccgccggtcgaggagctggccgccaccatccgcgcctgcatcacccggtccgtcgcgttcaagtgcaccgccggcctgcaccacgccgtccgccacaccgacccggcgaccggcttcgaccaccacggcttcctcaacgtgctgctggccgccgcccacccggacgccgccgagacccacctggcccgcaccgacgccgcgcggatcgccgccgacctgcgcgcctggtcgcccgccaccgccgtccgggcccgagccgccttcaccggcttcggcacctgcgacctcgctgatcccgtcaacgacctggcccacctcggcctgctcccggagagataccccgcatga

SEQ ID NO: 985 - DNA, 126 bp, Actinoplanes utahensis
atgacttggctccacctgcccgaagccaccggtttcggcctcaccaacctgccctacggcatcttctccaccccggccggcaccgccgccggctctcccaccgcacccggcgccgcgccacgctag

SEQ ID NO: 986 - DNA, 1110 bp, Actinoplanes utahensis
gtgcccggcgcgcggaccggtgtcgcgatcggtgaccacgtgctggatctggccgggctgaccggtgatccggtgcacgcgaccggttcgctgaacgcgttcatggcgcagggcccggacacctgggccgccctgcgctcgatgatcaccacctggctgaccgatccggcccatcaggagcgggtgactccgcacctggtgccccgcgacggggtcaccatgcacctgccgttcgaggtggcggactacgtcgacttctacagttcccgggaccacgccgagaacctgggccgcatgttccgcccgggttcaccggcgctgaccccgaactggacccacctgccgatcggctaccacggccgggccggaacggtgcagctgtccggcaccccggtcacccgcccgcagggccagtcgctggtcgacggcacacccgccctcggcccgtcccgccgcctcgacatcgaagccgaggtcggtttcgtggtgggcaccccgtctccgctgggcaccccggtccccttgtccgacttcccggcccacgtcttcggcgtctgcctggtcaacgactggtccgcccgcgatctgcagtcctgggagtacgttcccctgggcccgttcctcggcaagtcgttcctgacctcgatctcgccgtgggtcgtcccgctggccgccctgtccgccgcccgggtcaaggctcccacccgggacgagcccctgctcccctacctggacgacagcgccgaaccgtggggcctggacctcaccctggaggtccggctgaacggccacgtcatcagccgccccccgttcgccggcatgtactggacccccgcccagcagctcgcccacatgacgatcaacggcgcctccctgcgcaccggcgacctgtacgcctccggcaccatcagcggccccacccgcgaccagcgaggctccctgatcgaactctcctggaacgcctcggacccgctgaccctcccggacggctccacccgctcgttcctcgaggacggcgacgagatcaccatcaccgcgacagccccctcccccgacggctcccgcctctccttcggcaccgtcaccggccgcgtccttcccgcccggtga

SEQ ID NO: 987 - DNA, 387 bp, Actinoplanes utahensis
atgcgtagcatggtgctcgccggcctcatcccggccgttctcgtccccggtgccgcccaggcgtcgccgtgtccgacgacagacgttctcgggacttatgcgttcggccgcgccgcgaccatcggcgccgccggcgagacagccggtgtctggactgtcgccggcacccggtccgggatcgccggtgacgacctgatcgtcacctacactccgcgctacaccgcggccgccaccgagacggcggtctacactgccctgttcaaccaggtcgcacggcctgatgtcgagtgcgaccgggtcggtgcggacggcgttgcgaaacacgtctgggtcacctatcggtgccgcaccggcgtcgcccccaactacacgcttctggtccgctga

SEQ ID NO: 988 - DNA, 1005 bp, Actinoplanes utahensis
atgcgcgagctgctgcggccgatcgtcgtcgccccgatggcgggcggaccctccaccccgggcctcgtcatcgccgccggccacgccggcgcgctcggcttcctcgccgccggctacaagcccccggaagcggtcgaggccgaggtccaggaagtacgaaaagccgatgtgccgtacggggtgaacctcttcgtcccgtcgtccccacccgcagacgtggcaccccttgagcggtaccgtgccgcgctacagccggaagccgaccgctacgggatcgacctcccgccgctgcggctgagcgacgacgaccacttcgcggcgaaagtcgacctggccgtcagccatcgcatcccactggtcagcttcaccttcggcatcccaccggccgccgtcgtcaccgccctgcggtccgccggctgcgccgtcctgatcaccgtgaccagcggcgcggaggcccggcaggcggtcgccgccgggccggacgcgctgatcgcccagggcgggtcggcgggtggccacgcgtcgacgttcagcccggccacctacaccggcacccgcgccacgcgcgacgtcctcgccgaggtcctggccgtcgcccgcaccgccgccgacattccggtgatcgcggccggcggtggtgacgtcgccgcgttgctggccgccggtgcggcggccgtccagtgcggtaccgcgttcgtgctgtccgacgaggccgggacccgtcccgcccagcgcgccgccatgctctccggcgaccatcgcgagacggtggtgacccgggctttcaccgggcagccggcccgagccctgcgcaaccgcttcgtcgacacctactcgtcgatcgccccgatcggctacccggcgatccaccacctcaccgccccgatccgggccgccgccgcccgtcgtggtgacgcctccgccctcaacctgtgggcgggtgtcaaccacgcctccgcccgtccggcgcctgtcgccgccgtgatcgatgcgctgcggggctga

SEQ ID NO: 989 - DNA, 540 bp, Actinoplanes utahensis
atgtcttatcctccccccaacgacccctacggccagcctcagcagcaggcctacgggcagccgatcccgcagcagccgtacggcggtcagcagccctacggcgcgccggcgcccggatacggcccggccgtgacctacgccagctggggcgcgcgggtcggcgcgtacctcgtcgatatgctggtcatcctgccgttcgccatcgtcgcgctgttcttccggccgacggtcgacccggtgaccctgcagacgcacttcagcccgatgtacttcatcatcctgctgctcgctgtggtggtgtcgttctacaaccgggtcttcctggacggcaagggccagagctggggcaagaaggccctcggcatccgcctggtggacgccgccaccggccagcccatcggtgccggcaaggcgttcctgcgcggcgtggcgcacttcgtggacttcatcatctgctatgtcggcttcctgttcccgctctgggacgagaagaagcagaccatcgccgacaagatcgtcggcacggtcgtggtcaagtaa

SEQ ID NO: 990 - DNA, 405 bp, Actinoplanes utahensis
gtgagagccttctccgttcctgagcggatcggtggtttcggcgtgctcgtcgccggggccgccgcggtgtggcccgccttcaccgacggcaccggcctcggcgcgccctgcccgatgcggaccctcaccgggatcccgtgcccgggctgtggcctgaccacggcggcggtcgccctcgtgcgtgggcacgtcggggccgccctccaggccaaccccgtgatcttcggtctggcggccctcgcggtcgccgtcggcccgctcgtcgcgctccgcgccgcgggcgtgctggaagcaccgcaaccgtggtcgcccaccgggcgccgacggatgggacggctggccggactgctggcggcagcgagctggctctttcaactgcaccggctcggcgtgagctgggcctga

SEQ ID NO: 991 - DNA, 5175 bp, Actinoplanes utahensis
gtgctttcggtgacggataccccccaggtgcgccccagcgggccgcagaccgctgagctgtccggcctcgagatagtcgaggagctgggtcgtggcgcattcaccatggtgcatcacgtgcggcgcggggagcacgactacgcgctgaagcggcccctcgcggatgccggggagctgcccgagctgcgcaccgcgttccagcgcgaggcggcgctgctggcctgcatcgacgacccgggcgtggtgggggtgcacgcggtcggggagatcgacggcgtacccgggctggtgctggaacatctgtccggtggggcgctttccgacctgctcgtctacggcatcctcagccaggagcggtgcgtcgagctggccgcgcagctgacccgcgggctggccgccgcgcaccgggtgggcctggtgcaccgggacatcaaaccggacaacatcatgatcgccggggacggccgggccaagctgatcgacttcggtctggcgcagctcggccgggacaccgatgcggactccgaccaggcggtcgggaccttcctctacacctcgccggagcagtccgggatgctgcgccggccggtggacgggcggtccgacctctactcgctgggcgtggtgctgttcgagtgcctgaccggacggctgccgttcgaggccgacgacgtgggggagctgctgcgtctgcacctggcggcgccggtcccggacgtgcgggagaaacggcccgacgtcgacccggcgttggccgcggtcgtgcaccggctgctcgccaaggacccggacgaccgctacccggacgcggccggcctgctcagcgccctgcggcactgcccgggcggcgcgtcggccgaggagcccgcggcgagtcgatggccgatgtgcgggcgcgacgccgaagccgaccggctggcccgccgctgggaacgggcccgggccgggctgggtggggtggtgctgatccacggcgcggccggctccgggcggacccggttggccgagcacgccgccggactggcgagcgtcagcgcgatgccggtgctgtggggcacctgccggccggacgaaccggccccgctcgccgtgttgcgcgaggcggtgcaggcgtcgatggcgcgggtccagcggctggccgacgagccgcgggcggcggccgagaagaacatcgccgaggcggccgccgcggccggcgtcgcccaggtcatcaagatcttcggcgatctcgggctgctcgacgtgagcggccagccggccgccggtgacgaacacgtcttcgcggccggcgcggccttcctcggcgacctggcccggcgcgccgacggcatgctcctggtgatcgacgacgcgcacctgctggacaacgcgacccgccagttgctcgccgcgctcgccccggacctgcccagcctgcccctgctggtgctgatgaccgacaccggggacggcgccgccgacctcggcgtgcccggcaccctggagctgacctgtaccccgctgccgccgccggtggtcggcgaggtggtggcctcccggctgcccggcgccgccgtccccgccgagctggcccggcacgtcacggtccgcaccgacggcaccccgctcgccgtggtcagctacctgatgcggttgctcgacgccgggctgctcggcccgctctggggcacctggcacctggacaccgtcggcgcggacgcgctgccgtccgcgtccgggatccgggacctgcttgccgcccgcctggccgggctgtccgagccggttctcgacgtgctcaccacggccgcggtggccggcgtccggttccggcccgaggggctgcccggcgacggcgagaggaccgcgctggaggcaggtctggagcggcacgtgctcgaggtgcgggccggcgggtggtacgcgttcgtccacccgcagctgcgtgacaccctgctggagcggctcggcccggacgagctgcggcagcggcacgccgcggccgccgccgccctggaacggcttcccgaggagctgcgggacgaggcgcacgcgtacgcggtggcccgccactaccagcgggccggcgacgccgcgccgatcgccgaccgacggcgcaccgcggccgccgccggcctgcgcgccctcgccgaccaggcgcccgaggaggcggtcggctatctggtcgaggcgatcgacggcgaccctgcgccggccgcggcgatgctgcactcgctggccgaggcctacctgcgggccgggcggttcccgcaggccgaggcgaccctggaccgggcgctggcggtcgaaccggaccgggtggcccgggcccggatgcacctgacccggatcgagctcgcccacaccatctgggacgacacccgggcgctcgaggcggcccgggacgcgctcaccgagctgggccggccactgccccggcacccgctgctgctcatcctgtcgacgctggcctatgcgttcgcgggtgccgtcgtccggcgtaccaagatcggtttcggtcgggccgaaggccagcggcgcgaagtgctcgccgcgctgaccgctgtcctggacgccggagggtatgccgccatcatcggcctgcgcctgcgcgaagccggcatcctcgggatgcgggccatgtacgcggtgaaccggctcggccccagcccggagtacgcccgggtgtacgccctggtcggttacgtcagttcgctgatccggctccgcagcaccgggcaacgctgccagcgccgggccatgcggatcgccaccgatctgggcgacccggtgctgatcgcgtacgtggattggatcaacggctgctcgatgctgctcggcgggtacgacgacggcagcacctgggagaaggcgatcacccgcaacgcccgctggtacgagccggcccagctgctgcccgggtacgcctcgcaggggctgcggctgctgctgcgcggctacccggcggacgccgagcgcgagtacgagcgcgggctgcgcggcgtcgccgacccggcgctcacctacggcacgtcgctgtccatgctgggcgcgatggtccccgcctaccagggccggttcggcgaggcggcggccgccgtgaagcggctgcgcgacgccatcccacccggcaccggcacccgggtgcagcacgccaacatcctcgtggcggccgccgccgtgctcctcgaacagggtgagatcggcgagtcgttcgacgaggtgatggccgagttccgcggcctcggtctgcgcacccgggatctgatggtgcagcacaagtggatcctcgcgttcgcggcgcacgcccggctgatccggctgcggtacagcagtgacgaggaccggccggcccggctcgccgaggcggtcaccgcgatccgggaactcgggcgggccggcggctcaccgctgatcaagctctcctaccggctgtcccaggcgtcgctcgcgcagatgagcggcgaccaggaacgcgggctcaaactggccgacgaggccgagaagaccgcccgggcgctggacgcgccgatggcccactacgagatctgcaagatccgggcccgggcgctgcgcgccctcgggttgaaccacgaggccgaccggcaggcccgctccgcgctggcgctggccaccttctacggctgggagcagcggcggcggcagacccgcaccgagttcggggtggacgagggggcgagcacccatcgccgtacggtcgccgagcggcgtggcccggcaaccggccgcaaccggcggctggaggccctgcagcaggtcagcacggcggccgccaccgtcctcgacccgcagcagctggcccaggtggcgctcgacgagacgctgcgcatcctgggcgccgaacgggcactgttcttcctgctcgacgaggccggggaaccggtccggttcgccggccgggacgccgcgggcgagctcaccgacaccatggaatacggcgccaccctggtccgccgggtcgccgagaccggcgaggcggtcgtggtcaccggcaccgaacagggcgccgccctcggctcgcgcagtgccgtggcgcacggcctgcgcagcatcctggtcgccccggtgcagttcaaaggccggctgatcggcgtcgtctacctggacagccggctcgcccgcggcatcttcaccgacgacgacgtcgacgtgctcaccgcggtcagcagccacgtcgcgatctccctggaaaccgcccgggccgcccagctgcacctggccgtgcaggccgcgcagcagcagcaggcgctcgccgaaacgctgcgtgccagcctcgccgaactgacctcgatcctggaaccggaccggctgctgcgccggctcagcggcaccctgcagagcaccctcggcgccggatccagctgcctggtcagcccggacggcgaagtcctggaacccgcagagatcgccggcggccggctcactccggacgaggtggcgctcgtcggcggcctcaccgaacccgccctgctcgacccggccggcaccggcggcctgcgggaacgcctgcttgccggcgacccggtcgcgctcgccgtgcccctcgacggccgggacgggcgcgccgggacggtgctgctcggcggcgccgcgctggacgacaccagccgccaggtcgcggccgcgctggccacccaggggatgaccgcctacgacaacgcgcggctgttcagccgggtgcaggaactggccaccaccgacgagctcaccgggcagcacaaccggcggcacttctacgccgtcgccggagcgctggtgcaggccgccgcccgcaacggacggccgctggccgccgcgatgctggacatcgacaaattcaagagcgtcaatgacacgtacggtcatggcgtcggcgacgaggtgatccgcaccgtggcccggcgcatccgggccgtgctgcggcactccgacgtactcggccgctacggcggcgaggagttcgcgatcgtccttcccgaccacgaaggtgaggcgatggaactcgccgagcgggtccggatggcggtcggcggcgaaccggtggcgacccaggccggacccctgccggtcacgatcagtatcgggctgactcgactgggtgacgacgacaccgcactggacgatcttctcgctcgggccgatcacgccctgtaccgggcaaaggaagccggccgcaaccgcgtaatggccgattga

SEQ ID NO: 992 - DNA, 834 bp, Actinoplanes utahensis
gtgcctcgtccatgccgcaacgtcctgttcgtgctcacccgactgctcgccgcgctcctgacgctcccggccgccgcctccaccggttcggccgtcgccgcgcccgccggcccaccccgcacagcggtgacccatccggcggcgcacatcgtccgccccggcgacaccctgcccgcgatcgccgcccgctacggcctcaaggcgcggcaactgcagcgatggaacgacctgccggcggatttcgtaccgcacccggacagcgccctgcgcctgtccgcctcctaccggccccgcccgccctggcacacccgggtcgaaccggtcaccacccccaccgccccgaactgccccgtccccgccaccgccctgcgccgcgtctgggtcacctacgaggacttcaacggcgacccgcacgacggcagcctgatcgtcaacgagtcgatcgtgcccgccacccagaacgccttcgccctcctgtacgcctggcacttcccgatcatggccatggagccgctcgcggagaacatgcccgacctgaccgaccgcgccgccctgaccagcggctacgaatgccgcaacatcgccggcaccacccggtggtcgcagcacgcctacggcttggccatcgacgtcaacccccgccagaacccgatgatccgcggcgactacctggacccgccgaacagcgccccctggatcccccgaggcccctacctccccggaatgatccaccccggcggcgccgaactggccttcacgagcagcggcttccactggggcggccgctggcactccctgaaggactacatgcacttcagtcccaacaaccactga

SEQ ID NO: 993 - DNA, 1050 bp, Actinoplanes utahensis
atgcggcgcatgatctcgaccgaacaccgtggacggcgtgccgccggttctctgaagacctgggcggcgggtgccgtgggtgtcaccctcgccgttgccgtcacaccgcacgccgcgctggcgtcggcctctccggacctgcgcgccgagtccacccagctcaccgacgtggtgcaggcgggcagcacgatcgacctcccggtgatcgtggacaacgtggcccgggcgggtgaggagggcaccaccgcacacggcgtttcgatcagcatcatggccggcgccgacagcttcgtgacccggcatgacaactgttggtacggcgcctacagcaccacctgccggtttccgggcgtcgtcgtcgcgcccggcgatcgatacgcgctcagtccggagacaccgctggcgtaccgggtcgccccggacaccccggaactcgagaacgcccgggtgctgtactcggtccacgccatgagcagcgaggacgaccagccgccgtgggacacccggcagggtgacggaccctcactggtgctggtcgcaggaccgggtgcgaaacccgcggacgaccggaacaacgccggcaccatcacgttccgcaccggtccgaaccccacggacatcgtggcggtcggtacgcaggtgagcgcaaccggcggtgagtcggtcccgatcgcgttcggagtccgcaacgacggcccggcgttcatcgacccgaccagcgggcgagccgcgtccaacggggagccggtctgggtcgacttcgccgcgccgtccggtaccgaggtcgagtcgatcgattcccgatgcgccccgttcgtcgacggcgctgtcgaccggagtcgtgccggcgcggcgggattcgcgcggtacgagtgtggtctcggcgtcatcgacctggacgggtatcccgtgggctggtcggagctgtggagcggcacgctgaaggtcaccggtaccgtgtccggcccgggcaccgtcaccgcgcacatcagccaggcggagggcgatccggcgaacgacaccgccccgatcgagatcacccagtcctga

SEQ ID NO: 994 - DNA, 462 bp, Actinoplanes utahensis
atgagctacgccgttgacttcaccaccgtctcgaccaccggcctggaatcgtcaccggtcgccgacgcgctcgccggcctgcgcgccaatgaggcccgctacttcaagaacaagtacgaccacgtcttcacggtcgagccggcgaccgaagccacggcgaccgtcgactgggtcagccacatcctgaaagcggagcgcggcatcgtgatcgcctccccgcccctggaagccacccggttccaggtcgagaacatcaagatggcgtacgtcttctaccggagcggcctgtcgatcaacgtgatgtacaccgtcgacgagggcggcaagcgtgccgtcggcttcaaactctccgacggcatggacatcccggaggaactcggcgcgttcaagttcgcccgccagaagtccaagctggccggcaccatccgcggctcctacttcgtcatcaagaacgagtactga

SEQ ID NO: 995 - DNA, 606 bp, Actinoplanes utahensis
ttgtccgcgaacctgctggccctcatcgccgtcatcctgctgctcacctacttcgcgatcctggtcgcgctgcacgtgcgggacacccggcaccacccgctgcgcgacgcggtcagcgactacggtgtcgggcccaccgccggccggttccggatcgcggtgatcgccaacagcctcggcatcctggccatgaccggcgccctcgccgacgagctcggcctgctcggcttcacccacagcgactacgtcatcctgctgctgatcccgatcacccggctggccctggccttcttcccggccggcatggacagcacccggaccacctggaccggccgcatccacctgatcctggcgatcctctcgttcaccttcgtctacctctcggtggcccagctgaccaccccgctgaccagcttcaccagcgacacggtcgggctgctgctgctcaccctgcgctggctggccgccttcggcctggccgcggtcgtgatcaccatgctggccccggccctgcgcccgttcttcggcctggccgaacggatctatctggccaccaccaacctgtggttcctggtcgtcgccctgttcctcaccttccaccgatag

SEQ ID NO: 996 - DNA, 378 bp, Actinoplanes utahensis
atgcctgccgcatcggctgcctattgtggagggatgccgacccagcgcctggtggcacatctgcgggagctgggcttctcgccgtacgaggcgcgctgctacgccggcctgctcggcgccggtccgctgaccgggtacgcggtcgcgaaactcaccggcgttccgcaacccaaggtgtacgagacgctgcgccgcctggtcgcccggggcgccgccgagcaggcgcccggcccgccgattcgattcaccgccgtcgacccgcaggacctgttgaaccggctggccgccgcgcacgccgcgcagatcgccgccgtccgggccgccgcggaacaactgctggcacttaagatcggctctcgtcgtagcgagcactactga

SEQ ID NO: 997 - DNA, 153 bp, Actinoplanes utahensis
atgaccgcttccggatcagccggcgccgtctgttcgtcaccaccggagccggggttgtccaccctcgacgtgcgggcgatcctgcccgggcacggcgagccgctgccggccggggcgaaggagatcctgcagaaaccggcggcgtcgatctga

SEQ ID NO: 998 - DNA, 378 bp, Actinoplanes utahensis
atgaaaggcgacgccgggccggtcctgatcgaggtgatcaacccggccggggaccgcgccgcccgcgacatcgtcggccaggtggcgcaggcgccgcgccggtgtccctcctacgacgagggcaagccgggcacgccggacgcgctgcacatggtgacgatgccgctcagcgtgccgaagctcggcaaccggtcggcgggcgtgcacttcgaggtagacatgaccagcccgcgggtgaccgtgcacggcaagatgatcgcggtctccgtgcgcggcgtggtggtcaccgtgctgctggccaacctggagccgccggaccagcacgaactggagacgatcacgcggaccgccgtccgcaaggttcagcatcagcgatag

SEQ ID NO: 999 - DNA, 447 bp, Actinoplanes utahensis
atgcagatgattcggcataaatcgctcaaaatggcactcgccttctcggtcagcgccgggatgggactcgccgtcgccgcaccggcctccgccgcctccgtctggacgccggtgaagaacaccgcgctggcccagctgatgaccgacgcggcggcgccctccctggtcaccggcaccacgctgctacccgcgggggtggccggcgcccggctgctgccgtccgggtcacccgccggaccggtgcccggctggctgaagaaggccctgctcaccgggaaagacctgccggaggggtatcagccggtgccggacgcgctcaaggcgttcagcgacaccggctccaaggtcggcgactgcggcaccaagcctgccgacaccaagcccggcgacaccaagcccgccgacaccccgcccaccggcaccaagccgccggtcctagctagctag

SEQ ID NO: 1000 - DNA, 564 bp, Actinoplanes utahensis
atgccgaatcatctgcatttcctcaccctagccgcggctcctccggaccaccgtgaccttcgcgggatttcgccgggagggtcggaccgggcgggcgcccggcgtcagcatccgcactcgcgagcgcccggtcgctatggtccgaggatgagcgctctgccgaaggaactccgcgatctgatcgaatccggacccatcgcccatctgagcaccaccaacgcgaacggcagcccccaggtgtccgccatctggatcgggctggacggcgacgacgtcgtcagcggccacctcggctggcggaccaagctgcgcaacatcgagcgggacccgcgggtcgtgctctccttcgacgccccgcgccggcccggcgtcttcctggccgagcatgcggtgctgcgctgccacgccacgctcgaacacaccggccgggcatgggacctgctggatcggctggccaaggtctacctcgggccggagcagacgttcccggcaccacgcgccgaggggtggatcgcccgttaccgggtcgaccgggtcggcggcgtcggcccctggaccgcctga

SEQ ID NO: 1001 - DNA, 1014 bp, Actinoplanes utahensis
atggaccacgcacacgagcacgagcacgagcaccatgatcacggccatgaccatgaccacggcgggcacagtcacggggtcgccgccgacgccgaccggcgctggctgagcctcgccctcggcctgatcggcgcgttcatgatcggcgaggtggtggccggtctcatcgcccactcgctcgccctgctctccgacgccgcccacatgctcaccgacgccggcgcgatcgtgctcgccctggtcgcgatgcggctggcggcccgcccgccgcgaggcggctacaccttcggcctcaaacgcgccgagatcctgtccgcccaggccaacggcctgaccatgctgatcctcgcggtctggctcggcgtcgagtcgatccgccgcctgatcgaagcgcccccggtcgccggccgcctggtcctgatcaccgcgctggtcgggatcgtggtcaacctgggcgccgcctgggcgatgagccgggccaaccggtccagcctcaacgtcgaaggcgccttccagcacgtcctcaacgacctgttcgccttcatcgccaccgcgatcgccggcgtgatcatggtgaccaccggtttcacccgggccgacccgatcgccaccctgatcgtcgtggtgctgatggtcaaggccggggtgggcctgatccgcgaatccggccggatcttcctggaggccgcgcccaccggcatcgacccgcccgccctcggcgcccgcctggccggcgtccccggcgtcgtcgaactccacgacctgcacgtctggcagatcacctccggccagccggcgctctccgcgcacgtgctggtcgccgaaggcctggactgccacgccgtccgctccgatatcgagagcctgctccgccgcgactacaagatcacccacagcacgctgcaggtcgaccacgccgacaccgaccccacccggtccaccggctacgaggtcgacctcgccgacccgggcgggcactgcgtcgactcgcacggcgagtcgtaccgggtgtag

SEQ ID NO: 1002 - DNA, 1209 bp, Actinoplanes utahensis
atggccgacccgttgaatccgaccctgatgacccggatgcgcgccaccctcggccgggaacgcgacgcgtccctgctggaggcgttgcgcaccgcgggccgggtggcctacgacgagctgatggccgcggagaaggttcgcgagcagctcggcgccgacgggacctcggtgtggaacgccccggtcgcgatcggcagccagctgctggccgcatggaacggcttcgttctgcagaccctcggcgaaaccttcctcgacgccgactacgccgccaacccgggcacggtcggctacgtgccgccggtcacctacgagcagaccgcgcgctggttcagcgccgtcgagggttgggtgtcccgggcccggcaggcccgcgtcaacccggactacgacatcagcgccgagctgggcctgcccgccggactgccgatgtgggccgaggtcgaaccgtgcccgccggaacacctcagcgcgttactggccgccgtccccccggtccgcgaacacgtcgacgtcgccctgttcgccctggagaaggccggcgtcccggacaaccgccgcaaagccttcaaccggctcaagcagctcgtcgccgaagccgccgcggccgccgactacgcggtcggcctgcgcaccacccagcacaaccccgccctgcacgagctgatcgagaacaacctcaagcaggccctggaactctggttccacgccggccagctggccgccatgcccggcctcctcgacagctaccgcgcgctgcgccccatcgcccgccccgacccggccaccctccccggcggcgcccgcttcgacccgtggtgcctcaccgaccgcgtcaccctcccccgctggcagcgcgaccaccgggcgatccaggccatcagcgaactctgggaatacgacccggacccggccgcgaccctcgccgtcaaagccgacatcgacgccgccctcgccgccggcgacatcaccccgctgcgcacccccggcggcggcacctgctactacgaatgcccgtggtccgccctgtacgtggtccgccgcccggtccggatcgccggtcgccgcctgcaggtcctgcagcagttcacgatggaggcggcggccgacgacatgccccgcggcctgcccttccgccggggcatcctgatcggcccgttcttcccgacgaacgaggtcgaatactgcgaccccgacggccggcactga

SEQ ID NO: 1003 - DNA, 771 bp, Actinoplanes utahensis
gtggatgtgaacctgtgggtctgcggtcgccgtggacatctgacgtatgcgccggtcgaggaggagttccgggcccggctgcacgcggagacggcgctcggcccggtgtggcggtgtctgcgctgcggggatttcgtgctgggtgagccgcggctgtcgggtccggccgctgacgcgccgctcgtgccgcgggggcgggcgctgcgggatgcgatcgtgttgcggctgctggcggtggagcggttcgtcaaggggatcctggttctcgccgccggctggggggtgatccagttccggggcagccgggacgccgtgcagcgggcgttccacgaggatgttccgctgctcaagccgttcaccgacaagatcggctgggatctgcagcattcggcggtcgtggacaccatccggcgggttgtcgaggcccggtcggacacgctgttgtgggccgggatcgcgctgatcgggtacggggtgttgcagctcgccgagggcaccggcctgtggctgctgaagcgctggggcgagtatttcgcgctggtggccacgtcgctggggctgccgatcgagatctacgagctgaccgagcggttcacctggttccggatcgccaccctggtgatcaatgtggcggcggtggtctacctgctggtgtcgaagcggctgttcggtctgcggggcgggcaccgggcctacgaggcggagcgccacgagatgagcctgatggaggtggcggacgcggccggggacccgatccgggtcggcggctga

SEQ ID NO: 1004 - DNA, 564 bp, Actinoplanes utahensis
gtgacctttctgtggtcgtacaccgaggcgctggccggtggggatgtgggctggtggcgcgcggcgacccggcatgccgcggatctgctggaggcggatcactggtggctggatccgccggcgctggtgccggtgcagcacctgctggtggagacgaccgcgttgctgtcctatgcgctggcccgcagcgtggacggcgatccgggggcggtgaccggggcgcagctgggcggatgggcggcggcgcggccgttgccgctgctggacgagacggtgccggattcgctggaggggtcgttgtcgctgctgcagtggagccggatcttcgaggagcagcggctgcgccagcagaacgacttcgcccggctgctggtggcggccgggcaccggctgccggcgaccggcgatccggtcgcggacctctggcaggacctggtggaccgggagaattcgggccggcggtacgggttggccggtcgcctgcccggcccggccctggcgctcggtctgggcgccgtcaggcagcagttcgtgagtgccggcggagcagcaggtgggcggtga

SEQ ID NO: 1005 - DNA, 951 bp, Actinoplanes utahensis
gtgacgtcgaccgctcccgccacgcccggcccgcaccgggcgtggcggcgatgggcccgatactcgctgctcgcaccggtcgccctgctcgccgtggcgatgctgcgcacccggctgccggacccggtgtcgatcctcggggcgctccgcggcgccgatcggcggtgggcggtgtccgcgctcgccgccggcctgctgtcccagctcgcctacgccgaacagcagcgccgcctgctcgccgccttcgccgtgcacgtcccgccgcggcgcgcggtggccatgacgtacgtccgcagtgctctcagcatggcgctgcccgccggcgccgcggcgtccgccgcctacgccttccagatctaccgccggcacggcgcgacctcggccgtctccgccgccgccaccctgatctccagcgtggtcacggcgctgtcgctgggcctgctctgcgccgcgacctggtcggtgccgctgaccgcggccctgctcgccgcggccgccgccgtcccgtggatccgccgccgcccggccctgtcccggcggctgaccgccctcccgttgctgcgccggccggccgtccgccgggcgctgcgggacgcgcgcaccgtcgaaccgcgtacctggatcgccgtgctgctggccgggctggtgaactggctgctcgatatgggatgcctgctgctggccgccgacgcggcgcacgccgggatcggatgggaccggctggcgctgatctacctgaccgtgcagatcgtccggcagatcccgctcaccccgggcggtatcggactgatcgagaccagcatgctggccgggctgatcgcggccgggaccacccaggcggccgccgccgtggcggtgctcatctaccgcctgatctccttctggctgatcctgcccgccgggctcaccgcccacctgctgctccgccggcactcacgaactgctgcctga

SEQ ID NO: 1006 - DNA, 1440 bp, Actinoplanes utahensis
gtgacgggccgcgagctcggcccggccccgggagctctctgcaacgattactgttcgctcatgggtgaacatttcgatcttgtcgtgctgggtgccgggccgggtggctacgtcgcggcggtccgcggcgcccagctcgggctctccaccgccatcgtcgaggagaaatactggggtggcgtctgcctcaacgtgggctgcatcccgtcgaaggcgctgctgcgcaatgccgaattggcgcacatcttccagcaccaggcggacacgttcggcatcgacggaaaagtgaccttcgatttcggggtggcgcaccgccggagccgggacgtggccgacggccgggtcaagggcgtgcactacctgatgaagaagaacgggatcaccgagatccagggccgcggcgaattcgtcgacgcgcacaccctgcgggccggtgaccgcacgatcaccttcgacaactgcattctggcgaccggcgcgagcacgcgactgatcccgggcacgaccgtcaccgatcgggtcgtcacctacgaggagcagatcctcgacgcggagctgccggaacgcatcgtcatcgtcggtgccggcgcgatcggggtcgagttcgcgtacgtactccgcaattatggggttgacgtgacgatcgtggaatttctcgacaggatgctcccgctggaggacgaggacgtctccaaggaactgctccggcactatcgccggctcggcgtcgacgtgcgggtcggcacccgggtcgacagcatcgaggagaccgccgcatcggttcgggtcaccgtttccaaggacggccggaccgagattctggaggccgacagggtgctccaggcgatcggtttccaacccaacacccggggctacggcctggagacgaccggcgtccgggtttcggaccgcggcgcggtcgagatcgacgactattgccgtacgaatgtgcccggcatctacgccatcggcgacgtgaccgccaagctgatgctcgcgcacaccgccgagtcgatggggatcgtggccgccgagacgatcgccggcgccgagacgatggcgctggactaccggatgattccgcgcgccacgtactgccagccgcaggtcgcgagcttcggatggaccgaggcgcaggcccgcgagcagggcttcgacgtcaaggtcgcgaagttcccgttcaccgcgaacggcaaggcgcacgggctcggtgatgccgccggcttcgtcaagatcatcagcgacgcggcgtacggcgagctgctcggcgcgcatctgatcggaccggacgtgaccgagttgctgcccgagctgaccctggcccagcagtgggacctgacggtgaccgaggtggcccgcaacgtgcacgcccacccgaccctcggcgaggcggtcaaggaggcggtccacggcctggccgggcacatgatcaacctctga

SEQ ID NO: 1007 - DNA, 807 bp, Actinoplanes utahensis
atgatctgcaccaactgtggttccaccgcggcgcccacggccggcccctgcccgggctgcggccggcccaccccggatcccgccgccggcatgttccccgacccgctggccgccccgcccaccaccgcgctcggcgggagcctgaccgatccgcggtacccggcgacccgcgccatgcccacctcgccctacggcgtcccggtcgacccgtacaccggccccaccaccggcgaccccttcgccgccaccccgcccgccgcctacagcggccccacctccggcgcgccgggctacgctccgccggcgtattcgccgccggccacgccgccggccacgccgccgtacgccccgccgggccagcccaccggttacgccccgcccggccagcccgctgcttacggtcagcccgccggtttaggccagccggttgcttacggtcagcccgccggtttgggccagccggttgcttacggtcagcccgccggtccgggccagccggttgcttacggtcagcccgccggtccgggccagccggccgcttacggcccgcccggccagccgcagtacggcccgccctatgccgcctacccgggtcccggcccggcgccgtcccaggtctacaccattgtgtcgtacgtcttcggcggtctcgccgtggtcctcggcgccccgttcacggcgatcatcggcctggctctggccggcttcggcaagaagcggcacgagccccacggcgaactggccatcaagatcgtgtccggctgcctggtgctctccggcgtgatctggctcctccacaggaattga

SEQ ID NO: 1008 - DNA, 1098 bp, Actinoplanes utahensis
atggcaactgagcgccgggtcgcgatctggcgcagcgcgatgctgcccgggtcggagaccttcatccgcaaccagggcgacgcgctgacccgctggcggcccacctacgtcggggccacccggatggagtcggtgctctcccgccccgacgacgtgatcgcctttccgggcggcaagggcttcctgcggctgcggctcaccggcacctcaccgcaactgcgcgacacccttgccggcgtacgacccgatctcgtgcacgcccacttcagcggcgacggctggctggtcagccacaccgcccgggagctcggggtgccgctcgtggtgaccgcgcacgggcacgacgtcacccgtcagccgtccagccccggtgcgaaaggcgtgcggtaccgccgcaacctgcacagcgtcttccagcgggccaccacggtgatcgcggtctccgaggtgatccgtcagcaggcgatccgctggggcgccgaccccgccaaggtcagggtgcactacaccggcatcgcggtgccggcgaccgtcgagccgctgccgaagcggtgggacgtcgtgttcatcggccggttcgtcgccaagaagggcgtcgacgacctgctcaccgcactgtccatgctggacgagccgcgcccccgggtgctgctgatcggcgacggcgagctgctcccggcgatgcgggaccgggcgcgggagtcgcgcgtcgacgtcacgttcgccggcagtctgccgcccgacgaggtgcgccgtcacctgctggagtcccggctgctcgcctgcccgtcgaagaccgcaccggacggcgacaccgagggtctgcccaccacgatcctggaggcggcggcgctcggcctgccggtggtcgccacccggcacagcggcatcccggaggcggtcgtcgacggtgagaccggcctgctcagccccgagggggacccggccgcgctggccgcgtcgctgcgccggctgctcgccgacgaggagcttcggcagcgcctgggcgagcagggccgcaagcacgtgaccgcgcatttcgacctgaccgagcagacgcgcggtctggagcggctctacgacgaggcgctaggctga

SEQ ID NO: 1009 - DNA, 966 bp, Actinoplanes utahensis
atgtcttcagagccggatgtcagtgtcgtcattccgacgtgtaaccggcccgagctagccgttcgcgcggtccgcagcgcgctcggccagacccatcagaacctcgaagtgatcgtcgtcgtcgacggcccggacgaggcgaccgtggcggccctcgacgagatcggcgactcccgtctcagggtgatcgttctgcccgagcgtggcaaggccccgaacgcgcgcaacaccggcgcccgcaacgcccgcggccgctggacggcgatgctcgacgacgacgacgagtggctgcccgccaagatcgagcggcagctggcgctcgccacggccgccaccagcgagcgtccggtgatcgcctgccggatgatcagccgcaccccgcgcgccgacaacgtgatgccccgccggctgcccgagccgggcgagccgatcagcgagtatctggtggtccgccgcggcctgttctacggcgacggtttcgtgcagacctcctgcatcatggcccccaccgagctctggctgaaggtgccgttcaccgtcggcctgcgccgccagcaggagctggattggaccctgcgggcgctgcgcgagccgggcaccgagctggtctacgccgccgagccgctggtcctctggcaccaggacgagaaccgcgagcggatcagcctggagaacccgtggcaggagcagctcgactggctgcgcgccaaccgcgagctgttcaccccccgggcgtacgccgctttcacgctcagcgtgctcagctcgatggccgcgccgacccgcaacgccaagctgttccgcgagctgctcgccgaggcccgcggccacggccggcccggcgcggtcgactaccttacccacatgcagatctgggccctcccgccgagcatgcgccaccgcctgcgtgacctcgtcgtcggccgcaaggcgccggagcagccggtcgccaccgatggcaactga

SEQ ID NO: 1010 - DNA, 1158 bp, Actinoplanes utahensis
ttgagcaagaccagcaaacgtcgcagacgtgcaccccgctgggccttctggaccgtggtcttcggcaccgtgctgctcgtcggcggcggtggcggggcgatcggcctcaaggcgaccgtggccgccgcgacgtcctcgatcgaccagaccaccctgatcggctcggccgcccccgccgaggagaaggccaaggtctccctcgacgggccgaagaacctgctcctcgtcggcatcgaccagcggcccgaccagaccaacggcgagccgctgcgctccgactcgatcatcctgctgcacatcaacaaagaccacaccagtggttacatgatctccctcccccgcgacagctacgtcaacatcccggcgtacgacaacggcgcgcagaagtggggcggcggccggacgaagatcaacgccgcgttcgccttcggcacccgcgggctcaagggcgacgacgcgctcaagcacggcttcgagctgctgaccatgacggtgaaggagctcaccgggatcacgccggacgccggcgcgatcatcgacttccagggcttccgcgacgtggtcaacgtgctcggccgggtctgcatgtacgtggacaccaccaccaagtcgatccacctgggcaaggacgccaagggcaacaccgcgcacccgtacgcgatcaaccccaacggcacgctgaaccacaagatcgccggagtcacgccgaacatctacaaaaagggcaaccagtgcttctcgccctcccaggcactcgacttcgtccgccagcgtgacctgctcgaggacaactccggggactacgggcgccagcggcatcagcagcagttcttccgggcgatcatcaaccaggcgatgaaggacgggctcgactcgccgaccaagctgccgaagctgctgggcgccttcggtaaggcgatgaccgtcgacacccgcggcgtcgacctggccgactgggcgctgtcgatgcgcagcctcaagccggacaagctgatcaccatcaagagcaacgagggcaaactgaactcgcagaccatcccgggcgtcggcagtgccgagatcctctccccggacacgatggacctgctcaagtccctcaagcgcgacgacgtggccacgttcctgctcggccacccgaagttcgtcgccaccagctga

SEQ ID NO: 1011 - DNA, 351 bp, Actinoplanes utahensis
gtgggcgccggttgtctcccggcatactcgcgtgttgtgacgaaccggacgccgcgcctcgagatcgaatactgcacccaatgccgctggctgctccgcgccgcatggctggcgcaggagctgctcaccacgtttcctcgcgacctcggcgaggtcgccctggtgcccggcatcggcggagtcttcgaggtacgcctcgacgacgaaacgctctggagccgcaaacccgacggcttccccgacctgccgcaactcaagcgcctggtccgtgaccgggtggctccgggccgcgacctcggccactccgaccgcgccgccacggtgacccccgaaccgccggccaccgcatga

SEQ ID NO: 1012 - DNA, 528 bp, Actinoplanes utahensis
atggctgactccgtcgtctacgaccagatccccgtcgttcgcgccatcgggcggggcaccacctcgctggccgcgttccacgacgcgctggtgaccatggagtgcggtttctacaacctggtccgcctgtccagcgtcatcccgccgtccaccacggtcgacgcatccggcaaggccccggtcccggtcggcgcctggggcgacaagctctattgcgtgtacgccgagcagcacgccacccagatcggcgaggaagcctgggccggcatcggctgggtccagcgccgcgacggccgcggcggcctgttcgtcgaacacgagggcaccagcgaggccttcgtccgcgaacagatcaaggccagcctcggcgacctggtgaagggtcacgaggacgagttcgacggccccgacttcgtcgtccacggcgccgtctgcaccggcgacccggtctgcgccctcgtcctcgcgccgtacgagaccgcctcctggcggggcatgaccgccacccagccccccggcatgaactga

SEQ ID NO: 1013 - DNA, 420 bp, Actinoplanes utahensis
gtgcgcctgcctcgcctgatcttcctgctcttcaacgccgaccgcgcggtccggcgctggatcgacgcccgctctgccgacaccggcatcggcgcgtccggcgccggcgtgctcttctacctggccggccacgagaacgccctgatcggcgacgtgaccgcggccctcggcgcctccccgtccgggatgagcggcctggtcaaccgcctggaacgcagtgggtgcgtgagccgctccccggacccggcggacgcccgcgccgtacggctcaccctgacgcctcgcggccgggagtccgtcacccgggcccgcgacctggtcgacgacctgaaccagcagctcaccgcgggcttcgacgaggccgaggtggcggtcatcgaacgctggctggaacacgtgagccgccgcgactttaggtaa

SEQ ID NO: 1014 - DNA, 873 bp, Actinoplanes utahensis
atgcgaactaaggagacggtccggattccggtgaccaccggcggcgcgatcaccgccacggtgttcacgcccgaggagccggccgccgtgctcgtcgtgcactccgcgacggccaccccgcagggcttctacgccgccttcgccgaatacctcgccgccgacgggatcgccgcgatcacctacgactaccggggcaccggtcggtccgggtccccgcgcgaccaccgcgacgtcggcatgcgcgactggatcggcgtcgacgcccccgccgtcgccgcctgggccggcgaccgtttccccggcctgccccggctcgccgtcggccacagcctgggcgggcacgccatcgccctcggcgccgccggcaccgacccggccgcctcggtgatcgtcgcctcccacctcgcggccatcaccaccatcccgtcccgcctcgagcgcgcccgggtccgcctgctgctccacctgctcgggccggcctccgcccgtctgctcggatacgtaccggccagccgcctcggcctcggcgaagacctgccggccgccgcgatggccgactggggccgatgggtccggatgggcaactacttcttcgacgatccgtcgatgcgggcccgggagcgcaccgccaccctcaccggccccgtcctggcggtcggcgccgccgacgacccgtggtccaccccgccacagatggacgtcctcaccacccacctcaccggcgccgacgtcgaacgccgcacctacacgccggccgccgccggcgtcccgatgatcggccaccacgggctgctgcgccgcaccctcagcgaagcggtctggcccgacctgctggcctggctccgcgcccacgcggcgcgggcgaggaagtga

SEQ ID NO: 1015 - DNA, 981 bp, Actinoplanes utahensis
atgtccgtccccctgccggccggccgcgaacccggtcgcctcgccgcggtggtccggcgtcagggtgcgctcgccgtgctggtcgccgtcgtggtgatcagcctggccgcgttccccggattccgcagcgccgacaacgccggcaccatcctggtcgccgcggcaccgccgatgctgatcgcgctcggcatgaccttcgtgatcatcacgggtgggatcgacctgtcggtcggctcgctctacgcgctcggcggggtggtcgccgcctgggcgtcgcagtacggtttcgccgcggcgctggcggctccactgctggtgtgcggggccatcggcgtactcaacggtgtcctgatctcccgcaccggcatggcgccgttcatcgtgaccctggccgccctgctcggcgcccgcgggttgatgcgcagcatcagcgacgagggctcgaccacctacctggtcaggagctccgccttccacgatctcggcaccggtgcggtgctcggcatcgggctgccggtctgggtgggggccgtgctggtcggcgccggcatcgtggtccttaaccggacccgcttcggccacgcggtgcacgcgatcggcggcagcgaggacgccgcggcgctgatgggcctcccggtccgccggatcaaggtcgcggtgtacgtgctgtccgccctgctcgccggcctggctggcgcgatcaacgcggccaagctcggctccggtgtcaccgtgctcggcagcggcatggaactggacgcgatcgccgccgtggtgatcggcgggacgctgctgaccgggggctccggatcggtcgccgggacggtggccggggtgctgctgctcggggtcatccagaacctgatcaaccaggtgggcaacgtcaacagcaactggcagcaggtgatcagcggggcgttcctggccgtcgtggtggtggcacagacgtacctggtccgcgcccggagatcgcggaactga

SEQ ID NO: 1016 - DNA, 963 bp, Actinoplanes utahensis
atgagcactgagaccctgacccgccgcccccgggccgccgtcagcgcggcctggctgccccgatacggcgtgtacgcggcgatcctgctgctggccgcctacaacgtcgcgttcacgccgtacttcctgaccctgagcaacctgcgcatccagctgatccaggcggcgccggtggtgatcgtggcgctcggcatggccctggtgatcggcaccgagggcatcgacctgtcggtcggctcggtgatggccctggccgccgcgctgatcccgctctacctgggctacggcgtggtcgccgcgatcctcgtgtcgctgctcgccggcgtcgcggtcggactgatcaacggggtgctggtcgcccgggtcggcctgcagccgatcgtcgccaccctggcactgttcgtcggcggccgcggcctggccgtggtcgtctccggcggccggctcaaggacatccgcaacgacgacttcctctacctcggctccggtgacctgctcggcatcccggtcctggtctggatcgccgcgctgctcgtgctggccgtcgccttcgtcatccggcgcaccgtcttcggccgccggttgctcgcgatcggcggcaaccggccggccgccgagctcgccggactgccggtcagaaaagtcctgatcggtgtgtacgttttctgcgccgtgctcgcctcgatcgccggactgttgtcggtctcccggatccagtccagtgacgcgtccgcggtcggcctgctgatcgagctctccgcgatcaccgccgtggtggtcggcggcacgccgctcaccggcggccgggtgcgggtgctgggcaccgtggccggcgccctgctcatgcaactggtggtcgccaccatgatcaaacacgatctcccgccgtccacgaccgagatggtgcaggccgtgatcatcctggtcgcggtgtacgcggcccgggagaggaggacccggtga

SEQ ID NO: 1017 - DNA, 1512 bp, Actinoplanes utahensis
atggcgctgctggaagtggccggcgtgtcgaaggccttccccggagtgcgcgcgctggacggggtgtcgttcacgctgcagcccggtgaggtgcacgccctggtgggggagaacggcgccggcaagtccacattgatcaaggtgctcaccggcgtctaccagccggacggcggcgaggtgcggtaccagggcgaaccggcgcggttcggcaccccgctggacgcccagcgggccggcatctcgaccatctaccaggaggtcaacctcgtcccgctgatgagcgtggcgcacaacctgttcctcgggcgcgaaccacgcaaccggttcggtctgctcgacgaggcgcggatggtccgcgaggccggtgagctgctggccggctacggggtgcgcaccgacgtacgccggcgtctcggcaccctggcgctcggcgcgcagcagatggtggcgctggcccgggccgtgatgatcgacgccaaggtggtcatcatggacgagcccacctcgtcgctcgaaccccgcgaggtggagacgttgttcggggtgatccgtgacctgcacgcccgggggatcggcatcgtctacgtctcgcaccggctggacgagctctaccaggtgtgcgacgcggtgacgatcctgcgcgacggcagactcgtgcacaccggccggatggccgatctggaccggcgccggctggtttccctgatgctgggccgcgagttcggcgacgacttcaccagcttcaccggcgcggccgagagcgccgagccgaccggcgagccggtgctgcgggtccgcggcctgaccagtcggccgcggctcgacgacatcagcttcgacgtgcgacccggcgaggtggtcggcctcggcggcctgctcggcgccggtcgcagcgagacgatcaaggcgatcggcggggcgtacccgatcgacgccggcgacatcgaggtcggcgggacgaaactcggccggcccagcacggtccgcgcggtccgggccggtgtggccacccagcccgaggaccgcaaggccgaggggatcgtgcccggcctgtccatccgggacaacatcgcgctggccgtcctgccccggatgaccaggatgggcctggtcagcgacaagaagatcgacgaggtcgtgcggacctacatgagccggctgcggatcaaggcgtccagccccgaccagccggtcggcgacctttccggcggcaaccagcagaaggtgctgctcgcccggctgctcgccaccgggccgaaggtgctgctgctcgacgagccgacccggggcatcgacgtgggcgccaaggccgaggtgcaggcgctgatcgacgagctggcggccgaggggctcggcgtggtgctggtctcctcggacgccgaggaactggtcgagggcgccgaccgggtggtggtgctgcgcgacggcgcggtcgtcggcatcctgtccggcgaccgggtgaccaccgaggacctgatggccacgatcgcggaggccgcggatgagcactga

SEQ ID NO: 1018 - DNA, 1092 bp, Actinoplanes utahensis
atgttcagaaacgtcgctttcgtgcgccctaggtccgtcgccgccaccttcgccgcagccgccctgctgctcggcgcgggcgcctgttcgaaggccgaggactccggcaccgccggcacggccagcgcgggtccggccgccagccaggtcgtccagtccgccgccgcgagcggccccacctgcaccctggagcagtacggcgccgccaaactcgacctgaagacggcgcaggtcggcttctcccagtcggagaaggaggcgaacccgttccggatcgccgagacgcagtccatcaaggacgaggcggccaagctgggcatcgccaacctgaagacgacgaacgcgaactcgcagttcaccaagcaggtcgcggacgtcgagcagatgatcgacggcggggtgcaactgctggtcatcgccccgttgaactccgacggctgggactcggtgttcgccaaggcctcggccaagcacatcccgatcatcacgatcgaccggaagatcaacgcgacggcctgcaaggactacctgacgttcatcgggtccgacttcgccgagcagggcaagcgggccgcggacgcgatggccaaggcgctgggcaacaagggcgaggtggcgatcctgctgggcgcgcccggcaacaacgtgacgacgctgcggaccagcgggttcaaggacgagatcgcgaaggtcgcgccggacatcaagatctcgttcgagcagaccggcaacttctcccgcgaggacgggcagaaggtcgccgagcagctgctgcagtccaagccgaacatcaacggcatctacggcgagaacgacgagatggccctgggcgcggtgaccgcgctcaagggcgcgggcaagaaggccggcgacgtcaagatcgtctcgatcgacggcaccaagggcgccgtgcagggcatcgtggacggctggttctccgcggtcatcgagtccaacccgcgcttcggcccgctggccttccagaccgccaccgacttcttcggcggcaagccggtcggccaggacatcgtgatccaggaccgggcgtacgacgagagcaacgccaagacggatgtcggcagcgcgtactga

SEQ ID NO: 1019 - DNA, 480 bp, Actinoplanes utahensis
gtgtggcgaaacaggtcaccagaccggtcaggaatcgagaagcccggaccgccggtcgttcctagcatgggccgcatggacattcggattcaggccagtttcctgccgcacgacgacgccgaggcggccatcggcttctaccgtgacgtgctcggcttcgaggtgcgcaaggacgtcggtttcaaggacatgcggtggatcacggtcggtgccaaagggcagccggtgtcgatcgtgctgcacccgccggccgccgacccgagcatcaccgacgatgagcgccgggtgatcgccgagatgatggccaagggcagctacgccgcggtcacgctggccaccgaggacctcgacggggtgttcgagcggctggtggccggcggcgccgacgtggtgcaggagccggccgaccagccgtacgggatccgcgactgcgccttccgggacccggccggcaacctgatccggatcaaccagctctag

SEQ ID NO: 1020 - DNA, 435 bp, Actinoplanes utahensis
atgggcggtcttgagcagcggcttcgtgatctcaaacggctgcgtcaggtgcgggatcggatcgatcgggactatgctcagccgctcgatgtggaggcgctggcacgcggggcgcacatgtcggcggggcatctgagccgggagttccggagcgccttcggggagtcgccgtacggctatctgatgacccggcggatcgagcgggccatggcgctgctgcggcgcggcgatctgagtgtgaccgaggtctgtttcgcggtggggtgttcgtcgctgggaacgttcagcacccggttcaccgagctggtcgggatctcgccgagcgcgtaccggcggaccgccgcggacgcgaccgacgggatgccgaactgtgtggcgaaacaggtcaccagaccggtcaggaatcgagaagcccggaccgccggtcgttcctag

SEQ ID NO: 1021 - DNA, 897 bp, Actinoplanes utahensis
gtgaccgagaccggtcttcgtggagtcttcaacattctcgccacaccgttcaccgcggacctgggggtcgacaccgcgagcatcggcaccctggtcgacggggtgctggcgaccggggtcgacggggtgaccgtgctcggcgtggccggtgaggcgcacaggttgaacgccgaggaacggagcctggtcgtcgccacggcggtcgaggcggtggccggtcgggtgccggtctatgtcggagccagccacgacgacacggccacggtggtgcaggccgggaccgaggcgcgcaagctgggcgcggccgggctgatgatcgccccgccgaagggctggaccgcgggggaggcgctgaccgcgcactaccgtgaggtggccgacagcgtgggcctgccgatcgtgctgcaggacttcccggcggccagcggtgtcgatctcaccccggagcagatggccgagctcgtcgcggcggtcccgctgatcaccacgatcaaactggagagtctgccgacaccggtccgcaccgcgcgcacccgggcgctgctgccgccgggtcggaccatcctcggcggcatgggcgggatgtatctgctcgacgagctgcggcacgggtcggccggcacgatgaccggtttcgcctacaccgaggcgttgatcgacatctgtcgcgcctgggcggatggggacgtcgcgcgggcgaaatcgacgtacacccgattcctccgtctgctggtcttcgagcagcaggccggggtggggctggcggtccgtaaggagatcctgcggcggcgggggttcatcgccgacggctcgctccggcagcccggccagccgatcgacgagctgaccgccgccgacctgaccgagctgctggcggacctcggcctggccgggtga

SEQ ID NO: 1022 - DNA, 720 bp, Actinoplanes utahensis
gtggctgacctgcgcggcgcagcggccgaggcgctggccggcaccggtgtggcggcggtcgccgggacgggtctgctgcccctgatgccgccggcggcagtgccggatttcctggccgcgtggtccagactggagcccgacgcctatctgcccggcgggtcgaccttccgccgccggcggtacggccggatcgcggcggtgcccggcgcggacggcgaataccggctcgacgacctgcccggcgcgccgttcacccagtcggccgcgacgatcccgctgtaccggggtgcggctcgccggttcgcgccggtcggtacgtcgttcctgcgctcatccgccctgcgcacgctgctccgattcgacctggacgtgatcggccggctcgagccgcgcgccttcggcatcggtatccacctcatccgggtgaccgtcggcccggatcatcccgagaatccggcccccgaaggtcggcacttcgatggacatctctatgtggcgatgcacctgatcggccgggagtcgtgctccggcgggtcctccctcgttttcatgccaggtgatgacaagcccgtgttcagcacgacgctgaccgggcgcctggataccctgatcgtcgacgaccgccgggtggaacacgaggtgagcccggtgcgggcgctcggccccggcgcggtccgggacatgctgctggtcgatttcgatccgttggacgacatctag

SEQ ID NO: 1023 - DNA, 870 bp, Actinoplanes utahensis
atgtcagcgttccggaattacgccatgtcgctgatcagcgcctctgtgacggtggtgatcggcctgctctccgacatcgtgttcaagctgtccaacaacgagacgttcatcgtggtgtccaccggtgccgtggtctcgctggcggtggcgctgatcgaacagcggatgaacagcgatcagaaggagttccgcgcgcacatcaccgccgagatggcggagaagctggacctcttccggatgatcgacgagatcgacgatccccagctgcgcgccgaggtgttcctgctggcccgcaggctgagcatcggggaggtgccgtcgcacatcgccgcgatccgcaccccgatgctctacgaccgggcgcgttccacggtgtacgcgtccaacgtcagcctgacccggccgatgctctaccgatgggactcactggcccggttccgccggatcgtcgaggtcagcgggcgtcgctcggccgagggcgtcaccttcacgcgcacgttcttcctcagccgccgacagatcatcgcgccggacgggcggtgggacgagcgcagctggcgcacgctgcgggcgcagaccgaggccggcatcgcggtgcgcatcgtctgggccgaggacctggagctggacaacctgccgccgcatcgcaagctggtgcgcgacctgaccatcttcgacagcctggaggcggtggacacgaccggcgtccaggtcatctaccggcacccgtcggaccggctccgcgagttcctcgacatcgagaaggagcagctcaagtattccgagtccttcgaccggtacaccggggtcgagctggtcgatctggaggagctggccgcggccgaggtggccgggagcgcgagtggctga

SEQ ID NO: 1024 - DNA, 2043 bp, Actinoplanes utahensis
gtgctcatactcgggtggcatggcgggatcagaccggagtgggacgatctcgggcccggctggtcgacccacgacggcgcagccgtgctgctacgggacgggcagatcgtcgcggccgtcgaggaggaacgcctcaaccgggtcaaacactcgaacttcttccccgcccgggccatcgcccgatgcctggagatcgggggcgtccgccttccggacgtcgacgtggtggcgatgaatttccaggagcggacccgggagatctttccggcggacgccggtctgccgtcgcccaacgccttcctggacgacccgtcgagcgggaccccgacggtgcgggacgccctgcgggagatcttcgaccggcacttcgccacggacgtcgccgaccgtctgcacttctgccaccatcaccaggcgcatctgtggagcgcctgggggccgagcggattcccggaggcgctcggcgtctcgatcgacgggtccggcgacgcgctgtccgggatggtcgcccgggccggcgaggcgggcctggaggtgctgcgggagtggccggtcccgcattcgctcggcgacctctactcggacagcatccgtctcctgggctaccggcggttcgacgagtacaaggtcatgggactcgcgccgtacggtgatccgcggcggttccggtcgctgttcgagcagttctacgagctgcggccggagggcgggttccggctcgccacccgggccgagcgctggggactgatccacgacgccgggctgctgccgctggcccgccggtccggccagccgttcaccaccctgcactccgacttcgcggccgggctgcaggaggccctggaaaccgtggtgctgcacgtcatccggcatttcgcgacgagcaccggactgcgccggatggtctacgccggcggtgtcgcgcacaactgcaccctgaacgggcggttactgcacgaggggctgttcgacgaggtctacgtccaaccggccgcgcacgacgcgggcggggcgctgggcgccgcactgcacgccgaccacgtgctgggcggcggcggccgggcggcgatgccgcacctgtcgctgggcaccgacctgccatcggcatcgcggatcgccgatcggctcgcggcgtggtcggggctcgtcgaggtgacccggctgaccgacccgatcggcacgacggcccgcgagctggccggcggcgcggtcgtgggctgggtgcacggccggtccgagttcggcccgcgcgctctcggcaaccgcagcatcctggccgatccgcggccggccgggaacaaatcgcgcatcaacgagatggtcaagaaacgggagggctaccggccgttcgctccctcggtgctgcaggaacacctggccggtctcgtcgagatgcccgccgcccgggccgacctgtcgttcatgacctacacgctgaccatccgggccgagcaccgggagctgctcggcgcggtcacccacgtcgacggcagcgcccgggtgcagagtgtctcccggagccggcagccgcggtactgggcgctgatcgacgcgttccgcgagttgaccggtgtgccggcgctgctgaacacgtcgttcaacaacaatgcggagccgatcgccgactcggtcgacgacagcgtcgtctgcttcctgaccacgggaatcgacctgctggtggtcgacgacttcctggttcgccgccggcccggcctggatctggcggagcaggcccggacactgtgccccggcgtgccgctgagccgcaagctggtctcccgcccggccccggacgggtccggcttccaccactcgatcgaggcgaccgccagcgcgcacttcgtccagcagcgggtggacgtctccgccggcctgcaccgcgtgctgtcgctggcggacggccgctcgacggtcgccgagctgtgctccgccgccgccgtgaccgaggccgcgcagcccgggatactgcgggaattgatcacggtttgggagcgccgcgccgttaccatgcggccatcagggtccgtccgcgagcgagcttga

SEQ ID NO: 1025 - DNA, 588 bp, Actinoplanes utahensis
atgatcgcgcgccggctcggctgggaacggaacctcctgcgccgcacctcggaccgggtcgagagcctggtgatgttcgttctggtcctcacgttcctcgcgggcgccccgctgctggcctggtgggccggcgcggccagctaccgcgcggacgtgcgggcccgcgactgggaacgcgcgcacgtcttccaggtcgacgcggtcctggtcgaggactccggcacgtacggcgccatcggcacccgcaccgccgccccgcaggccgcccgcgccacctggatcgccccggacggcaccgcccacagcggcctggtccagactcccaccgaggtccacgccggcgcccggatcgcgatctgggtcgacgacaccggccgcctgcaggcgccacccctgcggcacagccccacctcgcagggcatcctggtcgccctctgcgccatcctctgcctggccgccttcctggccggcctgcaccgcaccacccgcgccctgctggaccgccaccgctgcgcatcctgggcccgtgaatggcgcgtcgtcggcccccgctggagccgggacccccgctggcgccgccgccgctga

SEQ ID NO: 1026 - DNA, 1455 bp, Actinoplanes utahensis
atgaccggctggccggccgctccggcgatctacgagatcgacacctggccgtggctgaccggcctgacccgccgtttcggccgtccggtcaccctcggtgacgtgccggccgaggtctgggacgaggtggccgcgcccggcatggacgcggtctggctgatgggtgtctgggagcgcagcccggcgggcctggcggtggcccgggtcaacgacgggctgcagcgggcgttccggcaggcgctgcccgatctggcgccggaggacgtggtcggctcgccgtactgtgtgcgccgctaccgtgccgacgatcgcctcggtggcccggccgggctcgccgccgcccgcgccgagctgaacagacgcgggttgaagctggtcctggactacgtgccgaaccatgtcgcgccggaccatcccgcggtggtccggcatccggactggttcatccggggcagcgaggacgatctggccgccgacccgaccggctggttccacgccggcgggcgggtgatcgcgcacggccgcgacccgtactttccgccgtggccggatgtcgcccagctgaacgcgttcgcccccgggatgcgggccgcgaccctggccgtcatgtcgcagatcgccgagcagtgcgacgggatgcgctgcgacatggcgatgctgctcaccaacgacatcttcgccggcacctggggtcgctgggccggtccgcgcccggacgacgagttctggccggcgctcatcggtgagctgcggcgccggcatccggaggtggtgctgatcgccgaggtgtactgggagaccgagtggctgctgcagcagcagggcttcgacttctgctacgacaagcggctctacgaccgcctcgcccacgaggacgccgggtcggtgcgccggcacctggcggccgggctgggctatcaggagcggctgatccggttcctggagaaccatgacgagccgcgggccgcggcgaccctgccgggcgggcggaaccgggcggcggcggtggcgatggccaccctgcccggggcgacgctgtggcacgacgggcagttcgacggccggcgcgcgcacctgccggtgttcctggcccgctatcgcgacgagcatctcgacccgggcctgcgcgactttcaccgccggctggtccggctggcgccggccgtccggcgggggcggtggcggctgctcggcacgtccgggtgggccgacaacgagtcccatcaggacctgctcgcctgggcgtgggaggcggcgctggtggtggtcaactattccgggcggccggcgcagggccgggtggagttgccctggccgtcgctggccgggcgggcgtggcggctggtcgaccggttggacgggcgggtcttcgaacggtccggcagcgagctggcggccgaggggctctacgtcgatctgccggcgtggggtttccacgtgctcacgctgtcctga

SEQ ID NO: 1027 - DNA, 1149 bp, Actinoplanes utahensis
gtgctgcgcgaggcggagctggtgcacgcggtgcgggggctgcgcgacgaatgggcgtactgggcggagctggccggtaccgagccgatggcgaaacacaccagccagatcgaggcgatcacccggctgctcggcgccggcctcgaccgggcggacaccttcgagctggtcctcgacctgttccacgtctgggacttcttccgcgccaaactgctgctgcgccgggtcggcccgctgagccggatcctggccgtcgccgacgagctggcctgggcggtgtaccggccctcggtgctggccgcgggcgtcgccgccggccgcaaggagccgccgctggtcttcctcgaccgcggcgcggtcccgttcgcggcggcccgcggcgccggctaccgcgacctgctgccccgcggggtgcgcacgaccgccgggctgacggcggtccgcgaactgccggtcccggtgatcggcatcccgtggtatctcaccggccacctgcccggggtgctgctggtcgcgcacgaggccgggcaccacgtcgaggacgactgcggcctgaccgcggaccttcccgccgcgctcgccggtctggacgccggcaccgccgcgcggtggaccccctggctgggcgaggcgttcgccgacgtcgtcgccaccgtcgcctgcggccccgcctacccgatgatcctcgccgaggccctgcgcgacgccggcgacggcgcgggcgccgagtcctatccgccgcccgccgaccggctcgatctctgccgcggcgcggccggagacgaccggaccgactctccggccgggtccgtgggccatcggatggcgacggcgcggtacgccggcctgggcgaccgtagcctgcgcgacgtgctgacccatccggatgtggcgagggccgaggtcggcgcggccgggctgctccggggcctcggcagcgcgctgaccgacgtccgcgccgtcctccccgccgccgctctggccttcctcgccgacccacccgcgtacgacacgatgcgggtcgactcgcgggccgtcgacgagatcctggccctgcgcccgcgcggcccccgagccggcaacgaccccgccgccgccgaggcgcgggatctcgccgcggcgcagagcctggtgaaagctctttcgtga

SEQ ID NO: 1028 - DNA, 4668 bp, Actinoplanes utahensis
gtgaccgaccagcggctcgccgagatcgtccggctgctggccgccgggcgttccctggaggacatccagcgggactgcctgccggagagctggcgtcgggcgttgcgggtctgcgccgcggccggcgacttcgaccgcgcgctgtacgacacggtcctggccgcgcacggcgccccggacgccccggccctcgacgagttgaccggccgtggcctgctggagcgggccggcgacgaccgctggcggatccgccggtcggaggcggtcgcctggatgggcgagtggcagccggcccgggaccggctggccgccctggaggccgacatcgcggcctggctggccgggcgcggcccacagatcgagcggctgcggcacctgctggtggccgacccggcggccgcgatcgcactgttcgaggcggagttccgggccgccgaccggaaccgggacttcgcccgctgccaggacctgatcgacgtgctcggcgacccgaagcggctcacctacgccgggccggaggtggcggcgctgcggctggaacgcgccggctatctgcgggcccggctgttctggtcggcgacgtggagccgctcggcgcagtatctggagccggacgggctggccgggcaggccgacgcgctgctcgacggccgcgggccgcgggtctggcaggtgttcgcgccgaccggcaccggcaagaccgtgcagctgcagtggctgatcgcccgccgctgcgtcccggccgagttcgacatcccgtgcgcccggatcgacttcgacgtggtcgacccggtggtcagcgcccgctacccgtggctgctcctgctggacatcgccgagcagctggaacgccgctgggcccggcgggtcttcgaacggctggaccgcttcgcctcgtaccgcggcctgctcgaccggcaggattcgcaacaggcccgggcggccgccgagggactcaccgcgcaggacccggagcggctggaacgggccgtctcggagatcttcgtccgccggttcaacgacgcggccggcgccggaccggtgctgctggtcgtcgacacgatggaggaggtgctgctcggcccgggcgccgacgacctgctgcgcgcgctggcccggatcgtcgcccagtgcccgtcgctgcggctgatcctggccgggcgctacgacctgcgcgagcgggccggggcggcgctggccgcgttcggcgacgtgcggccggtcgcgctcggcgacttcacccccgagcagaccggccgatatctgcgggagatccggcacatcaccgatccggacctggtcgccgcggtggtcgagcggaccggcgggcacccgttcctggtcgccatgttcgccgacctgatcgcggaggagccggcgaccagcccggccgacctgcgcgcctaccgggatccggcgctgcggctgctgatcgaccgggtgatccgccggatccccgatccggatgtgcgctggctggtccgctacggggtggtcccgcgccggctgtattacgccgacctccacatgatgtggccgttcctggtcagcggccgctccggcgtcaccgaccgcgacgacccgcgcgccgaccggcaccacctcgccggcgacgacggcgtcttcccggtcggcggtgaggtgtcggccaaggaggcggtctggcggcggctgctcgactacgcggcgcaacgctcctgggtgtccgaaccggatcgggatggacggctggtcgtcttccaccagaaggtgcgcgccccgatgcgcgagctgatcgccgcccagccggtcgcgctggacctgcacgccgcgttccggcagcgcttcgacgacctggccgcggcgcacccgcaggctcccgcgccgttcgagcgcgaggcctactaccaccgggtgcagctcggtgaccccggcgcgcaacggtactgggacgcgcggatccgggcccggcgcgccgccggcgacctggacggactcgccggactggcccgcgacgtactcaccggcgactacccggacggcgtgatcgaaccggggcagcgggccgacgcgctggtctggctcgcctacgcggcgatcgagcgcgcccggcgggccggcgcgcccgccgccgacccgctgtggaacgaggccgagggtttcctggcccgcgccgaccggctccggaccgcggcccagctgccggctggtgggctggcggttgccatgtacgccgcgaccctctgcgtcggtgaccgatccaccgaggcagcctccctggtcgtcgccgccctgccgaaggcgagcgccgacgaccggatcgacctgctccgggtcctcgccgacgcggccggccacgcctccggggtgatcttcgcggaggcgctggacctggccgggcagcgccggccggaccaggtggagccgctggccctggccctggcccgggacgccgagaaagccggtcggttcgaccgggcgctcgactggtgccgccgagccgggggtgtccgggcccggctgcgcgaggccgagctgctcatctcggcgtaccagccggggaccgcgctggaggtgctcgcccgggtccggccggacgccccggccgagcgggtggaacggcaccggctgtgcggccgggcctgcgggcggctcgggatcagcgaggcggcggtcggctacctcggttccgcggtcgaggccgccggcgaggtgaccgacggccgccgggccgccctgctcgcccgggtccaccaggaacgcgcgctggtcctcggcgacctgctgctgctcgacgaggccgagcacgacctcaagctggccgccgccctgtggagccaggccgggttcaccgaggggcaccccgaatcggcgtacctccatcatcgtttcctggtgcggcaggtcggtgacctgcgggcggcggccgcgctgcagcggccgccggtgccggccgacgaccggatcggcgtgctgtgggacgagctggtcgccgaacggctcgaccaggaccggccggagccggtcaccggcccaccgcagcaggtggccgtcgtgatcgcggcccggctggcgcgtgactgggcggcgcaccggcacctgctcggcccgctggccgaggcgatgggccggatcagtccgccgtcggcccggctcggggtgctggccgagctggcccggcaccccggcccggccccggccgaggaggtggcccggctgcgcgaggtgctcacctggccgcccgaccacccggacgacgggcccgcccaactgcctctgctggccgtgctggaacgcctcgccggcgatccggaccgcgccgccgtggtgctgcagccggtgagccgggccgacccgctgctcggctcgcggatgctggacgccgcggccgggcggctggctcagcccgagacgctgctcccggtgccgtcgtacccgctgctgcgggcggtcgggctgcgccggctggcactcggcaccggcgcggccgcgtggtacgccgaggcggtccggctgtgccgctcggtcgaccggccgtcccgctgggcgatcgacatctaccgcgaggccgcggagcacctgggtgacccgcggctgcgggccgccgccaccgacctggactggcggctcggccggatgttcggcggccccgaaccggagtcgctggtcgccgtcgcggccctggcggcgcacccgctgacctggccggccggggtcccgcagaccttctacgagctgcaggtgcggctcgtgcaggactggcgtgccctcaccctcgagctgggccgggccctcgccgcgcccgtcccgccggaccgactggactccgacgacgtgctccttcacggcctgccctgggaactggccacgcccgccgccccggcgctgtggcgggccatgccgtcccgggcccggccggccgacgtgcgctggctgcagtacgcgctgaccacactcggcgcggtcgtcgaggtggacggggtgctcggcccggagaccggggcggcgctcgattgccgggacctgaccccgccgctgcgcggggagccgctcgcccggctgcgcgggtcggtggcccgcgaccggggcgcccggcggctgagcgcggtggtggtgcaggccgtcgccggaacctcgcacgaggactacggctaccacgtggccgatctgtaccagcggtgcggctatcaggtgcgctcggtgcccggcctggagcaggtgctcgccgacgagccggcggtgctgcacgtgtgcggccggctcgactaccgggactccgggccgcacttccggctcgggccgggcagcgtgctggagccctccgacgtggtccggctgctgcggtccgggcggcccgggcgggagccggtgctggtgctcgacccgccgtacccggggtcgccctacgacgtgccgtggcagatcgtgctgcgcaacctgttcgccgcgcacgtgttcgccgagggctgcgtaccggccgtgctggcgaccgggctgatccgcagcggcggtgactatgtgctgaccatcgcggacgggctggcgcacggccggtcaccgctcgacctggtgcgggcgatccggccggccggggtgccggatggccggccgctggacttcaaacgcgacgacgagctgctggcggcccggtcgacgacgctgttcgccgccccgacggcgctgctgtga

SEQ ID NO: 1029 - DNA, 1938 bp, Actinoplanes utahensis
gtgagcacggtggacgccgagctggccgtcgccgccgaccagcggaccgtcacgctgaccgtggcgggtcgcccgccggccaccgcgacgatcaccggtgtgctcgatccggcgcatttcgacggggcgctggaccgccggatcccggccgagacccgcggcaagctgggtcgcgagctgttcgacgcggtgatccgggaggacaccgcccggctgtggaacgaggtcgacgaggacggcaccccgctgcggctgcgcctgcggatcccgccgccgttgcgtggcctgccctgggagctgctcgcctccggggcggaccggctggcgctgcgccgcggcggcaccctctggcggggcggtccgccgcgggccggcgccgaggtggacggcccgctgcgggtgctggtggtggtctgcaacccgaccgatcggcaggtgctcggcgacgaggagctggccgggctgaccggggcggccgccgagtgcccggcccgcgcgcacatcgagatcgtcgacgggccggaccgggaccggctggccaaggagatcgaccggctgcggccgcacgtgctgcacttcatcggccacggcatgccgcgggtcccgggccgggccgccgcgctggccttcaactgggtgaccgccgggcggccacagggcgccgggtgggagctggccagcaccgaggtcggcctgatgatgtcggacgactggacgccgcggctggtcgtggtcaacgcctgccggaccgcggccgacgccctggaccaggtcggcggcgtggccgaggcgttcctgcgggccggcgccggcgctgtggtggccatgcaggccgacgtcgagtcgccggccgccgccaccttcgccggattgctctatcagggcatcttcgccgggctggggctggaccgggcggtcgccgcggcccggaccgaactggcccgcacgaccggcgacaccggcgagtgggcgatcccggtgctgacctgccgcaccgacccggccgatgtggtgcgcaccgggttccgccggccggccgagcagatcgccggcctgaccgcccgcccggagtaccagatgctccgcaacttcctggaccacgcgcccggccggcgggacgcctggtgggccctggacccgctgaccgcgaccccgccgcggtcgctgctggtggtcggtggccgctccggcaacccgcacaagccgaccgggaagacctggttcacccggttcagcctgctcacctacttcctgcgcggctaccgggtcacctatgtggacctgggagtgccgctggcccggccggacggcgagcacgcgctcaccaagacgtggctgcacgtgctgcagatgatgcgcgaggcgtgcaccgatccggggcaggcggagccgctgccggccgcggcgttcgccggcttcgacgcgctgttcggcaccctcgccggggagccggccggctggtcgggggagcggtggcggttcgacgagaaccggccgcgcgccgccgagcagcgcgaccggatcctggacggcttccgcaccgcgctggccgccgcggccggtgaccggccgcacgtgatcgcgctggacaacgccgagcaggtgctgcccgagtcgttcgacagcgcgatctatccgagcctgctgcgcccggtcgccgcggccggcggcgggctgcggctgatgctggtcggcaaggccgactggctggccgcccggctgcccggccgggaccaggcctactggggtccggtggtcaccatcggcgatttcgaggcaccccagatgatgcgcctggcccgggactactgccgccgccgcgggctaccgttcgagctgctcaagccggtgttcggggcgatctgcggggtgagcccgcaggcctgggtgacccggttcgacgaggtgctcgacgtgatcgggccggtggcgccgtga

SEQ ID NO: 1030 - DNA, 783 bp, Actinoplanes utahensis
atgggcgattctctcggcagctaccggtcggcgatgcgggatgcctggcacggctggtggatcaactggccgctgtcgcagcgggtccgggtgggcgacgtgctggacacgtccggcggcaccatccggcccgccggcgacctgacgaaatacggggtggccggcgctgcggcggcggccgcgccaccggccgacttcctgtacgacgcgaacggctcggcccaggtcacgttcaaactgtccggcaccaccccgccgggcttctcggcgctggcccaggccgacgccggtgcgctggtcagcttcaagggcgacaccagtgtgctggcgctgttcaccgggctgacccaggaccgtttcgccgacacccgggcggtcgccggcaatctggtcaagcagttctggaacggcgtgtgggcgccggaactggccggggtcaccgacgtggtcacggccgcggccggtaccgtgctggccgcctccgacacggacgcctcggccgagctgcgggtggacgcgacagtcggcgccggcccgctgaaactggccgacctggccgggaacgtcgcggtggcccggtccagccgggtcggcctggagtggtccggcaccgaggtcaccccgttctaccgggtgttccggctgcgccggacgtggctgcaccgggtggcgacggattacgggccgcgccagccggggcggggcgccgcacccgaggcggtgccgccgctgctggtcgacgaggcccgcgacgacccggatgcggtgctggagccgctgtga

SEQ ID NO: 1031 - DNA, 996 bp, Actinoplanes utahensis
gtgccgggtatgcagcagaggaaactgggggaactgaccgtctcggcgctcgggttcggggcgatggggatgagccacggctatgggccgggtccggaccgggaagcgaacatcggactgctccgggccgccgtcgagcggggggtgaccttcttcgacaccgccgaggtctacgggccgtgggtcaacgaggagctggtcggggaggcactgcagccggtccgggagcaggtggtgatcgccaccaagttcggcttcgtgatcggggcggacgggcggcagggggccggggtggacagtcggccggagaacatccggcgggtggccgacgcctcgctgcggcggctgcgggtggacacgatcgacctgttctaccagcaccgggtggatcccgacgtgccgatcgaggaggtggccgggacggtgcgggagctgatcgcggccgggaaggtgcgggcgttcgggctgtccgaggcgtccgcggcgaccgtgcgcagggcgcacgcggtgcagccggtcagcgccgtgcagagtgagtattcgctgtggtggcggcggcccgaggaggagctgctggacaccctcggtgagctgggcatcgggttcgtgccgttcagcccgctcgggcggggcttcctgaccgggaagatcggggcggacaccgtgttcgccgagaacgacatgcgcaacgggctgccgcggttctcggctcaggcgcgggcggcgaatcaggcgctggtcgagctgatcggccggatcgcggccggcaagggtgcgacgccggcgcagatcgcgctggcctggctgctcgcgcagcggccgtggatcgtgccgatcccggggacgcggcggctggagcggctgcgggagaacctgggtgccctcgacgtggagctcagcccggcagatctggccgagatcgggtcggccgcggaccgggccggggtgcagggcgagcgctatccggaaaagatggagcggatgaccaacctgtga

SEQ ID NO: 1032 - DNA, 276 bp, Actinoplanes utahensis
atgcgtacggtgattcgtgggatcgtggtgttggcgctggtggccgggggtggcgccggcatggtggggcccgccggagcggcgccggcggtgacgttcaagaactgcactgagctgaacaagaagtacaagcacggggtcggcaagcggggcgccgaggacagggtgagcgggtccaccaagccggtcaccaccttctccgtgaacaacgatctctatgcggcgaacaagaggctggaccgtgacaaggacgggatcgcctgcgagaagcggtga

SEQ ID NO: 1033 - DNA, 1803 bp, Actinoplanes utahensis
atggccctgccgatcgaggactacgcgatcatcgccgacacccagaccgcggccctggtcggtcgcaacggatcgatcgactggctctgcgtgccccgcttcgactccggcgcgatcttcgcggcgctgctcggcgaggcggagaacggccactggaccatcgcaccgtccggcgaggtggtcaccacccgccgccgctaccgggacgacacgctggtgttggagacggagttcgagacggccggcggcgtcgcccggttgatcgacttcatgccgccgcgcaccgactcgccgtccgtcatccggatcgtcgagggcgtccgcgggcaggtggacttcggcatggagctgcggctgcgcttcgactatggacacgtcgtgccatgggtctaccgcgagggtggggcgctcgtcgcggtcgccggtccggacgcggcctggttgcgcaccgacgtgccgacccggggcgagaatctgaccaccaaagccgatttccgggtacgggcgggggaacgcgccgccttcaccctgacctggcgcccgtcgcatctgccctcgcccgccccgctggacccggcccacgagctcggcgtgaccgagggttactggcgcggctgggtgtccgcctgcacgtacgagggggagtggcgggacgccgtcgtccgatcgctgctcactctgaaagccctcacctacgcacccaccggcggcattgtcgcggccgccaccaccagcctcccggagaaactcggcggcgtccgcaactgggactaccgcttctgctggctccgcgacgccaccatcaccctgcagtcgctgctcttctccggtttccagagtgaggcgatcgcctggcgcaaatggctgctgcgcgcgatcgccggcaaccccgccgagctgcagatcatgtacggcgtcgccggcgaacgccgcctcgacgagtatctggccgactggctcaccggctacgacggcaacccggtccggatcggcaacgccgccgccgagcagttccagttggacgtgtacggcgaggtgatggacgccctgcatcagggccgccgggccggcctcaaagccgacgacccgtcctggggcctgcaggtcaaactgatggagttcgtcgaggagcactggcaggacccggacgagggcatctgggaggtccgcggcggcccccgccagttcacccactccaaactgatggcctgggtcgccgccgaccgcgccgtcaaggccgtcgaggagttcggcctggacggccccgccgaccgctggcgccgcctgcgcgacgagatccgtcaggacatcctggacaagggttacgacccggtccgcaagaccttcacccagtactacggctccgatgagctcgacgccgcgatgctgatggtccccctggtcggcttcctccccggggatgacgaacgcgtcgccggcacggtcgccgccatcgagcaacacctgctggtcgacggtttcgtccagcggtacacccaacatccggacgccgacgtcgacggccttcccccgggcgagggcgcgttcctggcctgcacgttctggctggccgacaactacgcgctgatgggtcgccacgacgaggcccgggagacgttcgcccgcctgctggccctgcgcaacgacgtgggtctgctcgccgaggagtacgacaccaccaccggccgcctggtcggcaacttccctcaggccttcagtcacgtcccgctgatcgacacggcccggaccttgaccagcgcgctggcgccgaccgaggcccgggcctcggagggcctcaggtag

SEQ ID NO: 1034 - DNA, 855 bp, Actinoplanes utahensis
atgacaagtgctgttgcttcgccactgcggaccgacttcgagcgctcggtcgccagctactggaacaccaaccgggccgacccggtcaacctgcgcctcggcgaggtcgacgggctgtaccaccaccactacggcgtcggcgagcccgacctcagcgtgctggacggcccggccgacacccgcgagcagcggatcatcgccgagctgcaccggctggagaacgcccaggccgacctgctgctcgaccacctcggcccgatccggccgggcgacgcgctgctcgacggcgggtccggccgcggcggcaccagcatcatggccaacgcgcggttcggctgccgggtcgacggggtgtccatctcggaataccaggtgggtttcgccaacgagcaggccgctcagcgcggcgtcgccgacagggtgcgcttccacttccgcaacatgctggactccggattcgcgaccgggtcacggcaggcgatctggacgaacgagacgacgatgtacgtcgacctgttcgacctgtacgcggagttcgcccggatgctcggcttcggcggccgctacgtgtgcatcaccggttgcgccaacgacgtgaccggccggcgctccaaggcggtcaacaggatcaacgagcactacacctgtgacatccacccgcgcagcgactacttcaaggcgctcgccgcccacgatctcgtgccgatcgccgtcaccgacctgaccgcggccaccatcccgtactgggagctgcgcgcccggtccgaggtggcgaccgggatcgaacaggctttcctcacggcgtactcagaaggcagtttccactaccttctgatcgccgccgatcgggtctga

SEQ ID NO: 1035 - DNA, 1017 bp, Actinoplanes utahensis
gtgatcgcctcggggcccaccggcctgggcacctccgcggcccgtctcttcggtcgggtggaccgggacgagccggagctcttctgcccggcgccgctgcgcgacgaccgggcgctgggggagcgggtcaacgacgccgtggtccagtgggccgagaaggccggcatctaccccggccggctggacaagctgcgcggggcgaacttcggccgcttcatgatgctcgcccacccggccaccagcgatcccgaccggctgctcgccgcgacgaagtgtctggtcgccgagtgggcggcggacgactactacgtcgacgaggtgtccctgggcgcggatccgatggtggtcggctcgcggctggccaacctctactcggtggtcgacccggcctcgctgaccccgcgctatcaggccgacttcgagaagcatcaccgcctgcagccgatctcggtggcgttccgcaccgcgatggaacacctggccgagtacgcctcggtcacccaactggcccggttccagcaccagatggcgatcctgttcgtcgcctggtcgcaggaggccgactggcacgccaaccggcgcaccccgccggtctgggagtatctggtgcagcggcacctgaacagctatctgccgccgatgatcctggtcgacgtgctggccgggtacgagctgtcgccggccgagttcttcgatccgcgggtccgcgcggcgttcaccaccgcaggcaacgccgccgtgctggtcaacgacctctactcgggcaggaacgagtccgagaccgatcacaacctgccgaccgtgctggtgtccggggagcggctcacgccgcgggccgcggtccggcgcaccgtggagatccacaacgagttgatgcacaccttcgtgacctcggccgcgtcgttgagcgcgtccggctcgccgcagctgcgccggtttctcgcggacacctgggcctggctgggcggaagtcgcgagtggcacgccacgagcggccgctaccactcatccaactga

SEQ ID NO: 1036 - DNA, 1410 bp, Actinoplanes utahensis
gtggcgactcccacgcagtccgagatccgcgaggaagagcacgaagagcagcggcagagcctgagcacggcggcggcccgcaacctcacgaccaccaccaagaccgcgccgcagatgcaggagatcacttcgcgatggctgctccgtaagcttccctgggttcaggtcgccggtggggcgtatcgggtgaaccggcggatgacttatcggatcggcgacggccggctgagcttcaccaacgtcggtgcgcaggtccgggtcgtcccggccgagctgcgggaactctcggtgctcagcgagttcgacgacgcggacgtgctggccgccatggccgacaagttcgtgcagcaggagtaccagcccggtcaggtgatcgtcgagttcggctcggtcgccgaccacgtgtacgtgatcgcgcacggcaaggtgaacaaggtcggcgtcggcaactacggcgacccggtcaacctgggggtgctcgccgacggggaggcgttcggcgagaagtcgctcaccgacgaggagcggatctgggactacaccgccaaggcgatgaccgcggtgaccctgctggccatgccgcgctcggcgttcaccgcgctgctcggccagagtgaccacctgcgcacgcacgtcgagcagttccgggccaagaaccgccggccgcagaacaagcacggcgaggcggagatctcggtggccgccgggcacaccggcgaaccgaagctggacggcacgtacgtcgactacgagctgacgccgcgcgaatacgagctgagcgtcgcgcagaccgtgctgcgcgtgcacacccgggtcgccgacctctacaacgagccgatgaaccaggtggagcagcagctccggctgaccgtcgaggcgctgcgcgagcgtcaggaatacgaaatgatcaacaaccgcgagttcggcctgctgcacaacgccgacctgcggcagcgcatccacacccggggcggcccgcccaccccggacgacctcgacgagctgctcagcatgcggcgcggcaccaggatgttcgtggcccacccgcaggcggtcgccgcgttcggccgggagtgcaccaagcggggcatctatccaccgatgctggaacaggacggcggcaccttcctgtcctggcgcggggtcccgatcctgccgtgcggcaagatcccggtgaccgagacgcacaccacctcgatcctggcgatgcgcaccggggagagcgaccagggtgtggtcgggctgcaccagaccgggatcccggacgagtacgagccgagcctgtccgtgcggttcatggggatcagcgagcaggcgatcatgtcgtacctggtgagcgcgtactactcggccgcggtgctggtgccggacgcgctgggcatcctggaccacgtcgagctgtcccactga

SEQ ID NO: 1037 - DNA, 987 bp, Actinoplanes utahensis
gtgcttcgtctgttcaccgccgcctcgctggcggcgggcgtcctggtcgccccgggcgcggcctgggccgccgacaccaccacgtcactgaccagcgccgagatgtacgcggcgctcaagagcgtggccggcaccaccgcacccgccgagatcaacggttacggcggcgacttcagcgtcacggccagcctgagcggtgcgacccagaccggctcggccctgttcgccgccgacccggcgaccggcctcggctactacaccaccaccggcacggcggtcggcgggaccggcggcggatacggcgccgccggcaagggcgactaccactacctggacgaccccaccacgcgggccgccgccaagatggccggctacgcgtcggcgaaatacgtcttcgcggccgacagcaagctcaccctcgactcctgggccggcgagaacctgcccgccccgtcgagcatggtggtgtccgacccgcggcacgccggtaccaaggtggcccacgacgacgggaccaccgactacagctacgtcgacgacgacaagatgacctggaccttcaccgtcaacacggccggtgcggtgaccgccggcaagatgagcgggagcggcctggaggacaccttccggtacaactacggaccgcagaccatcacgctgcccgccggcgaccaggtgatcgcccaggccaccctgatgaaggcgatggcctacctgaccatggccgccgacgtgaagcgggtggcgaccacggcggccaagaccaccgagaagaaggcggccggcaagaccgtcacggtgtcggcggtgcgcaagtacgcggccagtgaggcctcggcgtacaaccgcaatgccgaattcaaggtcatcgccgtcaccaacatcaagggtggcgcgcacgtcagcgcgaagaacccgttcaccaaggtctccgtgagctacacgatcaaggccgccggcaagcacgccgtcgtcaccaagggctga

SEQ ID NO: 1038 - DNA, 1212 bp, Actinoplanes utahensis
ttgcccgatggtcaggccatgagcgacgccgtccacgacgaatcccggctcgccgcgctccgcacctaccaggtgctggaccggccccggcccgcggtgctcgacgacctgacccggctggccgccaccatgttcgacaccccgatggcggccgtctccctggtcgaccgggaccgccagtggttcgccggcaacgtcggcctggccgacgccgagaccccgctcgacgtgtcgttctgcgcccggctcgtgccgacccgcaaaccgctgatcgtccccgacgccacccgcgacccgcacttccgggcctaccgcaacgtgaccggggacccgcacatccggttctacgccggcgcacccgtcatcgacggcgaaggccacgtgctcggcgcgatgtgcgtcatcgacgacgaggcccgggagatcggcgaccggcagatcgacgcgctcacctcgttcgccgggcaggccgccacccacctcaccgcgatccgcggccggctgcgcctcgccgaactcggcgacgaactggcccgcgccgcccagcgcgaggaggacctggtcgccaccatcacgcacgagctgcgcaccccggtcaccagcatccagggatacctggaactgctcgccgagaacgacgacctggaaccgtaccgccgcctgatcgaaccgatccaccgcaacgggcgccgcctggtgacgatggtcgaccacatcctggccggcacccggccgcacgacgccccgctgcccgccccggtcggcccgatcgacctgaacaccgccgtcgccgcggccctcaccgcctgccgcgccctgaccggcctgcgcaccaccccggtcaccatccacccggcgtcacccgccccgatcctggccgacctggcccggctcgccggcgccatcgaacagctgctgcgcaacgcgctgctgttcaccccggccgaccggccgatcaccgtgcgcgtcaccggcggcggccggccggccgtcgaggtgcgggacagcggcgtgggcattccgcaggacgagctgccgtacgtcttcgaccgcttctaccgcggtcagcacgcccgcgaccaggcggtgcccggcgtcggcctgggcctcaccatcgcccgtgccaccatcctggcccacctcggcaccctcgaggtgaccagcgacccgcacggcaccacggcccgcatcaccttccccgccctggactga

SEQ ID NO: 1039 - DNA, 567 bp, Actinoplanes utahensis
atgtcccccgacgacgtcgtcgcggtgatcatgcagcggctcgccgaccagcaccgggtggtgcccgcctatgtgatccgggacgccgtcgaggccgccctgcgccgccgcttcccggacggcccgctcgccgagatccggatcccgcccgacctggcggccgacctggtcgccggcttcggcagcggcgcggccaccgccgaggacgactccgccaccatgcccgcggtcctcagcggcgacgagaccggccggctgctggccgcactcggcctggccgtacacgtcgccgcgttcaacctggaccgcgaccgcctgcacgtcgcccagatcctcaacggcgcggcggccgccctggtcgccctgggcgcggcctcccgggccgcccacgccgacggcacctcggcggtgctgctctccccggccaccctgcgcaccgtgcgcaccgtgatggtcgccgtgctgcagggcatccgcggccgcagctggcaggccgaacacctcgacccggtcaccaccacggccatgttcaccgacgtgctgaccatgctcggcgccgtcccctga

SEQ ID NO: 1040 - DNA, 696 bp, Actinoplanes utahensis
atgagtccacgacgcgtaccggtcagccgccgggatcggccggccaaaccgccgctgagccgggcgggcgcggtcgccgtgggcctgcggatcatgcgcgaggagggtctcgagcggctcaccatgcgccgactcgcggccgagctcgacaccggcccggcgtccctctacgtctacgtgcagaacacggccgagctgcacggcgcgatcctcgacgaactgctcgccgacctaccggttccggccgccggcgacggctggcgcggcgagctgatcgagctgctgtgcggatacacgcggaccctgttcgcccatccgagcctggcgcgctcggtgctgacgctacgcccgtccgggccgcactacctgcgcctggtcgacgcgatcctgggcctgctgctcgccggcggcgtgccgtccacgcaggccgcctggggcgtcgacctcctgctgcagctcggcacggccaccgccgccgagcagggcacccgcgacgagaccgccggcgccgacgacgagaccgcgctgttcacgatggccgtgcgggaggccccggccggcgagttcccgcacctcgcccagacccgcgaccacctcttcaccggcaccggcgtggagcgcctgaagtgggcattctccgccctgatcaccggcatcgagacggttgccacgaccgatcccacccaccctgcatga

SEQ ID NO: 1041 - DNA, 1137 bp, Actinoplanes utahensis
atgaccacccccgtcaccatcgtcggcgccggactcggcgggctgacgctcgcccgtgtgctgcacctgcacggcatcgccgccaccatctacgagctcgacgcctccccacaggcccggacccagggcggcatgctcgacatccacgactacaacggccaggtggcgctccggtccgccggcctgttcgacgagttccagaagatcatccactcgggcggggcggcgacccggatcctggacaggcacggcgtcgtgcactccgacgagtccgacgcgggcgacggcagccgccccgaggtggaccgcgggcagctgcggcaggtgctgctggactcgctgccggaggggacgatcaggtggggcagcaaggtcaccgcggtcaccggcatcggcggtgggcggcacgagctgaccttcgccgacggtgcgacggtccgcacggacctgctggtcggggccgacggcgcgtggtcacgggtgcgaccgctgctgtccggcgcgcaaccctcgtacaccggaatgtccttcgttgaactcgatctcctcgatgcggatgtgcggcaccccgggccggcccgaaccgtcggcgacgggatgctgttcgcgctcgggcccggccagggtttcctggcgcaccgggagaccgacggcagcctgcacgtctacgtcgcgctgcggaaacccgcggagtggattgacggcatcgactgggccgacaccgcgcgggccaaggcgctgctgaccggcgagttccccggctgggcgccggagttgcacgcgctgatcaccgaggcggacggcccgctggtgccacgcacgatccatgcgctgccgaccgggcaccggtggcagcgggtgcccggcgtgaccctgctcggcgacgccgcgcacgtcatgtccccgttcgccggcgagggcgcgaacctcgccatgctggacggcgcgtcgctcggcgaggcgatcgcggcccaccccggagacctcgacaaggcgctggcatcgtacgagggtgagctcttcccgcgcagtgccgcagccgccgcggagaccgcccgcaacctggtcctctgcttcgacgacaacgcgccgcagagcctgctggaccggttcgccgccgaccacgacgcccggtga

SEQ ID NO: 1042 - DNA, 2328 bp, Actinoplanes utahensis
gtggtccagcggcgggtccaggatccggagcgcgtggccgcggtacgcgcgaccgggctgctggacggcgcggagtccgccgggctgcggcggctgacccggctggcatcccggctgctgggtgcgccgactgcgctggtgtcgctggtgctcgacgatcggcaggtgttcgccacccagctcgggttgccgcggccgtgggcggaacagggcgggacgccgctgacccattcgttctgccggcacgtggtggacggcgacgagccgctggtggtggcggatgctcgggagcatccgctggtgcgggacaacctggcgatcgaggagatcggggtggtcgcgtacgccgggatgccgatccgggtggacgggcagacgctgggggcgttctgcgcgatcgaccaggtgccgcggatctggtcggagagcgagctggcgatcctggaggatctggcggccgcggtgtcgtcggagatcgagctggcgcgggcggtgcagctggccgaggagacgtccgcggtggtgcggcggatcctggacgtgtcgcaggacgcctacgtgtcgatcgacgcgaacggtctggtccaggagtggaacccggcggcggagcggctgttcggctgggtgcgcgacgaggcggtgggcgccgacctgagcaagctcatcgtgccggaggcgcaccgggaggcgcatcggcacggactggaccgggtgcgcgagagcgggcggtcgcgactggccgggcagcggctggagctgccggcggtggaccgggagggacggacgttcccggtggagttcaccctgcagacgacgagcatgtccggtgggcggccggtgttccacgcgttcctgcacgacatcagcgaccggcgggcggccgaggagcagttgcgtcggcaggccgagctgatcgacgcggcgccggcggcgatcatcgtgcgggatccggacgggacgatccggttctggaaccggggcgcggagcagatgtacgggtggccggcggccgccgcggtggggcgcaacattcaccggctgctgtccaccgtgttcccgaagcaggtggcggaggtggatcaggcgctggaggaggtgggcttctgggagggcgagctggtgcaccggcgcgccgacgggcggaccgtggtggtgctgagccggcacgtgtcgcggccggccgcgggcggcggcggccgggagatcatcgagacgagcaccgacatcaccgagcggcggcgggccgagcaggcgcgcgaggagagcgagcggcggttccgggtgcagttccaccagtcgacgatcgggcaggtgatcgtcgggctggacgggaacatcctgcacgtcaacgacgcctacgcgcggatggtgggccggtccgcggccgagctgaccgggtacggcgtgatccagctgacgcacccggacgaccgcgacggcgacaccgaggcgctggccgggctgttcgccggggagggcgactcgtacgagcggatcaaacggctggtgcacgccgacgggcacagcatcgacgtgcagaccggggtacgcctgatccgggacgccgacgggcggccgctgcacctgatcgggatcgtgcaggacatcaccgagcaggtccgggccgaacgggaacgggacgcggcgcaggtcgtgctggccgagcgcaacgaccagttgcagcgcgccaaccagctgaaactggaccttatggggatgctctcgcacgacatcggaaccccgctgaccgcgatcctgggctatggcgaggtgctcagcgaggcggagctgccgccgcagctgtcgaatctgaccgcccggatcatcaccggcgcgcaccggatcgacgagctgcgccacaacgtgctggcgatgtgcaagctcgacgccggggagctgaccacggtccggcaacccgtgccgctggccgccgcgctgcgcgacgcggcggacggggccgacgccgcggtcccgatcgactgcccggccgatctgtgcgtgctggccaatccggcgcacctgcggcagatcgtggtcaacttcctgaccaacgcccgcaagtacggcggcggggccacccgggtgacggtgaccgtggccggcggcgaggtggtggtcggtgtgcacgacgccggcgccggcgtgccggagcagttgcgggcacacctgttcgagcggtacacgcaggccgccgagaacgccgccgaggggcacggcctgggcctgcacatcgtggcgagcctggccgaggcgaacggcggccgggtgtcgtacgagccgggtgatccggccggcagcgtcttccggctgcacctggaaatggggtga

SEQ ID NO: 1043 - DNA, 507 bp, Actinoplanes utahensis
atggaaccgatcagcgaggccgggatccgggcctcgttcgtcaactgcagcaagggtgaggcaggccggatcaagctgccgcccgacttccgcgacaccccctggggcgatctcgacttctacggcttcgtcgacccgtccgcgccgcagcgcgcggtgatcgtggtgcccgggggtgatgccggcccgatcggcatcctgttacgcaaggcggagagcggccgggccggcgccggccgctccagcatgtgccaggtctgcctgaccgatcacgcggccggcggggtcagcctgttcaccgcacccctggcgggggcggccggccgcaacggcaattcggtcggtgagtacctctgctccgatctggcctgctcgctctatctgcggggcaagcgccaaccgaagctgcgcctggtccgcttcgaggagacgctgaccgtggcggagaagatcgaccgtgcgctgctcaagttgatcgcgttcaccgcgcgggtgtcgcgcgcctga

SEQ ID NO: 1044 - DNA, 795 bp, Actinoplanes utahensis
atgaccgcggtacgggatcgtttcagggaattgcacgaggccggcacgttcgtcatgccgaacccgtgggacgccgggtcggcgcggctgctggccaacctcgggttcgcggcgctggccaccacctcgtccggattcgccgccaccctcggcaagctggatcagcaggtcacccgggacgagctggtcgcgcacgtggcggcgttgaccgcggcggtcccgctcccgctgaacgtggacgccgaacggtgtttcgccgacgacgccgccggcatcgcggagacggtggacctgctggccgcggccggggcggccggcctgtcgatcgaggactacgacccggcggccggccgggtcgaaacgctggagaccggcgccgagcgggtggccgcggcggcgcgggcctgccgccggcacgggatcgtgctcaccgcccgcgcggagaacctgctctacggcatcgacgatctcgacgacacgatcgcccggctgcgggcctaccgggaggccggggcggacgtcgtctacgcccccggcctgcgaacggcggcggacatcacccgcgtggtgaccgacgtgccggcaccggtgaacgtgctggcgctggccggcgcgccgagcgtgccggagctgaccgagctcggggtccgccgcgtatcgacaggcggcgcgctggcctgggccgcctacggcgccctccgcgacgcggcccgcgagctgctcacctccggaaccacggccttccgcgaccgcgccctgctcgaggctgagcgggaggccgcattccaggactga

SEQ ID NO: 1045 - DNA, 1227 bp, Actinoplanes utahensis
atggcggccacgcagtacgtcggcgacatcgagcgggaccgcctcgccgccctgcaagcctacgaggtgctggacaccgaggccgagcacgacttcgacgacatcgtgatgctggccgcccagctctgcgacaaaccgatcgccctgatcagcctgatcgacgccgaccggcagtggttcaaggcccggtacggcaccgatctgtgcgagggcccgcgggccggctccatctgctcgcacgccatgtacgacgaggacgttctgcaggtctgcgacgcccgccgggacccccgcttcgccgcctgcccgacggtgaccggcgcgccgcacatccggttctacgccggcgcgccgctgatcagcccgctcggcaaaccgctcggcacgctctgcgtcgccgaccccgagcccggccggctcaccgacgcccagcggcacggcctgcgggtcctggcccggcacgtggtcacccagctggagctgcgcaaatacgcccgggacgtgcacgccctgcaccagcgggtgcagaccgccgagcagatcaaggacgagttcatcgcccgggtcaaccacgagttccgcaccccgctcacctcgatccacggctacctcgagatgctcggcgacccggagctgcccacggccaaccgggacggcttcctgcagcgcgtccagcgcaactccgaccggctgctcgccctggtcgacgacatgctgctggccgcacaggtgaacgcggagagccgggagttccaccgggtgccggccgacctggccgtgctggcccgcacctcggccgcggcgaaccgaccgctggccgaggccaagggcctcagcatcgtcgcggacgcggccgccccggtcttcgccgacgtggacccgcggcggatgggccaggccctggaacgcctcatcctgaacgcgatcaagttcaccgccaccggaaccatcacggtcaccgcggccagccgggacgggcggtcgatgctgctggtccaggacaccggaatcggcatcagcccggccgaccaggcccgggtgctggcaccgttccggcggtcggcggacgcggaacgggccgaggtccagggactcggcctcgggctgagcatcgtcaaggcgatcaccgagggacacgagggtgaggtcaccatcgtgagcagcccgggccagggcaccacgatcgccctgtcgctgccggccgccggcccctacccggaactctga

SEQ ID NO: 1046 - DNA, 2139 bp, Actinoplanes utahensis
atgttcagcgattcgccgtccgtgccgaacgggtggttagtgcacccaccccgacccgaggcgaccccgatgaacctccgcatgctgcccagcaccgtccgcttcgcgctgctctacctggtggcggtcggtgccggccagctcagcgtgctcggcatgccgggggctctgccggtggtctggccggccaccgcggtcgccgcggtctggctgatcagccgcaccgacccggtgcggcggtgggccgacgccggcgtgctgttcgggctcaccacgctggcgctggccgccgccggcgccgacctgcgggtggcgctggtgcacggcctgtccgcgatgatcgaggcgctgatcttcgcgggcgccgcggcccgctggctgcccgggctctgggcgccggtcgccgagcgcggcggcgcccggcccatgaccacgctgcgcgatctgctgcgggtgctgatcatggcggtgttcgccggcctcgccggtgcggcgatcggcggcctcggcgagcagttcctcacccacgactacgcgcccacctcgatcgcgatgtggctggtccgcgacgtggtcagcgtgctgctcttcggcgcggccgcgcgccggctggccgacctgcggctcgaccgggacgcctggccggagacggtgatcgtctgcgcgctctcggcgggcgcctacttctacgtcttctcggtcaacgagaccctgccgattggcttcgcgctgatggccatcaccgtctgggtggcgctgcggctgcccaccgtgctggtgatcgggcacgtcatgctcttcggcaccacggccgcggtgttcaccctgcacggccacggcccgtacgcgctgatgcggaccaccgacccgggcgtgcccggcctgatcgtccagctctacatcgccgtgctggccctggtcgggctggccctggcgttcagccgggacgagcggaccgcgctgatcgaacggctgcgcgccagcgagcacgaggccaccgagaaggccggcctgatgaccacgatcgtcaactcgatgaccgagggcctggccatcctcgaccagaccggccacctggtgctgcgcaacccggccgccggccgcctgctgggcagcaccagccaggtcaccgcgggctcggcgctgggcagcgactacggcttcttccacccggacggcgccccgctggccgacgccgagctgccctaccagcgggcgctggccggcgaggacgtgcagccgatggacgtgctgatccgcaacgccgccgtcccggagggccggatcgtccggttcaatgtggcccggctggccggctccggcggcccgcagcacgtggtggtggtcttccacgacgtcaccgcggaccgtcggcaccgcgacgagctgatgtcgttcgccggagtggtcgcgcacgacctgctcaacccgctgaccacgatcgagggctgggccgaggtgctggaggcggaactcgccggatacaagccggccgagcgggtcagccggatccagcgggccgcggcccggatgcgcaccttcctcaacgggctgctcgcctacaccgccgcccgcgacggcaagctgatgcccaccacgatcaacctgcagttgctgctcaccgacatcgccaacagccggtacgaccaggcggagagcaacggcaccacgccaccgcagttcgccttcggcccgctggacgcggtcgaggccgacccggtgctcacccggcaactgctggagaatctgatcgaccatgccctggagacggcgatgcccggcgtcccgccgcagatcggcgtctccgcccagcccgcgccgaacggcatgctgcgcatcgacatcctggacaacggccgcggcatcccggccgggctgagccaggcggtcttcaccaacttccaccgcggcgagggcaccggcggctccggactggagctggccgtctgcaaacggatcgtggagcggcacggcggcaccatcgaggcgattcccaacccgtacggcagcggcacccggatgacgttcacgctgccggccgggcgctccgcgtacgcccgcaccctggagaaccagtggcagcagacgcagtcgccgcgggcgcagcagcccggcgcgaccgccctgcacccgaggtag

SEQ ID NO: 1047 - DNA, 2187 bp, Actinoplanes utahensis
gtgagccggtggcgtgatcgaccgtggttccgggccaccgcgctcagtgcgctggtggccctggccggctgcgccgggtcgctgggcgtcggcacggtgctgcgccgcaacgagaaggccaccaccgacgtgcagatggaccggcgcacggcggctgcggtcgccgcggtccaggccgagacccggcggtacgtcgacacgctgcgcaccaccgcggcctcggtcggggcccagcagaccctgcaagccgacgagtacgccgcgatcaccgccccgttgcactcgatgaaactggccggggccacctcgatcgccctggtcgtgccggccgccgccgaccaggtggcccgagtccagcagacctggcgcgaccgcggcgccaccggcctgaccctgcaccccggcccgagcgccgaccacgacttctcggttctggtcgccgagctggacgggcgcagcggcacgaccggcatcgacctgatgcgggccgccgcgccggccgccgccctcgccgagtcccggcgcacccggcagatcgccgtctccgacacctaccagctgctggtcgaccagagcctgccaccggagcggcggcagaactcgttcgtcctggccgcacccgtctaccgcggaatccagcaggacttcctcggctggctcctgctcggcgtgcgcggccaggacttcatgggcgccaccctgaacgcggccgggccgggcctggccgacctgcggctcaccgcgaaccgcgccgacggccagccggtcaccgtcgccgccatgcggcacggtgccggcgacgacctgcggcgggtggtggacatcccggtcgccgactcgacctggacgttgcacgtcaccgggtcgcgccgcggcctccccggtgccggcaacgccctgccggccgcggtgaccggcgccggcctgctgctcagcctgctgctcacggtgctgatctgggtgctggtcaccggccgggaacgcgcccggctgacggtccggtcgaagaccgccgagctggtcaccgaacaggccgaggtgaaccggcaggccgggctgctgcgggcggtgctggacgggatcagcgacggggtcggcgtggtcggcccggacggcgcgttcctgctgcacaacccggcggcccgggagatcctgggacgcgacgaggaggacaccgacggcgccggcagctggcaggagcacttcgggctgttccggccggacgggaccacccccttcccgaccgatgacatgccgctggtccaggccctcgccggggaacgcgtcgatcaggtcgagatggtcgtccgcaacgccgcgcacccggacgggcggatgatcagcgtgtccgcgcggccggtggagacgggcgaggggcagcggggcgcggtcgcggtgttccacgacatcaccgaacgcaaacgggtggagaccgaactgcgcggcttcgccggagtggtcgcgcacgacctgaaggccccgctcaccatcgtcaccgcctacgccgacctggtctccgacgccctcgacgacctggccgcgggcgccggcgtgccgaccctggagcaggcccgccacggcaccgccaaggtgctgcacggcgcgggccggatgcagcggctgatcaccgagctgctggactacaccgcggcccgcgacgccaccctgcgcgtcgaacgtctcagcctgcgcgccctggtcgacgacgtggtgaccacccgtaccgacgcccccgaccaggaggcggacgcccggccggacgtgttcgtcggcccgctgcccgacgtcgaggcggacccggtgctgctgcgccaggtggtcgacaacctggtcggcaacgccatcaagtacaccccgccgggccgggcggcgcgcatcgacatcaccgcgcgcaccggcgcggacggcgaggtccgggtgcgcatcgccgaccggggcatcggcatcccggacggcgagcacgccgccgtcttcggcaccttccaccgggccagcaacggggccgcccatccgggcaccggtctcggcctggccatctgccgccggatcgtggagcgccacggcggccacatcgaagccgccccgaatcccggcggtggcaccgtcttcaccttcaccctgcccgccacaccgccgggcgagccgtcccggacgaccccggcccgtgcatcaatcccgaccggatag

SEQ ID NO: 1048 - DNA, 1242 bp, Actinoplanes utahensis
atgaatcgccgcagcctcctccagctcgccctcggcacgggcgccgcctccgtcctggccgcctgcgccgggcccggcggatcgtcgtcctcctcgtcgcacccctccggcggcgagctctccttcgcccactggcgggccgaggacaaggacgtgttcgagaagatcatcaaagatgccggtctggcggtccggcaggacatctccccgtcgaacgactaccagagcaccgcgctgcagaagatccgcggtggcagcgtcggcgacgcgttcaccgctttccggggtgcgcagttcctcgacatcgccaaggccggcatctggtccgacctgaccggcaagccgctggtgcagaagttcgcgcccaccctgatcaccgccggcgcgcgggacggcaagcagctcggcctgccgtaccagctggtcttcaacaccccgctggccaacaccgacctgctcgccaaggccggggtgaacgccgcgccgaaggactgggacgggttcctggcgctgctcgaagcgctcaagggcaagggcgtcacgccgatcgcctggccgggtggcgacgcggcgaacgccggtcaactgctcaacgtgatggtggtcaacaacgcgccgaccgacgatgcgctcggcaggatcgagaccggcgaggcgaaggtcaccgacgactggttcctcaccgtgctcaagcagtaccagcagctcaagccgtacttccagcagggcgcgacgggcaccggcgcggacgcggcgctggcactgttcgcgcagggtagggcgggtctgctggctaccgggtcgttccaggtgggcggggtccgcaagctcggcggcacgttcccgatcgacctgctcgcgccgatcaccaccaccgcggacaaggcgaggtacgagggcgtcttcaacgcgacgttcatcctcggcgtgaacaccgggtcggcccggcaggacgccgcgctggcctggctcacccatctgtccgacccggcggtcgccggcgtgtacgccaacggcacctcgcagcacgtcaccgtgcagggcgtcgagtacaccaacccggacctcaaggcgctcgcgccgtggctgaccaggaagaccacgctcgccccgcgcttccagttcaccaacctggacgtgcgcggcgccgtcgagaacgccgcgatccaggtggtcggcggcaagagcccggaggaggccgccgaggcggcccagaagatcgtcgatcagaagaagaagtag

SEQ ID NO: 1049 - DNA, 870 bp, Actinoplanes utahensis
atgaccgtacgcaagatcgggctgctgctcttcgccctgcccgcccttgtcctgtacggcggcttcttcctgctgcccgccgtgcagggcctgcggtatgcgaccaccgactgggacgggttcagcccctcgttccggtcggtgggcgcggcgaacctcaccgccgtggtcgaccacgacgacctgttccgcaacgcgctcaccaacaacctcaagttcctgctggtcgtggtgctcgggcagaccgccctggcgctgctgctcgcggtgctgctggccgcccgcagccgcggctcgacctggttgcgggcgctgttcttcctgcccaccgtgctgtcgtcggtgtcggtggcgttcatctggaagttcgtctacgacccgaacttcgggctggtgaacaccctgctgagcgcggtgggactggatcgtttccgatcggcgttcctgggcgacgagggcaccgcgatcctctgggtggcggtcgcgcagatctggttccacgccgggcagatgatggtcatctacatcgccggactccatcagatccccgaggagctgtacgacgcggcgcgcaccgacggggccggccgctggcaagtcttccggcacgtcacctggccgatggtcggcccggccacggcgctggtcatcgcgtacaccaccattcagtccttcaaggccttcgacctgatcctcggtctggccggcaatccgccgcggtccgggctggatgtgctgagcacccggatctacagcacgttcgcgaattcgcagctcggatacgccgccgccgaatcgatcgttttcatggccgcgatcgcgctggtcaccatcctgcagaatcgggccgcgaaatgggtgcacgggtga

SEQ ID NO: 1050 - DNA, 804 bp, Actinoplanes utahensis
gtgacacgacgcctgatcctcaccacgtacgcgctgctgatcgtggtgcctctgctggtgatcgccggcggcagcctgaagaccagccgggaactgttcgactcgccgttcggcctgcccgcgcatcccaccctggccaactatgccaaggtgctggccgacggcgatctgctcggcgtgctcggcaacagtgtgctggtggccgctgtctcggtgccgctgaccctgttcctcggcagcctcgtcgcgtacgcggtggcccggctgccacgctggccgtcccgcgtgttgttcggcattttcgcgatcggtctcgccgtgccggcgcaggcggtgatgattccgcaatacgtgcagttcgaccggctcggcctgcggaacagcctgatcgggctgatgctggtcaacatcgtggtgaccctgccggtggcggtgttcatcctgaccggtttcctgcgcacgctgccggccgagttgtacgaggccgcggaattggacggggcgggactgtgggccacctaccgccggatcaccgtgccggtctcggcgccctcgctggccgccaccggcatcttcctggtcgtcatgcactggaacgatctgctgtatccgctgctgttcatcgacgacccggcgaaacgcaccctgccgctggcgctgctggatttccagggcgaatacctgaccgactatccgctgctgttcaccggggtgatggtggcgtcgctgccgatggtgctggcctacgcgttcctgcagcggcacttcgtcgcgggcatcaccgcgggcgcggtcaagggctga

SEQ ID NO: 1051 - DNA, 1200 bp, Actinoplanes utahensis
gtgggattgctcgaccggttcgtctcgccccgacgccgattcgcggcgctggccgtccgcgtcgcccggcgcaccccgggggtcgaccgggcggtgagccgccccgacgacttctcgatcgcgatctaccgcaccggcgcgaccggcccggcccacctctatctggccaacatcttccgcgagacggaaggcgcgacgcccgccgaacgccgggaacgtctcgcgaaactggtccggatcatggcggctccgccgccgcaggacgattgggagacggtacgcccgaaactccgcccggtgctgcgcccggtcacgttcgggtcggcgggcccgccggggatgcgtccacccatctcccgagccgccctgccgtacctgaaggaactggtcgtggtcgaccagccggaagcgatggcgtacgtggtgcccgaccgggtcgacgagtggggcgtctccgccgaggaggtcttcacccaggcccgggagaacctggccgggatggcccgcacctccctcgaccagccgtggcccagcggccagccgctgatcagcatgctcgacgacggcgacgcctacttcacgtcgctgctgctcgcccccggctggctcgccgaggtcggcgaacgcctcggcggcccggtcctcgccttcgccccggacaacaacacgctgctgctctgcccgctgcccgagaccaccgcggaaccgttctacgccctggtcgaccaacatttcaaggaggccccacgcagcctgtccccggtcggctacgtggccggcccgcaggggcgcaccatcgcctacaccccacccctcggccacccgcaccacctctccgcccgccgcgcggagatggtcctcgccctcaccgaataccagggccagaccaactggctcgccgagcagtacgcccaggccggtgtcgacgtgcacatcggcggcctgctctccgccgaaccgatcggcggcctcccggaaaccatcgcggtctggacggccggggtcagcaccctgctccccaaagccgacgccatcgtcttcgtccacccggactcgggaccgcagttcagcgccccgtgggacgcggtcgcccgacgcgtcaccctggaagcggagcccctgctggccccggcccgctaccgcgtcgacgactggcccgccccggacatcctggcctccctccgccaggagatcgcctga

SEQ ID NO: 1052 - DNA, 2256 bp, Actinoplanes utahensis
gtggcgccgattgatgaggaagaagccgggctacgggtcggggcgccggcggatcatgcggcggggcttgcggcggtgcggctcagtctgaccgatgcggtgcgcaagatgggtgtgggcaaggcggtccgcaaccttcgtacgctcaatcaggtcgacggtttcgactgtatgagttgtgcgtggccggatcctcaggggcatcggcatgcggcggagttctgtgagaacggggccaaggcggtctcctgggaggggcagcgggagacggtcgggccggagttcttcgcggcgcactcgatcgacgacctgagcgggcggagcgatcactggctggagaagcagggccggctgacgcatccgatggtgcgacgcgagggtgcgacgcactatgcgccgatctcctgggacgatgcgttcgcgctgatcggcgccgaattccggaagctgagcgacccgaacgaggccgtcttctacacctcggggcgggccagcaacgaagcggcgttcgtctaccagttgttcgcgcgggcggtggggaccaacaatctgccggactgctcgaacatgtgccacgagtcgaccgggacggcgctgtcgcggaccatcgggatcggcaaggggtcggtcaccctcgaagatctgcaccgggcggatctgatcgtggtctccgggcagaatccgggcaccaaccatccgcggatgctgaccgccctggagatcgccaaacgggacggcgcccggattctggcgatcaatccgctgccggaggcggggctgctgcgcttcgacaatccgcagaaggcgcgcgggctggccggttcggggaccgcgctggcggaccggctgctgcgcatccggtccaacggcgatctggcactctggcaggcgatcggcagcctgctgctgcggcgcggggtggccgatcgggagttcatcgagtcgtcgaccgtcgggttcgacgcgtgggcgcggcacgtggccgccgtggaccgggacgcggtgctgacggcgaccgggttgacctgggccgagatcgaggccgcggcggacatgctggcgtcggcgacacggatcgtgcactgctgggcgatgggcatcacgcagcatcgcaacgcggtggcgacgatcaaggagttcgtcaacgtggccctgctgcagggcatgatcggcaagccgggcgccggactgtgcccggtgcgcgggcactccaacgtacagggcgaccgcagcatggggatctgggagaagccgccggcggcgttcctggaccggctgcgcgacgagttcggcttcgagccgccccgcgagcacggggtggacgcggccgatgcggtgcgggtgttccgggacgggcgggcgaagatcttcctggcgctgggcggcaacttcgtggccgcgatgtcggacaccgaggtgaccgcggccgcgatgcgcaacgccgcgctgaccgtgcagatctccaccaagctcaaccgcagccacctggacgccgggcggaccgcgctgatcctgcccacgctgggccgcaccgagcaggaccacaccggcgggcgggtgcagcggatcaccgtggaggactcgatgtccgcggtgcacgcctcccgcggccggtcggcgccggccgggccgctgctgcgctccgaggtcgacatcgtctgcgggatcgccgcggccacgctcggcgaccggcacggcatcccgtgggcgtcgttcgccgaggactacgggcggatccgggaacggatcgggcgggtcgtgccgggctgcgacgactacgcgcaccgggtcgacaacggcggcttcacgatgccgcacccgccgcgcgacgagcgccgcttccccaccccggagggccgggcggtgttcacggtcagcccgctgcaggtgatgagcgtgcccgcggggcggctggtgctgcagacgctgcgcagccacgaccagttcaacaccacgatctacgggctggacgaccggtaccggggcatcagttcggggcggcgcgtcgtcttcatcagcgcggccgacctggccgaactcggcttcgccgacggtgaccgggtggacctggtctccgagtgggacgacggcgagcggcgagccgagcagttccggctcgtcgagtacgacacgccgaagggctgcgtggccgcctactacccggagacgaatccgctggtcccgctcgactcacaggccgaggagagcggcacacccacctcgaagtgggtgatcgtgcgcctggaacgccggtga

SEQ ID NO: 1053 - DNA, 582 bp, Actinoplanes utahensis
gtgggtgatcgtgcgcctggaacgccggtgaacccggccgcggccggctgggcggagacggcggcagcccgggtcgtcgcctgggcgcgcaccctgccggcggggccggcggggcggcgggtgctggtgatcgagggccggtccgggtccggcaagacgacgctggcggtcgcggtcgcggcgcggctcccggcgccgatcatccacatggatcagctgtacgcgggatgggacggcctggcggccggcgtggaggcgctgcgtgaccgggtgctggagccgctcgcccggggccggccggcggtgtggcggcagtgggactgggcggccggccgctacaccaccgaacaccgggtgccggacggggactggctgatcgtcgagggggtcggcgccggcgcgaccggctgcccgatcgccgggacggtgtggctggacagtccggacgacctgcgccgggagcgggcgctggcccgtgacggggacctttacgcgccgcactgggaacgctgggcgcggcaggaggagaagcttcccgacgtgcgcgggcaagccggcctgatcatcgcgaacggggcatga

SEQ ID NO: 1054 - DNA, 831 bp, Actinoplanes utahensis
atgacggagcagcggatcggggtcagcggggcgaccgggcaactcggcgggcgggtggctcggcggctcgccgacctcggcgtaccgcagcggtcgctcgtgcgggacgtgtcccgcgcgccacgactgcctctcgccgaggccgccgcggcgccgttccacgaccgggacgcgtgccgggcggcgatggccgggctgcggaccgtgctgatggtgtcggcgtccgagacgccggaccgggtggtgcagcaccggacgttcgtggacgccgcggccgaggccggagtggagcatctggtgtacatctcgttctacggggcggccccggaggcgacgttcacgctggcgcgcgatcactgggcgaccgagcggcacattctcgggtccgggatggcggccaccttcctgcgggacaacctgtacgcggacttcctgccgatgctggccggcgaggatcgcgtgatccgcgggccggccggggacggacgggtcgccgccgtcgcgcaggacgacatcgcggacgccgcggtggcggtactgcgcgacccgggacgacacgcgggacgggtgtactcgctgaccgggccggaggcgttgagcctcgccgaggtcgcggagatcgtcggggcccgctatcacccggagaccatcgacgaggcgtacgcgtcgcgggccggctacggggcgccgcagtggcaggtcgacgcgtgggtgtcgacgtacaccgcgatcgcggccggcgacctcgccggggtcaccaccgacgtggcggagttgatcgggcgggcgccgatcacggtggcggaacttctggcccggccccgtcgatga

SEQ ID NO: 1055 - DNA, 1359 bp, Actinoplanes utahensis
atggtcaggacacgaccgtccaacgaggtgctcgcccggtgcctcgccgagctccgctggagtccccggaccctggcccggcggatcaacgccgcctacggccccggcaccatctccgagtcggcgccgtaccactggcgcgaccgcgggcgggtgccctatccgccggtggcggaatacgcggcccgggtcatcgccgaggcgctgggccggccgatcgccaccgacgcgttgtggacgagggcatcggactcgccggaggcggcgagccgcggactcctggacatcctcgaccgggcggcgtcagacggcgagcggcttcccgacgtcgcgcgagaatacctgtgccgggaaccgggcccgttgtcccgagcccgcgagcacggctccggcgtcgagctggtgcggtcggccgagcggggcgtcgacgcgctgcgcgaggctgccgcgggggccgagggcctggacgcgctcggctacgtggcggcgcagttccaggcgacgcggctgctcctcgggcaagggggccgcagcgacgggctgaaccggcggctgctgctcgtcctggcggagttggcgcagctcgccgcgtggctggccgttgacgccgaccggcaccgggaatcccggcgctacctggtcaccggcctgcgcgccgcccacgagggcggcagccgccggctcctggcgcacctcctgcgagacctctcggccaacatggccctgcaggggcgtcacgccgatgcggtggccatcggggaggcggccctcgccgcagccgccggtaccagggccaccggggcgttcgccgcgggacagctcgcgtacgcgcaggccctcgccggcgacacccgctcggcgtgccggacggcggaccaggctgccggatggatcgccgcgacccccggcggggacgagccggaatgggtgcgacgggtggccgccgacacggccgggccgatggctgcccggactctgctgcagctggcccgggacgaacgcgcccggggccgccgggccagcgcccggacgctggtccgccgggggatctcgctgctgcgtccaccgaccctgctcgaaccggaccatccgcacccgcgggccgccctctacgagggcatctacctcgccggtgggcacgtgatcagcggtgagctggagcaggcctgcgtggccggacgcacggtgctcgaccggtgggaccgggtccggtcgcgtcgcggcgcacacctgctccgggaggtcttgaccgacctgcgccgcagcgggcgcgaccggggcgtccgggagttcgtcgcgcacgccgagaggcggctgcgcctcatcgacggggccgggccagaagttccgccaccgtga

SEQ ID NO: 1056 - DNA, 804 bp, Actinoplanes utahensis
atggatcacgaccaccacgacgacatcttcgaccgcggcctccagttcgacctgaagacgctgctgggccgcaggcggatgctcggcctcgccgccggcgtcggactcgccggtctggcggccgccactcccgcgttcgcgaaggcgtcggacgactccccgctcgccgcggacgccgccgcctgccggaccattcccacggagaccggcgggccgttccccggcgacggcacgaacggtccgaacatcctcaccaggagcggcatcgtccgcagtgacctgcgcaccagtttcgacaccgggtccgccaccgccggcggcgtcaccctgaccctgcgcctcacggtgctgtcggccgccacctgcgccccgtacgacgcggccgcggtctacctctggggatgcgaccgggagggccggtactcgatgtactccgccggtgtcacccaggagaactactgccggggtgtacaggcggccggctccagcggccagctgacgttcaccacgatctttcccggctgctacccgggccgctggccgcacctgcacttcgaggtctacccgagcctggcccgggccacctcggcgagcgggaaactcaagacctcgcagctggcgttcccggccgacgtctgccgcaccgtctaccagagcgccggctatcaggccagcatccccaacctcgcccgggtctcgctgtccaccgacggggtcttccgggacggatacagccagcagatggtcaccatctcgggcagcccgcagtccggatacctcgcgagcctgacgatcaccgtgtga

SEQ ID NO: 1057 - DNA, 1689 bp, Actinoplanes utahensis
atgaatgcggacgtgaagactcccctcaccgccgccggtgagctggcgatgctcgtcgacagggccgctcgcctggtgcgggatccgcagcgtcgggtggcgctcgcccgtgacgggatcgagcgggccaccgcgctgggtgacgaggtcgcccgcgtgcgctgcaccgcgatggtcacggagttcaccgcccgccacggccaaccggtggacgccctgtccacggcgctgagcctgatcggcgaggccgttgttctcggcgacccgctggcgaccgcgcaggcgcatcacacggcggcgatgtgtctgcaccttctcgattgcgtcccggagtcgatggagcacgggtacgaggcgctggacgcgtaccggaagtccggcgatgcctacggtgagggccgggtgctcagcctggtcgcgacgctcctggcggagatgggcgaccggcgacaggcgctcgagctgttggaacaggcacacggtctgttcctggcctgtgccgacgcgagcggcgccgcgacgatgctcgccatgatggcggatggtcagcgtgagatcggtgatccggtcaccgccgccgagaccggcgagcgcgccctgcggctcttcggcgacgcggggatgccggtggacgcacaacgggcgatgacggcgtacgcgcacgtcctggcggacctgaaccgcctggacgacgccgagcggtggctcggccgggcgggggcgcacaacaggctgcccgacggcgccatcgccaaccaggggtatgagatgcatcggctcctggtcctggtgcgctcggtgctgaacccctcgatgcgctgggatgcggctcgcgaaacgctggagcgcgtcatcgccctggccggcgggctgcgttcgcagcgctccgaggcgctggccgagtcactgctcgccgaggtgctgcacgcgaccggtgacgacgccggggcctacgaccacctccttcgctgccgggagctcgccgacgccgccacgcgcggtgcgcaggaacgccgcacccaggctcttcgggtgcggttcgaggtcgcgcaggcgcagcgggaggcggaacgctaccgccggcaggccgaggcgcaggccgcgatcatcgccgaactggagcaggcccgggcgacgctcgccggccagatggccgatctccagcggctcaacgaagaggtgctgcacctgagccggaccgacccgctgaccggcatcgcgaaccgccggcgggtgaccgagcacctcaccgcgctggccgaacgcaaccaccggtacgacgcaccgccggtcgccatcgccgtcttcgacgtggatagattcaagagcgtcaatgacgggtacgggcacgaggtgggtgaccgtgtcctggtcgcgttgagccggctgatggcggatcacctgcgggtcatcgacctgccggcccggctcggcggtgacgagttcgtgatcatcatgcccggcctcaccgtggagggcgccctccgggcctgccaccgcctgctcgaggcggtacgccgccatccgtggcagcagctcacccccgggctcgcggtgcgcatctcgatcggggtcgccgacggcaccggagtgaccgatccggacgagatgttgcgccacgccgatgcggcgctctatcgcgccaaggaggccggccgggacgcggtggtgaccgcctcgcggccctga

SEQ ID NO: 1058 - DNA, 390 bp, Actinoplanes utahensis
atgcgtaaaacgacacggagcctgaccctcgccggagcgggaatcctggccgccgcactggcctcacccgcccaggcgtcgccggtgaacgtgccggacgccggcggcgcatcggggcaggcccagcgctccgacgacgtggccggcttctacaacacccgggccgcctgcgaggagatcagccggatcgggtccgcgatcggggcgtgggatgcccccgactgcaggacggcattccacggcgtacggcgaatattcgtcctgatcgtggacttcaacgatgatgggcagccggtcccggccggcgggccggggaccggcttcccgggcggggggcagcaagggccgggtgcggggcccggcggcggccagcaaggacccggtgcctag

SEQ ID NO: 1059 - DNA, 234 bp, Actinoplanes utahensis
gtgccgatcgtcgccgtgccggtcgccgtgccgctcagcgtggtgccggtcgtggtgccggtcgccgaaccattggccgcggactgcacgccgatgctcaccgacgaggccggcgcggttcccggctgcccggcgcccggcgcggttcccggctcaccggccgtgcccggttcgctggcggacggggtgggctgggcggctgtgcccggttcgctggcggacctagctagctag

SEQ ID NO: 1060 - DNA, 360 bp, Actinoplanes utahensis
atgagaacggcgacgaaactggccgtgatcggcggcggggcgctcaccgcgctcgcgatgacggcactgccggcccaggccggcggaaagccggacaccgggtcggcctgtgccgacttcaaccggatcggggccgagaccggcctgtggggccgttacgactgcgcggactggcgggtcgaccacagcgaccgggtgctgatcgtgcgacaccacggtgcggccacggtccgggtcgacgaccgctggccggtcatcgacatcggccgggatctgccgcgggcgggcgacctgccccaggtgatcaacatcaacgggccgtcgggcgcctacaccattccggtacggccaccccggtag

SEQ ID NO: 1061 - DNA, 207 bp, Actinoplanes utahensis
gtgctccccggccgccgccacccgggccctcagccgccggccatggcgcccaccaccatgaagggttcctgtccggcggcgacgcgctccggcaggggcgcgtccggcggctcgttcgacaggtcctcctcgcaggcgaagaagcggaccagcggccgccgtctgccgctcacccggtcccggatggtcccggtcagcatcgggtag

SEQ ID NO: 1062 - DNA, 1116 bp, Actinoplanes utahensis
atgacccatattcggctgctggttggcacacgcaaaggcgcgttcatcctgacctcggacgggacgcgcaaggactggcgggtcgacggcccgcacttcgcgggctgggagatctaccacctcaacggctcgccggtcgcccccgaccgcctgtacgcgtcccagtcgtccggctggttcggccaggtgatccagcgctccgacgacggcggccgcacctgggagccggccggcaacgacttcacctacaccccgccggtcggcgaccacctctggtatgacggcaccccccgaccgtgggaattcaaacggatctggcatctcgaaccgtcccgcaccgaagcggacaccgtctacgccggagccgaggacgccgcgctctaccggtccaccgacggcggccggaactgggcggagctgaccgcgctgcgccagcactccaccggtcccacctggcagcccggcgccggcggcatgtgcctgcacaccatcctgctgcaccccaccgacccgcagcggatgtacgtcgcgatctccgccgccggcgccttccgcaccgacgacggcggcaccacctggcagccgatcaacgccgggctccgctccgacggcctgcccgacgaggacgccgaggtcggccactgcgtccaccggctcgccctgcacccgtcccggcccgacaccctgtacatgcagaagcactgggacgtgatgcgcaccgacgacgccggcggccgctggcgcgagatcagcggaaacctgcccaccgacttcggcttcccgatcgcggtacacgcccacgaaccggagacgatctacgtcgtcccgatcaccagcgactcgctgcactacgtgatggacggccggctgcgtgtctaccgcagccggaccgggggagagcggtgggagccgctgaccgcgggactgccccaggaacactgctacgtcaacgtgctgcgggacgccatggcggtcgacacgctcgacgactgcggcgtctacttcgggacgagcggcggccaggtgtacgcgtcggccgacagcggcgacacctgggccgcgatcgtgcgcgacctgccgccggtgctctccgtcgaagtccaggtgctgccgtga

SEQ ID NO: 1063 - DNA, 1539 bp, Actinoplanes utahensis
gtgcggttgttcggatcccggcagacggccccggaagtctcccggcccaccccgcgcgacgtcgaagccctcgaagagctgatcctggctctcgacgcggcgatcgacgacgtcaccgcctggcggatcacggtggccagcacggtcgagtcgtacgacttcggctacggcgccgtctggctggccgacggcggccagctgcgcctgctgcacgaggtgggccggatcagcgggcaggtgcaggcggccggcgccggcacggtgacacgtggcgacaccggcctgatcgggcaggcgttccgcacccgccaggcggcggtcgccgagaaccccgccgactgccgcgactgccgacgctgcgaggcggcgatgcgcgccgggatggtggccggggtggcactgccggtcaccaggggcagcgaggtgcttgccgtgctggagtactactcggccagcccgctgcacctggacgcggcccgccgggagaagttcggcgccatcacccggatcgccgaacgcgcccggaccagcgcggtcgccgcggccgagctgcgccaggcggccgacgaccggaacgcgatcaccaccgtggtcaaccggctcggcgcggcccaggacagcgcgaccgccctgcgcgccgccctggacgcggtccggtcggcgttcggctgggcctacgggtcgtactgggaggtcgacccggacgagaacgtgctcaagttccaggtcgagtccggctcggccggcgacgagttccgccgggtcacgctggccgccaccttcgccgagggggtcgggctctccggccgcgcctggcgctcccgcgacctggtcttcgtccgcgacctgcaggagctcaccgactgcgtgcgggctcccgcggccgggcgcgccggggtccgctccggcgtctgctttccgatcatgagcggtgaccgggtggtcggcaccatggacttcttcaccagcgactacatcgagctgtccgaatcccgggcggccgccctgcgcaacgtgcagcagctggtcaaccagcgtctcgcggtgctgcgggccggcgagagctcggccgccaacgcgcgcgccctgctggacagcgtcgaccggctccgcaacgccagcggcgacgccaccgcggtcgccgaacaggcggtcagccgggcctccgcgatgaccaccgaggtggccgcgctcggccaggcgtccgccgcgatcggcgacgtcatcaagatcatcgagtcgatcgccgagcagaccaacctgctggccctcaacgccaccatcgaggcggcccgcgccggcgagtccggcaagggcttcgcggtcgtcgccggggaggtcaaggaactcgcccgggagaccgccgaggcgacccagaaggtggccgaacagatcgccggcatccaggccagcgcggagacggtggccaccggcatccacaccaccagcgagacgatcggcaagatggacgccgtgcagatccggatgaacgaggtactcgccgagcaggcggagatggcccgggccctgcagggctag

SEQ ID NO: 1064 - DNA, 1284 bp, Actinoplanes utahensis
gtgggcggatatgggtggcaagtcgtcctcgtcgtggtgctcgtgctgctcaacgcggctttctcgggcagcgagatggcgctgatctcactgcgcgagagtcagctgcagcgtctggagaagcagagccgttccggggcgaccctggcccggctggcccgggatccgaaccggttcctcgcgaccatccagatcgggatcaccctggccgggttcctggcctcggcggccgcggcggtctccctggcacagccgttgatcaagccgctcgggttcctgggggacgcggcaaagccggccgcgatcgtggtggtcaccatcgtgctgacgttcttcaccctggtcatcggggagctcgcgccgaaacggatcgcgatgcagcgggccgaggggtgggcgctgctggtggcccggccgctggacgtgctggcctcgctgtcgcgaccggtggtctggctgctcggcaaggcgaccgacctggcggtccgcggggccggcggggatccggacgccggccgtgaggaggtctccgccgaggagatccgcgacatggtggcccagcagcaggagttcaccccggagcagcggaccatcatcagcggggcgttcgagatcgccgaccggaccctgcgggagatcctggtgccacgccgcgacgtgctgatcctgccggccgaccagccggccccggagagcctgcggcggctggtcgagggcgggcattcacgggcgccggtgaccgggccgctcggcctcgacgacgtgctcggggtggtgcacctgcgcgacctgatcgggtcggacgggccggtgcgcgagcacatgttcaccccgctgttcctgcccgagacactgaagatcgccgacgcgctgcgccagctgcgcacccagcggcagcagttcgcgctggtcgtcgacgagcgcgggtcgatcgacgggatcgtcaccatggaggatctggtcgaggaggtggtcggcgagatctacgacgagaccgaccgggacgtgcagtcggtggtgcgcgaggaggacggcgcgatgctgctgcccggcaccttcccgatccacgacctgccggacatcggcgtggagatcgacgaggcggacgagggcgactacaccacggtggccgggctggtactggcccggctggggcacatcccgacggtgccgggcgaactggtggcgatcgacgggcacaccgccgaggtcgtggagatcaccggccgggcgatcacccggctgcggctgcgcccgctggaccaggagacggtcgacgcctga

SEQ ID NO: 1065 - DNA, 1236 bp, Actinoplanes utahensis
gtgctcacgatcatcgcgctcgcgctgctgggcgtggtgctcggtttcgccgtactgcgcccgcgcggcctgccggaggcggtcgccgcggtcccggccgccctgctctgtgtcgcgctagggctggtcccggccggtgccgccgtcgccgaggcccgcgagctgctgccgaccgtgctgttcctggccgccgtactggtcctggcgttcctcgccgaggagcacaacgtcttcgggtacgcgggtgccgtggtcgcccggatcggccggggccggccgggccgcctgctgaccgcggtcttcgcggtggccgcggtgaccaccgcggtgctcagcctggacgccaccgtggtgctgctcaccccggtggtgctgaccgtcgccgcgcgggccggggtgcggccccgcccgcacgtctatgcctgcgcgcacctggcgaactcggcgtcgctgctgctgccggtgtcgaacctgacgaatctgctggcgttcgcggccagcgggctgagcttcgccgggttcgcggcgctgatggcggccccgtggctggcggtgatcgccgtcgaatacctgatcttccggtggttcttcgcccgggacctggccggcaccgcgcagacccccggcgaccccggcccggccccgcgatacgccctgatcgtgctggccgtgaccctggccgggttcgccgccctgcagccgctcggcgtgcagcccgcctgggtcgccgcggccggcgcggcagccctggccgtgccgctgttgcgccgccgcatgatcggtgtgccggccctggtcgccgagaccaacccggcgttctgcgcgttcgtcctggcgctgggcgtcgtggtgctggcggtccgctcacacgggctcggcgaccggatcgacgcgctggtgccgcacgacgccggcctgtccgccctgctggcggtcgccgggctggccgcggtgctggcgaacgtgctgaacaatctgccggccaccctggtgctgctgccggccgccgcgcactcgcccggcctgctgctggcggtcctgatcggggtgaacgtggggccgaacctgacctacaccgggtcgctggccaccctgctctggcgacggatcctgcacgtgcgggacgcggcgccgcgtacccggcagttcctgttgctgggtctggccaccgtgccgttgtgcatgctcgccgcggtcctggcgctgtgggtggggttgcgggtcagcgcgctgtga

SEQ ID NO: 1066 - DNA, 630 bp, Actinoplanes utahensis
atgtcacttggtgacatgaccatagcgcacgtgatgtcagcctgtgacatgactacgatcacgggcatggtgcgatgggagccgggagccggcgggcggctgcgggaggcggcgctggagctgtatgtcgagcgcggctacgagcagacgacggtggccgagatcgcccagcgggccggggtgaccgcgcggaccttcttccggcacttcgccgacaagcgggaggtgctgttcgccgggtcgcaggagttgcaggacgggctggcccaggcggtgcgggccgcgccgccggcgaccggcgcgctgggcgccgtggaggcggcgctggaggtggcggccgagtggctcgggcgcgaccacccgcactcgcggcagcggcagtcggtcgtcgaggcgaaccccgagctgcgcgaacgcgagctgatcaagatggcccggatcggcgccgcactcgccgaggggctgcgccggcgcggcgtgcccgacccggaggcgaccctggccgccgaggtcggcatcgtgacgctgcgggtcgccttcggacagtgggtgtcccggcccgagcccagcgacctgggcgcgctgatgcgcgagacgctgagcgccctgcgcgccgtcacagcgcgctga

SEQ ID NO: 1067 - DNA, 222 bp, Actinoplanes utahensis
atgcacgtcttcgtcaccggcgccagcggctggatcggctccgccaccgtcaccgacctcctgcgggccggccaccgggtcaccggcctggcccgctccgacgcggccgccgcccggatcgccgcgctcggcgccaccccgctgcgcggcgacatcgaggacctcgccggcctgcgcgccgcggccgccgccgcggagggtgtcgtccacctcggctactag

SEQ ID NO: 1068 - DNA, 414 bp, Actinoplanes utahensis
gtgcacggcgccggcgaccacggcttcctcgccaccctggtcaccatcgccacaaccaggcaggtcgcggcgtacgtcgagagcggcgccaaccgctggcccgccgtgcacgtcgaggacgccgccgccctggtccgtctcgccctcgaggccgccccggccggcaccgtcctgcacgccaccgccgagcagggcgtccccacccgcgacatcgccaccgccatcggcgcgggcctcggtctcccggtcgcctcgattccggcggaccgggccgacgagcacttcggctggatggcccgcttcttcacgatggacgctccgacctccagcgaggccacccagcagctgctgggctggaaacccaccggccccaccctgctggaggacctcagcgccggccactacttcgcctga

SEQ ID NO: 1069 - DNA, 636 bp, Actinoplanes utahensis
atgagcctgtcatcgatggccgaggacagcgccctgcgcctgcagggcaccccgggcgtctccccgaaggcggccgccgccaccgcggccgccgtcaccgccgaggaaatggtcaagggtgccccgcccgacgacgccaagaccgccggtgagaacgccgcccgcctctccgccggcaccagcgtcaccggctcggtcctcacccaactcgtcaagtacgtccccaccgagaccatctcggtctacctggccgtccaggcggccctcggcaccgtggccgccccgcccgggcacccggagtgcgaggccgacttcacctcccgctgggtgtggctgctgctgctcgccgtcgccaccgtcctgctgaccatcggcctggcctaccgcagccagaaacaggtcgcccccaccgcccgcttcaaggtcccgctcgtcgaacccgccgcggccaccgccgcctatctggtctgggcgctgtcgctgccgacgacaccgctcaaggacgtctgctcctacaacgccacggcgtggggcccggtcctgctgctggccggcaccaccatcatcgccaccaccgcctacatcttcggcaagaccatcacctggcagaaggtcctgcaggacgccgaccgctga

SEQ ID NO: 1070 - DNA, 993 bp, Actinoplanes utahensis
atgccgatcaaacggtacggcgttctgcgggccgccgtgatcgatcgaaggatcgagacctctgacactccgcattatcagattcagttgcgcgccggcggtatcgattatcgggccgcggtgaatgtgcgctcccagcagtcgccgccggaactgctctacctggcggtcgacgcgttcgcgcacccggttctcgaccagctgcgccggcttccggacggtttcaccgagctggagagccggtcgggtgggccggccctggactacatccggagcaatctgttccagcggccggacatgcgcccggtgccgaccgccgagccgggcccggagaatgatctcggcgatttcctcgaccaccatgtgcggcgggcactgggggatgccgacgcccgggcctacgttttcggtcaggcctgggggccggaggcgatcgaggacaagatcttccacttctcccccggcaacggtgtgcacgatgtgcacatgaaccagggcaacgagggccggttcgccggtgacgacggtgtctatcaggacggcgcgctgctgctgcagttcggtgacgcgtgggtggcgatcttcctggccttccagtcgcaggcctggcacaccgacgacatcaccggccacaagctcccggacgtgcccggccccgggccggcgtccaccgaccgccgggtgcgcatcgtcgcggcgctggccgatccggccggcccggccccggagcgggagacggtcaccctggtcaacgccgggccgtccgatcaggacctgtccggctgggcgctgctcgaccgcgccggcaaccggcaggcactgcggggcgcgttcccggccggcggcgccttgcaggtgacgctcaccgccccggtggcgctgggcaaccgcggcggcacgatcaccctgctcgacgcggccggcctcaaggtcgacggggtcgcctacacggccgaccaggccggccgggagggctggacgatcgtcttctag

SEQ ID NO: 1071 - DNA, 561 bp, Actinoplanes utahensis
ttgctctacggaaccccgactacgcgccgccgggacgcccagcgcaaccgcgcggccatcgtcctggcggccagcgaggtgctcaccgagggcgacccggtgtcactgatgccggagatcgcccggcgggccggcgtcggacaggccacgctctaccggcatttcccggaccgcccgacgctcatcgccgcggtcatcgagtatcagctggagcgcctggaagaggccgcctcggtgctgctcgcccacccggagcacttccggaacctgctgcgctcggtgctgcacgcccagatcgccatgcgcggcctggtcgtgctgatccggcggctgtcggtcgccgcccagaaccggtaccggcagcgggccctcgccgccctcggcgggccgctgcggcgcgcgcaggagcacggctacgtccgcgccgatctcgtccccgccgacctgaccctgctgttcaccatggtgcagggcgtcgccgaggcggcggcggacgcggcggccgcgcgcgcggccgccgatcgctcggtcgatctgatgctggacggcgtcttcatctag

SEQ ID NO: 1072 - DNA, 321 bp, Actinoplanes utahensis
atgctcggcacggtcaccttcaccgacccgcacggcccgggcaccctgcgggtgagccgctggccgcacccgcccgccgacgtggccgccgccctgaccgccgaggaacgctcgatccggctgcccggttaccaccgcacccggatcgacgacaccgtctgggagtacacctggaccgacccggccgccggcccgatgcgcggcgtgcgccgggcggtgcccacgaccaccggcacctacgtcgtcgaatggcgcaccccacgcaaccaatgggcagctgacctgcccaaactcgcgattgtcctggagacgctcgactag

SEQ ID NO: 1073 - DNA, 996 bp, Actinoplanes utahensis
atgtatgtcgggatcaccggggtgggcgcgtaccttccggagcgcgaggtcaccacggacgagctgcaggacggcgtggcccgctccggcggcatccgtctgcccggtggcctgttccgccggctcaccggcatccagcggcgccggatcgccgggcccgacgagtacgcgtcgacgctgggcgtgcacgccgcccgggccgcgctgcaccgggccgagctggacccgctcgacatcgacctgctgctgttcgcctcggcgtcgcgggacatggtcgagccggccaccgcgcacatcgtgcagaccgagctcggcagtcgcgcccacgcgctggacgtcaccaacgcctgcaacagcttcgtcaacgggatcgacatggcccgggcgatgatcctggccgggcgggcccggcgggtcctggtggtgaccggggagaccccgagccgggtgatgcgcggccgggtggacagcatcgaccaggcgcgccgctcgttcgccgggttcaccttcggcgacgccggcgcggccgtggtggtggagccggtggcgcgcggcgggatcctggacgtcgacaccgagacacagtcgcagcactgggcggtcggcggcatccccggcggcgggtcccggcatccgcgcggcgacgagcacacctacttcgccggggacgggcaccggctgcgcggcgtgttcgagaaggtcggggcgagcatcctggaccgggtgcgggcacggaccgggctggagctcaccgattacgccaaggtgctggtgcaccaggtgacgctgccctacctggaccggttcgtcgaggtcaccggggtgccccgggaccgcctggagatcaccgtggacggggtgggcaacgtggcgagcgcgaccctcggcgtacaactcgatctggtcttcgatgatctcgcccccggggagcgggtgctgctcatgggcctcggcggcggggtcagcatcatgaccatggtgtgggagcggtcgtga

SEQ ID NO: 1074 - DNA, 738 bp, Actinoplanes utahensis
gtgaccccgctctgggtcatcgtcccggcgttcgacgaggccgcccggatcggcgccaccctggacgccctcgccgcgcagaccgaccgcgacttcaccctgctggtcgtcgacaacgcctcgaccgacgccaccgccggcatcgcccgcgacttcgcccgccgggcccccttcccggtgcacgtgctcagcgaaccggagaagggcgtcggctgcgcggtcgacaccggcttccggcacgccatcgcggccggcgcccggatgctcgcccgcaccgacgccgactgcctgccccggcccggctggatcgccgccgcccgccgggcactcagcgccggcgacgtcctggtctgcggccggatcaccgcccggcacgacgaacacggaccgctcggacgcgccgccttcgccgggctcgtcggcctcgccgcggccttcggccggatccgcccggcgcaccgcggcgacgcctacctcgcgccgtaccggatgcacgccggcaacaacatggcgatcaccgcccggctgtacgaggcgtgcggcgggatgccgcgccgcccctcgccgaccgaccgcaccttcctcaaccgggtccgcgccaccaccgaccgcatcgtgcacagccgcgacatggtggtggagaactccacccggcggctgcgcgcctacggcgtgatccgcaccgcccgctggtatctcgaccgcggcagcggcccgctcaccccggacccgcggtga

SEQ ID NO: 1075 - DNA, 336 bp, Actinoplanes utahensis
atgctcgatgaactcgacgccggcctgcggcccggcgacgacaccacggcgttgctgcgccgccgccggatcacccgcggagacctcgccgacctacggctgcggtacgcggcggccctgcacgcccgcggcctgcgccccggcgacaccctcggcgtggcggtccgccccgggccgcgcgcgctggcggtcctgctcgccgcctaccggatcgggctgcggatcgccgtgctcgacccgtccgccggccccgacgtactgctcgcccgcctgagcctggcccgcccgtcgctgatcctggccgacgccgccgcccaggccgtcgccggctgctag

SEQ ID NO: 1076 - DNA, 936 bp, Actinoplanes utahensis
gtggtgatcttcacgtccggcaccaccaccagcccgcgcgcggtcgtgcacacccgggccgggctgggcgccgggatgcgcgcggtgaccgccctggtccggccacgcccgagggtaccggtcctcggcggcatgttcttcgtgatggtgcccgccctcgccggcggcgcgccggtcgccgtacccgcccgccggccccgcgacctggcccggcagatcaccgggttgtgcccgcaggccacctacctgaccccgccgcaactgcgcgccgccctcgacgccggggtgccgatgcgcggccgcgtctacagcggatcggcaccggtcaccgccaccctgctcaaccgggtccgggccgccggcgccgacgaggcctggtgtgtgtacgcgctgaccgaggtcttcccggccgccgccgtcgaagcggccgagaaggcggcccactccggcgacggcgacctggtcggcaccctgctccccggagtccgcgcccgcctcaccgaccggcgggaactccaactcgccggaaccggcgtctgcgaccgctacctcggcgccgaaccccacgcctgggtgtccaccggggacatcgcccgcctcgacggagaccgggtggtactcgccggccgggccaaggacatgatcctgcgacgcgccgagaacatctaccccggcctgtacgaaccgtccctgcacgtacccggcgtcgccctcgccgtcctcgtcggggtgccggccggcgacggcgacgaggaggtcgtggcgatcgtggaaaccgcgcccggagccgacgagacagcggtacgcgccgccctgcgcgaacccctgcaccggatgggatcggcccgccccgaccggatcgtcttcgcgacggtgccgctcaccgggcgctcccggaaacccgaccgggccgcggcggcggcgatgtgccgatga

SEQ ID NO: 1077 - DNA, 759 bp, Actinoplanes utahensis
gtgccgatgagaaccctcgcggtgatcgtgcccgcctacaacgagagcacctcgatccgggccactctggcggcgctggccgcccagaccgaccgggacttcaccctggtcgtggtcgacaacgcgtcgaccgacgacacggtggccgtggtccgcgccttcccgacgccgttcccggtcgagatcgtcaccgagccggaacggggcgccgggaccgccgcggacaccggcttccggcatgccatcgcgaacggggccaccctgctgtcccgcaccgacgccgactgccggccggccgccgactgggtggcgaccgcgcgacgccacctgaccgcgggagccgacctggtgtgcgggcgcagcaccccccgccgcgacgaacagccgaccctcgccgagcggtacgtcttcccggcggcggtccgggcggcggcactctacgggagataccggaaggcacaccggcaggccggattccgtacgccgtacgtactgatccacggccacaacctggccctgaccgccgacctgtaccagcgctgcgggggcaccgcccgggaagccctcgaagccggatccgaagacgtcaccctgctcaaccgggcccgccggcacacctcccgcatcgtgcgcgccgaagacctcgtggtcgaggccagcctgcgccggctgcgagcatggggcgcgcgccggaccctgctctggtactgggaccggcggtggcgcccggacaccaccgcggaggtgcacgtccgatga

SEQ ID NO: 1078 - DNA, 432 bp, Actinoplanes utahensis
atgagccgacgcgaccgacgggtctacctgtccagccacccgctgctgttcgcgctgctcgccgccacccgcggccgcggggtgcgccggatcggcgcgacggtgctggcgcactccaccacggcgttccgggacggcctgacccgggtgccactcgaccggaccgcggcgggaaccaccggcggggcggccggcgaactcaccggcggcgatctgttgttcaaccaggacggcagcgagcatcgaggggcccggcgcgggctggcactcggcgcgggcgaggtggaccggctgcggccggtctggaacgcggtgctggaccacgggctcgcaccgctggccggcggagggacgatcgaactcgtcgagctggccgccgagatggcgggagcgacggcggcggcgctgctgcgggtcgacctagctagctag

SEQ ID NO: 1079 - DNA, 471 bp, Actinoplanes utahensis
atgctcgcggtggcggcgatcaacaccacggtcgcggcagtcccccgggcggcggcctggtgcgccgactcggacctgtggcactacgccgaaacccacctcgaagcgctgacgtcggaaatgctccgggtgaccgcgccgaccccgctgctgccccgggtcgccgcggcggacggcgtgatcgacggctgcccggtgcgggccggcgaccgcctgatcctggtcacccggcacgccgtcgacgcgcaccgccgccaaccgtgcccggccgacccggcgccggcgcagaccgcgcagctggtcttcggcaccggaccgcacgcctgccccggggcgcggctggcccgcctgcagctcagcgacgccctgcaggccctggccaggttccggccgcgggtggtcagcgctcgcgtcgaccggcgaagcgctctccccgcctggtcccgtctcaccctggcgcccacccgatga

SEQ ID NO: 1080 - DNA, 1002 bp, Actinoplanes utahensis
atgaccgacccggcgggctggaacggacgcaccggcacgcccccggcggccgggaacgaacccaccggcacacgcgtagcgggcggggacggagccgccggcacgcgcccggcggcctcgaacggacttgccggcacgcgcgtggcggtcaccggcgccagcggattctgcggctcggcggtggcccgcgccgccgcggccgccggcgccgacgtcatctgtctcggccgccgccccggcccggtcggcgagcaccgcttctgggacgccacccgcaccctgcccgacctgaccggcgccgacctcatcctgcacctggccgccgcggtcggcgacccgccccccggccgggtcgcggcggccgccttccacgcggtcaacgtggacggcaccgcccggctcctggacgccgccgccggccgtcccctggtctgggtgagcagcgccagcgtgtacacccccagcccccacccgatccgggaggaccaaccactgggcgggctcaccgcgtacggccgatcgaaagccgccggcgaacgcctcgcctcggccggcggcgccgtgatcctgcggccccgagcggtctacggcccgggcgacccgcacctgctgccccggctgcgccgcgccgtgcgcggcggccgggtgctgatgccgggcccggacattccgctcagcctgaccgctgtggagaatctggccgacgcctgcctggtcgcacaccggtggcccgccggcgcctacaacgtcgccgacgcggaaccgtaccgccgcgacgccatcatcgctgccgcctgcggggtgccggtccagcacgttccgctcggcgcggcccgcgcggccgccaccgtcgcgacggcgatctcccgcctgaccgggggcgaagccgccctttcccggtacgccctggaacaactgaccaccccggtcgtcctgaacatctcccgagcgctgtcccagggctggcgaccggcccgcaccttcgccgacttcctgcgatga

SEQ ID NO: 1081 - DNA, 621 bp, Actinoplanes utahensis
atgatcccgacgagcgccgcggaggccgagcccgtcggccgccgccggggccgcccgccggacccccatgcccgttcccgcattctcaccgccgccgagaccctgctcgacgaggccggctatctgaacgtcacgatcgacgaggtcgccacccgggccggtgtctcgaagaagaccgtctatcgcttctggccgcacaaaccggccctgatcagcgatctgatcgtcgagcgttccgcggtcctgccggtgccggacaccggtgacacccgccgcgagctggccaccctgttcggcatgatcatcgagtacctgaccgccggtcacggccgcacgatggccctgctggtcgccgccacgcacgacgatccggccaccctcacccgcctccgcgagcaggtggtcgccccgcgccgggacatcgcccgcaatgtcctgcagcggggcatcgcccgtggtgatctcccggccgacgtcgacgtcgacgcgctgctggatctgtggcatggcctggtcgcctaccggatcagcgggcgccccgcggccctgcaccggcacaccgtcgaccagttggtcgatctggcgttgaccggccacgtcccgcgcctgccgcaaacctga

SEQ ID NO: 1082 - DNA, 978 bp, Actinoplanes utahensis
atgcccactccatccggacggctcgcccgcccacccgcgtggaacgcgaccgtgccccgccagctcctctggttcatgctggtcggcgcgttgagcacggtcctgcagacgatcgtgtacgtctcggtccgcgacgtcctcgccgccacctgggccagctggctcgcgctgctggtggtcaccccggccaacaccgaggcgcaccgccgcatcaccttcaacgtcaagaccaccgcggtcgcccgcctccacggcgaggccggcctcacctcggtcgtggtgtacctggccaacctggccgtcgccccatggttcgccggcatcgccggcccgcacccggcaccgctcaccgaatccctgatcctcgccgtcaccggcagcctgatcggcggcgcccgctacgtcatcctccgcggctgggtcttcgccgcccgccgccacacccccgtaccctccaccaccgcagccccgaaactcacggacccgcgcgccgccggcctgaaggctgcgggtgcgggtgcttcaggtaccggggatctggacgatctcgacacggtggatcccggcgcccttgtcaccgcggatcggggcaccggagatttcgccgtcggtggcctcgccccggaggcacccccgtcgcagctcgtcggcgcggccacgtcagccgggaccgcgggcgcctccgacgacaggcgccgcaatgcgccgcgccacggtcgtccccctcgcatcatcccgggcgaaccggccgcaccccacagcaccgcccagcagtgcgtcccgggacaggccgccgacggatctttcgccggcaccctcccactggccgcactggcctgcctgggcaccatggctccgatcccggccgcccgcctgtgcctcggccagcccggcacaggggtcctcaatcaacgcccacccggccgtctccgaacctggcaccgcaaccgccgccggcacctcaccgcccgcagctga

SEQ ID NO: 1083 - DNA, 354 bp, Actinoplanes utahensis
gtggcactcgcactcccgatcgccgcgtcgttcgccgtcatctcggcgctcgccctgatcatggcccggctcgtcgacaccgaccggctggatcgcaacgcggccttcggcatccgcaccgccggcaccaaacgcagcgaccaggcctggaaagccggccaccgcgcggcccagcccctcacccgcgccctcggcatcaccggcctgtgcttcgcgatcctcatcctcggggtggccttcaccggcgctcgcaccgtcgtgacggtgactgccgtcctcggctacgccggcatggtcaccctgctcgccttgatggcccaccgggccgacaccgccgcccgttcctcatcctga

SEQ ID NO: 1084 - DNA, 567 bp, Actinoplanes utahensis
gtgccaccgcagaacctcccgccccgggacgcgatccgccgtgcggccggggacctgttcgtccgggacggttacggcgccaccacggtgcgggccatcgcggcggcggcggggtgcgacccggcgctggtgatccggcatttcgggtccaaagagggcctgttcctggccaccgtctcggtgtccggcgacctcaccgcgatcctcgccgccccgctcgacacgatcggccgcgagctggtccgctacgttctggacggcgccggcagcccggtcgccggcgtctaccgcgcgttgctcagtgcctccgaccgcccggagatcaaggatcgcctccgcgcctccatgcacgacgtcttcgtcagcccgttggccgaacgcatcggcggcgcctaccccgagctccgtgcccgcctcgccgccgcccagttcgccgggctgatcaacgccttctggctggtcggcgacccggtcctggccgacgccgaccgcgacgccgtgatcaccctctacggcgacgccatccagcgtctgctcacctgcgacgatcccgcccccacggtctga

SEQ ID NO: 1085 - DNA, 1452 bp, Actinoplanes utahensis
atggctggttccgatgcggctgcatctggggcggctggttctggagcggttgcgtctggggtggctggttctggaacggctgcgtctggggtggctggttctggaacggctgcgtccggggcggccgggacaggggcggccaagtccggggcggctgggtctgcggcgggcacgccggcggcggctaccgaggcggcctgcggcatcgggaaattcgcggccacgtccgaagccgacctcgcgaagatcaccgtgctcgatccggggccgctcgcccccgacctgcccgccctcgccgacgtccggctcgccccggccactggtgaggtcgtcgccggcaaccacaccgggcgcagcgacgccaccgcgagctatgccgacgccaagctgctcggcatgcacctgcccggcctcccgctgcacgacgcggtcgccgcccagcacgcccccggcggcccacgcggcccggtcgacgtcaccctggccaccctcaacgccggcggcctggccaccgcccgactcggcacggccaccgccgccgccacctggaccgacgggtaccactgcggccgcaccggcccgctcacccgcgccaccaccatggtccagggactcagcctgctcggcggcgccggcggagtcccggccatccaggcggtcgacgccctcacccacctcacccggcggaccagcctgctcaccgtcggcccgaccggatccacgcggagcgccaccgccctggtcaagctcggcgggggccggatcggcgtacgctccggggccggcgtcgccctcggcgacgtgatcctgttctcgggaaccccgcaggagatcaccgccaaggtgatcaaccagcccaccctggaagtggtcgccggcggcgaccggaaacactccaccgtcacctaccaaccggccaccctcgcggtcacctcggccggcaaacccgtccccggcctcaccggcgaccagaccagcgtcagcctcaacctgctcggccgcctcgccgcggaccgccccgcgtcaccgctgtcggtacggatctccgtcggcaaggtcacccggcacctcagcgacaccgtggtccgcgccgaagccgcatcgctgcgcgtcgaggtcaagctcggctcggcacacctgctcgacgtggcgctcggctacctgaccgtcgccgccaccgcaccgtgccggatcggcgccccggtgccccgcgaccgggttcccgccaccggccagccgggcgacaccccgggcgacacgcagcagaccacccccgccacccaggtggtcgcgaccaccaccccgcaacccggcacacccggatccggatccggcgccctcgccctgaccggctccaacgtcgccgcggtgggcctcggcggcctggcgctcatcgccggcggcctgaccgccctcttcttcacccggcgccgctacaccgccaagcactga

SEQ ID NO: 1086 - DNA, 108 bp, Actinoplanes utahensis
atgccgatcgctcgtgcggcgaagaatgttccgtcgctgaccgcgccccgccgcgccaaccgggcgtcccgtccccggggtgccgcacccgccgtcctagctagctag

SEQ ID NO: 1087 - DNA, 1749 bp, Actinoplanes utahensis
atgacgaccgtcgcgccgcggccggtgcagacccgttcctggccggtccgccgccaggtgcgtgggtcatggctggcccgcaccatccgcaccaccgatgccaagcagatcggcatcatgtacatggcgaccgccttcggctggttcgtcatcggcggcatcctggccctgctgatgcgcaccgagctggcccgccccggcctgcaactgctctccccggagcagtacaaccagctgttcaccatgcacggcacgatcatgctgctgttcttcgcgacgccgatcgtgttcgccttcgccaacttcgtcgtcccgatccagatcggcgcccccgacgtcgccttcccgcggctgaacgcgttcgcctactggctctacctgttcggcggcctgatcgcgctcggcggcttcctctcgcccggcggcgccgccgacttcggctggacggcgtacgtgccgctcagcggcggtggtcactccccgggcgtcggcggcaacatgtgggtcgtcggcctggcgatctccggcgtcggcaccatcctcggcgcggtcaacatgatcaccacgatcctgtgcctgcgcgcccccggcatgaccatgttccggatgccgatcatgacgtggaacatcctgctcaccagcctgctggtggtgctggtcttcccgttcctggcggccgccctgttcgcgctcgccgccgaccggatcctcgacgcccaggtgttcgccgtcgccaccggcgggccgatgctctggcagcacctgttctggttcttcggccatcccgaggtgtacgtggtggccctgccgttcttcggcatcgtcaccgagatcatcccggtgttcagccgcaagccggtgttcggctacaagccgctggtcgcggccaccctgctgatctccgggctgtcgatgagcgtgtgggcgcaccacatgttcgccaccggccaggtgctgctgcccttcttcagcctgctcagctacctgatcgccgtaccgaccgggatgaagttcttcgtctggatcggcaccatgtggcgcggccagctcagcttcgaatcgccgatgctgttctccgtcggcttcctggtcaccttcctgctcggcgggctgaccggggtgctgctcgcctcgccgccggtcgatttccacgtgcacgacacgtacttcgtggtcgcccacttccactacgtgctgttcgggacgatcgtgttcgccgtcttcgccggcatctacttctggttccccaagatgttcggccggatgctcgacgaccggctcggcaaaatccacttctggctgaccttcatcggcttccacaccaccttcctggtgcagcactggctgggtgccgaggggatggcccggcggtacgccgactatctgcccggcgacggcttcaccacgctgaacaccatctcgacgatcggctcgttcatcctcggggcggcgaccctgccgttcctctacaacgtctggaagtcgtaccgggtcggggaactcgtcaccgtcgacgacccgtgggggcacgggaactcgctggaatgggcgacgtcgtgcccgccgccgctgcgcaacttcgaccggatgccgcggatccggtcggagcggccggcgttcgacgcgaaattcccggaactggcggtggaggggcccggcgggacgccggaggaggggtctctgctgcggggggagcagctggagggtgggctcgaaccgggccggcaccacaagcgcaattcggactaa

SEQ ID NO: 1088 - DNA, 1518 bp, Actinoplanes utahensis
atgatgtcgtacccggtggttaggctgcggatcgtgaggggggatccgagcattctgcacgtcgacctcgatgcgatgttcgccgcggtcgagcagcgggacaagccctcgctgcgcggcaagccggtggtcgtcggcggggtcgccgggcgcggcgtggtctccaccgcgtcgtacgaggcgcgggtcttcggggtgcgctcggccatgccgatggcccaggctcgccggctcgccccgtggagcacggcctacctgtcgccccgcttcgccgcctacaagcgcaccagccaggtggtgatgcgcctgctggccgaggtgtccccgctggtcgagcaggtcagcatcgacgaagcctatgtcgatctcgcggccgtcggcggcgacctgagcgtgcgggcggtcaccgagctcgccacggacctgaaggcgcggatcgcggtcgccaccggcggtgtgaccggctcgatcggcgccgcctcctccaaactgctcgccaagatcgggtccgacctgcacaagccggacggcctcaccgtcgtcgctcccggtgacgagctggccttcctgcacccgctgccggtcaaccggctgggcggcgtcggcccggccaccgagcagcgcctgcaccggtccggcgtgcgcaccatcggcgacctggccgcggtctccctggaacacctgaccgactggttcggccagtcgcacggcgccggcctgttccggctggcccgtgcgcaggacgaccggccggtggtcagcgagcgcgaggcgaaatcggtgtccgccgaggagaccttcgacgtcgacgtcaccgacccggtccggctgcgccacgagctcgacctgctcgccgcccgggtggccggccgcctgcgctccggcggcctggccgggcggaccgtcaacatcaaggtccggcacggcgacttcaccacgctgacccgggcgttcacccgcgaccacccgaccgacgacggccgactggtggcgcagctggcccgccggctgctcgccgagctggacacgtccggcgggatccggctgctcggcgtgggcgtctccacgctggccgacttcgcccaggacgacctgttcgccgaggagcacgccgcggccggtcgaggggcgctgatcgggctgctgccggcggccacggtgcccgacgagccggccatcgcggcgcccgaggagccggagccggcggtccccgcggcggagccggcggccgggccggtggtgtggcggccggggcaggacgtggtgcacgacgcgatgggggccggctgggtgcagggcagcgggctggggcgggtgaccgtgcggttcgaggggccgctgaccgggcgcgggccggtgcggacgttcgccgtggacgacccgcggctgcaccccggcgagccgccggagtgggtggccgatccgcagccgcggccgggggagccgccggatcgggcggacgattcggggccgacagcgggtgacccggcggatgggccgggcgcggacgggggatga

SEQ ID NO: 1089 - DNA, 1407 bp, Actinoplanes utahensis
atgctcggatcccccctcacgatccgcagcctaaccaccgggtacgacatcattcccggtacgacattcccggtacgacgggagcgaaggagccgactgatggcgcaggacggactgacccgccagtcgaccctctaccgggccggcacggtgggccgccgccccgtggtgccggccgacttcgccgagctggagcgccgggcgcggcgcgtgagcagcgccgcggcctgggcctacgtggccggcggtgcgggcgagggccggaccatgcggcgcaaccgggcggccttcgaccgctgggcgatcgtgccccggatggcggccggcgcggtcgaccgggacctgtcggtcgacctgttcggcacccggctgcccagcccgctgctggtcgccccggtcggcgccggcgcgctgatgggcccggacagcgacgtggcgatcgcgaccggcgcggcggtcaccggaacgccgtacatcttctccaatcagggttgcaacccgatggaggagagcgcggcggcgatgggcgacaccccgcgctggttccagctctactggagcaaggaggaacggctggtcgacagcctgatcgcccgggccgaggcgatcggagcgggcgctctggtcgtcaccctggacaccaccgtgctgggctggcgcccgcgcgatctgaacctgggctcgctgccgttcgcccggggcctgggcatcgcgcagtacacgtccgacccggtcttccgggagatcgtcgcggagcgggcacggcaaccgcaggaccggccacgggtcacgctcggcgcgatccgggcgctgctgcggatgtcccgcaaccatcccggcccgttctgggcgaacctgcgctcgccgatcccccgggccagcgtggagaccttcctcgacatctactcgaaccccgggctgagctgggagcacctggccacgctgaaggggcgcacccggctgccgatcgtgctcaaggggatcctgaccgccgatgacgcgcggcgggcgctggcggtcggcgccgacgcgatcgtggtgtccaaccacggcggccggcaggtggacaacgcggtcgccgcgctggacgcgctggtcgagatccgcgcggcgctcgggccggagccgacgctgctgttcgacagcggcatccggaccggcgccgacgtgttcaccgcgctcgccctgggcgccgacgcggtgctgctgggccgcccgcacctgtacggtttcgccctggccggcgcgcacggtgtggccgaggtgatccgcaacgtgatcgccgagctcgacctcaccatggccctgaccggggtccggaccatcgcggagatcacccgcgaccgggtccgggctgaaccggccgggccgctcggcggtatcccctcgatgaaggaggtcgactga

SEQ ID NO: 1090 - DNA, 1860 bp, Actinoplanes utahensis
gtggctggtcggaggtctgctgatcgcgatcggcctgccgaccgcggtgatcccggtcgcgatagcgaccctgcggtcactgcgcagctggggaacgcagggcgcggcgtacggttcgctggacgacccggtgctgcgccggcggatcaaggcactgggcgccgtgctggtcgtgctgggcctggtcgcgttcctgtccggggcgaccatcgaggcgctgatctacgccgcgaaccacgcgcacccgccgatcccgctgccgctgatcctgctgttcgggctgatcccgtccggcctgctgatgttcctcggctattcaatggtcaacgccggccggctgaccctggccggggacgcggagggcaccgatgcgggcttccggctgggttggatcctgaccggtttctgcgtggtgttcggcggcgcggtcaccgatccgcggccgttctggcacatcgccggcctgatcgcgatccccaccggggtgaccgccgtgctctcctgtctcgcactgcgcgcgttgcgcaagccgatgaccgaggcccgccaccgctacttcgaggcgcgggaggcccagctccgggccgaaagagcccagccctagcaccaccgctggcagcagaccgtccccgcgttccggtccgtcgacgccacgaccgcgccatccgcgcgtacgtccaccggggcgctgccgggcaccagcttcccggctaccacgaacggcgccggcgcatcgatggacagcggcgattaatcggctgcagggcgggtcggggtggcggcagactgtccgccatgcactccgcgttcacggtgaccccggctcagctgcccgccctgctcctgcaggtcgcggtggtccggccggtgttcctgtggggcgcgccgggcatcggcaagagctcgctggtccgcgacttcgccgccgcgctgggcctggagtgcgtcaccctggtcggcacccagctcgccgccgaggacctgatcggcgtccccgagctgcgcgacggccgcagccggttcgccccgcccgaggcgatcgcccgcgacgagccgtactgcctgttcctggacgagttgaacgcgtcgtcgccggaggtgcagaaggcgttctactcgctgatcctcgaccggcggatcgggtcgtacgagttgccgcccggctccatcgtgatcggcgccggcaaccggaccagcgacaacgcgctcgcccggccgatggcctcggccctggtcaaccgcatgatccacgtgcacctgcgggcggcgtgggcggactggtcgcggtgggccgccgacgcggggatccacccgtgggtgctgggctacctcaccgaacggcccgatcacctgtgggcaacgccgccgaagaccgaggagacgttctcgacgccgcgcagctggcacatgctctccgacgcgctgcactcgtgcggggacacggtcgacgaggacacgctgcgactgctggccgggggcacgctgagcccgggccacgccggggcgttcagcggctacgtcaagatcgtccggcaccggtacgggctggacgcgatcctgcgcggcgacgccggctggccgagcgctccgggcgaccgtgacctgctgtattttctggccgaggcgttccgggcacgcctggtcaaagatctcccggccgccaaggaccgggctcccgcgtccgtccggcagttcgcccaccaggccaaggcgctgctggtcgaactcgccgagctgaatttggagtgcggccgcctggtcatcgcggccgacccggacggcgctccggtgctgcccgcgtggtttctggtcgaggtcagccgcgacctgccgcgcctggtcgcagcgcgcgccgcctga

SEQ ID NO: 1091 - DNA, 1776 bp, Actinoplanes utahensis
atgggaaagaaatctgctcaggtcgatccccaggtcgcggcctttcaggcggcggccgggtcgctgcgcgcgcatccgatgttcgagcaactgttccgcgggtttcagcagccgagcgctacggtcacgctggtggaggattccggcatcgggttcgccctggtggatgccggtgggcggatccgggccaaccggacgaagcgcctcgacgtcgccgaatggacctgggtgatcgcgcactgtctgctgcatctgggattcgggcacctcgatccgtcagcggctcgtgatccggcctatcagcatgtcgcgtgcctcgcggtgacccgctttcagcgcgcggtgaagctgggtcgggagcccgggcagttcccggccgtgctgccgtccgccgacgagcatcgattgctggccgcttggcggcgttccggggtgccggccgccttcgccggttgcggcgcgggcacacccgacctcggcgcgcccgcgccggagagcaccgccggctggacggaccggttcgcgcgcggattgtccgcggcggcgaccgcggcggtcgacgtggccggcggcgcccgcgggtcgctcaccgggccggccgcgccgaaagccgcctgggatcgcgcgatgagctggttcaccgggtcgttcccgctgctcggcggggtggcggcggggttcaccgtggtggccgacgcggagctcgcgcggggctgggacatcgcggtggcggcggtctcgccggaggccggggagatctacgtgaatccgcgctgcgggctggacgggcagcagtggcgattcgtgctcgcccacgagatgctgcacgcggcgctgcggcacggcgaccgggtcggcccacgcgacccgtatctgtggaatgtcgcctgcgactacgtgatcaacggttggctggtggagatgggcgtcggcgtgatgcccgacggcctgctgtacgacccggcgctggccgggtcgtcggccgaggcggtctacgacctgatcgccggggacctgcggcggatgcggaaactcgcgacgctgcgcggcaggggacggggcgacgtgatcggcgagccgctgccgtgggccgggcggcgggccggcggggtcgacctggacgagtactaccggcgggcgctgctgaccgggcatgcctatcaccacagcggcgggcgcgggctgctgccggccgggctggaggcggagatccgggtgctggagcagccgccgctgccgtgggacgtgcggctggcacggtggttcgaggagcacgtgccggcggcggtccggcagcggtcgtacgcgcggccgtcccggcggcaggcgtccacgccggacattccgcggccgggctggcaccggccggagcaggtcgtgccgcgcggcaccttcggcgtggtggtggacacctccgggtcgatggacgagcggctgatgggcaaggcgctgggggcgatcgcgtcgtacgccaccgtccgggaggtgccggccgcgcgggtggtgttctgcgacgcggccgcctacgacgccggatatctgccggtcgacgacatcgccgggcgggtccgggtgcgcggtcggggcggcacgatgctgcagccggccgtcgacctgctggagcgggcggcggacttcccgcgggacgggccgctgctggtgatcaccgacggggagtgtgacgcgctgcggatccggcggccgcacgcgttcctgatgccgcgcggcgcgcggttgccgttcacaccgcgcggcgaggtgttcagcctgcggtga

SEQ ID NO: 1092 - DNA, 489 bp, Actinoplanes utahensis
gtgcagctcgcccaagtactcgacatcctgcgacaactgctgctgaccagcgcccatccggagatcgccgcggtggaccggttcggcaccgacccggcgcccggcggcccgtccccggccggtctgcgggtgcgctacgacacgggttccgaggcgtacctgtggggcgccgtctggcccggtgagacgccgctgccggtgccggagatcctgcccccgccgtcgctgcgcgccgcccgggcggccgccttcgccgcccagctgctggacgccgcccgcccggccgcgttccgctcctgggagctgctcgcgctgcccgatctgggcccggccgacgcccgcggcaaggtgccgctcggcgtgcggatcacctgcgccgacggcccggcattcctgatccgggccaccgcggccggcggcccgacccgggagccggacaccgagccgcaccccggctaccgcatcccggaggcactcaccgcaggctga

SEQ ID NO: 1093 - DNA, 384 bp, Actinoplanes utahensis
gtgcctgtgcgtttccttctcaacgttctctggttcgtcttcggctccgggttcctgctcgccatcggctacgggatcgcggccctgatctgtttcgccctggtcgtcaccatcccgttcgggatcgccgcggcccggctggcggtctactcgctgtggccgttcggccgcaccgtggtggaccggccgggcgccggcgccgcctccgggctggccaacatcctctgggtggtcctgttcggctggtggatcgcgctgcaccacctggtcgtcgggatcatgcagtgcgtgacggtcatcggcatcccgttcgggatcgcgaacttcaagctggtgccggtggccttctggccgctcgggcgggaaatcgtggacgtcccctga

SEQ ID NO: 1094 - DNA, 270 bp, Actinoplanes utahensis
atggagatcaacggcctgttcaccggcatcgtcttcggcctgatcatcggcgcgctggggcgcctggtcgtgccgggcaaacagcacctgccgatctgggtgaccctgctggtcggcgtcgtcgccgggctgctcggcaccttcgtggcgaccgccttcggggtggacgacacgcccggcatcgactggatcgaactcgccctgcaggtcggtctcgcggcgctgggtgtggcgctggtctccggagccggccggcggcgccgcctctga

SEQ ID NO: 1095 - DNA, 1215 bp, Actinoplanes utahensis
atggctcgcgtacgcgccgcactctatctggacttcgacaacgtgttcagcggactgatcaagcaggacccggacgtggcgatccagttcgccaaggatccgggcgcgtggttggtccgcctgaccacgtcgctgaccgtcgacggcccgcgccgctggctgatcctgcgctgctacatgaacccgggcggctgggtgcccaacccggacaccgaggccaaccagccccggctgtactactcgcagttccggccgttcttcgtgaacgccggcttcgaggtgatcgactgcccgcggctgacccacaccaagaacgccgcggacatccggatggtggtcgacgcggtcgacgcgctcgccgacccggtgccgtacgaggagttcgtgatcgggtccggcgactcggacatgaccccgctgctggtccggttgcgccgggccgaccggcgcaccacgatcgtctcgccgtccgatgcggccgaggccttcaccgcggtcgccgaccgcctgatcaccagccaggaactgctcgaactggtgcagggcgagccggtcgacagcgacgaggcgccggtcgacccggagcagccggtctcctacgagcagttccgcgacctggtcacctggcggtacaccgcggccaccggcccgctcaacctggcctcgctcgcccacgacctgcgccgccagctcggccccagcgtcgatgagacgagctggttcggcaacggcggcttcgtccgcgccctggagagcctcagcctgccgaacgtcaagttctccaaccacttcctgtgggacgccgcccgtcacgacccaccggaggccggggtcagcaccggccccgctccggaaccggtcggccgcctgtcggcgctgctcagcctgccccggctgacccgggagatgtggccgccgatctaccagtcactcgccgagtacgccgcggcccaccacttcaacctgaccgaggcgacccgctgggcgcgcgaccagctggccgcccagggcgtcgacgtgagccgcagcgccatcgccttcgtcacccggggcaccgccttcggtggcgccccgctctaccgccagccgccgccgaacgccaccgagatcgccgcggcgttcgccgacaacgtgctgagccgtgccgaggccgccgcgatcgcgctgagcgacgaggagaccgccgaggtccgctcctggctcggcgccgcttag

SEQ ID NO: 1096 - DNA, 345 bp, Actinoplanes utahensis
atgacaatggatgcgacgctagcggggcatctgcaggagttgcggcgcggcaccgtcgtcgtcgccagcctcaccgtcctgcgcagccccggctacggctactccctgctggagacgctcagccgggccggcttcgaggtcgaggccaacacgctctacccgctgctgcgccggctcgaggcgcagggcctgctgaccagcgagtggaacaccgacgagccacggccgcggaagttctaccggaccaccgcgcagggcgatgccatcgccgagaccctgcgcggcgagtgggcacgactcgacaccgccatcggcgacctggacctgaacgggagcgcgaaatga

SEQ ID NO: 1097 - DNA, 981 bp, Actinoplanes utahensis
atgaccaacctcgtcgaccgatacgtcttcaccgccctgcgtcgcatccccgagcagcagcgcgccgacatcgaccgggagctgcgcgcctccatcgaggacgcggtcgacgcccgggtcgacgccggcgaaacccgggaggccgccgtcgagaccacgctcaccgagctgggcgacccggagcggctcgccgaccggtatgccgggcgccccggccacctgatcgggccggatgtctatccgctgtggcgacggctggtcaccaccctgctctggaccgtgctgccgatcatggcgaccatctcggtggtcgtccagctcttcgaggacgccgacatcggcaagatcatcggcggggtggtcggcaccacgctcaccgtcggcacccacatcgtcttctgggtcacgctgatcttctggatcgtcgaccgcagtggcgccgccaaggggctccgcccccgatggagcgtcaaggacctgccgaaatacgaggcggcccgggccaccatcggccagctgatcaccggcgtggtgtggtcggcgctgctgatcctcgccctcgtgctgcagcagttcaccttcaccgacgtgccgctgctcgacccggcgaactggaccttctggtggccgctgattatcgccctattcgtgctgcgcgccctctaccatgtcggggtgcaccgggtcggcggctggacgcggacggtggcggcggtcaacctgctgctgaccgcggcgtacacggtgccgttggtgtggctggtcagcagcggccacttcttcaacccggccttccacggcttcctcgacgtccacggcggcgatgtccgcgactggaccggcacggcgatcatcgcggtcctggtggtcggcggcgcctgggacgtgatcgactcggtggtgcgcgccgagcggtcccggcgggggctggccccggccagggttcccgggtccggcgggggttacggcctcggctgctga

SEQ ID NO: 1098 - DNA, 375 bp, Actinoplanes utahensis
gtgaccacggtcctcgtggctgacgacgacgctgacatccgggacctggtggccttcaagttggagcaggccgggctcgaggtgatcacggtcggcgacggtcaggccgccgtggagcaggcgcgggcgcatcatcccacccttgcggtgctcgacgtttcgatgccgctgctgtccgggatcgatgtgtgccggatgttgcgggccgatccgtccaccgccggcatgctgatcatcatgctgaccgcccgggtacaggagcaggatgtcgagggcgggttcagcgccggcgccgacgactacgtgaccaagccgttcagtccgcgggagctggtctcccggatccaggccctgctcacccgcacccgcacctga

SEQ ID NO: 1099 - DNA, 450 bp, Actinoplanes utahensis
ttgtttacccatatgtcggtcggtcaccagctttgcctcagcctccactttcgcggccgccgccgtcctcgccgccatcccggcattcgcggcgggttcggcaccggtttcggccgcaaccgttccgcaacccgggtgcgcctgggctgcatcccggcagcggtgtcctggtttccaagcaaccaccgcgctacctcgaacggcccgggaggaccgatgaccgccctgatgaacgacgtccgcaccgaggcgctcttcgtctcggacctgcagcgctcgcagcagccgaccgcggagctgatccgcgaagcggtgtccgccaccgtcgaccgcctcggcgagaacggctgcgccgccctggtcgcccaggaattcggcgaacacccggactgcgcgatcggccgcatgcgctgggcccggtccgcggtacggctcgccttcgccgcctga

SEQ ID NO: 1100 - DNA, 1803 bp, Actinoplanes utahensis
atgcctttcgcctacctgcaccgtgacggtgccgaccatgtcgaggtgctcaccggtgacgtgatcaccgtcgatgtgcttgccgacattccgctggacccggggcggccggtgctcgcggtggtgccgtaccggcagatcgccgagcgcggattcgattgtgtggatgacggggcgccgctggaatgcctgctggtggatgcggtgacgacccggccgttgagtgatttcccggccggtgagctgcgggtttccggaggtgcgttcgatcgggacgacgcggagtacgggcagatcgtcgaggaggtgctgcgggacgagatcgggcacggggagggcgccaatttcgtgattcaccgggtgttccaggcctcggtggagggggatccggtggcggcggcgcgggccgcgttcgggcggttgctcgcccatgagcaggggacgtactggacgttcctggtgcacaccgggcagcggacgttggtcggggcgacgccggaacggcatgtcagcgtgaccgacggcatcgtgatgatgaatccgatcagcggcacgttccggcacgggtcgggcgagttgctcgactttctgcgggatccgaaagaggtcgaggagttgtacatggtcctcgacgaggaattgaagatgatggccacggtggccgagcacggcggccaggtcgcgggtccctatctgaagcagatgtcgcagctgacgcataccgaatacctgctggccgggcgtggttcgctggatgttcgggacgtacttcgggagacgatgttcgcgccgacggtgaccggcagcccgatcgagaacgcgtgccgggtcattgcccgccatgaacgccgcgggcgacgttattactccggcgtcctggcgctgctgtccgtttctgatgatgggacgcagtcgctggacgcacctattctgattcgcaccgcggagatcaccgccgacggcaccctgcgggtgccggtcggcgcgacgctggtccggcattcgacgccggcgggcgagatcgccgagacccacacgaaggccgccggcattctggccgctctcggcgcggcgaccattgcggtacgtacgcagcccccacccgccccgggcgatgaggcgctgcgcctgctggcggcccgcaacgtggatctggcccggttctggctcgactcgcgggaggccggggcgctggtcgtcccggcgctggccggccggaccgcggtgatcgtcgacggtgaggacacgttcaccgcgatgctggcccaccagctcaaggcgctcgggctggccgtgtcggtggtgccgtggtcgtccccggttccggcggcggacctgctggtggtcgggcccggcccgggtgatccggcggacccggtcgatccgaagatggtcgcgatgcgcgcggtggtggccgaccggctggccgtcgggttgccgctgttcgcggtctgcctcgggcagcagatgctcgcgctgcggctcgggttgccgctgatccggcgggactcgccctatcaggggctggcccgggaggtggaactgttcggggtgcgccgccgggtcggtttctactccagtttcgcggcggtgtccccggccggttcgctggattccgtgcacgggccggtggagatcgcccgggatccggtggacgggacggtgcacgcggtgcgcgggcccttcttcgccggggtgcagttccacccggagtcggtgctgagccgggacggcatcgacgttcttcgtgaacttctgccgcctttgctggccgatgtggttagcccgctcccgaacgggtag

SEQ ID NO: 1101 - DNA, 762 bp, Actinoplanes utahensis
gtggtccaaggtgatcgagagcctcaccttggaccaccgccccgcgtcgagtccccctgccgcccccgctgcgggccgcgccgcaggtcggctgcccgggtccctgcggcgttgttcacaggggtagaaatcgcaggtcaccgcgcgaatgctggacgcatgccgatcgaagagcgcaccgcccaggccgtcgacgcgatcctcctccgccagcacggcgtgatcacctggcagcaggcccggcggcacctcagcgagaaggcgatccgccatcgcgtccggtccggccggtggagacgggtgcaccggggcatctatctcgcccacagcgagagctgcacccggcagcagtatctgtgggtcgccagcctcggcgccggcaacgggcggcccgcactcctcgccggcgtcaccgcgctgcaggtcctcgggctgcagcggctgcccgccgacccgctcccgatccacgtgctggtccacatcagtcggcccgaccgcgacccgccgcccggggtgcgggtccaccgcacccgtcggttgagcatggtggacgtctgtccgacgatcgccccgccgtgcaccaccgcggcccgcgcgctggtggacgcggtggagtgggccaccgacggcgacgacgcgacccgggtgctcgcggcggcggacggccagcgcctggtcagcccggagcaggtgcggccggtgctggcccggctcccgcgcctgtcccgccggcggctgctggagcgtgccttggcggcctga

SEQ ID NO: 1102 - DNA, 579 bp, Actinoplanes utahensis
atggaggcgatctactatttcgatccggcttgtccgttcacctggaccacctcgcggtggctgacctcggtcgccgcggagcgtgggatccaggtgcactggcgggcgttcagcctgtcgatcctgaacggggacaacacgcccgagcagtaccggccgatgatggcggcgtccagccgcgcgttgcggctggtggaggccctgcgggcggatggccgcgaggaccggatcggggcgttctacaccgcattgggcgaccgtacgcatgaggcgggcaccccgatcaccgacgcgatcgtggcggaggcggcggaggcggccggcgtggagaaggcgggcgagatcctcgacgacccggcgtgggacgaggcggtgcgggagtcgcacgagaccgcgttgcggctggccggtccgggcatcggctcccccgtgctgcacctggccggggcggcgcgtgggctgcacggcccgatcatcggcgaggtccccgaccgggcggagtcgctggcgatctgggacgccaccgcggccctgatgcggatcggcacgttcttcgaggtgaagcgcggccgcggctga

SEQ ID NO: 1103 - DNA, 273 bp, Actinoplanes utahensis
ttggccgagccgcacgtcaccctcgacccgctttcgctgaacccggtggagcagaagctgcgtggtccgttggaggaccagctcagttcggcgctgcaggccgcgacggtcaaagtccggcagcgctattccggggagagcgtggagcaggtcaccacgatgcttctcgatcaggcgagggccgggctgcacccggacatcgccgccggtttccaccccgaccacgagcaactgcgccacgtggccgaggcgatcgtgagcaccgcgaactga

SEQ ID NO: 1104 - DNA, 2625 bp, Actinoplanes utahensis
atggtgagaacggacgtgtcggagcgggatcggctggcccaggccgactccggcgagcagccgtggcgagcctggggtccctacctctccgagcgggcctggggaacggttcgtgaggactacagcgagcacgggacggcgtgggactacttcccgcacgatcacgcccggtcccgggcctaccggtggaacgaggacggcatggccggcgtctgcgacgaccggcagacgttctgcttcgccctcgcgctgtggaacggcaaggatccgatcctcaaggagcggatgttcggcctcggcggcgacggcggcaaccacggcgaggacgccaaggattactggtggtatcaggattccactcccacccactcctggatgcgctggcgataccactatccgcaggctgaattcccgtacgatcaattggttcgcgtgaatggccagcggtcccgcaccgaaagcgaatacgaactggtcgacaccggcatcttcgactccgaccggttctgggcggtgaccgtcgactacgcgaaagccggcccgcacgacatgtgcatcgcgatcaccgtctccaaccgcggcccggagaaggcgagcctgcacgtcctgcccaccctctggttccgcaacacctgggcgtggggcctgccgaaccgtccggtcccggagctgaccggcactcccgggcggctcaccggccggcaccgctcgatcggccagatcaccctcgacgccgagggcaagccgccggccctggtctgcgacaacgagaccaacgcgcagcggctgtggggactgcccgggcgcagcccgtaccccaaggacgggatcaacgacttcctggtcgacgacgcgccgacggtcaacccggccgggaccggtaccaaaggttccctgcactacctggtcaccctcaagcccggcgcgacccggacgatccggctgcggctcacccagagcgacgccccgcccgccccgctcgacctgggccgaggctggaccgcggtgatgcgcgaccggcaggccgaagccgacgcgttcttcgccgggatcatcccggcggcggccaccgaggaggaggccgcggtcgcccggcagggcatcgccggtctgatgtggggcaagcagttctaccacttcgacgtgaagcagtggctggtcggcgacccgggcaacgcgccgccgccaccgggccggcgccacggccgcaacaacggctggtggcacatgaacagcttcgacgtgatcagcatgcccgatccgtgggagtacccctggtacgccgcctgggacctggccttccactgtgtcagcatcagccgtgtcgaccccggcttcgccaaatcgcagctgctgctgctgctccgcgagtggtacatgcaccccaacggccagattccggcgtacgaatggtcgttcgccgacgtgaacccgccggtgcacgcgtgggcggcgctgcgcgtcttcgagatcgacggcggccgcgactacgacttcctgtcccgggtgatgcacaagctgctgctcaacttcacctggtgggtcaaccgcaaggacgtcggcggcaacaatgtgttcgagggcggcttcctcggcctggacaacgtcggcccgttcgaccgctccgccgcgctgccggtcgccggtgtcctcgaacagtccgacggcaccggctggatggcgatgtacgccctcaacctgctggacatggcgatcaatctggcgctgcacgaccgggcctacgaggacatggccaccaagttcttcgagcacttcacgtacatcgccgaggcggcgtaccggcagggcctgtgggacgaggaggacagtttcttctacgacgtgctgcggctgccggacgggcacaaggtcccgctcaaggcccggtcgatcgtcggcctgctgccgctcgcggcgaccacccggctcacctcggataccctgaaccggctgcccgaggtaaacgcccgggtccgctggatgctgcacaaccagaccgactacggcgacgtgatcagcgcccgccggctcggcggcgccgaccgccgccgccagcggctgctcagcatggtcggccaggagcaactgctgcggatcctggccaggttgctggacccggaggaattcctctcgccgtacgggttgcgcaccctgtcccgggcccacctggagaaaccgttcacggtgtcgctgggcggctccgacttcaccgtcggctacgagccggcggaaagcaccagcggcctgttcggcggcaactcgaactggcgggggccggtctggatgccggtcaactacctgctggtggaggcgttgcgggagttcgccgagttctacggcgaagacctgcgggtggagtatccgaccgggtcgcagacgaaggtgtcgctgaacgaggtggcggacgacctggctcgccggctgatcgccctgttcgtcccggactcgacggggcggcggccgatctacggcatgacggaactcttccagacccacccggactggaaagacctgatcgtcttcccggaatacttccacggcgacaacggcgcgggcctgggcgcctggcaccagaccggctggagtgcgctggtcgtcgacctgatcctgaccctgcacgactga

SEQ ID NO: 1105 - DNA, 1830 bp, Actinoplanes utahensis
gtgtccaccgtgcgcccgatcaccttcggaccgcaggtctgtaccgatctgaccagtggatcgtctcgtgaatggctggtacccgacggggtggggggctatgccatgggcaccgtcacagggctgcggacacggcgatatcacgggttgctgatggtggccggggacaccccggcgtcccgcatgttgggcctggcttctctcgatccggtcgtgacgctgccgtccggagcgcgggtgcggctcgcctgccacgagtgggcgggcggcgcgatcgagccgcaggggcacaccctgttgtccggtttcgccctgatcgacgggatcccacgctggcggtggcggatcggcgacgtggtgatcgagcgggagctggcgatggtcaccggccggccggcggtcgccgtcgtgcaccggctgatctccggcgggccggtgcagctggccgtcgaggcgctgtgcacctggcgggaccagcactcgtcgggcttctccggcatgtcgctcccggtcgcggacggctgcgtcttcgccggcgcctaccggatcgccgggccgggcttcgccgcggccggcgaacgcttccgcaaggtccactaccgggccgaggcgtcgcggggcctgccggccgaggaggacctgtggtacgcgggcagcttccacgccgcgctcgacgcccccgggaacatctgcgagatcgccgcctgggccggtgagctggacgatccgccgccgccggcggcccgggtggtggacggggcacgggcccgcaaccggcggatcggcacggatccgctcaccctggccgcggacgcgttcgtgatccgcacgcgcaccggaccggacgtgatcgccggctacccgtggttcggggcgtggtcccgggacacgatgatcagctacgaggggctcttcctcgcgaccgggcgggttgccgaggggcgcgagctgctcacggcgtacgccgcacatctgtctgaagggatggtggcgaacaccgcggacaccggccgcgtcgagtacaacaccgtcgacggcacgctgtggttcatgcacgcggtcgaccggcacgtcaccgtcaccggcgacaccgatctcgccgcggaacttggtccttccctcaaaagcatcattcaccaccatattgccggtacgcggtacggcatccgtgccgacccgcacgacggcctgctccggcagggcgccccgggcgaggccctgacctggatggacgcgcgcgtcgacggcgtgccgatcaccccgcgctcgggcaaggcggtcgaggtgaacgcgctgtggatcaacgcgctggccaccctcgacgacagtttcgcgccgctgctgcaccaggcgcgggacagcttcgcgcggtccttcccgaccctgtccgggctgctccaggacgtgctcggcgagcacacgctgcgcccgaaccagctgctcgcctggtcgctgccgcacgcgccgctgcgccccgacccggcggtgctgacccggatcggggcggccctgctcaccccgatggggctgcgctcgcaggcgcccggcactcccggctaccacgggcggcaccggggcgggccggccgagcgggacaccgcgtaccacaccggaacggtctggccctggctcaccgggccgtacgtgtcggcctggcgccggctcggccgtgacgtccccgacgtgctggccgacatcgaccaccacctggccgaatacgggctcgggtcgatctcggagaccgctgacggggacgccccgcacaccggcaccggctgcccgttccaggcctggtcggtcgccgagcacctgcgggtccgtaaattctga

SEQ ID NO: 1106 - DNA, 1476 bp, Actinoplanes utahensis
atggatcgcacccggctgtggcggctctggctcgccttcgccgctctctgcgcgctgttccgctgcgcggggcagctcgccggcctgccgttccacgtgtacgagatcccctacatgatcgtcacctgcggcgccccgctggcgatcttcgccggtatcgcgatcaaccggccggcccgccggtccggctgggtcgtgctggccctgggacaggtctcgtacgcggtggcggacgtcatcttcagctacaacgtgttgaacaacagcgaacaggccgagcccgcgctcagcgacgtcttctacctgaccagttacgtgctgatcggcgcggcggtgctggtcttcatccggcgccgcacgcccggctggcacctggccagcgcggtcgacgcgctcgtcctcgcgctgtcgagcggcctgctcagctgggtcttcctggtcgggccggtggctttcgacccgaccatctcgttgccggcgaagctgaccgaggcggcatacccggtgctggacctggtgatgctgctgctcgccgtacggctggtgctcggctcgggcgcccgcagcgtcgccctgggcctgctcttcgcctacctcggcaccatgttcgtggccgacaccggatacgccgtcctgggcatcctcaccgcgcagaacgccagcgagccgttcaccggtggcctctacgccacctcgatcggcctgttggcggcatgcacgctgcatccgtcgatgcgggacttcgaaacgcgcagccaggtcgcgccgccggacgccacccctgcccgcctgaccatgctgacctgcgccgtgctgatggtccccggcctgcagttcgtcgagcaccaatacggccgcgacctgagcatccccctcaccagctccacctgcgccgtgatgtttctgctggtcatggtgcggatggcgggcctggtcgcggcccagcgccgggccgccgacaccgacggcctgaccggcgtgtgcaaccgccgccacttcgaacaggtcctggccgccgaatgccgccgcgccgcccgggtcggctaccggatcgccctcctcatgatcgacattgaccacttcaagaagatcaacgacacctacggccaccccggcggcgaccgcgtcctgcgcgaactcgcccagcgcctggccaccggcgcccgggccggctcactgatcgcccgctacggcggcgaagaattcatcgccctcgtcccgcacatcaccggcgacgacctgccactgatcgccgaacgtgcccgcctggccgtcagcggcctgcccatcccggtcaccggccagaccctgatcaccgtcaccgcgtcgatcggggcggccgcggccaccggaccgctcgccgacccggcggaactgctgcgggcggcggacgaggccctctacgcggcgaagtcggcgggccgcaaccggtcggtgatcgcacccgaggtccgcgccccggccccggccgcctga

SEQ ID NO: 1107 - DNA, 486 bp, Actinoplanes utahensis
atgcctgcctccgattacgtccggaaccttcgcgaccgcgtcggccaagagctgatcatgttccccacagtgtccgcgatcgtcctcaacgaccgcggcgaggtgctgttgcaccagcgcagcgacaacgcccgctggcacctgatcgccggcctgatggaccccggcgagcaaccggccgacgcggtggtccgcgaggtcgaggaggaaaccgcggtccagatcaagatcgaacgtctggccggcgtggtctcacacgacgtcacctacctcaacggtgatcaatgccaaatggtcaacgtcttcttccgctgccgcgcgaccggtggtgaggcccaggtcaacgacagcgagtcgctggcggtcggttggtttccgctggacgccctccccgagctcgacagtttcacccagcgcatgctcgcgttggctcttgacgagaacgcgcctccctatttcgccgctcccggtgaaggcggtttctga

SEQ ID NO: 1108 - DNA, 672 bp, Actinoplanes utahensis
atgatctcggtggtgttggccgacgaccaggcgctggtccgggccggattccgcgcactactcgacgccgaacccgacatccgggtcgtcggcgaagccgccgacggcgtccaggccgtcaccctcgtccgagccacccgacccgacgtggtgctgatggacatccgcatgcccggcgtcgacggcctcgaagccacccggaggatcgtcgccgacccggtctgcgccgacacccgggtggtcatcctgaccaccttcgaactcgacgaatacgtcttcgaagcgctccgcaccggcgcctccggcttcctcgtcaaggacaccgaaccggtcgaactgctccgcggagtccgcgccgtcgccgccggcgacgccctgctctccccgagcgtgacccgccgggtgatcggcgaattcgccggctccggcaccggccgccggcccgaaccgccccgcgaactcgaccagctgaccgaccgggaacgcgaagtgatggccctggtcgccgaaggcctctccaacgacgagatcgctgcccgcctggtgatcagcccggccaccgccaaaacccacgtcagccgaacgatgatcaagctgggggcgcgggatcgggctcagcttgtcgtctacgcctacgaggcgggattgatccggcccggctggctcgcctga

SEQ ID NO: 1109 - DNA, 1434 bp, Actinoplanes utahensis
atgaggaagcggcggaagcgggcaacccgggcctgcgggccgccggtcgagcccggtgggccgccctggcgccgccgcatccgcgacgcgcaccgcggctggccacccggcgccaccgtgatcaccgcggtcgtccacctgggcggcgtcagcaacctgatcgcgcacggcggcctctaccgcccctgggacgtcctgaccaccctcacgctgatggccggcccactcgccctgttctggcgccggcaggcccccatcctggtcttcacggtcgccgccaccgccacgatcatcttcgccacccacgccatgccgcacctggcctatgccgcggctgccgccgtcgccctctactgggtggcccgccagggccgccgccaagccgcgctgatctgcggcgtcaccgcctgggccggctgggtcggcgtcaccgtcggcctctccggccggctcggcctcaaccccggcgtccgcccggtcgccggtcagacctgcctggtcgccgtcctgctcggcctggccgtcctgctcggcggcgccgcccgcatccgtgccgagaactacgccgaacaggcccgcacccgggccgaacaggcgcgcgcccgcgaggagcaggaacgccgccaagcctccgaagaacgcctgcggatcgcccgggagctgcacgacgtcctcggccaccacctgtccctgatcaacgtccaggccggcgtgggcctgcacctgatggaccagcgacccgaacaggcccgcgaagcactcaccgcgatcaagagcgccagcgccgaagccctccgcgaagtccgctccgtcctcggcgtgctccgcaccgaaggcgaagccgcgccccgccaacccgccctcggcctcaaccggctcggcgaactcaccgccacggccggcatcccggtccgcaccaccatcaccggcgaaccgcgggatctgcccgcggaggtcgaccgggccgcgtaccgcatagtccaggaagccctgaccaacgtccgccgccatgccggaccgcaacccgaagcggatgtcgcggtcagttatctgccggccgcgctgtatctgtcgatccgtaacggcggtccggcgccgtccccggcgcctcccgggcccccggcgttgccgctggccggcgatggcatggtgggcgtgcgggtctcggggccggcgccggccggcgacgatgggaacggcgtcgtgggtgtgcgggctccctcgtcgccgccgggtggtgacggcgagagcggcagcggcatcgtgggcatgcgcgcccgggcggaggcgctcggcgggcgcctcgaagcgggacggccgccgaccggcggcttcctcgtgacggtcatcctgcccaccggccggccggaacccgacgaaccggcggccccggacaccaccgacaaccgtgtgaccacaaaggggaatcgatga

SEQ ID NO: 1110 - DNA, 825 bp, Actinoplanes utahensis
atgatgggtccgtcgcacgcactgtcgggggcggccgcctggctggccggcagctgggcgctcgaccagttcgccgattatcaccagtcaccgctgatgatcggcgtgggcaccgcgatggccgccgggggtgcgctgatgcccgacttcgacctgtccggcaaggtgaccaccaatcagggcggggccacggtggcccgcaccttcggggtgttctcgctgttcgtggccgaggtgatcgagaagatctcgctgggcatctacaccgcgacccggcagtcccgggacccgaagcgggatcacgggcaccggaccttcacgcacacgctgccgttcgccgcgctggtcggctggggcaccaccgcgctggccgcgcactacggcaagtgggcggtggtcggcatcatcttcttcatggccggtctggcgctgcgcggcctgttcgagaagtgggcggagaaggccggctggctgatcgtcaccctggccgccgccgcgatcgcctggttcaccgcggcgaacctgcccggcgaccggggttatccgctgctcggtttcgcggtcggcgccggctgcgtggtgcacctgctcggcgacatgatcacgaagaacggtgtgccgatcttctggccgatcccgaccggccggggccggatgtggcggatggtcggcatcccgaaccgcttcgcggtgaaggtcggcggcaagaccgagacggtgatcctgagcaccgccttcaccatcgtctcggtggtctcgctgatcggcctgttcgccccggtcctgctggaccgtctccacctgaacctctgggcgtcccggtag

SEQ ID NO: 1111 - DNA, 843 bp, Actinoplanes utahensis
atgactcccgccgggggccgtacaccggcggcgtccggcacccgggcggccactaccgtgacggatgtgacgaccgccgccgacgccgcctccccgcccgatccgccgcccgacggctccacatcgccggccgacccggcctcggcaggggagacgccgcccgccgggccggcgggtcgtccccgccgggtccggggcgagcagacccgcgaactcatcctcggtaccgcgctgcgtctgttccaggagcggggctacgccgagacgaccatgcgggccatcgcccgggaggccggggtggcggtcggcaacgcgtactactacttcgactccaaggaacacctgatccagggcttctacgatcagaaccagctcgcccaccgctccgcggccgcccgggtcttcgcctcggagcggaccttcgcgggccggctgcggggggtgctgcacgccgggatcgacgtcaacgcgccgtaccacgccttcgccgggacgttcttcaagacggcagcggatccgtcgtcaccgctcagccccttctccccggcgtcggcgccgtcccgggaagccgcgatcggcctctttcgcgaggtcgtgagctcgtccgggctgcgcctcgacccgcagcttcgcgcccagctccccgagctgctgtggctgggctggatgggggtgatcctcttctgggtgcacgacggctcgccggaccaacgacggacccgcatgctcatcgacggagccgtaccgctgatcgacaaggtcgtcaagctgtcgcggctacccgtcatgcgccccgcgctgcaccaggcactgggcctgatcacggcgttgcggggcacctga

SEQ ID NO: 1112 - DNA, 567 bp, Actinoplanes utahensis
atggacccgaagatgtggatgtacctcggctacctcgtcgtcagcgtcgccctgacgatctgggtgggcaccaccctcgcccgcaacggaatggtcttcctcaccgacgtcttcgccgacgaccggctggcccgggccgtcaaccagctcctggtcatggggttctacctgctcaacctgggctacctggccatcgccatgcgcaccggcgatcgcatcggcaacgccgccgaggcgttggagaagctctccgggaagatcggctgggtgttgctggtgctgggcgcgctgcacctgagcaacgtcttcttcctcggtcgctaccggcgtggccgactgcgtccggcggcgcccacacccggccgcaccccgttcccggcgtacccgcccggcgtcatgccgggcctggtcgtccccccggtgggcccggtcgcctacccgtacgccgccggccacccggccgcgtaccccccgcccccgtacgccgcggcgcccgcgcgatctccggcaccgcagcagagcacggtcgggagtgcggcgccggcggccgagggaacgccggcatga

SEQ ID NO: 1113 - DNA, 489 bp, Actinoplanes utahensis
atggtgccgatcgtggtgatgggggtcgccggctgcggcaagagcacggtcggcgccgccctggcggcacgcctgggcgtgccgtacggcgaggccgacgacttccacccggcggccaacgtggccaagatgcactccgggctggcgctgaccgacgccgaccgggcgccgtggctcgccgcgatcgccgcccggatcgcgacggcgggggagcaggggctggtggtgtcctgctcggcactcaaacgcgcctaccgcgacgtgctgcgcggaccggacccgcggacgttcttcgtgcacctggtgctgacgccggaggtggcgaccgcccgggtgagcgcccgggccgggcacttcatgccgagcacgctggtcgcctcccagttcgccacgctggagccgctggcgccggacgagaacgggctgggcgtcgacgcgaccctgccactcgacaagatcatcaaccgggtgctggggcggctggcctag

SEQ ID NO: 1114 - DNA, 3600 bp, Actinoplanes utahensis
gtgacccagtctgtcgccacgctgcgcgagctcctcgccgagcgggtcctggtgctggacggtgccgccggcaccatgctgcagggcgcccggctcagcccggccgactaccgggccgacctgatcccggccgatcacgagcaggacgtcaccggcgaccccgacctgctgaacctcaccagcccggacgtcatcctcgacatccaccggcagtatctggcggccggcgccgacatcatcaccacgaacaccttcaccgccaccaccatcgcccaggccgactacgggctggagcacctggtgcgcgacatgaacgtgcgggccgcccggctggcccggcaggccgccgacgaggccgaggccgccgacggacggccccgcttcgtcgccggcgacgtcggcccgctgaacgtgacgctgtcgctgtcgcccaaggtcgacgacccggcctaccgcgcggtcaccttcgaccaggtgaagaccgcgtacgcggagcagatcgcggcgctcgccgagggcggcgtcgacctgctgatgatcgagaccgtcttcgacacgctgaacgccaaggcggcgatcgcggcggcccgcgaggtcgccccggacctgccgctctgggtgtcggtgacgatcgtcgacctgtccggccgcaccctgtccgggcagaccgtggaggccttctggcgctcgatcgagcgggcccgaccgctggtcgtcgggctgaactgcgcgctcggcgcggccgaggcccgcccgcacgtggccgagctggcccggctgtcggacacgttcgtcgccgcccacccgaacgccggcctgccgaacgcgttcggtggctacgaccagacccccgcggagaccggtgcgctgatcggtgagttcgccgcgtccggcctggtcaacatcgtcggcggctgctgcggcacgaccccgccgcacatcgccgaggtcgcccgggcggtcgccggcgccgcgccccgggtggtcgccccgcccgcgccgaccacccggttcagcggcctggagccgttcgcgatcggcccggacaccggtttcgtgatgatcggcgagcggaccaacgtgaccggctcggcccggttccgccggctcgtcgaggccgacgactaccaggccgccgtcgacgtcgcgctggaccaggtccgcggcggcgccaacctgctcgacgtgaacatggacgccgacctgctggacagcgagcgggcgatgaccacgttcctcaacctgatcgcgaccgagcccgaggtggcccggattccgatcatgatcgacagctcgaagtggaacgtgctggaggccggcctcaagtgcgtgcagggcaaggccgtggtcaactcgatcagcctgaaagagggccccgacctcttcctgcggcaggcccggcggatccgtgacttcggcgccggcgtcgtggtgatggccttcgacgagcagggccaggccgacaccaccgagcgcaaggtggagatctgcggccgtgcctacgacctgctggtcgaggacggcttcgacccgaccgacatcatcttcgacccgaacgtgctggcggtcgccaccggcatcgccgagcacaacgggtacgccaaggcgttcatcgacgccctcccgctgatcaaacagcgctgcccgggtgcccgcaccagcggcggcatctccaacctgtcgttcgccttccgcggcaacgacgtggtgcgcgaggcgatgcactcggcgttcctgttccacgcggtccgcgccggcctggacatgggcatcgtcaacgccggtcagctcgccgtctaccaggacatcccggccgacctgctggagctggtcgaggacgtgctcttcgaccgccggccggacgccaccgaccgcctggtcaccttcgcctccacggtcaccggcagcggcgccaaacgcgaggtcgacctgtcctggcgggacgccccggtcgagcagcggctctcgcacgccctggtgcacggcatcgtcgacttcatcgaggcggacaccgaggaggcccggctcaagctgccccggccgctcgacgtgatcgagggcccgctgatggacggcatgggcgtggtcggcgacctgttcggcgccggcaagatgttcctgccccaggtggtcaagagcgcccgggtgatgaaacgctcggtcgcctacctgctgccctacatggagaaggacaagaccgagagctcccgcggccagggccgggtggtgctcgccacggtcaagggcgacgtccacgacatcggcaagaacatcgtcggcgtggtgctcggctgcaacaactacgaggtgatcgacctcggcgtgatggtcccggcggcgaagatcctggagaccgcgatcgccgagggcgccgacgcgatcggcctgtccggcctgatcaccccgtcgctcgacgagatggtcgcggtcggcgccgagatgcagcgccgggggatgaccctgccgctgctgatcggcggcgccaccacctccaagcagcacaccgcggtccggatcgccccggcctacgacggcgccaccgtgcacgtgctggacgcttcccgggtcgtcggcgtggtctccgacctgctcgacccggagcggtcggccaagctcgacgaggcgaaccgggccgagcaggagcggctgcgcgagcagcacgagaagcggcacgcccagccgctgctcaccctcgcccaggcccgggccaaccgggaacgggtcgacttcaccgggctgcccaccccgaccttcaccggggtccgcgaggtgcagccgaccatcgccgagctgcgcgagatgatcgactggcagttcctcttcctggcctgggagctcaaggggaagtacccggcgatcctcaacgagccggtggccagggagctgttcgacgacgccaccgcgatgctcgaccagatcatcgcggacggttcgttccaggcccgggggctctacggcttctggcccgcgcacgccgagggcgacgacatcctcctggacaacgggcacggtttcccgatgctgcgccagcagaccgagaaaccggccggccgcgccaaccgctgcctggccgactacatcgcgccggccggcgaccacctgggcggcttcgccgtggccatccacggcgcggagaaactggccgcgcgatacgaggccgagcacgacgactaccgggcgatcatggtgaaggcgctggccgaccgcctggccgaggccttcgccgaatacctgcacctcaaggcccgtcgtgagtggttcgagccggacgcccagcccaaactggaggatctgcacgccgagcggttccgcggcatccgcccggccctgggctaccccgcgtgccccgaccacagcgagaagaaggacctgttccagctgctcgacaccggccggatcggggtcgccctgaccgagtcgtacgcgatgaccccggccgccgcggtcagcggcctgatcttcgcccaccccgacgcgaagtacttcaccgtcggccggttgggtaaagatcagatcgaagactacgctgcccggcgcggcgtgccggtgggcgaggtggaacgctggctgcgccccaacctggcgtatccgatcgactga

SEQ ID NO: 1115 - DNA, 1641 bp, Actinoplanes utahensis
gtgctcgtagcggtactccctgacggtcggctgcaggatctgcgtgccgacgggcggccggtcggggcgccccacccggcgcccgacctgccggcggcgatcgccgcgcgcgaggccgccgagcagccgcgctggatctgggcggccaccgccgacacctatcccgcgctgctgcgcgccggcgtccgggtggcccgttgccacgacctggagctgaccgaagcgctgctgctcgggcacgccggtcgctggggcgagccacgggggctcgccgccgcgaccgcccggctgcgcggcctcccggtcccggccgaccggccccggcccgaggccgagccgcccggtttcgcccagggcgcgctcttcgcgacgttccccacggccgtcgcggtctccgccgaggacctgattgcggtgtacgcggatcagcagcgccgcctcgcgcagaccggccaccccggacggttccggatgctggccgccgccgagtcggccggttccctgatcgccgccgagatgggccacaccggcctgccgtggcgcgccgacgtgcacgaccggctcctacgcgagctgctggggccgccgcagccggtcggcccgccgcgccggctggccgagctcaccgcggcgatcaacgaggcgttcggcacccacgggctgcaccccgactcgccggccgaggtggtccgcgcgttcgcccgggccggcatccagatcccgaacacccgccgctgggtgctccgccgggtcgaccacccggcggtcgccccgctgctggagttcaaggagctctaccggatctggaccgcgcacggctggtcctggctcgactcctgggtccacgacggccgcttccatccggaatacgtcgccggcggcgtcgtctccggccgctggggcgcccgcggcggcagcgccctgcagatccccaaggtggtgcgccgcgcggtgctggccgatccgggctggcggttcgtggtcgccgacgccggccagctggagccgcgggtgatggccgcggtctccggcgaccgggggctggcccgcgccgcggccggcggcgacctctacgccgagctggcccgcgactccttcgacggcgatcgggccaaggccaagatcgccctgatcggcgcgatgtacgggcagaccggcggcgacgccatcccggccctggccgtgctgcgccggcactatcccaccgcgttcgagtacgtggagcaggccgcccgggtcggggagaacggcgggctggtccgctcctggctgggccgcacctgcccgccggcggccggcccgggccgcgacgccgggctcgacccgcccgatgaggtggccccgccacccggacgggcgaggggccgattcacccggaacttcgtgatccaggccaccgccgccgagtgggccctggtgctgctggccaccctgcgcaccgcgctggccgggacgccggccgagctggtcctgttcgtgcacgatgaggtggtcgtgcactgcccggctgaccaggcggaacaggtcgccgagacgatccgcgagtgcgccgcgcgggccgggcggatgctgttcggcgccagcgaggtgcgcttcccgctggacgtctcagtggttggttgctacgcggaagccaagtga

SEQ ID NO: 1116 - DNA, 903 bp, Actinoplanes utahensis
atgaccaacctggtaaccaacgcacccgcggtcgccgcgaaacccgccgccgcggacaaggaacgcagaatcagcccgctcaacggcgtggcgcacatcgcgctgttcctctgggcgctggccaccgccggcccgctgatctgggtggtgctggcctcgttcaaggacaacaccgagatcttcctgggcaagccgttctcgctgcccgcgcacttctcgttcaagacgtacgccgacgcctggagcgaggcgcacatcgggcagtacttcctgaacagcgtgttcgtggtggtggtcagcacggccggcaccatgctgctgggcgcgatggcggcgtacgtgctggcccgctaccggttcccgggcaaccgggcgctgtactacctgttcgtctccggcctggccttccccacgttcatggcgatcggcccgctgttcggcatcctgcagagcctgagcctgctcaacacgtacaccggcctgatcctggtctacatcgcgtactcgctgtcgttcacggtgttcttcctgaccgcgttcttccagacgctgccggccgagatcgacgaggccgcgatgatggacggcgccgggcatctgcgccggttcttccaggtgatgatgccgatggccaagtccggcctggtcagcatcacgatcttcaacatcgtcgggcagtggaaccagtacctgctgccggtggtgatcatgcagggtgccggcgccgactcgaagtgggtgctcacccagggcgtcgcgaacatcagcacctcagccggttaccacgccgagtggtccacgctgttcgccgcgctgaccctgtcgatcctgccgatgatcgtcgtctacggcatcttccagcggcagatccaggcgggtctgaccgccggtgccgtcaagtag

SEQ ID NO: 1117 - DNA, 906 bp, Actinoplanes utahensis
atgcggcacggcaagtatcccttcatcatcggtttccttgtcgtgccgctggcgctctatctgaccttcgtggtcggtgcctacctgcagatgttccagctgtccttcacggactggtcgggcttcggcgggttcaagtacatcggcttcgacaacttcgtgaagctgtgggacgacccggtcttctggatcgccctgcggcacaacgtcttcctgctgatcttcctgccgatcgtgacgatcgcgatcgcgctgttcttcgcgttcctgctgaacgtcggcggccgcagcaagggcggagtgacccggggcatctggggctccaaggtctaccggatcatcttcttcttcccgcagctgctggccctggccatcgtcgcggtgatcttcggccgggtgttcggctcggaccacggcggcatgctcaacggcctgttcccgtcctcctggtcgccctggttgttcctggccgacgagcggttcgcgctgacctgcatcctggcggtgctggtctggcaggcggtcggcttctacgtggtgctcttctcggccggcatgggcaacatcccgcaggagatctacgaggccgccgcgctggacggcgctaccaagatcaccctgttcttccggatcaccctgccgctgctctggggcaccctgcaggtcgcctgggtctacctcggtatcgccgccttcgacgcgttcgccctggtcaacatcatgtcggtgaacaagggcggcccgaacaacgcgacccaggtgctcagctaccagatcttcctgaacgccttccagaactcgcaggccggttacgcctccgcgatcggcgtcgtgctgttcttcctgaccctgacgttcgccgccctgaccctgcgggtcacccgtcgcgacgccgcaaacgcctga

SEQ ID NO: 1118 - DNA, 1425 bp, Actinoplanes utahensis
atgtctgagataacgacctcccgtcgtacgctgctccgccgtgccgccgcggtcggtctggtggccgcccccggcgtcagcttcctgagcgcctgtgccggctccgacgactccggcaccaccaagcaggcgaccggcaccaagtcggccgacaacccgctgggcatcgacccgaaggccggcgtcgagatcgtgatcttcgacggtggtctgggcaccaagtacgccaccgatgtcgacaccccgctgttcaacaccaagtggccggacgccaaggtcacctactcggcgacccagcaggtctccaccacgatcaagccgcggctcaacggcggcaacccgccggacatgatcaacaactcgggctccgacatcatggacttcggcgccgtggtcaaggccggccaggccgccgacctgaccgacctgttcgccgccccgtcgctggacatcaccggcaagacggtcgccgagacgctggtgccgggcgccgtgcagcagggcacctacgacggcaagccgttcgcggtgaactactccttcaccgtcttcggcctctggtacaacaagaagctgttcgccaagaacagctggaccatcccgaccacctgggccgacttcaccgcgctgctggacaagatcaaggcggccggcatcacgccgttcggctacgcgggcgccaacgcgtcgtactacatggtccgcgcgatcatgaccagcgccgcgaagatcggcaccgagcaggtgctcaaggacatcgacaacctgaagccgggcgcgtggaccaacgacgcggtcctgcaggccgccaaggcgtggggcgaggtcggcaacaagtacatcgacaagtccttcctcggcctcaagcacaccgaggtccagctgcagcaggaccaggacaaggtcgcgttctacccctgtggctcctggttggagaacgagcaggcggccagcaccccggccaccttcgagtacgcgatgatggcgttcccgagcgtcaccacctcggacaagctcccggcgaccgcgatcaacgccgcggccggcgagatctacttcgcggcggccaagggcaagaacccgcagggtggcaaggagtacctgcgcaccatgctgtcgaagaaggcggcgctggagttcaccaagctcaccaagtcgctgaccgtggtggccggcgccgctgacggcgtcgtcatcagccccggtctgaccagcgcgaacgacgcgctcagcaaggccggccaggacgtcttcatgggttacctgttcgacacctggtacaagaagctggacgacgcctcccgcgaggccgccaaccagctgatgttcaagggcggcgacgcgcagaagttctgcgacacgatggaggccgcttcgcaggccgtcgcgaaggactcctcgatcaccaagttcacccgttcctga

SEQ ID NO: 1119 - DNA, 900 bp, Actinoplanes utahensis
atggcagtcgtcgccaccacggtgccgcgtcgcaagaaggccgaccggcacgccgacggcacgatgaccgtcgggcgcaccccgctgggcaacttcctggccaacgcgggcggcctgctgttcgcgatcgtgatgttcttcccggtgtactgggtgctgatcacctcgttcaagccgcagaccgagtggtccagcttcgtgccgacgttcctgcccgaatcgccgacgctggacaactacaagtccgcgttcaacgccccgggcttcaagacctcgctgatcaacggcatcgagatcacctgcatggcggtgctcgccgcactggtggtcggcttcctggcggcgctcgccgtggcccggttcaagttctacggccggcgggcgatcatcctggtggtcctggccgtgcaactggtaccgttcgtcgccctgctgatcccgctgttcctgatgctgcagaaggccgatctgatcggtaacaagatcatcggtgtgacactggtctacgtggtgttgcttctgccctacacggtgtggacgctccggggtttcatcgccggcatcccgcgggagctggacgaggccgcgatgatcgacggctgcacccgcggtcaggtcttctggcggatcatcctgccgctgaccggccccggcctggtggcgacctcggtctacgggttcatccaggtctggaacgagttcatcatcatcaacaccctcaacgacaacgaccaccagaacctgatggcctggctgatgcagaaccagaccagccacggcacctactggggtccgctgatggccggctcgatcatcacctccatcccggtcgtgatcttcttcctcgccgtccagcgcaacatcgcctcgggactgaccgcgggcgcggtcaagggctga

SEQ ID NO: 1120 - DNA, 990 bp, Actinoplanes utahensis
atgtacgcggtcgattctccggcgacccgcacgcccaccgggccggccggatccggcgcgaagcgcccggtcggccggcgccgtgcgcgacgcggcagcgaggaaggctccggcctgccgtggctgctctccaccccggccctgctgctgctggccgctctgctggcctatccgttcggacggatgctggtcatctcgttccagaagttcggtgtcaagcagctctggaccggggcagcggcgccgtggtccgggatcgacaactacatcgacacgctctccgactccgcgttctggtcggtcgtggggcacacggtcctgttcaccgcggtgtcggtggtgctcagcgtgctgtccggcctcggggtggcgctgctgatgcgccgggtcggcaggaccgtgcgactgctcatgatcatcgcgatgatgttcgtctgggcgctgcccgcgctggtccaggcgcagatcttcaagatgatgaccgactccgacgtcggggtgctgaactatctgatcgacaagctgcccggggtgagcttcgagaaccactcctggttctacacgcccacgcagggctggatcgtgatcaccgcctgcgtgctgtgggccggtatcccgttcctcgcgatcaccctgaacgccggcctgacccaggtgcccaaggagctgatggaggccgcgacggtcgacggcgccaacgcctggcagtcgttccgcaacatcaccctgccgatcctcaagccgctgctggtgatcgtcacgaccctctcggtgatctggaacttcgggctcttcacgcagagctgggtgctgcgcgacggcaagccggagccggagttccactcgctggcgacctacctgtacgcgcaggcgttcgcgcagaacaagtacggcctgggctcggcgatcgcggtgctcaccatcctgctgctgctgggcgccatgacggtctacatccggcagatgttcaagatcggagaggtggactga

SEQ ID NO: 1121 - DNA, 1308 bp, Actinoplanes utahensis
gtgaagcgcaagatcgccgtcgccgcggctctcgccgcgacgctgctgggcgccgccgcgtgtggcagcaagtccgacgacagctcgaccacctcggccaacggcaaggtcgacggcaagggcaagaccatcaaggtctggctgatggtcgacgcccagagcggctggaagggtgtcgtcgacgacgccaccaagcggttcaccgacgccaccggcgccaacgtgaccgtcgagtaccagcagtgggcgaacgtgctcaccaagctggacgccacgctggccggcaccgacgtcccggacgtggtcgagctcggcaacacccagttcccgaagtacgtcgacgccggcgccttcgccccgctggacaagaagagcttcgagaactcggacagctggctgaccggtctctccggcccgtgcgagtcggacggcaagacctactgcgtgccgtactacgccggcgcccgggtcctgatctaccgcaccgacctgttcaaggcggccggcatcaccgccgcgccgaagacctacgacgagttcctggccgacgccgacaaggtgcaggccgcgaacaaggacccgaagttcggcgccgtctacatgccgggccgctactggtactcggcgatgtcctgggtcaaggccaacggtggtgacatcgccaagaaggacggcgagaagtggaccggccagctctccagcccggcctcgcaggccggtctgcagaagtgggtcgagctggtgaagaagtactcgaaggcggacgtcaccaaggacgaggccgaccagtacctggtgttcagccaggccaacgccggcatgttctacggcaacggctgggagcagggttcggccgagcaggtcaagaaggacccgaacgacccgaactcggcgctggtcccgaccaaggtcaagggcaagctggccgccgccccgatgccgggcatcccgtcgctgctcggcggctcgaacgtcggtgtcccggtgaagagcaagaactccgagctcgccgcccagtggatcaagtacttcaccgacagcacctcgatggccggcctggccaaggccggcgcactgccgaacgcgaccgccgtgctcgacgccgccgcctccgcgaacccgacgctcgccgtcccggccgaggccgccaagaacagctgggccgtgccggcctccggcaagtgggccgacgtggagaaggccaacatcctcaaggacatgctgtcggacatcctgaccggcaagaagtccctcgcggacgcgaccgccgccgcggaccagaagatcgctgacacgctcaacggctga

SEQ ID NO: 1122 - DNA, 1050 bp, Actinoplanes utahensis
atggctgagccggagatggacggcaccgcgaagaccgcggtcgcgttctcaccggcccgcgaccaggctgccccgggcgggagcgaccacacctcgcgggaccggctggaacagggtttctgggtgcgcggcgaacccagggccgccaaggagaagagcgaccccatggatcatccggcctccgacggcgtgctggtgcgggtccgcaccctgctgccggagttcaccggtgccctgcagcgcgtcgccgagcaggtcctcaccgaccccgcggcggcctcccgggccaccatcgtcgagctcgccgagcgcagcgggacgtccccggccacggtgacccggttctgccgcgcgctgggcttcgacggctacgcggatctgcggctgggcatcgccgccgagaccgggcgcgcccggtcggccggctggacggtggacatcggccgggagatccagcccaacgaccccctggagcgggtgctcggccagatcatggccgccgacaccagggccatgcacgacaccgcctcgctgctggacctggccgaggtggagcgggccgcggtggcgatcgccgccgctccgcgggtgaacatcttcggcgccagcggcagcgcgctggtcggcgaggagatgcagttcagtttgcaccgcatcggcatcccggtgtgggcctggaccgacgtgcacaacggtctggccagcgccgcgctgtcccggcccggcgacgtcgcgctcggcatctcgcacagtggcgagaccggcgagacgatcgagctgctcgccgaggcgagcagccggggcgccaccaccatcgcgctcaccagcttcccccgttccccgctggccgagctcgccgacatcgtcctgctcaccgccacccaggcgaccaccttccggccggatgcgctctccgcgcgacacccccagctggtggtcctcgatctgctgtacgtggccgtcgcgcagcggacccacgaacgctcgcacgccgctttccagcgcaccgctcaggcggtccatgggcacaaagcggtcaaagacacctga

SEQ ID NO: 1123 - DNA, 2721 bp, Actinoplanes utahensis
gtgctcgccgcccggggtgaagacgttgctgtgcgagacgtcgtcccacgccgacggggggaccgcggcgcgcagggcgacgagcaccggcgcgtcgtcggtgagcagggagagggcgaccaggcactcctcggcctcgccgacgcactcgaagggtttgtgcgcgtcgatgccgagcagttcgaggaagccgggtgtctgcgccgcgtcggcgaacaggtcatggccgaagatgtgcgcgaggcgttcgcgcggcatgtgcggggccatcgccaggaacacgaagcggcacttggggcagtcgccgcaccagcgggccgtcgggtcgtgaagcttgaacgctttgttacagctggtaacaacatcatcgtacgctgtgtgaccggcgaacagttgcgcgatgtggagctcggagagcgtgcgcagcagggagaagtacgggtcgacgaggccggtgtgcgcggtcaccgcgtcccgcagcagcccctcggcgagtactcccttggaccactggtggttcacctcgtggccgttccagatcaggttggggtcggacgcggagcgctcgttcgacatcaccaccgggcccagtccgtgccagacggcggtggcgatcgcgatcagcgaattgatcgcggtgaccgggatgtgcccgttcagcgcgccggccctgttcagctcgaacagccgcgggtcgaggcggcgccgggcggccagggcgggcagaccggaggcggcgttcacgttctcgatcaccgggttcgggttcaccgagaacggcacggggtcgaggccggccgcgcgcaggatctccagggtgacgatcgagtccttgccgccgccgaccgcggacagcggccgcccgccggcctcgaccggggcggccgcgggcagcgtgccgggcgtctcgacggtcagctccagcacgtgcgggagccggttgcggtacgcgtactcggcgagcccgtcggtgtagacccgggtgaaccaggtggccaccgcgggggcgaccgggcgcggcgccaccacccggggcggggcgccgaccttgtagtagctcaccccggcgaccacgtgcagcagctccagcacccggcgcagggcggcggtgtcgcgcggcgccgcgggcaccggcagcgtgatcgtctcggtgaagcgcagcggctccggcccgtccagcacgtagtcgaacgtggcgaccccggtcgtctcgtcgaacgcggacgaggggaagcgcatgacgtcgaactgcacccgggaactcctgtcttctggccgacgggcaatattagttcggttcggcgagcggcacggctgggccgtttcgctcgattttctcggcataagccggatttggacgatggtgagggggacgacgtgcgcctggcagacctgcgcggccgatcggtggcggtctgggggaccggccgggagggccgggccgcggtcggcgcgatcgccgcccacgagccgtcccggctgattgcggtcaacgacggcgccggttacctggacgacccgtggaacgacccgcgcgccccgctggccggcggcgagcacgccttcgccgccctggccagcgccgacgtggtggtccgctcgcccggggtgccgtccacccaccccttcatggccgagctgcggacccgcggcgtgccggtgaccggtggcagcgccctctggatggccgaccacgcggcggcgaccgtcggggtgaccggcagcaagggcaagagcaccacgtccagcctgatcagccacctgctcgcggcggtcggccggcccaacgcgtacggcgggaacatcggggtgccgctgctcgacctgccgccggccgagctctacgtgctggagctgtccagctaccagtgcgccgacctgaccgactcgccccgggtcgcggtggtcacctcgctgttccccgagcacctggacgcgcacggcggcgagcgcgagtactaccgcgacaagctgaacatcctggcccacgggccggagctgatcgtggtcaacggggccgacgagcggctgcgcgacgagatccgcggggtgagcgaccggagcggtttcccgccggtcccggccgcggcggacgactcccggttccgggtcgaggacggcaccgtgttctgcagcgacgacccgctcttcccgcggtccgcgctggcgctggtgggccggcacaacgagcggaacctgtgcgtggccctcgcggtgctggacgggatgggcgtcgacgtggtgggcctgcgggcggacctggaggcggcggtccggtcgttcccgggcctgccgcaccggctgaccgagatcgccgacccgtccggggtgaccttcgtcgacgacaccctgtccacctcgccgtactccgcgatgcacgccgtggaggcctacgaggggcggccgctgaccgtcctgctcggcggcaccgaccgcggtcttgactacgctccgttgcgagaattcctcgcgtcccgggaactcaccgtgatcggacttccggacagcgggccgcggatcctggccgagttgtccggcctgccgaaggtcaccacgctgccggccgaggatctggccgacgccgtgcggctcgcgcgcgaggtgacgccggcgggcggggtggtgctgctgtccccggccgcgcccagttacgggcgcttccgcaacttcgagcaccgctcggaggccttcgccgaggcgatccgggccaccgcttcctga

SEQ ID NO: 1124 - DNA, 327 bp, Actinoplanes utahensis
atggagatccggatgaccttcagccgcaccgagggccacgccttcacggtgtgggtggaaccggaaggtgactgcgtcgaactgccgcaggcacagcgcgcggtgttctccttccgggggccggacggcatggacgcccagttgacccaccaccccgaccggctcgtcatctggcggccaccggacaccgaggtgtggctgtcggtcgacggcgacgagttccaccaggtggccgggttcgccgacatccccgcgcccggcctggactcctcgggtgcggggctgagcgtgccgatccgggacatcgtcgaagaccttttccactga

SEQ ID NO: 1125 - DNA, 888 bp, Actinoplanes utahensis
gtggagatcgacgaccacctgctgggcgcggcccccgacccggtgcgtccggtcctggccgccgcggccctgtcctcgctgcgcctgaccaccggcccggaatgcgccccggacaccaccgacacccggctcggcggcgtacccctgctcccgccgggcgcggcctggccgtattcgccgtcgggcaacccgcagtcgttcctcggtcagctgaacaccgacgaggtcaacgcccgcctcggggagccgctgctgccgccggggacgctgctcggtttcttctacgactggcgggagcagcgctggggcttcgatccggcggatgccggccactggcacgtctccagcaccccgctgtcctgcgccaccgcgccgccgctcgccgcggggctcaccgcaacgacggattcgttctccacaacagcgatggcggatgagccggagtcgttcgtcgcccatcaggcccgcctgacccccgtcctcaccattcccgccatcgacgagccgccggtcgacgccacccgggagcaccaccggtggcagcgccacgaccgggtccaggatttctacggctccctggagaacgacgacggcgtcccgctgcaccgcgtcttcggctggcccgacgcgctgcagggcccgatgcgcctggagtgccagctcgccgcgaacggcgtccaccacggcaatccggccggccgtgaagccgcccgggtcgccgaactgaccccgggcgcggccgactggctgctgctgtgtcagctggacaccgacgacaccatggactgggcgtgggccgacgccggccgcctctacttctggatccgccaccgggatctggccgcccacgccttccaccgcacctggctcgtcctgcagtgcccctga

SEQ ID NO: 1126 - DNA, 1257 bp, Actinoplanes utahensis
gtgcccggcgtgccgaaggcacggccgatcggcggcgccggcaccgagttcccgtcggtcaccccggccgagtacgccgcgcatttcgcccgtaacaccacccgccgcagcgccgccgcggacggcatggacccgggcgacacgatggccctgcgggacacccaacgcctgctcagcaccagtctgacgttcgccggtggcaccgatgaggtggccgcccggctgtgggaggcgctgctgcaggcccagcccgacctgctgaccgcgctgcccggcaccgccggctcgcaggcgggccagctggcccgcgcgctgacctggctggtccaccggctcgacgacccgcccgcggtggtcgccgggtgcggccggctcggcgccgccctggccgagtgcggcgtgcagtggaagcagttgcagctggtcggcgcggcgctggcggaggcggtgcgggccgggatggcgccgggcgtctggcggcaggatttcgatcaggcgtggcggtggacgtggcagcacgtctacgagtggctggtgcacggcggcacgctgatcgcctaccaaccgaccgtctgggacaccgaggtgatcagccacgagctgcgccgacccgacctggcggtggtccggctgcgcccgttcctgccgatgccgtaccgcccggggcagtacgcgcgggtcgaggtcgacgcggtccccggcatctggcggccgtattcgctggccggcgccccgcagctggacgacgtgatcgagttgcacgtgcgggcgaaaaccgagaccggggtgagcggcacgctggtgcacgacacccgggtcggcgaccgggtccgggtgacccgcgccgagggcgacatgggtctgccggccgagccgggccgcggcgtgctgatgatcgccggggataccggggtggccccgatgaaggcgatgctggcccagctcgcggcggtccgcgacccgcgcccggcggtgctcttctggggcgtccgcaacctgcgggagctctacgacgtcgactcgctgatggcgatcgcccgggaggccccgcgtgccacggtgatcccggtgatctccgagggcgacccgggaccgtacccgttcggcctggtcaccgacgcggtcgcgacctacggcgagtggtcccggcacgaggtctatctggccgggccgccgctgatgctggccgccaccgccctcgcgctgcaccagctcggtgtctccccggcccgcatccaccacgacgccccggaatga

SEQ ID NO: 1127 - DNA, 1467 bp, Actinoplanes utahensis
gtggtggcacctgcgcccatcttcccgcacgtcccgccgatcgacatccactcggccgccacagatctccctattcagggtctccggcccgacccgatagaccacgcacggccgcaacgggccgggcgggacggtccggtcctcgaagtcggcggccggatcgtggaccatgccgagccgctccatcacccggcgggagcggacgttgccgcgcaccgtgatcgccaggatctccggcaggtccagctcgccgaagccgaagcggagaacggcccgggccgcctcggtcgcatacccgtgcccccacgcgccggcggccagccgccagccgacctccaccccgtccaccggggcgtcctcgtcgaccgggtcgagaccggccatcccgacgaactcgccggtcgcggtcacctcgaccgcccaccagccccagccccgggtcaccatggccccgcggaaatactcgatcgacgcggcggactcggccagcgtcagcgtgccggggaagaactcgcgaacccgcgggtcggcgttcatcgccgcccagaccggcaggtcggcgtccgtccactggcgcagccgcagccgctcggtgatcagttcggtggtcatgccggacgtttctacccccggtgcggcgggggcgatcggcggggtcggcagaatgatcgtgtgcccgccatcgttatcaccgaccccgacgacccgcgcatcggtgactaccgcgccctcaccgacctcgaactgcgcacccggtgggagccgccgaacgggctgttcatcgccgagggtgagctggtcatccagcgggcgctgcgggccggctaccggctgcggtcggccctggtcgacgagaaacgcgccgaccagctcaccgggctgccgccggacgccccgctgtacgcggcggcccccgccgtcctggagtcgatcaccgggttccacgtgcaccgcggcatcctcgcctcgttccaccgccgcccgctgcccgagcttcccgacctgctcgccggcgcccgcaacctggccgtgctggagggcctgaacacgcacaccaacctgggcgccctgttccgcagcgcggccgcgctcggcatcgacgcggtggtcctgtcccccagttgcgccgacccgttgtaccgccgggcggtgcgggtcagcatgggcgaggtgttcgccatcccgtacaccaagacggaaacctggccggagccgctcaccacgatccgcgacgccggcttcaccctgctggccatgaccccggccccggacgcggtcgccctccgcgacctcaccgcggcgcagcgggaccgcccggcgctgctgctcggcgccgagggtccgggcctcacgccggccgccctcggcgccagcgacgtccgggtcgccatccccatgcacaacaacgtcgactcgctcaacgtcgccaccgccgccgccatcgccttctacgaactgacccgctga

SEQ ID NO: 1128 - DNA, 675 bp, Actinoplanes utahensis
atgagcatcagccatcgtcagaccgcgtccggccgccccctgcgggtcgcccccgcgtgggtcggcgccgcgaccccgaccggccgggccaccgaccatcacctcctaccggtccgcgacgccgtctggatctggtcggtccggcgcttcgcccggctcgccctgtgggcgctgcccgccgccgcggtcctctacggttggttcaccctcggcgtcaacgtcccgcccggtccgctccccgtgggactcctcgccggctggctgaccagcatcgcgctgatcgccctggccggcctgctcgccggctcccgcacccggcgcgtcgccctcaccggcctgctcgtcaccctggccggcgccaccctgctgctgccgctggtcgccctcccggaacagaccgccaccgccgccgtgtccatcaccaccggccaggtccgcatcctgctcgacgtcgcccgcgccgtctgcggcggcggcatgctgctcctcggctgggccgtgttccgttcccagctggtcaacccggccgacggcgtcctgctgatgctggccgcggtcgccctgggcgccggcaactacgcggtcaagccgctcccgacggtgggcgcgctcctgctgctcgccgccggcatgggcctggcctggacgggtggccggctggtcccccgaacctga

SEQ ID NO: 1129 - DNA, 1113 bp, Actinoplanes utahensis
atgggagctgtcatcgcagttctggtcatagtcatcgcgttgttcgcggtgatcaccatcgtccggtccatccggatcgtcccgcagcagcggatggacgtggtcgagcgcctgggcaaataccagcgcaccctgagccccggcctgaacctgctggtgccgttcatcgacgcggtccgcagcaaggtcgacatgcgcgagcaggtcgtgtcgttcccgccgcagccggtgatcacctcggacaacctggtggtctcgatcgacacggtgctctacttcaaggtcgtcgacccggtccgggccacctacgagatcgccaacttcctgcaggcgatcgagcagctcaccgtcaccaccctgcgcaacgtgatcggctcgctcgacctggagcgcgcgctgaccagccgcgaggagatcaaccggcacctgtccacggtgctggacgagaccaccggccgctggggcatcaaggtcacccgggtcgagatcaaggcgatcgagccgccgcccagcatccgcgactcgatggagaagcagatgcgcgccgagcgggagcgccgcgccaccatcctgaacgccgagggtcacaagcaggcgcagatcctcaccgccgagggtgagaagcaggccgcggtgctgcgcgccgacggtgaccggcagtcccgggtgctgcaggccgagggccaggccaaggcgatccggaccgtgttcgacgcgatccaccaggcgaacccgtcgcagaaggtgctggcctaccagtacctgcaggcgctgccgcagatcgcgaacggcagcgcgaacaaggtgtggatcgtgccgaccgagctgaccaaggccctggaggggctgggcggtgcgctcggcgggctcgccaacatggtcggggacgtgccgctggccgaggtgcactcggacgaggtggcgctggaggcggcggccgcggcccaggcggcggcggctgaggcggcccgggtgaacgacgaggtgcgggaggcggaggcccaggtctcggcggatccggacgtcaccgcggcgctgggcgcgtccccgcaggtgccgccgtcgtcggcgctgggtggggccgactaccaggggcagcagcaccaggcctga

SEQ ID NO: 1130 - DNA, 477 bp, Actinoplanes utahensis
atgcgcggacgtgacacgatcgttgatgtggcagccgtactctggatcatcctcgccatcgccctggcgatcggcgaagccttcaccgcgaccttcctgatcatcttcttcgcggcgggagccggcgcggccgccctcgccgccgccctcggtgccccggtgctcctgcaggtcatcgtcttcgccgtggtctccgggctgtccgtggcggcggtccgcccgatcatcgtccggcacgcccggcccgccctggagaccggtgacacggccttcgggatcgaggcgatggagggccaccacggcaccgtgctggagaccgtcgacgccggccacggtcagatccggatcgacggggagatctggcaggcccggccgttcgacggcaaggagaccttcgagcccggcgagcgcgtccgagtcgtcaccgtgcgcggcgccacggcgctggtctggcacgatgacctgcccgacgtttga

SEQ ID NO: 1131 - DNA, 1311 bp, Actinoplanes utahensis
gtgacactgcttccggagaccgcccgccgggtcgacgagatcgccgcccgggcccaggcgcagggccgggcgccgtcgctggcgctggcggtggtgcgcgaccgcgcggtgctgcacttcgcgggtgccggggagacgccgcggccggatcccaagacccagtaccggctcggctcgatcaccaagacgatcaccgcgacgctggtcatgcagttgcgcgacgaggggttcttcgccctcgacgacctgctctaccgccatctgccgggtaccccgatcggcggcgtgacgctgcgccagctgctcgggcacatctccgggctgcagcgggaaccggacgggccgtggtgggagcggcgggacggcggtgacgtggcgcagttgctggccggcttgacccacgagaagctgaccggcccgccgttccgccgctaccggtattcgaatctggcgtacggcctgctcggcgcggtggtgtcccgggtcaccgggcagagctggacggatctggtcaccaagcgcgtgctggatccgctgggcatgaagcggaccagctatctgccggtggagccgttcgcccgcggctacgtggtccacgcgctgggcggcacgttgcacgaggagccgcgcccggacgccggcgccatggccccggccggccagctgtggtcgacggtgaccgacatggcgaagtgggccggcttcctggccgatccggcgccggcggtgctggcccgggagacggtcgacgagatgtgcagcccggtgaccatcgacgatctggagtcgtggacgtccgggcacggactgggcccgcagctgttccgggtgggtgagcgggtgtacgccgggcacgccggctcgatgcccggctatctcgcgcatctcgccgtgcaccggcgcagccggttcggggtggtggtgttcgccaacacgtacgccctcgccggcggctccctgatcaaggagctgagtctgcggacgctgaccacggtgctggacagcgagccggcggcgccggtcccggcctggcagccgccggcggcgccgaccggcgaggccgcggagatcagcggccgctggtggtggatgggcggcgagttcgacatcgccccggacggcgacggcctgacgatgaccggccgcctcggccggacccggttccgccgggaggcgccggaccgctggcgttgcgtctcgggcagcgacgagggcgaggtgctgcgcatcctgcgggctccggacggcacggtcgacaagatcgacattgccaccttcgtctacagccgcgacgcccgggatctggcctga

SEQ ID NO: 1132 - DNA, 852 bp, Actinoplanes utahensis
atgaaccgcatgaaggcgttaccgatcctcgccggcgcggccggcatgaccttcgtcggcggcagcgtcgcggtctccggccacctcgccggcgcgcccgccctcaccgtgcaggcgctgcgctacgcggtggcctgcctgctgctgctcggctggtcggcgtgcacccgcaccccggtgcgccgcccgcgcggcgccgaatggcggtggctgctcggcgtcaccgtggccggcctgctggtcttcaacatcgccctgatgcacggcgcccggcacgccgaaccggcggtcctcggcgtcgcggtcgcctgcgtcccgatcctgctcgccgcgggcggcccgctgctgcagggccaccggccggccgcccgcaccctgctcgccgccggagtggtcacgctcggcgcgatcggtgtcgaggggctcggccgggccgatcggatcggggtgttctgggccgtcgtcacgttcctctgcgaagccctgttcaccttgctcgccgtgccggtgctggggcggcacggcccgctcggggtgtccgtgcacgccaccgggatggcggtcgtgctgttcggcgcggcggggctggtcaccgaggggccgggcgcggtgctccggctgcacgccggcgacgtgctggccggggcgtacctggcggtcgcggtcaccgcggtggcgttcgtgctctggtacacctgcgtcacccggatcgggccggggcgggccgggctgctcaccggactcgcgccgatcgccgcggcgctgaccgggatggggctgggcgggccggcgccgcggccgctggtctggctcggcatggcgaccgtggcggccgggctcgcccctagctag

SEQ ID NO: 1133 - DNA, 1182 bp, Actinoplanes utahensis
atggcgaggcgatggaggggaccaatctccggttcggacttcctgcagttgcgcaccgcggacgccccggccaaggggttgaccggctggctggccgacggcctgcggtccgcgatcgcggccggccggctcgccccgggcagccggctgccggccacccggctgctcgccgccgagctgggcgtctcccggggcgtggtggtgcaggcctaccagcggctggtcgacgaggggctggccggcgcgcgcaccgggtccggcacggtggtggcccgggacgccgcggtcgcgccccggccggccgccgaccgccggcgcaccctgcacgagctgcggctgcccctgtccaccccggacggcatcgacctcaacctctcccccggggttcccgacctggccgccttcccccgggcggcgtggctgcgggcggagcgcgcggtgctggaccgggtcaccgcggccgacctgggctacggcgacccgggtggcacaccggtgctgcgggccgccctggccggctggttacggcgtacccgggcaatccgcgccgaggcggacgacatcctggtgtgcggcggcgtcgcgcaaggtcaggcgctcctcgcgcaggttctgcgggttcgcggcgaagccgtcgtggccgtcgaggaccccggctcccggggcagccgggaccagctggcgtactggggggtgcgcggcgagccggtgccgatcgacgagagcggcttgatcgtcgagcagctgcggcgaaccgggctggcgaccgcgctgctcaccccggcgcaccagtttccgaccggtgtcgtgctcgccccggaacgccgccgcgagctgctcgcctggggcggcctgatcgtcgaggacgattacgacgccgaacaccggtacgaccgtgccccggtcgccgcgctgcagggcagcgccccggaacgggtcgcgtacctgggcagcgtctccaagtccctggcacccgggatgcggctgggctggctgatcgcgccgcgccggatgcaggccggcctgctggccgccaagcacgccagcgacctgggcagttcggcgctgccccaactggtgctggccgagctgatcgcgaccggcgactacgagcggcacctgcggaccgtgcgggcccggcagcgggcccgccgcgacgcgctgctggccctagctagctag

SEQ ID NO: 1134 - DNA, 219 bp, Actinoplanes utahensis
gtggcggccgggctgcacctgctggtggaactgcccgccgggaccgacgacgtggcggccgccgagcggatccgggagaccggcgtgctggtccacccgctcacctggcaccgcctgctgcccggcccgcccggcctggtgatcggctacgccggtcacaccccggaccgcctcctcgacggcgcggcgcggatcgggcgcgctatcccagcacggtga

SEQ ID NO: 1135 - DNA, 930 bp, Actinoplanes utahensis
gtgcggtgcgggtggccgcatctgctgcgggtgacatgcgagcaagggtacgtggcatcccggaaccttgtcgcgactcggagcgtcacccgggcgtgtccgaaaggacgtattaccgtgcgggtcatgtatggggaggacgtgatggccggcaactggcgccggcggaagaccattccggaggtggatgccgagcccgacctggtggtcgaggacgccgactccggtttctgcggtgcggtcgtcgggttcgagctgggtgcggtggtgctcgaggaccggttcggcaagcgccgcaacttcccgctcgccccggccgcgttcctgctcgacgggcagacggtcacgctgcggagaccggctccgcgggcggtcgcgccgcagcgccgggtgaccgcgtccgggtcgatcgcggtggcccgggtgaccgcccaggtggccaaggccagccggatctgggtggagggcatccacgacgccgccctggtcgagcggatctggggcgacgacctgcggatcgagggcgtggtggtggagccgctggacggcatcgacgacctgcacgcgcacgtccgggagttccggccggggccgcaacgacggctcggggtgctggtcgaccacctggtgccgggctccaaggagagccggatcgtggcgtcggtcacccaccccgatgtgctgatcaccgggcacccgtacgtggacgtctggcaggcggtcaaacccgagcgggtcgggctgcgcgcatggccggtgatcccgccgggccgtccgtggaaggagggcgtctgcgaggcggccggcgtccgcgagccggccgacatgtggcgtcgcatcctctcctgcgtccacagttacaaggacgtcgagacgcccctgatcaacgcgatggagcggttgatcgaccacgtcaccgtgctgggatag

SEQ ID NO: 1136 - DNA, 804 bp, Actinoplanes utahensis
atgccacgtacccttgctcgcatgtcacccgcagcagatgcggccacccgcaccgcacaccggtccacccgtttcgtggcctgggtgcgggcctggcgggccgggctggtcccgttcgacgacctggccgccgagatcgccgaggacgaggagcacctcgtcgccgaagcccccggcacctggaccgacgtgccgctcggccagggcctgccgatcttcgcgaagctgcaccccgacgacatccggctggtcctgccggtccccggcgacccgcgcgggctgcccggccccgggccgctgaccggcgccgcactgctcgccggcgaggccgtggtcaccccggagttcggcgtggtgcccgaggtgcggcggcacacgtccggctccggtgtggagttcgagaccgtggtgtggcgggtgctgccggcccccgggcaccggccggtgttccagatgggtgccgccgaggccgaggcgcagctgaccgccgcgctcgccgaggccaccacccggctgaccagactggacgtcgcgcagtggaaaccggagctggccggtgccctgcagcagctgcgccggccggagagcacggccaccctgccgcccggcttcgacccgcgctcgcgccggctgttcgcgcgggcgagcgtgctcgcccaggtcctcgcgctggccgggacgaacgcgccgggcggcgcggtcaacggctacgaggcgcagcagcgcgacgaggcgctgcggccgctcaccgcggcctgccggcaggccctggtcgcggcctgcaacgcgccgctgcacccgtga

SEQ ID NO: 1137 - DNA, 510 bp, Actinoplanes utahensis
gtgaccgccgaccggcacgcgcactgcacctactgcggggcccggttcgtgccggaccaggcgtggccccgccgctgcgcggcgtgcggcgagaccacctaccgcaacccggcgccggtcgcggtcgcgctgcagccgatcggttccggactactggtggtacgccgcggcatccccccggcgcacggcagtctcgcgctgcccggcggcttcatcgaatacggcgagagctgggccgcggccaccgtccgcgagctggccgaggagaccgggctcgaggccgatgccgcggaggtacgcctcttcgacacccgcagcgcgccggacgggacacttctcatcttcggcctgctgcctgaactcgcggacggcagcgggctccccacgacgccgccgcccgaggaggcgctcgggctcgaggtgctgcacgagccggtgccgttgggcttcagcctgcacaccgaggtcgcggggcgatggttcgacctcagtcgatccggccggctctga

SEQ ID NO: 1138 - DNA, 408 bp, Actinoplanes utahensis
atgacggacaggggcacgggtgaggtggtcgccgccgcctgggtgtgcgtgcgcgatcggcgcctgctggtggtgcgggcgcacgggtcggatgcgttctacctgcccggcggcaaaccggagccgggagagaccgacgccgaggcggccgtccgggagaccgccgaggaggtcggcctgacggtcggggacccgcggttcttccggaccttcgaggcgccggcccacaaccggccgcccggcacccgggtccgcctggtgtgtttcaccggggaggcggacggcgtcccggcgccggccaacgagatcgccgaactggcctggttcagctccgcggacgcggaccggtgcgctccggcgatccggctggtcctcggcgagctggtcagagccggccggatcgactga

SEQ ID NO: 1139 - DNA, 489 bp, Actinoplanes utahensis
atgccggcgtgggaagagtcttacctcgggcagctgcgcgggtcggtcggcccggagcgggtgctgatcaccgtcggggcgcgtgccgtactgcgcgaccccggcggccgggtgctgctgatccggcgcagcgacaatgggcggtgggcactgccggccgggaccatggagttgcgccagacgctcggcgagtgcgcgatccgggaggtcagggaggagaccgggctgaccgtgcacgccatcacgccgttcgccctgtactccggggagcagctgacgatcagcgcgtacgggcagccctaccagcacgtcactctcgcggtgcgggccgacatctggtcgggggagctgctgcgggagaccgacgagacgatcgacgcggcgttctacccggtcggcgagctgcccgagacggccgggccgaacacccggcggactttggacgacctggcccgcttcgaggccggcgccccgttcacgctggcctga

SEQ ID NO: 1140 - DNA, 672 bp, Actinoplanes utahensis
atggcggttttggcccagggaccggcgcggcgccatcgtcatgatggtccatctccgcggcaacgcgggcccggcgtgggcgagcatgagatcgtgcgcacacccggccgggccgcccggcgtcgccgcggcgtcccggcgttgttctccctcggcgcgaccggcctgctggccgccggcggcgtcctgttgctgtccaccctgatcccgccgctgttcggctggtcgtcgtcggtggtgatgagcggctcgatgtgtccggcgattcagccgggcgacgtggtggtgacctcaccgccggcgccgcgggacatccgcgccgggttcgtggtccggttccacgacccgagccggccccggcggccgatcctgcaccggatcctcaccatcgacgagcacggcatgctggtcaccaagggcgacgcgaaccgggtggtggactcggcgccggtgccgcgcagcgcggtgaccgggctgggtcggctacgggtgccgtacgtgggactgccggtgctctggtgggtgcggcgggactatctccggctgatcgtgaccggcctggtcctgctggtgctgtgcgcgctgacgtcggtgggccgcacggcccggcctccgctgcccggccggcgccgagcggggacggcgagggccgccggccgtccgacaacctga

SEQ ID NO: 1141 - DNA, 780 bp, Actinoplanes utahensis
atgaaggaacgcaaggcgatcgagagctggctcaccgacatggacggtgtgctcgtccacgagggtgagccggtgcccggcgcacccgagttcgtgaaccggatgaaggcctccggcaagccgttcctgatcctcaccaacaactccatctacaccccgcgcgacctgcaggcccggctcacccggatgggcttcgaggtggacgagcagtcgatctggacggccgcgctggcgaccgcgcagttcctcgccgaccagcggcccggcggcaccgcgtacgtgatcggtgaggccggcctgaccaccgcgatgcacgcgtcggggtacgtgctgaccgagttcgacccggactatgtggtgctcggcgagacccgcacctacagcttcgaggcgatcaccaaggcgatccggctgatcaacggcggtgcccggttcatctgcaccaacccggacgcgaccggcccgtccaccgagggcctgctcccggcggccggctcggtggccgcgatgatctcccgggccaccggggtgaagccgtacttcgtcggcaagcccaacccgatgatgatgcgttcggcgctgaacgcgatcggcgcgcacagcgagaccaccgcgatgatcggcgaccggatggacaccgacgtcctctgcggcctggaggccgggctggagacgatcctggtgctcaccgggatcagcagccggatggagagcgagacgtacccgtaccgcccgtcccggatcgtcaactcggtcgccgacctgatcgacgagatctga

SEQ ID NO: 1142 - DNA, 1047 bp, Actinoplanes utahensis
gtggtttacgacgcgttcgtcctgctctccttcggcggccccgaaaagcccgatgacgtgatgccgttcctgcgcaacgtggtgcgcgggcggggcgtcccggacgagcgcctcgccgaggtgcgtgagcactacatgcacttcggcggggtctccccgatcaaccagcagtgccgcgacctgctcgccgcggtgcgggccgagttcgccgggcacggcatcgacctgccggcgtactggggcaaccgcaactggcacccgatgctggccgacaccgtggcccagatgcgcgacgacggtgtcgaacgcgccctcggcttcgccaccagtgcgtacggcggatattcgtcctgcaagcagtattgggaggacatcgccgcggcccgcaaggcggtcgggccgaaagcgccggtgatcatgaagctgcggcagttccacgatcatcccggcttcgtcgagccgcacgccgaggcggtccgtgccgctctgggcacgctcgacccggcccgccgggccagcacccggatcgccttcacggcccactccatcccgaccggcatggcccgcaacgccggccccaccggcggccgctacaccgcccagctggaggagaccgcccggctggtccaggcccgcgccgccgaggacgtgccgtgggacctggtctggcagagccggtccggcccgccgcaggtgccgtggctggagccggacatcaacgaccacctgacggccctcgccgagaaggggatcaccgacgtggtggtcagcccgatcggtttcgtctccgaccacctcgaggtgctctgggacctggacaacgaggccagggagaccgccgagcggctgggtctgggctacgcccgggccgccacgccgggcgtccacccgcggttcgtcagcatggtgcgcgagctggtcgaggagcggctgggtgagcaaccccacaaccggctcggtacgctgccgacctgggacgtctgcccgacggagtgctgccccccggcgacccgaccctccgcaccgcgacctggagcccccgcatga

SEQ ID NO: 1143 - DNA, 768 bp, Actinoplanes utahensis
ttgtctggactgctggccggtaaacggctgctcgtcaccggcgtcatcaccgacgcctcgatcgccttctcggtggcgaagctcgcgcaggagaacggcgccaccgtcgtgctcaccggcttcggccggctctcgctggtggagcggatcgccaagcggctccccgagaccgctccggtcatcgagctggacgtgaccaaccaggagcacctggacgcgctggcgtcccgggtccgcgagcacgtcgacgggctggacggcgttgtccactcgatcggcttcgccccgcagagcgccctcggcggcaccttcctcgagaccccgtgggaggacgtggcacaggcgctgcacgtctcgacgtactcctacaagtcgctggcgaccgcctgtctgccgctgatggaccagggtggctcgatcgtcgggatgaccttcgacgcgaccaaggcctacccgctctacgactggatgggcgtggccaaggccgggctcgagtccgcctcccggtacctcgcgatgtacctgggcaagcacgggatccgcagcaacatcgtgtcggccgggccgctgcgcaccatggcggccaagtcgatcccgggcttcagtgacttcgaggatgcctggacccggcgcgcgccgctgggctgggagctggagaacccggagccgaccgcccgcgcggtctgcgccctgctcagcgactggttcccggccaccacgggtgagatggtgcacgttgacgggggttaccacgccatcgccgcttag

SEQ ID NO: 1144 - DNA, 705 bp, Actinoplanes utahensis
gtgcctcgcaccgtgttggtgaccggcgggaaccgcgggatcgggctggccatcgcccaggccttcgccaagcagggcgaccgcgtcgtgatcacccaccgtggctcgggcgcgcccgagggcctgttcggcgtgcagtgcgacatcaccgacgccgcgtcggtcgacgccgcgttcagcttcgtggaggccgagatcggcccgatcgaggtgctggtcgccaacgccgggatcaccgacgacacgctgctgctgcggatgtccgaggagcagttcgagcgggtcctggacaccaacctgaccggcgccttccgggtcgccaaacgggccagtggcaagatgctgcgggccaagtggggccggatgatcttcatctcctcggtggtcggcctgtacggcggtcccggccaggtgaactacgccgcgtcgaaggcgggcctggtcggcatggcccgtagcatcacgcgggagctgagcacgcggaacatcacggcgaacgtggtggcgcccggcttcattcagaccgagatgaccgacgtcttgcccgactcgcgcaaggccgagatcatcaaggccgtcccggccggtcgtctcgccagcccggaagaggtcgccgcggcggtgaccttcctggcgagcgacagtgcggcgtacatctcgggcgccgtgctccccgtcgacgggggcttggggatggggcactga

SEQ ID NO: 1145 - DNA, 1209 bp, Actinoplanes utahensis
atggagactactggcccgaggcggcgaaacggggcaatggggccgctggtccggctcgcggtcggccgcgagaccgcccgtccgccggtccgcgggcgcctccggttcaccctcccgctgatcctgttcgtgctggtcagtctgggtctggcggcgtgggaggagctcagcacgacccgggagatcccggccctgctggtcgggatcatcgcggtgggatcggtgttgccggtcgcggtgtcgtaccggtggccggtgaacgcctggcggctcaccttcctgatgatcttcctgggctgggtcgaccacgcgcccggcgacccctggccgtggaacgccgtgcagatcctggccacgctgttcgtgctgggccggctcgccgcggtcagcgcctccccggtcacgctcggggccaccaccctcaccgtgatcgcggtgctgctgctcggcggggcgaactccgggggcgccgcggtgctgatcgtggcgatcaccgcgctcgggaacatcgcctcgcaccgccgccgcacccgcgagctgctcgccgagcagaccgagctgaatgagcaggaacgcgcgaaacgggcggtgctggaggagcgcacccggatcgcccgggagatgcacgacgtggtggcgcaccacatgtcgatgatcgcggtacaggccgagaccgccccctaccggctgccggctctgcccgacgaggcccgcgacgagctggcgtcgatcgccggagcggcccgcgaggccctcgcggacatgcgacggctgctcggcgtgctgcgtgccgagcaccaggaggcggaccgggcgccgcagccggggtacgccgagatcgccgccctggtgatcaccgcgcgccgggccgggctgccggtcaccggcgagctgggcgaggtggccggggtgggcgaggcggccgggctggcggcgtaccggatagctcaggaagcgctggcgaacgcggcccggcacgcgccgggcggcccggtgcggctgaccgcccgcgccgccggcgacgacctggagctgtcggtcaccaacgagctgaccacgccgccggaaccgggacaccggccgggacacggattgatcgggatgcgtgagagggtggctctgctcggcggcgagctgtccgccgggccggacggcgccggggcgtaccgggtgctggcccgcatcccccggcagccggagacccgatga

SEQ ID NO: 1146 - DNA, 648 bp, Actinoplanes utahensis
atgatcaaggtactgatcgccgacgaccaggcgatggtgcgccagggtttcggcgcgctgctggccgcccagccggacgtgctggtggtcggggacgcggcggacggcgcggccgcggtcaccgccgcccgcgagctgaatccggacgtggtcctgatggacatccggatgccggtgatggacggcctggaagccacccggcggctggccggcggcccgcggatcctgatcctgaccaccttcgacctcgacgactacgtgtacgaggcgctgcgcgccggcgcgagcggcttccttctcaaggacgcccccgccgccgacctggtgcaggcggtccgcgtggtggccgccggtgaggcgctgctggccccgtcggtgacccgccggctgatcgccgacttcgccgcccgcccgcgcgccgaccggccccgcccggtcgcgctgaacgcgctcaccccgcgcgagaccgaggtgctgcggttgatcgcccgcggccggtcgaaccaggagatcgccgccgacctggtggtggccgagcagacggtcaagacgcatgtcgggcggatcctgatgaaactcgcgctccgcgaccgggcgcaggcggtggtcttcgcctacgagaccggcctggtcgcggccggggagtga

SEQ ID NO: 1147 - DNA, 180 bp, Actinoplanes utahensis
gtgcgccgcgacaccaccgggagtgggcatggccgcgacgtgaccgcgtgttctctccccgcccgtcacgctgcggaagtaggtggccccaccatgaagaacctgatcgctcccctcggcttcaccgtgatgaccgcctgggtcgtcctgctcttcgtcctgacctcgcacaacgcctga

SEQ ID NO: 1148 - DNA, 951 bp, Actinoplanes utahensis
atgatccgtttcctggctccgtggtggctgctgacgctgctgcccgtcctggccgtcgccggcgcctacgtgtggcggcagctgcgccgcaagtcgttcgcgatccgcttcaccaacgtcgacctgctgcgcaccctcgcaccgaaggggctgggctggcgccggcacgtgtcggcggtcgcgttcctgctgatgatggcggcgctggcgtgctccacggcgcggccgtcggtggacaccaagcagccgctggagcgggcgaccgtgatgctggccatcgacgtgtcgctgtcgatgcaggccgacgacgtggccccgacccggatccaggcggcgcaggaggcggccaaggcgttcgtcaacgagctgccgcccacctacaacctgggcctggtgtccttcgcgaaggcggcgaacgtgctggtcgcgccgaccaaggaccggtccgaggtgctggccgggatcgactcgctgaccctggccgaggcgaccgcgaccggggaggcggtgttcacctcactggacgcgatccgctcggtgcccggggacggggcgaacggcgcgccgccggcccggatcgtgctgctctccgacgggtaccgcacctccggccgctcgatcgaggacgccgcgaccgcggccgccggggcgaacgtgccggtcagcacgatcgccttcggcaccgacaccggcgtggtcgacatccgcggccagctgcagcgggtgccggtggaccggctctcgctgcaggagctggccgaccggaccaagggctacttctacgaggcggcctcggtgagcgagctcaagaaggtctaccaggacatgggcagctcgatcgggcaccggacgcagccgcgcgaggtaacccagtggtacgccgcgacggccctgctgctggcgctgatcggcgccgcgacgagtctgctgtggacgtcgcggctgccgtga

SEQ ID NO: 1149 - DNA, 948 bp, Actinoplanes utahensis
gtgagcctgcccgccacgccgccaccggcgccgcccgaggaggcggcccgagccgaggccgtgctcgcccgcctgcagctgctggtcacccggaaactcgacggcctgctccagggcgactacgtcggcctgctgcccggtccgggcaccgaggccggcgagtcccgggagtaccgtcccggcgacgatgtgcgccggatggactggccggtcaccgcccgcaccacgctcccgcacgtgcgccgcacggtggccgaccgggagctggagacgtggatggcgatcgacctgtcggccagcctcgacttcggcaccgccaagtggctgaagaaggacctggtgatcgccgcggccaccgcgatcacgcacctgagcgcccggggcggcaaccgggtgggcgccgtggtcggcaccggcaccggcaccggcggcgacgtggtgcggatgccggcccggccgggccgcaaggaggcgcaggggctgctgcgcgggatcgcccgcaccgcgatccggcccgggcgcaccgacctgggcgccctgatcgacacgctgaaccggccaccccggcggcgcggtgtggccgtggtgatctccgacttcctggccccggtggacggctgggcccgcccggtgcgccggctcggcgtccggcacgacgtgctggccatcgaggtggtcgacccgcgggagctggagctgccggacgtcggcgtgctggccctgatggacccggagaccggcgcgctgcacgaggtgcagaccgccgatccgagactgcgggagcggtacgcggcggcggccggcgagcagcgcgccgcgatcgcccgcaccctgcgcgcggccggcgccgcccacctgcgcctgcgcaccgacaccgactggctgctggacatggtccgcttcgtggccgcccaacgacacgcacgcacccgggggaccactcgatga

SEQ ID NO: 1150 - DNA, 1272 bp, Actinoplanes utahensis
gtgttatgcgccgggcggccacgggggaagccgcccggcgacgaggtaaatgctacacggttcacagacttccgtatccacccggtgagcgtgcccgttccggcggatcgcgcagaaagatcaacatgttcggccgatagtgccctgggctgcgcggatccccgggatggcggggagtggtctctatgcttccaggaacgtcgtgtaagtcttgaccgtcggcatccgcgccggcggacaggtgaccgttgtggaggaccggtggcgcagcccagcacgcccgagaccgagaccaccccggagggggccgccccggttccgccggcgcacgacgcgtcgcagctggagcgggcgatgttcgaggtcaagcgggtcatcgtcggccaggaccggatggtcgagcggatgttcgtggcgctgctggcccgcggtcactgcctgttggagggcgtgcccggggtggccaagaccctcgcggtggagaccctggccaaggtggtcggcggcaccttctcccgggtgcagttcacccccgacctggtcccggccgacatcgtcggcacccggatctaccggcagagcaacgagaagttcgacgtcgaactcggcccggtcttcgtcaacttcctgctggccgacgagatcaaccgggccccggccaaggtgcagtcggcgctgctcgaggtgatggccgagcaccaggtgtcgatcggcggcaagagccacgaggtgcccgacccgttcctggtgatggccacccagaacccgatcgagcaggagggtgtctacccgctgcccgaggcgcagcgcgaccgcttcctcatgaagatcatcgtgggctacccgaccgatgccgaggagcgcgagatcgtctaccggatgggggtcagcgcgccggagcccaagcaggtcttcaccccggacgacctgctcgccctgcagcgccgcgccgaccaggtgttcgtgcacaacgcgctggtcgactacacggtccggctggtgctggccactcgcgccccggcccagcacggcatgcccgacgtcgcccaactgatccagtacggcgcctcgccgcgcgcctcgctcggcatcgtccgcgccacccgggcgctggccctgctccgcggccgggactacgcgctgccgcaggacctgcaggacgtcgcgccggacatcctgcgccaccgcctggtgctcagctacgacgcgctcgccgacgacgtcccggccgaccagatcgtggcgcggatcatgcaggccgtgcctagctag

SEQ ID NO: 1151 - DNA, 225 bp, Actinoplanes utahensis
atgttggtcgacatggttgaggaactctccccgcagtgctccgccaaaggttgccgtgcgtcggcggcctggcaactactctggaacaatcccaagctgcacgcaccggaataccgcaagacctggttggcctgcgacgagcaccgggtctccctcggcgcgttcctcgaagcccgctcgttcctgcgggaagtgacggctttcgagtcgtctcctacgctctag

SEQ ID NO: 1152 - DNA, 504 bp, Actinoplanes utahensis
gtgagcacgccgccgatcgatgccctgcagccctggccggacacggtccagtggcgcccggtctcccgcaaactgatcactgtggaactgctcgggctcgccgtctggcagacggtcctggtgctcggcctcggcatcgcctggctgttcctgcgccagtggggctggctggccggcatcggcggggtgctgctgatcggcgtctggcgggccgtcgtcgcgatccgcgcggtccgcgcctggggatacgccgagcgggacaacgacctgatggtccggcacggactgctggtccgcacgctgtccatcgtcccgtacgcccggatgcagtacgtcgacgtcaccgccggcccgatcgagcgcgccttcggcctggccaccgtgcagctgcacaccgccgcggcggccagcgacgcccgggtgcccggcctgccgcacgaggaggcggcccggttgcgcgaccggctcaccaccctcggcgaggaccgggccgagggcctgtga

SEQ ID NO: 1153 - DNA, 1260 bp, Actinoplanes utahensis
gtgcgacgccggctgcacccgctcagcccgctgctgcacggcgccaagaccctcgccgtgatgatcgcggcactctcctggcagaccctgcgccagctcgggctggcccacttcgcgctggtcgtgctcgccatcgcggtcggcgcggtgatcttctcagcggtcggctggtggaacaccggctatcaggtggtcgcccgcgagctgcggatcagcgacgggctgctgtggcgccggcaccgggccatcccgctcgaccgcctgcagtcggtggagctgcgccgcccgctgctggcccagctcaccggcctggccgagctgcgcctggaggtggtcggcgggaacaaggcggaggccccgctggcctacctgagcgtgcgggaggccgcggcgctgcgcgagcgactgctgtccctctccgggtcggctcccctcccgctgcccgcggtcccccaggagaatctccttctggcggtacgcaaccggcagctgctgttcagtcagctgctcaccccgcaggccttcctgctgccgatcggcgtcgcctgggtgatcacccagttcgtgatggaggggtcgtggaccttcatcgggatcgccagcaccgtcaccgcgatggccggggtgctgctccagccgatccgtcgggtgctgcgcgactgggatttccggctggcccgcgacgccggcggccggctgctgctgcgctacggcctgaccgagacccgcagccaggtggtgccgctgcaccgggtgcaggcggtccgggtcacctggccgttcctgtggcggctgaccggctggctgcacctgcagctcgacgtcgccggttatcacaacccggagcacggccgggacagcggctcggaccggctgctcccggtcggtgacccggccgccgcccggctgctgattggcgccgtgctgcccggcgtcgacctggccaccctggccacctccccgccgccgccgcgggtccgctggctgcacccgttcgagctgcgcttcatgggcgtcggcctgcaccccgacgtgctggtcacccgcggcggccgggtgtcccgggagatgacggtggtgccgtacgcccggctgcagagcgtccgggtcgagcagggtccgctgcagcgcctgctgcgggtcgccacggtgtacgcggacgcggccggcggacgctccggcgtggcccgcgaccgtgacctggccgaggcgtgggcgctcgccgacgagctggcccgccgggcccgcctagctagctag

SEQ ID NO: 1154 - DNA, 393 bp, Actinoplanes utahensis
atggagctcccggagttcgctcccggcctcagcgcccgggtcgagttgaccgtcaccgatgccgacaccgcccagtccctcgggtccggtgacgtcccggtgctggccacgccccgggttctggcgctggccgaggccgccacggtcgccgccaccgcccgccacctgcccggcggcatcaccaccgtcggcgtccgtgccgcgatcgaccaccacgctccggccgccgtcggccggacggtgaccgcccaggccgcactgacccgggtggacgggcgcacgctggccttcgacgtgacggtgcgcgacggcgccaccgtgatcgccgaggtccggatcgaccgcgcgatcgtcgaccggcagcgcttcatcgccaaggcgctcggcgactga

SEQ ID NO: 1155 - DNA, 1083 bp, Actinoplanes utahensis
atgctgaggccggccaggacggtgggcaagatgcggaacatcccgcaattgtctcaaaagcggatttatccggtgacagaacctcaggctggatttccccgcgcgctcgcgcgaggctttcggcatcgaaggcggagaggacacggcatggggtacgcggtggtgctgggcgaagcgctgatcgatctgctggaggctgagcgcggcggcgagttgatctatcggcaggcgatcggtggcgcgccgctcaacgtggcggtggcggtggcccgactcggcggccgggtggagtacgccggcacgctcggcacggacgtactcggcgaccggatcgccgccttcctggccgaggccggcgtcggtgccgccggggtgcgccgggtcgcggtgccgaccacgctcgcggtgaccaccttccagggcgccgagccggcgttcaccttctacggcgagccgccgtcgtacgccctgctcaccgcggacgatctggacccggccacgctggccggcggggacctgctctacaccgggtcgatctgcctgctccgcgagccgttccggacggccgcccggcgggcgtgggcggacttcaccggattgcgggtcttcgatcccaacgtacgcccgaagctgctgcccgacgcggccgccgtgaccgccctgcgcgacctggtcgaggagttcttcgccacggccgacctggtgaaactcagctcggccgacgtcgagctgctctacggcgacgccgatgtggccgccgcggcgcggcggatccgggcgctgggtgccggcgcggtcgtggtcacctgcggggcccgcggcgcgcacatcgccgcggccggtgacgcggtgctggtgccggccccggtggtggccgcggtcgacgccaccggcgccggggactcggtgatgggtgcgctggtcagccggctgctggccgagggccgcccggcggatgcggccggctggcggcggcaggtgcgtttcgcgctcgcggtggccgcgctggtctgcgaacgcccgggcggcgccaccgcgatgccgaccccggccgaggtgaccgcccgctggggcgagctttga

SEQ ID NO: 1156 - DNA, 543 bp, Actinoplanes utahensis
ttgcccaccgtcctggccggcctcagcatggggatggccgtcccggctcccgggccggccgtcttcctgccctggaaagccggccgccaggcgatcacctacgatgccgcgctggtcccgccgggcgccaccgccctggtcgagttcagctccaccgggcagaacctgtggatccgtctggaggtcaccggcctggtgccgggccacacctacggcgcgcacatgcacgtcgccggctgtgggaagaatccgtcggcggccggcccacacttccagcaccaccacgctccggccgcggccggcgacggcgatccgcggtacgccaacccgtcgaacgagatctggctggacttcaccgccgacgcgcacggcggcgcggtggtccgtcgcgagcagcactggatgttcgcccacgagcagccgccccgctcgctgatcctgcacgccgagccgacccggaccgggccgggcacggccggcaccgccggggcccgggtcggttgcctgaacctgccgttcggcaacggcaccggtgggcggtaa

SEQ ID NO: 1157 - DNA, 1473 bp, Actinoplanes utahensis
atggcgcagcaggacggcggcacacagcccgcccccaagacggagtcccacgacccggccttcccggaggcgttcctggcgttcatgcgcaccggttggcgcgaggacccgatcgcggtcgccccgctgcccgaggtgccgaactacgccaagcgccgtgccgcgctctccgaggcgttccccggcgagacgctgatcatcccgagcggcaacgagaaggtgcgcgccaacgacaccgactacccgttccgcccgggcagcgacttcttctacctgaccggcgaccgtgatccggacagcgtgctgatcctgcacccgaccgcgtccggccacgaggcggtgctgttcacccgggagcgcaactccaaggagagcgaccgcttcttccgcgaccgcaacggcgagctgtggatcggccgcacccacacgctcgccgagaaatcgaccgagctgggcctggagaccgcctcgctgggccacctgggctcggcgctggcccagtccgccccgggccgcacccgggtgctgcgcggcctcgacccgaacgtcgaccggaccgtgctggcctacgagcccgaccgggccaaaccccgcgaccgcgagctggcctgggtgctctccgagctgaagctggtcaaggacgagtgggagatcgcccagttgcaggccgcgatcgacgccacggtgctcggcttcgaggacgtggcccgggtcctgccggccgaccgcggggtcaaggagcggctgctggagggcgtcttcgggctgcgcgcccgacacgacggcaacgacctgggctacggctcgatcgtcggcgccggcgcgcacgcgacgatcctgcactgggtccgcaacaccggcgtgaccacgccgggcgagctgctgctgatggacatgggcgtggagggccacaacttctacaccgccgacgtgacccgcacggtcccggtctccggcacgttcacccccctgcagcgccaggtgtacgacatcgtccacgcctcgcagcaggccgggatggacgcgatccgtcccggtgtgctgttcaaggacgtgcaccaggcgtgcatgcgggtgctcgccgagggtctgcacgacctggacctgctcccggtcagcgtcgacgaggcgatggccgaggacagcaccgtctaccgtcggtggaccctgcacggcttcggccacatgctcggcatcgacgtgcacgactgcgcgaacgcgcggaacgagacgtaccgggacggtccgctcgccgagggctacgtgctgaccgtcgagcccgggctgtacttccagcccgaggacgagctggtcccggccgagctgcgcggcgtcggcatccggatcgaggacgacgtggtggtcaccgcggacggctgccgcaacctgtcggacggcctgccccgtacctctgccgaggtcgagtcgtggctggcggcacagcgcgaggccggcccgcgcctgcccggctga

SEQ ID NO: 1158 - DNA, 540 bp, Actinoplanes utahensis
gtgctacattgcgccgcatgccgtccgtggggcggcagagtggaggttgcggtgcggttccagcgggtcctgtgcgcggttgccctgaccgggctggtggccggctgcacctccaccgcccccgacgagccgaagttcacccagccgtcggtggccgcctcggcgccgccctggactgagccggacgcgtattcctatgtgctgacccggggctgcgacgcggccaagccggccgggcgttaccgggcgaaggtgcgcgccgggcaggtggccggcgcgacccggatcgggacgccggatgcgccgaacccgtcggccgacgtcgatctgggcccggtcaccggcgagcagggtgaggagatcgacgtgccgaccctggccgggctgctggagatggcgcggaccaccgcggacgacggtggtcaggtgaccaccgagttcgacgtcaaggacggccacccggtccgggtcaccctgaacacgaccggcgccgcggacggggccgagtgctggagcgtcagcgactaccggatcgggtag

SEQ ID NO: 1159 - DNA, 390 bp, Actinoplanes utahensis
atgacgacccaggcggatctggatcagctcaccgacttcttcggccgctacggcgcggcgctcaccatcggcgacgtggtcggcatcgcaggctgtcacgccctgcccgggatggtggtggccgactcgtacagcttcacgttcagctcgccggccgccgtcgcgctctccttcctgggcgccgcgcccacctatcgggaacagcggatcgtcgcggcgcatgcgcagatcctcggggtgcagcggatctcggcggcgctcgccatggtcgaggtggagtgggagtacctggacagtgagggtggggcggtccccggcgagcggtaccggtacctggtccggatcggggccgacggcccgctgatcaccacggtgatcgcttcccgctga

SEQ ID NO: 1160 - DNA, 2778 bp, Actinoplanes utahensis
atgacggtggccagcctcgacacctttggtgcgaagagcgagctgcgcgtcggagacgcgagctacgagattttcgagatcgacaaggtggagggccacgaccggctgccctactccttgaagatcctcctggagaacctgctccgcacggaggacggcgcgaacatcaccgccgaccacatccgcgcgctcggcaactgggaccagaacgccgaccccagcgtcgagatccagttcaccccggcacgggtgctgatgcaggacttcaccggcgtcccctgcgtggtcgacctggccaccatgcgggaggccgtcaaggacctgggcggcgacgccaccaaggtcaaccccctcgccccggccgagctggtcatcgaccactcggtgatcgccgacctgttcggccgtgcggacgccttccagcgcaacgtcgagctggagtaccagcgcaaccgcgagcgctaccagttcctgcgctggggccagaccgcgttcaacgagttcaaggtcgtcccgccgggcaccggcatcgtgcaccaggtcaacatcgagtacctggcgcgcacgatcatggagcgcaacggccaggcgtacccggacaccgtggtgggcaccgactcgcacaccaccatggtcaacggcctgggggtgctgggctggggcgtcggcggcatcgaggccgaggccgcgatgctcggccagccggtcagcatgctgatcccgcgcgtggtcggcttcaagctgtccggcgaggcgccggccggcaccacggccaccgacctggtgctgaccatcaccgagatgctgcgcaagcacggcgtggtcagcaagttcgtcgagttctacggccccggcgtgagcgccgtgccgctggcgaaccgggccaccatcggcaacatgtcgccggagtacggctcgaccgtcgcgatcttcccgatcgactcgcagaccatcgactacctcaagctgaccggccgcaccgagcagcaggtcgccctggtcgaggcgtacgccaagcggcagggcctgtggctcgacccgaacgccgagccggactactcggagaagctcgagctcgacctctccacgatcgtcccgtcgctcgccggcccgaagcggccgcaggaccgggtgctgctcagcgcggccaagtcggcgttccgcgacgcgctgccgaactacgccgcgccgcacggccacgccgacgaggccagcgaggagtccttcccggcctccgacgcgccggccaacggcgtcgacgacgaggccgacaagccgcacctgttcagtgccgcgctcggcgccaccggccgcacctccaagcccacccgggtcaagggcgacgacggcgtggagtacgagctggaccacggcgccgtcgtgatcgccgccatcacctcctgcaccaacacctcgaacccgcaggtgatgatcggcgccgcgctgctcgccaagaaggcggtcgagaagggcctgacccgcaagccgtgggtcaagaccaccctcgcccccggctccaaggtcgtctccgactactacgaccgggccggcctcacgccgtacctggacaagatcggtttcaacctggtcggctacggctgcaccacctgcatcggcaactccggtccgctgcccgaggagatctcggccgcgatcaacgaggccgacctcaccgcggtctcggtgctctccggcaaccggaacttcgagggccggatcaacccggacgtcaagatgaactacctggcgtccccgccgctggtcgtcgcgtacgcgctggccggttcgatggacatcgacatcaccaccgagccgctcggcaccgggtcggacggcaagccggtctacctgaacgacatctggccgtccgcgcaggagatcgacgaggtgatcgcccaggcgatcggcgccgagggtttctccgccgcctaccaggacgtcttcgccggcgaccagcagtggcagtcactgcccaccccgaccggtgacacgttcgcctgggccggagactccacgtacgtccgcaagcccccgtacttcgagggcatggccgccgagccggcgcccgtcgccgacatctcgggcgcacgggtcctggccaagctgggcgactcggtcaccaccgaccacatctccccggcgtcctcgatcaaggcggactccccggccggtaggtacctcaccgagcacggcgtcccgcgcgccgagttcaacagctacggctcccgccgcggcaaccacgaggtcatgatccgcggcacgttcgccaacatccgcctccgcaaccagctggttcccggcgtcgagggcggcttcacggtcaaccacctgaccggcgagcagaccaccatctacgacgcctcggtcgcctacaaggaggccggcgtcccgctggtcatcctggccggcaaggagtacggttccggctcctcccgcgactgggccgccaagggcaccatgctcctcggcgtccgcgccgtcatcgccgagagctacgagcgcatccaccgctccaacctgatcggcatgggcgtcctgccgctgcagttcccgcagggccagaacgccgagtcgctcggcctgaccggcaccgagacgttctccttcgagggcgtcaccggcctcaacgacggcaccacgccgcgcaccgtcaaggtcaccaccgacacgggcatcacgttcgacgcggtcgtccggatcgacacgcccggcgaggcggactactaccgcaacggcggcatcctgcagtacgtgctgcgcaagatgctgcgcggctga

SEQ ID NO: 1161 - DNA, 249 bp, Actinoplanes utahensis
atgacggatgacaacagcgtgctgaaccgcattcacggcctggtcgaggaggagcaccagctccgcagcgagctgggccagggcaagatttcctcgaccgaggagcacgcccgcctcaaggagctggaagaggctctcgaccagtgctgggacctgctgcgccggcgccgggccgcccgggagaccggcaacgacccggaggcggagaaggcgcacagcgtcagcgaggtggagagctacctgcagtga

SEQ ID NO: 1162 - DNA, 918 bp, Actinoplanes utahensis
gtgcgcgagcacgacacctacggtccgacgacgatgcgccgtggccgccgcaagttcgatgatgacgaagcaagctttgtgaaatccggccggctggagccggccctcaaagaggatcccgacctgcccgaggtcggtgacaactggtccagctgggacggtgctctgcacggtccgcagccccggcctgactgggtgcgcaccgagcacggcgcggtcgacaccgagctgggtgtgctgaaaaccggtaaggaagcggatgtcttcctggtccggcggtggctgccggcgaccggggagaccagcatgctggccgccaaacggtaccgggacggcgagcaccggatgttccatcgggatgccggctatctcgaaggccgccgggtgcgtcgttcccgggagatgcgggcgatgacgaaccggaccgcgttcggcaaggagatgatcgccggtcagtgggcggccgccgagttcgacgcgctcggccggctgtggcagatcgggcaggagagcggcctggtctgtgtgccgtacccggtgcagctgtccggcaccgaggtgatgctggaattcatcggcgactgggagaccggcgaggccgccccgcggctggcccagctccgctccggggacggcgacctggaaagtctgtggcagcagatgaccgacgcactgtcggtgctggcccgcgcccaggtggcccacggcgacctgtcgccgtacaacaccctggtccgcgacggccgtctggtcctgatcgacctgccccagatcgtcgacgtggtcgcgaatccgcgcggtgccgagttcatcgcccgggacgtcaccaacgtcgccggctggttccgttcgcggggactcccggtcgatccggaagcgctgaccgcccgcctgctgttcgaggcgggcctgcagtga

SEQ ID NO: 1163 - DNA, 807 bp, Actinoplanes utahensis
atggatttgcaactcgccggtaagcgggcactggtgaccgggggcagccgggggatcgggctgcgcatcgcgcggtcgctgctcgccgagggagccgatgtggcgatcgtcgcacgtgacggggaacggctggccaaggccgccgccgaactggcggcggcgggccatcccgggcggatcgtcacggtgcggctcgacaccggtgacgacgcgtcggtgcgggccggtgtgcagcgggttcgcgagcagctcgggggcatcgacattctggtcaacaacgcggcggtgcccggcggcgggccgggtggcccgatcacgccgtcgcagaccaccgaccggcagttcgtcgacgcggtcaatgtcaaggtgctgggatatctgcgcaccgcccgcgccgtggcgcccgacctgatcgcccagggctggggccggatcatcaacatctccggcctggccgcccggctcagcggcgacttcgtcgcgaccgcccgcaacatcggtgtggccgcgctcaccaagaacctcgccgacgaactcggccggcacggtgtcaacgtcacggtcgtgcaccccggcgccaccgtcaccgagcgcacgcccgcgctgatcgcggcggccgccgagcagtggggcgtcaccgtcgacgaggccgaacggcgccgggccgagcggaccgcgatcggccgcgaggtgaccgccgaggaggtggccgacgtggtgaccttcctcgcttcgccgcgcagcgtggccatcaccggcgacgccgtcacggtcggcggtggcctcatcggcccgatccactactga

SEQ ID NO: 1164 - DNA, 651 bp, Actinoplanes utahensis
gtgcctctagtcttcctcgccctggacgacaccctgctcgaccgcagcggtgcgttccggctgtgggcgaaaggcttcctcgacgagatcggcgcctcgcaagacgatcttgactggctggtcgccgtggacgcggacggcctcacctcccggtgggacctcgccgaccagatcctcgaccgctaccagctccgggtccccgccatcgacctcgtcgacgaactccacgaaggcccgctcacctacgaacgcctcgacccgatggtcggctgcgccctggagatcgccgccgacgccggcctcgtcccggtcgtcgtcaccaacgggaccaccgaccagtgcgaaggccgcatccgccgcaccggcctcgaccgctatgtcgccgattgggtgatttctgagcaggccggggtgagcaaacccaacccgcggatcttcgccctcgccgcccagcgcgtccgcatgcgcctcgccggcgcatgggtcctcggcgacagcccggaagccgacatcggcggcgccgcggctctcgggctgcccagcgtgtggctgcatcgggggcgcgaatggatggacacacgcttcgctccgacccgcacggtgggcaacgtcatccagggaatctcggcgatcatggcgacgcgctcctga

SEQ ID NO: 1165 - DNA, 579 bp, Actinoplanes utahensis
gtgcccagggtaagccaggaccagctcgacgcccgccgccacgagatcctcacggcggcgcgcggctgtttcgcgcggttcggctacgagggggccaccgtccgccgcctggaggaggcgacgggcatgtcccgcggcgcgattttccaccattttcgtgacaaggagtcgctgttcctggcggttgccgaggatgacgcggtcaccatggccgagaccgtcacccgcaacggtctcgtccaggtgatgcgcgacctgctcgaccgggccggcaccagcgacggcgacacggccggctggctcggcacccagctggaggtgtcccaccggctgcgcaccgacccggcgttcgccacaaggtgggcgcagcgggcggccgcgatcgccgacgccacccacgagcggttgcagcgccagcgggaggccggggtgctgcgccaggacgtgccggtcgaggtgctcacccagttcctggagctggcctatgacggcctcgtcctccacctggccaccggccgcccgccgggcgacctggcgcgggtgctggacctggtggaggacgccgtccgccggcactaa

SEQ ID NO: 1166 - DNA, 363 bp, Actinoplanes utahensis
atgagtgacttcgacaccatggtcgagcggtacctggcgatctggaacgagaccgacgccgacgcccgccgggccgcgatcacggacgtcttcgccgaggacgtcagctatgtggacccgatcgcggcggtccgcgggcaggacgagctgagcgggctgatcggggcggtgcaccagcagttcccggggctcgtgttcagcctcggcggggcggtggacgcgcaccacgagcagggccggttcacctggcacctggggcagccgggacaggagccgctggtcatcggcttcgacgtggcggtgctggacggctccgggcggatcgcgcaggtgttcggattcctggacaaggtcccggcttag

SEQ ID NO: 1167 - DNA, 744 bp, Actinoplanes utahensis
atgagcgcggtcgggcagttgttgcggacgtggcgggacgagcgccgcctgagtcaactcgacctgtccggccgggccggtgtctccgcccgccacctgtccttcgtggagaccgggcgctcccggccgacccgggagatgatcctgcgtctggcggaggagctcgacgtaccgctgcgccatcgcaacgagttgctgctggccggcggtttcgcgccggccttcaccgagtcggacctggacggcccgccgctggcggtggtcctcgacgggctgcggcaggtgctggccgggcacgggccgtgcccggcggtgctggtcgatcgacactggacgatggtcgacgcgaacgccgcgatcgaccgcttcacccgcgactgcgcccccgagctgctggagccgccggtgaacgtgctgcgtctggcgctgcacccggacggtctggcgccgaggatcgagaatctcgccgaatggcggacgcatctgctgcaccgcctggaccggcaggccgccgcgaccggtgatccggtgctgcgcgggctgcgtgccgaactggccggctatccgggtggcgagctgaccggcgagccggtcggcgtggtggtcccgttgcggtatgccgggctgaacttcttcagcatcaccgcggtgctcggcacgccccgcgacgtgaccctgtcggagctggccatcgaggcgttcctgccggcggacgccgcgaccgcgaccgcgctgcgtgaatag

SEQ ID NO: 1168 - DNA, 771 bp, Actinoplanes utahensis
atggggcgcatggatctcgggctggctggtcgcgtcttcattctcaccggcgcctcgcgggggctgggtttcgccaccgcgcaggcgctggtcgccgacggcgcccgggtggtgatctcctcgcgggacgagcggaatgtcgcggacgcggtcgccgggctcggcgggccggagcacgccgtcggggtgaccgccgacctggccgatccgggcacgcctcgcgagctggtcgatgtgacctcggagcgatacggccggctggacggcgcgctgatctcggtgggcggtccgatgcgcggcaccgccgccgggctgaccgacgagcagtggacggccgggttcgagacggtgttcctgggttcggtgcgggccgcccgcacgttcgcggcggcgctgcccgagggcggcgcgatcggcctggtgctgtccacctcggtgaagtcgccgctgaccggtctgggtctgtcgaacgggctgcggccgggcctggcgatggtggccaaggacatggccgacgagttcgccccgcgcggggtgcgggtgctgagcctgctgccgggccggatcatgaccgaccgcaaccgggagttgttccaggccaccggcgatgcggcgaccgcggcggcggaggcggccgcgtcggtgccgctgggccggctgggcgagcccgccgagttcggccgggtggccgcgttcctgctctccccggcggcgagctacctcaccgggatcgcggtgccggtcgacgggggtgcgctgcggacactgtga

SEQ ID NO: 1169 - DNA, 495 bp, Actinoplanes utahensis
gtgagcgacgtgctcggtcccggcctgcgggtgctgttctccggcatcaaccccagcctgtattcggccgagaccggtcaccatttcgcccgccccggcaaccgtttctggccgacgttgcacggcgccggtttcaccgaccggctcctgcacccgtcggagcagcatctgctgcccgcgctgggcctgggcatcaccaacgtcgtcgcgcggcctacggcccgcgcggacgagctgtcccgcgacgaactgaccgccggtggtcaggttctcaccgatctggtacgccgtgagcacccgagtttcctcgccgtgctgggggtgacggcgtatcgtgccgccttcgcccgcccccgcgcacggatcggccgccagccggacctgctcggcggcgtcccggtctgggtcctgccgaacccgagcggcctgaacgcccacttccagctccccgacctgatccgcgagttcaccgccctgcgcgaagccgccttctag

SEQ ID NO: 1170 - DNA, 1923 bp, Actinoplanes utahensis
atgaccagctggaacatgctgcgatcgatccagagtgccgacaaggtggcgaaacaccagatcaagccgggcaccagccggcggatcctgcgcttcgccgagccgtaccggcgcgacatcgcggtcttcctggtggccgtggtcttcgacgcggtgatcggggtggccaccccgctgctggccggcaacgtgatcaacgcgatcacccgcggtggtcccgcggcgtccgtcacggtgatccggatcgccctgttcatcgccggcctggcgatcgccgacgcgctgctctccctcgcccagcgctggtattcggcgcggatcggcgagggcgtcatcctcagcctgcgcacccgcgtgtacgaccacgtacagcggatgccgttgcagttcttcacccgcacccagaccggtgcgctggtcagccggctcaacaacgacgtggtcggcgcgcaacgggcgttcacctcgaccatctccggggtgctcagcaacgtcatccagctggtgctgaccgcggtggtgatggtcagtctgtcctggccgatcaccgtgctgtccctggctctgctgccggcgttcatcatcccggcccgccgggtgggcaagcggctcgccgagatcacccgcgagtcgtacaacctcgacgccaagatgaacgccacgatgaccgaacgcttcaacgtctccggggcgctgctggtcaaactgttcggccgcccggacacggaagccgccaagttcggcgaacgcgccgccagggtccgcgacatcggcgtacagcaggccatgttctcccgcaccttcttcgtcgccatgctgctggtcgcgtcgctggcgcaggccctgacgtacgggctgggcggctggctcgcggtccgcggcgacgtctcggccggcaccgtggtgaccctggcgctgctgctcacccggctgtacgggccgctgaccgcgctcagcaacgtgcgggtcgacgtgatgagcgcgctggtctccttcgaccgggtgttcgaggtgctcgacctggcgccgggcatcgccgagaagcccgacgccacccccatcccggccggggccggccggatcgagttccgcgacgtccggttccgctaccccagcgcggccgaggtgtccctggccaccctggaggacgtggccaccctggaccgcaccgagaacaccccggtgctgcacggcgtcgacttcaccgtcgaacccggacagttggtcgccctggtcggtccgtccggcgccggcaaatccaccacctccatgctggtgtcccgggtgtacgacgtgaccggcggtgccgtcctggtcggcgacgtcgacgtccgcgacgccaccctcgactcgctgcgcgacacggtcggggtggtcacccaggactcgcacctgttccacgagacgatcgccgagaatctgcggtacgcccggccggacgccaccgaggagcagatgtgggcggccctggccggggcgcaggtcggtgacctggtccgcggcctgcccgacggtctggacacggtggtgggggagcgcggctaccgcttctccggcggcgagaagcagcgcatcgcgatcgcccggctgctgctcaaacagccgtcgatcgtgatcctcgacgaggccaccgcccatctcgacagcgagtccgaggcggccgtgcagcgggccctgtccaccgccttgagggggcggaccgcgctggtcatcgcccaccggctctccacgatccgggaagccgacctgatcgtcgtcctcgaccaggggcgggtcgtcgaacgcggcacccacgaacagttggtgaacgcgggcggcctctacgccgacctgtaccgcacccagttcgcgggggcctcggccacctacccggaggaggacatcgagatcgtcaccgtcccggccggcacggtcgaaccctag

SEQ ID NO: 1171 - DNA, 780 bp, Actinoplanes utahensis
gtgacggcggacaacgccgccggcgaggtcggcgtccgttacgaacaggacgggccggtcgcgacggtaacgttgtgccggcccgacgttctcaatgcacagaccccggccatgtggtcggagctgagcgacatttcccggaaattgcctggcgacgtccgcgtcgtcattgtgcgagccgaaggccgcgcgttttccgccggcctggatctgtcggtcgcccgcggcgacggcgattcttcactggctcgtctggcgcagttgtccgccaccgactgcgcggatcggatagccggcttccagaccgcgttcacgtggttgcgaagtccgtccatcgtgtccatcgccgccgttcagggccatgcgatcggcgccgggttccagcttgcgctgaactgcgacatgcgggtgctcgccgacgacgcacggttctccatggcggaggtcaccctcggcctggtgcccgacctgggtgggacgaaacggctcaccgagctggtcggcccgtcccgggcactggagatctgtgtgaccggccggcggatcccggcggacgaggccgaccgggtcggcctcgccaccgcggtggtgccgcgtgccgacctggacgcggcggtcgccgatctggccgccgccgtcctggccggcgaccggaacgcggtggccgagatcaagggcctgctggccggtgcctccgggcggagctatccggagcaggaccgggccgaacgggaggcacagacccgccggctcgccgaactctccggacgcggggagtaa

SEQ ID NO: 1172 - DNA, 228 bp, Actinoplanes utahensis
atggcagccactggcacagctaccagtactgagaagggtcgtcgaatcgtcggtagcgagcggcagtcgctcgccaaggacctggtgaagcgttacacctcgggcgagagcatccgggcgcttgccgcttccaccggccgttcctatggattcgtccaccgcgtgctcaccgaatccggtgtgcagttgcgccagcgtggcggcgcccgccgccgcaagaaggcgtga

SEQ ID NO: 1173 - DNA, 1605 bp, Actinoplanes utahensis
atgatcaccgccaccggactggaacttcgcgccggagcacggatcctgctgtccccgaccaccctacgggttcagcccggcgaccggatcggcctggtcggccgtaacggcgcgggcaagaccaccacgctgaaggtgctggccggcgagggcatcccctacgccggtcaggtggagcggaccagcgagatcggctacctgccgcaggacccgcgcaccggtgacctgaacgtgaccggccgcgaccgggtgctctccgcccgcgggctggacagcatcctggccgagatgcagaagctcgaggtccagctggaggagagctcggaggagaagctggtccggcgctacggccagctggaggaccagttctccgcgctcggtggctacggcgccgaggccgaggccgcccggatctgtgccaacctggggctgcccgaccgcgcgctggcccagacgatcggcaccctctccggcggtcagcgccgccggatcgagctggcccgcatcctgttcgccaactccgggcagaacggcaagggcatcctgctgctcgacgagccgaccaaccacctcgaccaggactcgatcgcctggctgcgcggctacatggcgcagcacaagggcggcctgatcgtgatcagccacgacgtcgagctgctcgacgccgcggtcaacaaggtgtggtatctggacgccaaccgcgcggtcgtcgacatgtacaacatgggctggaagacgtatctggaggcccgcgagaccgacgagcgccgccgccgccgtgagcgcgccaacgcggagaagaaggccggcgccctgatggcccaggccgacaagatgcgtgccaaggccaccaagacggtcgccgcgcagaacatggccaagcgcgccgagaaactgctcggtggcctggaggaggtgcgcagctccgacaaggtggcgaaggtgcggttccccagcccggccccgtgcggcaagaccccgctgaccgggcacggcctgtcgaagtcgtacggctcgctggagatcttcgccgatgtcgacgtggccgtggaccgcggctcgcgggtcgccatcctgggtctcaacggtgccggcaagaccactctgctgcggatcctgggcggcatgctgcagtccgacaccggtgaggtgcgcgccgggcacggcctgcggctgggctactacgcccaggagcacgagacgctggacgtggaccgcacgatcctggaccacatgcgcagcgccggttcggagcagaccgacaccgagctccgcaagatcctgggcgcgttcctcttctcgggtgacgacgtcgacaagccggccggcgtgctctccggcggggagaagacccggctggcgctggccaccctggtctgttccggggcgaacgtgctgctgctcgacgagccgacgaacaacctcgacccggtcagccgggagcaggtgctcgacgcgatcgccaactacccgggcgcgatcgtgctggtcacccacgatgccggctgcgtgcaggcgctgaagccggaccgggcgatcctgctgcccgacggcgacgaggacgcctggagcgacgatctgctggagctcgtcgagctcgcctga

SEQ ID NO: 1174 - DNA, 936 bp, Actinoplanes utahensis
atggagctgaacgagaacgccgagatcgacaccagtcaggtcgaggacgtgcgcggatccggcggtggcggtggcggcttcggcggcctgccgatcccgatcggcggcggcggactcaccggcatcatcatcaccgtgatcctgctggtggtcggcggttacttcggggtcaacaacctgggcggcggcggcggcggaggctcctccaaggccgacaacaccaagatcagaaatgagtgcaagcagtccgacaagctccagaagctcgactgccgcaacgtgctctacatcaattcgatccaggcatactgggccaccgagatgccgcaggccttcggcaagcagtacgagaaggtcaacaccacgatcttccggagccgggtgaacaccggctgcggcgccgccgactcgggcgtcgggccgttctactgcccggccgacaaccacgtctacatcgacctgacgttctacgaccagctggccaaggagctcggcgcgccgggcgagttcgcgcagccgtacgtgctggcccacgaatacggccaccacgtgcaggacctgctgggcaccgaggccaagatgcggcaggcgcagaacgccgacaagagccaggcgaacctgcagtcggtgcggctcgaactgcaggccgactgctacgccggggcgtgggccaagggcgcgaccgggaccgccgacgccaaggggaacaaggtgttcacgagcctcaccgactcggacatccagcagggcatccagaccgccgggcagatcggcgacgacaccctgcagaagcgcggcggcggcacggtcaacccggccgagttcacccacgggacgtccgccgaccggcagaagtggttccgcaccggctacgactcgggcgacccgacgaagtgcgacacgttcgcgccgggggcggtcaacgagggcgactga

SEQ ID NO: 1175 - DNA, 633 bp, Actinoplanes utahensis
atgggtgaacggccggccgccggtggcgggaaatgggtggatgtggcgcccgagcgggtggggcgctggctggagaacttcggtacccggcacgggccgtaccgggaaatcggcttgaccttgatcgccgccgacggggccgaagcgtcgctgcacgccccgcccggcgtgggggagccggcgacggtggccgagctgaccgccgccgccctggcgccgcgccggttcgggttgctgctggcgcgtaagggggcggtcgcggccggggtggtggacggcggcgagctggtgatgtccaaggtggacacgcactatgtgcaaggccggacagcggccggtggctggtcgcagcagcgtttcgcgcgccggcgggacaatcaggccaaagcggccgccgcggacggtgccgggatcgtcggacgcatcctcctgcccgaggtgcgtacgctgacggccctggtcaccggcggcgaccgggccgccgtggaggcgatcctcgccgaccgggtcctggccccgctggccgcgctgcgggccggccgcctgctggacgtcccggagccgcgccacgccgtgctggtctcggcgatcgcgatggcccgcgcggtcccgatcctgatccgtgagccctga

SEQ ID NO: 1176 - DNA, 678 bp, Actinoplanes utahensis
atgagcttgaccgaggtggtgatggcgcggctgaccacggctttcgaggcggcccgcgacccggtgcgggccccggcgatggcggcctacatgcgcgatcagttccggttcctcggcctgagcgcgactgcccgccgtgccgccgcccgcgccgtcctggccggcctgccccgccccgacgaggcggtcctggttgacatcgcccgggcctgctgggctcgcgacgagcgggagttccagcagttcgcctgcgacttcctaaccgccggcctgccggccaccagcccgggttccctcgccctcgccgaggagctgatcaccacgaaatcgtggtgggacacggtcgacccgctcgccacccacttcaccggcggcctggtccgccgacatcccgagctgtgccgccggatggacgactggtcggccgccgacgatctgtggctgatccgcaccgcgatcctgcaccagctgcactacggcgcggcgacggacaccgaccggctcttcgactactgcacccggcaggccggccacccggatttcttcgtccgcaaggcgatcggctgggcgctgcggcactacgcccgcactgacccccaagcggtgcgggcctacctgaccgcccacgccgcgcgcctgtcgccgctctccctccgggaggccgccaagcacctgtag

SEQ ID NO: 1177 - DNA, 1311 bp, Actinoplanes utahensis
atgcccgcaggtcgtcgtacagtggcgaacccggagaaggaaccgagggtgaggcgaggactggccggcctgctcgccgctgaggcgatctccctgctcggcagccggatcaccttcgtggcgctgccctggctggtgctgaccagcaccgggtcggcgctgctcgccggtgtcgccggcttcgccgagatgctgccgtacgtgctggccgggctgctcggcggcccgatcgtggaccgggccggaccgcgtcccaccgcggtcgccgccgacgtggccagcatgatcgcggtcatcggcatcccggtcctctacgccaccggggcggtgccgtaccacacgctgctcgtcctgatcgccgtggccggggcgctgcgcggcttcggcgacacggccaaacgggcgctgctgccccgggtgatcgcggccgccgggctgagcaccgaacgcggcaccacgctgtacgacgggatcagccgggtcgccacgctgctcgggctgccgctggccgggctgctggtggcggcggccggcccggcccgggtgctgctcgccgacgccgcctcgttcggcgcctgcgccctgctgatcacactgttcgtccgggccggctcgaccggccagccgcccgccgacgacgaggagggcgggtacgcggcggcgctgcgctgcggattccgccatgtgcgacaggatcggctgatcatcgggatcatgtcgatgctgttcgtgacgaacctcttcgaccaggcgtacgccacggttttcgtcccggtctgggtccgcgagggcccgcacgggccggccgcgctcggcgtgctgggcagcgccttcgggatcggggcggtggccggcaacatcctctggacgatcgtcggtccccggctgccgcgccgctccaccttcgccgtctgcttcctgctcggcgggccggcgcaactgttcgccctgtcgctgagcgaccgtctgtggccggtcctggcgatcgccgcgctggccgggacactgatggcgtcgatcaatccgatcctgctggccgccgtctacgaacgggtgccggtccggatgcagggccgggtgatgagcgtgctgatcgccttctcctgggccggcatcccgctcggcggcgtgctcggcggctgggccgccgacgacctcggcctgcgcaccggggcgctgctcgccggcatcggatatctgctggtcacgctcgccccgttcgtctcctcggcgtggcacgcgctggacgagcaccgggcgcccggccgggttgccgagcgcggcgagccgtcactgacgtctgcgggatga

SEQ ID NO: 1178 - DNA, 696 bp, Actinoplanes utahensis
atgggtgtggtcgccgaactgatcctgatccggcacgggcagagcctggccaacgtgctcttcccgcaggccgacgagggggaactgctggagatcgcgctgagcgggccggacgccgaggtgccgctcaccgagcggggcgaggcgcaggcccgggcggtcggtgcctggctggccgggcagccggcggacgcccgtcccgaggtggtggtgacctcgccgtatctgcgggcccgggagacctggcggatcgcggcgcgagcggcgggcgtggcgctgccggaaccgcgtaccgacgatcgtctcgtcgatcgtctgctcggagatctggagatgctgacccgggccgcggtggccgcccggttccccggggaggcggcgcggctggccgaggccggcccgtgggagtactgcccgcccggcggggagtcgttcgcggacatccgggtgcggctgacgtcgttcctggatgatctgcaccgtgcgcacgccggccggcgcgtgctcgtggtggcgcacgacgcggtggtgctgatgacccgcgccgtcatcgaggatctggactgggaagagctggccgcggtggagaagtccgcgggcgcggtgcgcaacgcgtcgatcacccggttcaccgacgacggtggaaccctccggctcgaccggtacaacgtgatcgaccacctcccaccggcctga

SEQ ID NO: 1179 - DNA, 603 bp, Actinoplanes utahensis
atgagcgccccgttcctggccggcgtcgtcgccggatacgggatcgcggtgccggtcggcgcgatcggtgccctcatcgccgggctcagtgcccgcacctcgctgcgggtcggcgcggccgccggcctcggcgcggccaccgcggacggggtgtacgcgtgcgtcgcggtcgccgggggcgcggcggtggccggggtgatcgccccgatcgccggtccgctgcgctggctcggcgcgctggtcctgctggcactggcgggctggacggcgtggggcgcgatccgccacccgagcaccggggcccgcgatgagcgccccacgacgccgctgcgcgcgtacgccgcaatcctgggtttgaccctgttgaacccggcgaccgtgatctatttcgcggcgctggtgctggccgacggcggcgccggcggcgggccgtggttcgtgctcggcgcgttcctggcctcggcgagctggcaactgctgatcgccggcggcggctcgctgatcgggcggctgctcaccgggccgcgcggccggttgatcaccgccctgtcgtccagcgtggtgatcgccgtgctcgccgtccggctgctgacgagtacctga

SEQ ID NO: 1180 - DNA, 846 bp, Actinoplanes utahensis
gtggacaccttcatcgcccccgacggtctccggctggccctgcaccgcgccggctccggcgacccgctggtctgcctccccggcggccccatgcaggcctccacctatctcggcgacctcggcggcctgtccgcccaccgtctgctgctcatcccggatctgcgcggcaccggcgactcgccgccgccggacgatccggacacctaccgctgcgaccgtcaggtgcccgacatcgaggcgctgcgccagcgggtccgcctggagcgtttcgacctgctgggccactcggccggcgcgagtctggcgctgctctacgctgtcgcgcaccccgaccgcgtacgccggctgatcctcgtcaatccgagcccccgggcggtctcgctggagatcagcgacctggaccggcggcgggtcgccgaggagcggcgcgcggagccgtggttcccggaggcgttcgccgccctggaacggatccagaccggtcaggccaccgctgccgacggccgggcgctggccccgttcatctacggccgctgggatgccgggacgcaggcctattcggcccgcgaggccgatcagaagaaccgggtcgcggccgcggcctacaacgccgagggcgctttcgaccccgcggccgtacgggccgggctcgccgccctgcaagcctctgtgctgctgatctccggggagatggacctgcagctgccgccgaagtcagccgccgagtacgccggcctgttcccgcacgccgagttggcgatggtgccgggcggcggtcatttcgcgtggctcgacgatcccgactggttcacccagaaggtcgccggattcctccgcggcgcctga

SEQ ID NO: 1181 - DNA, 819 bp, Actinoplanes utahensis
gtgcagggccagccggagaccgtcgggggcgatgaaggtgtccacccggaaatcctatgcgcgaacgtcgatccactggggacccgccgcgcccgtccccccgccgggaccgtcgatcgcgcggaattgtcggtgggccggtctaggctcacgaccgtggttgcgttcaccggtgacttcgagacccacctgaccgccggggccgggcaggtggcggcgctggccgcgttcgccgccgagcacggcctcacgttcctgcacatcgagctggatcgcggcgtgacgacctcgcagccgatgctcaccctgcgcggcagcggtggtctcgccgaccggctcgacgtcgcccaccagtggtgccggcggctgcgcgaggccgggatcacccccacccgggtgaaaatcgaggcgtcgccgtggaccgacggggtgccgcagcacgacgaggccgccgccgaccagcccgcctaccgctatttcgagcaccatctgaagctgcgcctcccacccgggatggccgatctgatcgcgctgaccgacctcgtcgagccgcacggggcgcggctgtcccgcaacgccctgaagcgttccgccgacggcgccgagatccgcttcgtcaaccagcgctgccatcgcgtcgggctggcgtcggccacctcgcggctggaccgcctggtcgccgcgctgcgggacgccggccacgacatcgtctcggtcgagcaggaatacgtggtgcacgacgacaacctgcggatcgacgacggctggctgccccgggaggagccggtcgacacctcgtggacgccgagccggcgctga

SEQ ID NO: 1182 - DNA, 261 bp, Actinoplanes utahensis
gtggacgccgagccggcgctgaccctgatgcgcggcatcgcccgcgccgtcgagcactcccccggcaccgggccggcgctgaccctgatgcgcggcatcgcccgcgccgtcgagcgctcccccggcaccgggccggcgctgaccctgatgcgcggcatcgcccgcgccgtcgagcgctcccccggcgccgggccggcacccggcgcggtcaccgagtccgcgatcgcgacctacgagcgggccgcgcggcacgccgcctga

SEQ ID NO: 1183 - DNA, 747 bp, Actinoplanes utahensis
atgactccgactccgcccttctccgagcttgtcacgctggtcgaggagcgttccgcggcgctgcgggaggcggccgccgccgcgccggacatgggagcccgggtgccgggctgcccggactggtcgctgcgtgatctggtcgcgcacctcggcgaggtgcagcgtttctgggcgctggtggtgaccgaggcggacccgtccgggccgccgccccgggagcggtacggcagcacgttcccgcagagcgacctgctggagtggttgggcgagtcgacccggctgctcggggccgccctgcgcgccgccgggccggacacgccgtgctgggcgtggtggccggtcgaggcggcgccgcacacggtggccgcggtggcccggcatcaggtgcaggaggccgcggtgcacgccttcgacgcgatggaggcgctcggcaaggcggaaccactgccggccgcgatcgccgtcgacggggtcagcgagttcctggcgaccggcctcggttcgcgcggcgcctggccgcaccgcccggcccgggtccagtaccaggccgtcgaaggcccctcctggaccctcgacctgtccccggccggcgccaccgccgacccggcggccagcggcgaacccgtcacccgtgtccatggcaccgccagcgacctggtcctgcacctctaccgccgcatcccgctggacgccgtccgcatcgacggcgaccgcgaggtcgccacccaaatcaacgcctggtcgtag

SEQ ID NO: 1184 - DNA, 798 bp, Actinoplanes utahensis
atgagcgataccgaatccgttcagaccgtggcccacggccacgcccaccacgaccacgatggtcacgggcacgagggccacaaccacggggatcacggccacgaccacgggcatgaccacgccgccggtggtcccgggcacgaccacgggcacgaccacgggcatgggcattcgcacgcggccgagggggacaccgcgcggaccgtggcgtcggctccggccggcgtgacgtcggccgctgacgacgaggttccggcgtggctggcgcaggagcgggccgctgcggccgcctccggcgagccggtcgaggtcccggctgccggcgtgtcggccggggccgccgccggcgattcggccaacggtgactcggcgaacggtgactcggctgccggtgacccggtcgccggtgtcgcggtcgccggtgtcgcggtcgccggtgtcgcggtcgccggtgagaaggcggcgcccgggaagaaggcctcggtcgacgacgtcgaagaggcgatgaaggacgtcgtcgaccccgagctggggatcaacgtcgtcgacctgggcctggtctacggcgtgcacgtcgacgacgacaacgtggtcaccctggacatgacgctgacctcggcggcctgcccgctgaccgacgtgatcgaggaccagacccgccaggcgctgaccaccggcccgggtggcggcctggtccaggacttccggatcaactgggtgtggctgccgccgtggggccccgacaagatcaccgacgacggccgcgagcagctgcgcgccctcggcttcaacgtctga

SEQ ID NO: 1185 - DNA, 456 bp, Actinoplanes utahensis
atgctgctcgacgcgctgtaccaggacatcatcctggaccactacaagcacccgcatgggcgtgggctgcgggatcctttcgatggcgaggcgcatcacgtcaatccgacgtgcggcgacgagatcaccgtccgggtcagttccgacttctcggatatctcctacgacgggttgggttgctcgatcagccaggcgtccgcctcggtgctgcacgagctgctgcagggcaaggacgcggcgaccgtcgccgagatccaccacgcgttcgtcgagctgatgcagagccgtggcgccatcgaacccgacgaggacgtgctcggcgacgggatcgccttcgcgggcgtcgcgaagtttccggcccgggtcaaatgtgccctgctgccgtggatggcattcaaggacgcggcggtacgggccggcgtcgaggtgggcgcgagcccggaggtgaaggcatga

SEQ ID NO: 1186 - DNA, 1230 bp, Actinoplanes utahensis
atgagctacgacgtcgcgcgggtgcgcaaagacttcccgatcttcgagcgggaggtgaacggccacccgctggtctacctggacagcgccaacacctcgcagaagccggtgcaggtgctcgacgtcatgcgcgcgcaccaggagcggcacaacggcaacgtgtcccgctcggtgcacacgctcggcaccgagtcgaccgagatgtacgagggcgcccgcgccaggatcgcgtcgttcatcggcgcgggcacgcccgacgaggtgatcttcaccaagaactccaccgaggcgatcaacctggtcgcgcacgcggccggctcgttcctgcggctgggccccggtgacgagatcgtcatctccgagatggagcaccactccaacctggtgccgtggcagctgctctgcgagcggaccggcgccacgctgcgctggttcggcatcaccgacgagggccggctcgacgagtccgagctggacgcgctggtcaatgagcgcaccaagctcgtctcggtcgtgcacatgtccaacgtgctcggcacgatcaacgacgtgacccggctcgtcgagcgggcccggcaggtcggcgcgctggtcatgctggacgcgtcccagtcggtgccgcacctgccgatcgacgtgcgggcgctcggcgtcgacttcatcgcgttcaccgggcacaagatgctcggcccgaccgggatcggcgtgctctggggcaggttcgacctgctcgcgcagatgccgccgttcctggccggcggctcgatgatcgagacggtcacgatggcgaagacgacgtacgcgccgccgcccgcccggttcgaggccggcacgcccccgatcaccgaggcgatcgggctgggcgccgccgtcgactacctgaccgcgctggggatggacaacatccaccggcacgagcaggacatcacggcgtacgcgttggaacagctcggatcggtcccgggggtccggatcttcggccccgcgtctccggtgggacgcggcggcaccgtgtcgttcggcgtcgacggggtgcacccgcacgacgtcgggcaggtcctggacgcgctcggcgtcgaggtgcgggtcgggcaccactgcgcgcggccggtgtgcgtgcgcttcgcggtgccggcgatgacccgggcctcgttctacctctacacgaccacggaggagatcgacgccctggcgcgcggtctcgaccaggtgcggaaggtgttcggctga

SEQ ID NO: 1187 - DNA, 903 bp, Actinoplanes utahensis
gtgctggctgcacggctcccgcttcgacctgcgcaccggcgagccctccggaccgcccgccatcgacccggtggcggtctaccccgtcgagatccgcgacggagacatccacgtttccacgacaccgagcaatggagtacagccgtgagcaccctggagatccgcgacctgcaggtttcggtgaagctgcccgatggtgagctgaagccgattctggccggggtcgacctcaccatcacgtccggcgagacgcacgccatcatgggcccgaacggctccggcaagtccaccctggcgtactccatcgccggtcacccgaagtacgagatcaccggcgggtcggtgaccctggacgggcaggacgtgctggcgctcagcgtcgacgagcgggcccgcgccggcctcttcctggccatgcagtacccggtcgaggtccccggcgtctcggtcgcgaacttcctgcgcaccgccaagaccgcgatcgacggcgaggcgccgaagctgcgcacctgggccggcgagctgcgcggtgccatggagaagctgcagatggacccgtcgttcgcgcagcgcaacgtcaacgagggcttctccggcggtgagaagaagcggcacgagatcatgcagctcgagctgctcaagccgaagatggcgatcctcgacgagaccgactccggcctcgacatcgacgcgctgcggatcgtcagcgagggtgtcaaccgggtgcgcgagaccggcgagaccggcttcctgctgatcacccactacacccggatcctgcgctacatcaagccggacttcgtgcacgtcttcgtcggcggcaagatcgtcgaggagggcggcccggagctggccgaggagctcgaggtctccggttacgagaagttcctggccaaggcctga

SEQ ID NO: 1188 - DNA, 1122 bp, Actinoplanes utahensis
atgactaccatcgccccgccgagcaccaagtcgcaggtgctgcgctccttcgacgtcaccgacttcccggccctcaccggcctggaggaggagtggcgttttaccccgctgaagcggctgcgtgacctggtcaaggccaccaagctggacggcgcggccccgtcggtggagcacggcgacctgccggccggcgtcacggtgtccaccgccgccgacgtcgacccggtgctcaccccgttcgaccggatcagcgccctggcctacggctcggcggccaccgtcaccgtgatcgaggtggccgccgaggccgagcccaccgaggcggccgtgatccggctggtcggcaagggcggcgcggccgcggccgcgcgcaccgtggtccgggtcggccggttcgccaaggcgaccgtcgtgctgcagcagaccggcacggtcaccctggccgacaacgtcgaggtgatcatcggcgacggcgcccagctgaccttcgtgacgctggccgagtgggacaccgacgcggtgcaggcccagcacgtgaagttccgggtcggcaaggacgcccgggtgcagcacgtgcaggtcaccctcggcggtgacctggtccggcagttcaccagcgtggagtacgccgggcggggcggcgacgccgagctctgggggctgtacttcgccgacgccggccagcaccacgagcaccgccaactggtcgaccacagcgtgcccgactgccgcagccacgtggggtaccggggcgcgctgcaggggacgtcggcgcacaccgtctgggtgggtgacgtgctcatccgcgcggcggccaccgggaccgacacgtacgagatcaatcggaacctgatcctcaccgacggggcccgggccgactcggtgcccaacctggagatcgagaccggtgaggtggccggcgccgggcacgccagcgcgaccgggcggttcgatgacgagcagctgttctacctgatggctcgcggcatccccgagggcgaggcgcgcaagctggtggtccgcggcttcttcgccgagctgatcaacaagatcccggtcgaggagctgcgcgagcggctcggcgacgcgatcgaggcccgtctggtggaggccggggcatag

SEQ ID NO: 1189 - DNA, 1422 bp, Actinoplanes utahensis
atgactgaccagatcgtcactcaggaagagcacctggccgccctcggcaagtacgagtacggctgggccgacgccgacgtggccggtgccgccgcgacgcggggtctgtccgaggccgtggtgcgcgacatctccgcgaagaagagcgagccgcagtggatgctcgacctgcggctcaagggcctgcgcctgttcgaccgcaagccgatgccgaactggggcgccgacctgaccgggatcgacttccagaacatcaagtacttcgtgcgttccaccgagaagcaggccgcctcctgggaggagctgccggaggacatcaaggcgacgtacgacaagctcggcatcccggaggcggagaagcagcgcctggtcgccggtgtcgccgcgcagtacgagtcggaggtcgtctaccacgcgatccgtgaggacctcgaggcgcagggtgtgctgttcctggacaccgacaccgcgctcaagcagcacgaggacatcttcaaggagtacttcggcacggtgatcccggtcggtgacaacaagttcgccgcgctgaacaccagcgtctggtccggcggctcgttcatctacgtgccgaagggcgtgcacgtcgacatcccgctgcaggcctacttccggatcaacacggagaacatgggccagttcgagcggaccctgatcatcgccgacgagggcagctacgtgcactacgtcgagggctgcacggcgccgatctactcgtccgactcgctgcactccgcggtcgtcgagatcatcgtgaagaagaacgcccgggtccggtacacgaccatccagaactggtcgaacaacgtgtacaacctggtcaccaagcgcgccacctgcgaggagggcgcgaccatggagtggatcgacggcaacatcggctccaaggtgaccatgaagtaccccgccgtctacatgaccggcccgcacgccaagggcgaggtgctgtcgatcgcgatggccggcgagggccagcaccaggactccggcgccaagatggtgcacgccgcgccgcacacctcctcgacgatcgtgtcgaagtcgatcgcccggggcggcggccgcacgtcgtaccgcggcctggtccaggtgctggagggctccgcgcactcgaagagcacggtcaagtgcgacgcgctgctggtcgacacgatctcccggtcggacacgtacccgtacgtcgacatccgcgaggacgacgtgaacatgggccacgaggcgaccgtctccaaggtcagcgaggaccagctcttctacctgatgagccgcggcctgaccgaggacgaggcgatggcgatgatcgtgcgcggcttcatcgagccgatcgccaaggagctcccgatggagtacgcgctggagctgaaccgcctgatcgagctgcagatggaaggggccgtgggttaa

SEQ ID NO: 1190 - DNA, 945 bp, Actinoplanes utahensis
ttgccgaccctcacccgcccgttcgccgcctggctgcgcccgctcgccctggcgaccctggtggccaacgtcgcgctgatcgtcaccggcgcggcggtccggctcaccgactccggcctcggctgccccacctggcccaaatgcaccgacgagtcgtacacgacgaccgccgcgatgggcgtgcacggcgcgatcgagttcggcaaccggctgctcggtttcgtgctggccgccctggccatcgccggcttcctcggcgcgctcggccggcggccccgccgccggtcgctggtccgcctctcggtcgcggccggcctcggcgtcccgatgcaggcggtgctgggcggcatcaccgtgctcacccacctcaacccgtgggtggtcggctcgcacttcctgctctcggtcgcgctgatcaccgtctcctacgccttctggcgccggatcgacgacggcgacgccgcaccacgcgccctggtccccgcgcccctgcgcccgctcgccgcgatcaccgccctggccagcctggcggtcatcacggtcggcacggtggtcaccggcagcggcccgcactccggcgaccgcggcgccaagcgcaacggcctggacccggccgccgtctcccaggtccacgccgacctggtcttcctgctgatcggcctctcggcggcgctgtggttcgcgctgcgcgcggtcccggctccggacaccgcggtccgggcggccgcggtgctggtcgccgtcgagctcggtcagggtctcatcggcttcgtccaatatttcacgcatctgccggtcgtcctggtcgccgcccacatgctcggcgccggcctggtctggtgggcgacgctggcggtcctctggtccctccggacgcgcgccgccgtcgccggcgacctcgagaccacgacgacgccggctccggaaccggttccggccgcatag

SEQ ID NO: 1191 - DNA, 879 bp, Actinoplanes utahensis
atgcccaccggccgccgggtcgccctggtcacctgcgcggccttccccgacctctgggacgacgaccacccgctgcgcgacgccctgcgctcgcgcggcgtggccgtcgacgccgtccgctgggacgagccggacgccgactgggcgggctacgacctggtcgtggtccgctccccgtgggactacgtcgcccgccacgaacagttcgtcgcctgggcccggagcgtcccgcggctgctcaacccggcggacatcatcgtctggaacaccgacaagcggtacatcggtgagcttgccgccgcgggggttccggtcatcccgaccggcttcgtcgggcccggggaggcctggaccccgccgtccagcggtgagtgggtggtcaagccgacagtctcggccggcagccaggacaccgctcgctaccgcctgcccgctcaagcggcgcaggctcaggcgcatgtcggcaggctgaccgctgaggggcggaccgcgatggtccagccgtacctggcggcggtcgccaccgagggggagacggcgctgctgttcttcccggacgagtccggtgagctggccttcagccatgccatccggaaagggccgatgctgcgccagaccggcgagcacgtcatcgacgtgggcagcgaggagatcacgccgcggacggcatccgaggcggagcgggaggtggcccggctggcgctcaccgcggtgcccggtgggtcgaagcggctgctctatgcccgggttgacgtcatccccggtccggatggggcgccgcaggtcatcgagctggagctgagcgagccggggctgttcctgctcaccgctccgggtgccgcggaccgtctggccgacgccgtcctcgcgcgtctctga

SEQ ID NO: 1192 - DNA, 276 bp, Actinoplanes utahensis
atgacgctgacctccgagatcaagtctttcgccgccggtcacggcggctgcaaggcggtcatcgagtacgtcggtaagcgcggcgcccgcatcgtcctcgtcggcggggacggcgagtggtccgaccagttcgcccaggacaccggtgtcgcccgcgaggcgtgcgagcacgccggcgtcgaggtggagaacgagtgggagcgcgaactcctggagcagatgcgtcccagcaacgacctgtggcggtcgatggcgcgccggagcatggcgcgctga

SEQ ID NO: 1193 - DNA, 963 bp, Actinoplanes utahensis
gtgagcatgatcaccgagcgttccgtccagcgacggtcgcccggcgtggcggagcctgcgccacgcgaggagacccgacgtgagcggatggcggtgttccgggcctacctggctctgaccaagccggcgatcgtcgagctgttgctggtcaccacggtgcccacgatgatgctggccgccggcgggtggcccgacctggtcaccttcctcgcggtgctggtcggcggggctctcgcgggcggcgcggcgagcgcgttgaactgttacatcgaccgcgacatcgacgtgctgatgaagcggaccaagcggcggccgctgcccagccatcagatcagcccccgcgcggtgctgatcttcgggctggcgctggcggtggtctcggtggcgttgatggcggtgctgaccaactggctggcgaccgcactcaccgcgttctcgatcttctactacgacgtgatctacacgctctggctgaagcggcggaccccggcgaacacgttctggggcggcgtctgcggggcggctccggtggtcatcgggtgggccgcggtgaccggatcgatcgccccgatggggtgggcgttgttcgcagtcgtcttcttctggcaaatgccgcacttctacgcgcttgccatcaaatacaaggatgactacgcgcgggccggcatcccgatgcttcccgtggtgcgctcggtggcccgggtgaacttcgagatcctgctctacaccgtgctcaccgtcgcctcctcgctggccgcctggccgctggggaccgggctggggctcggctggatctacggctcggccgcgatgatcaccggtgtgctgttcctcggcgagtcggtgcggctggtctaccagacccgcaacggcggcatggtgaagccgatgcggctgttccagctctccatcacctacctgacggtgctcttcatggcgatcgccgtcgacgcactggtctga

SEQ ID NO: 1194 - DNA, 2115 bp, Actinoplanes utahensis
gtgggtgccaacgattcagctctccattggtccgacctcgaccgcaaggcggtcgacacggtccgggtcctggccatggatgccgtcgagaaggccggcaacggccaccccggcacggccatgagcctggcgccggccgcctacctgctgttcaaccgcgtgatgcggcatgacccgaccgacccgcactgggcgggccgcgaccggttcgtgctctcctgcggtcactccagcctcaccctctacattcagctcttcctcagtggctacagcacctcgctggacgacctgaaggcgctgcggcagtgggactcgctgaccccgggccaccccgagtacggtcacacccccggcgtcgagatcaccaccggcccgctgggccagggcatcggcaacgcggtcggcatggccatggcggcccgccgcgagcgcggcctgttcgacccgcaggccgagcccggccggtccccgttcgaccaccagatctatgcgatctgctcggacggtgacatcgaggagggcgtcagccacgagtcgagcgccatcgccgcggtgcagaagctcggcaacctcacggtgatctacgacgacaaccagatctccatcgaggacgacacccggatcgccaagtccgaggacgtcggcgcccgctacgaggcgtacggctggcacgtgcagaccgtcgactggcgctcgtccgacccctacgtggaggacgtggaggcgctctgggacgccatccaggcggccaaggcggtcaccgacaagccgtcgttcatcgtgctgaagacgatcatcggctggcccgcgccgaagaagcagaacaccggcaagatccacggctccgcgctgggcaaggacgagatcaccgccaccaaggcgctgctcggcttcaccgacgagccgttcgccatcgacgacgaggtggtcaagcacgcgcagcaggcggtcgagcgcggcaaggcggcgcacgccgagtggaacgaggcgttcgccgcctggggctcggccaacgccgaggccaaggcgctgttcgagcggctcgcggccaagcggctgccggagggctgggcggccgcgctgcccgagttcccggccgacgagaagggcctggccacccgggccgcgtccggcaaggtgctggaggcgctggcgccggtgctcccggaactctggggcggctcggccgacctggcggagagcaacaacaccacgatgaagggcgagccgtcgttcatcccggccgagtacgcgaccaaggagttccccggtcacgagtacggccgcacgctgcacttcggcatccgtgagcacggcatgggctcgatcctcaacggcatcgcggtgcacggcggcacccgcccgtacggcggcaccttcctggtcttcagtgactacatgcgcggcgcggtgcggctgtccgcgctgatgaagctgccggtcgtcttcgtgtggacgcacgactcgatcggtctcggcgaggacggcccgacgcaccagccgatcgagacgctgaccgcgctgcgcgccatcgtcggtctcgacgtggtccgcccggccgacgccaacgagacggcgtgggcctggcggggtgccctggagcaccacgaccggccgaccgcgctggccctgtcccggcagaacctgccgaccctggaccggtcgaagtacgcctcggccgagggcaccctcaagggcggctacatcctgtccgaggcgtcctcgggcaccccgaaggtgatcctgatcgcttccggctccgaggtggcggtctccctgaccgcgcaggagcgcctggaggccgagggcaccccgacccgggtcgtctcgatgccctgccaggagtggttcttccagcaggacaccgcgtaccagcaggaggtcctgccgcacggggtgaaggcgcgggtcaccgtcgaggccggcatccggatgagctgggaccgcctgctcggcgacgccggcgaggcggtctcgatcgagcactacggcgccagcgcgcccgccaagatcctcttcgagcagttcgggttcaccgcggacaacatcgtggcgaaggccaacgcctcgctggccaaggtcggcgtgatcaccggtcacacgaccggcaactga

SEQ ID NO: 1195 - DNA, 1137 bp, Actinoplanes utahensis
atgaccgacagactggcagagctgtccgcgcagggtgtggcggtctggctcgacgacctctcccgggtccgcctgaccagcggctcgctcgacaagatgcggcgtgagcagcacatggtcggggtcaccacgaacccgagcatcttccagaaggcgctgtccgacgcggacgcctacgacgaacagctgcgcgacctggccgcccagcgggtcaccgtggaggaggcggtccggctgatgaccgccgccgacgtgcgggccgcggccgacgtgctgcgcccggcgtacgacgcgtccgacggcgtggacggccgggtctcgatcgaggtggacccgcgcaaggcgcacgaggcggaggcgaccgtcgccgaggccaagaccctgtggtggctcgtcgaccggccgaacctgtacatcaagatcccggccaccatggacggcctgccggcgatcaccgcgaccctggccgccgggatcagcgtcaacgtcacgctgatcttctcgctggagcggtaccgcgcggtgatggacgccttcctgtccggcctggagcaggcgaaggcgaacggccacgacctgtccaagatcggctcggtcgcctcgttcttcgtctcccgggtggactcggaggtcgacaagcggctcgacaagatcggcagcgacgaggccaaggcgctcaagggcaaggccgcgatcgccaacgcccggctcgcctacgaggcgtacgaggaggtcttcggcaccgaccggtggaccgccctcaagcaggccggcgcgcacccgcagcgtccgctgtgggcctccacctcgacgaagaacccggacttcccggacaccatctacgtcgaggagctgatcgcgcccggcacggtgaacaccatgcccgagtcggtcatcgtggcgtacgccgaccacggcaccacccgcggcgacacggtcaccggcaactacgccgacgccaagcaggtcttcgccgacctggcgaaggtcggcgtggacttcgacgacgtggtcaaggtgctcgaggaggagggcgtcgagaagttcgagtcggcgtggaaggacctgctcgagggcgtcaccaagtcactgaaggcggcggccggcggcgcggagaacccgagcgacgcggcctga

SEQ ID NO: 1196 - DNA, 1518 bp, Actinoplanes utahensis
gtgggtaatccgctgcgcaccgcacaggaccgacgccttccgcggattccggagccctgcgctctggtgatcttcggggtcaccggtgacctgtcccgtaagaagctcatcccggccgtgtacgacctggccaaccgaggcctgttgccccccggcttcgtggtggtgggcttcgcccgggccgactggggtgacggtgacttcgagtcgctggcctacgccgccgccaagaagggcgctcgcacgccctggcgggaggacgtctggcagcggctgtcgagccagttccagttcgtgcccggctcgttcgacgacgacgccgacttcgacaaactctccgagaccctggaccagctgcgcgagcgcaacggcatccagggcaacacggccttctacttctcgatcccgccggccgccttcccgctggtgctcaaccagctgaaccggaccggcctggcggacagcgcgaaactcggcggctggcgccgggtggtggtggagaagccgttcggcaacgacctgcagaccgcggtcgcgctgaacgcgctggtcgacgacgtgttcaaccccgccgacgtctaccggatcgaccactacctgggcaaggagacggtccagaacatcctggccctgcgcttcgccaacagcctgttcgagccggtgtggaattccaagtacgtcgactcggtgcagatcaccatggccgaggacgtcggcatcggcacccgggccgccttctacgacgcctccggcgccgcccgcgacgtgctgcagaaccacctgctgcagctgctcgcgctggtcggcatggaggagccgacgagcttcgacccgcaggaggtgcgggccgagaagctgaaggtgctcaaggcgatcagcctgccggccgacatcgcgtccggctcggtccgcggccaatacctgccgggctgggtcgccggcgagcgcgcggtgggctacctggaggagaagaacatcccggccgactcgacgaccgagacgtacgtcgcggtccggctcggcatccagaaccggcgctgggccggcgtgccgttctacgtccgggtcggcaagcggatgccgcggcgggtcaccgagatcgcgatcctgttcaagaaggcgccgcacctgccgttcgacccggccgacgtggagatgctgggcaacaaccagctggtcatccgggtccagccggacgagggcgtggtgctcaagttcggatcgaaggtgcccggcacggccatggaggtccgcgacatcgcgatggacttccagtacggcgaggcgttcaccgagtccagccccgaggcgtacgaacgcctggtcctcgacgtcctgatcggcgaccgcacgctgttcccggacgccgccgaggtggagcagtcctggcgggtcatcgacccgctggaggccgcctgggcgggtaccacgccggagccgtaccgcgccggcgagtggggtccgcgggcctccgacgagttgctggaacgcgaaggccgtgcctggaggcgagcatga

SEQ ID NO: 1197 - DNA, 999 bp, Actinoplanes utahensis
atgatcgggctgtgggacaccaccggcaacgaggtggtcaaggcgctggccgcggagcggcgcagcgccggcggcgtggcctccgggctggcgctcacgctgatcgcggtggtcgaggagaagaaggtccgggaggccgaggcggccgccacgatagcggcggcggcccacccgtgccgggtgctgatcgtggtccgctccgacctggacggccgcagccggctggacgcggagatcgtggtcggcggccggctgggcccggccgaggcggtcgtgatgcggatgtacgggcggctcgcgctgcacgccgagtcggtggtcatcccgctgctcgcgccggacgtcccggtggtcacctggtggcacgaggagccgccggactcgatcgccaacgacttcctgggtgtcgtctcggaacgccggatcaccgacagcgcgcaggcgcccgacccggtggccgcgctgcgccagcgggcggccgactatgcccccggtgacaccgacctcacctggacccggatcacgctgtggcgcaccctggtggccggcgccttcgacaccaccgaggcccgggtgaccggcgcccggatcgtggccccggagaaggacccgaccgcgtggctgatgctcggctggctcaagtcccgactgggcatcgagccggtgctggagcacaccgaccgcgccccgcggatgcactcggtggagctgcagtgcgagaacggcgactgtgtccgggtcacccgcgaggagggcaccgcgctgttcagccgcaccggtcaggaggaccggtacatgccgctgccgaagcggccggtcggtgacgagctcgccgaggagctgcgccggctggacgcggaccagatctacgccgaggcgctgggggcgatggcggggctgtccgggctggacaaccggccggcggcccgggtgcacgtgtggaaggacccggcactggcggcgcgggcggccagcaccaccgacgcgatggccggctag

SEQ ID NO: 1198 - DNA, 717 bp, Actinoplanes utahensis
gtgagtgagaccttggtcgtggtggtcccggacgccgacatcctggcgtccacggtggcggcccggctggtcgtccggatcatcgacgcgcaggccgcccgcggctcggcgagcgtggtgctgaccggcggccgggtggccgccaaggtgctgcgccagctgggtgagctgccggccgccgcggcgatcgactggtcccgggtggacctgtggtggggcgacgagcgtttcctgccggccggcgacccggaccgcaacgagacccaggcgcgcgaggcggtcctggacgcgctgccgctcgacccggcccgggtgcacgccatgccggccaccgacggcccggacggcgacgacgcggacgcggccgccgcccggtacgcggccgaggtgaccgccgcgggcgcgcacttcgacgtgctgatgctgggcgtgggcgaggacggccacgtggcgtccctgttccccgggcacccggtgctggccgcccagggcgtggcggtcgccacgtacgacagcccgaagccgccgccgacccggatcaccctgaccctggacaccatccggcgggccggcgaggtgtggctggtggcggccggcccggacaaggcggaaccgatcggcgccgcactgcggggcgctgacctgccggccgcgcacgccgtcggcgtacaccggacgctgttccttcttgaccaggccgccgccgcgaagcgctaa

SEQ ID NO: 1199 - DNA, 963 bp, Actinoplanes utahensis
atgcggggtcgggccggggttctcccccagcgtcgtcacgtcgctgaccccgaccccgcgctcgaccagctcggcgtgcgccgcctcgatgtcgttgaccaccagttgcaggccgcgcagcgagccggccggcatctgcggcaccgcgcccttgccgatcacgatcgagcagccgctgcccggcggggtgatctgcacgatccgcacctggtcgcccatcacgatgtcgtggtcgacggtgaagccgagctgctcggcatagaacttcttcgcccggtcgatgtcggacaccggaacgacgaccacctcaagagtccagttcatggccaccatgctgccatccgtagactccggcaggtgtccgcaacgattcgcgcctaccgatcgagcgaccttgacgccatctacgacatctgtgtccgcaccggcgacgccgggcgggacgcccgcgggaagcacagctcggaccgcctgctcggggacatctgggccgcgccgtacgtgatcctggagccggagcacgcgcacgtgctggacgacgggaccggccgggcggtcggctacatcatcggcaccgcggacaccgagaagttcgtccgccgataccgcgacgagtggctgccggccaccgccgaccggctgaccggcggcgacccgcgcgacgagctgatgctgagcctgcaccggcgcccggagcggatgctgcacccggcgctcgccgcctaccccgcgcacctgcacatcgacctgctgccggaatggcagggccgggggcaggggcgcgggctgatggcggcgttcctggccgggctacgggcggccggagtgtcccgggtgcacctgggcatgtccccggagaaccagggggcgtacgcgttctatcaccggctgggtttccgcgacctgccggtcgacgacgacccgggcgcgctctatctgggccggaacacgggtccgctctag

SEQ ID NO: 1200 - DNA, 342 bp, Actinoplanes utahensis
gtgtccagtggcagcgccattcgtggcagccgcatcggctccagcccgatgcgccccgacgagcgcaccgagcccgccccgcgccggcaggtgaaatacttctgcgccgcgggccatgacagcctcatctggttcgccgccgaggcgccggccccggacacctgggactgcccccgctgcgggcagccggccggactggaccgggagcggccgccggggcgctcccgcaccgagccgtacaagtcgcacctggcctatgtgaaggagcgccgctcggaggaggacggcgccgccatcctcgaggaggcgctcgccaagctgcgccagcgccgcggccgctag

SEQ ID NO: 1201 - DNA, 255 bp, Actinoplanes utahensis
atgccgatcggattcgcgtacacgttgatcgtgttgctgatcatcaccagcattctgctgaccctgctgatcctgctgcaccgcggcaagggcggcggcatgtccagcatgttcggcggcggcgtgacctccagcctggccggctcctcggtcgcggagaagaacctggaccgctacacggtcctggtcggcgtcctctggttcgcgtgcatcgtgggcatgggtttctggctgaagagcaagacgggttcctga

SEQ ID NO: 1202 - DNA, 792 bp, Actinoplanes utahensis
atgggtgacgtgacccgcaagccgatcatcgccggcaactggaagatgaacctcaaccactacgaggcgaatctgctggtccagaagctggcggcgagcctgaccggcgagcagctcgacagggtggaggcggtcgtgctgccgccgttcaccgacctgcgcaccgtgcagaccgcgatcgagggcgacaagctcacgatccggtacggcgcccaggacatctcgaagcacgcttccggcgcgtacaccggggagatcgccggctcgatgctggcgaagctgggctgcacctacgtggtgatcggccactccgagcgccgggagtaccacgaggagtccgacgagctgatcaacgcgaagatcaaggcggccttcgcggccggcctgaccccgatcttctgcgtcggtgagggcctggccgtccgtgaggagtccggccacgtcgcgcactgcaccgcgcaggtcgacgccggcctggacgggctcaaggaagaccagatcaagcagatcgtcatcgcgtacgagccggtctgggcgatcggcaccggcaagaccgcgacgccggacgacgcgcaggaggtgtgcggagcgatccgtgcccgcctgaccgagaagttcggcgccgacgtggccgaggcggtccgcatccagtacggcggatcggtcaaggccgcgaacatcgcccagatcatggcgcagccggacgtcgacggcgccctggtcggcggcgccagcctggacgccgaggagttcgcctccatcgtgcgattcccggagcacgtcgcacgctga

SEQ ID NO: 1203 - DNA, 1197 bp, Actinoplanes utahensis
ttgaagactctcgacgacctgctcggcgagggtgtctcgggtcggcgcgtcttcgtgcgcgccgacctgaacgtgcccttcgacaagagcaacccgggcgtcatcagcgacgacggccgcgcccgcgcggtgctgccgacgctgatcgccctgcgtgacgcgggcgccaaggtgatcgtggcgtcccacctgggccgcccgaagggcgcgccggacccgaagtacacgctcgcgccggtcgccgcccgtctgggtgagctgctggggtcggacgtgctcttcgccgaggacaccgtcggcccgtccgcgtcggctgccgtgcaggcgctgcaggacggccaggtgctgctcctggagaacctgcggttcaacgagggcgagaccgcgaaggacgacgcggttcgcggggcgttcgccgaccagctggcggcgttcgccgacttctacgtcgacgatgccttcggcgccgtgcaccgcaagcacgcctcggtgtacgacgtcgcggcccgcctgccgcacttcgcgggtggcctggtcgtcaaggaggtcgaggtcctccgcaaggtgtccgagacccccgagaagccgtacgtcgtggtgctcggcggctcgaaggtctccgacaagctcgccgtgatccaggcgctgctgccgaaggtggacaagctcctcgtcggtggcgggatgtgcttcaccttcctcaaggcccagggccacgaggtcgggaagtcactgctcgaggacgagatggtggccgtctgcgccgatctgctggagcaggcgcagggccggatcgtcctgcccgtcgacgtcgtcgcggccacggagttctccgcggacgcgcagcacgacgtggtcgcggcgtccgcgatcccggccgaccgcctgggcctcgacatcggcccgaagtcgacggagctgttcgcgtcggcgatcgccggtgcgaagaccgtgttctggaacggcccgatgggcgtcttcgagctcgccccgttcgccgccggcacccgcggcgtcgccgaggcgatcaccaagatcgacggcttctcggtcgtcggcggcggcgactcggccgccgcggtccgcacgctgggcctggacgagaccgcgttcggccacatctccaccggcgggggcgcgtccctggagtacctcgaaggcaagacgctgccgggcgtcgccgctctggagaagtga

SEQ ID NO: 1204 - DNA, 1002 bp, Actinoplanes utahensis
gtgaccatccgggttggcatcaacggcttcggccgcatcggtcgtaacttcttccgggcggcgctcgcctccggggccgacatccagatcgtcggcgtgaacgacctgaccgacaacgccacgctggcgcacctgctcaagtacgacagcatcctgggccgtctgccgcacgaggtgaaggccaccgccgacgagatcaccgtcggtggcaacaccttcaaggcgttcgccgagcgcgacccgaacaacctgccgtggggcgacctgggtgccgacgtcgtgatcgagtcgaccggcttcttcaccgacgccaccaaggccaaggcgcacatcgacaagggcgccaagaaggtcatcatctcggctccggccaagaacgaggacatcacgatcgtgatgggtgtcaacgacggcctgtacgacgccgccaagcacacgatcatctcgaacgcgtcctgcaccaccaactgcctcgccccgatggcgaaggtcctgaacgacacgatcgggatcgaaaagggtctgatgaccacgatccacgcgtacacccaggaccagaacctgcaggacggcccgcacagcgacctgcgtcgcgcccgcgccgccgcgctgaacatcgtgcccacctcgaccggtgccgccaaggccgtcagcctggtgctccccgagctcaagggcaagctggacggcttcgcgctgcgcgtgccgatcccgaccggctcggccaccgacctgaccttcaccgccgcccgggacaccacggtcgacgaggtcaacgccgcgatcaaggccgccgccgagggcgcgctcaagggcatcctggtctacaccgaggacccgatcgtgtcggccgacatcgtcaccgacccggcctcctgcatcttcgacgccggcctgaccaaggtcatcggcggcaaccaggtcaaggtcgtcggctggtacgacaacgagtggggctactcgaaccgcctcgtcaacctggtccagctcgtcggagcctga

SEQ ID NO: 1205 - DNA, 981 bp, Actinoplanes utahensis
atggcgatgacggcagcggtcaaggacgagctgagccgggtcgacgtgcccaagccctgctgtcgccgggcggagatggcgtccctgctccggttcgccggcgggctgcacatcgtctccggccgggtggtcgtcgaggcggagctggacaccggcgcggtggcccggcggctgcgccgggagatcgccgacgtgtacggctaccccagcgaggtgcacgtgctggcctccggcggcctgcgcaagggcagccactacatcgtccggatcgtcaaggacggcgaggctctggcccggcagaccggcctgctcgacgtgcgtggccggccggtccgcggcctgcccccgcacgtggtctcggcgaacgtctgctgcgcggtggccgcctggcggggtgccttcatggcgcacggctcgctcaccgagccgggccggtccagcgcgctggagatcacctgcccgggcccggaggcggcgctcgcgctgcgcggcgcggcccgccggatcgggatcaccgccaaggagcgcgaggtccgcggtgtcgaccgggtggtgatcaaggacggcgacgcgatcgccgctctgctcacccggatcggcgcgcactccagcgtcctggcctgggaggagcggagggtacgccgtgaggtgcgggccaccgcgaaccggctggccaacttcgacgacgcgaacctgcgccggtcggcccgcgccgccgtggccgccgccgcccgggtcacccgcgcgctggagatcctggccgaggacgcgcccaaccacctgacctcggccggccggctgcggctggagcaccggcaggcctcgctggaggagctgggcgcgttggccgacccgccgctgaccaaggacgcgatcgccggccggatccgccgcctgctcgcgctggccgacaagcgggcccgggatctcggcatccccgacacggaggcggcggtcacccccgagatgatggcctgctag

SEQ ID NO: 1206 - DNA, 1086 bp, Actinoplanes utahensis
gtgacggcccggccggtccgggtggtggcgttcggcggcgggcacgggctgggcgcctcgctgcgcgcgctccggcacaccgcggccgagctgcccctggacatcaccgcgatcgtgacggtcggcgacgacggcggctccagcggccgcctgcgggtcgaacgggacgccctgctgcccccgggcgacctgcgccaggccctggcggcgctggccgacgggcacccgacgtcgcagctgaccgcgacactgatgcagcaccggttcgcggcgatgcccgagccggcggcggcgacgggcgtcaggaacgacgccggcccgtcgcgggcggccgtcgaggcgctgcccccggtggtgcgcgggccgcggctggagcgccgcgccgaccgcagcaaggacaccctggccgggcacaccgtcggcaacctgctgctgctcggcctgatggagctgctcggcgacccggtccgggcgctcgaccacgcggccgccatggtcggcgcgcacggccgggtgctgccgatggccctgcacgcggtcggtatcgaggcggacgtgatcggcgccgacccggcccggccggacgagacggtcactatccgcggccagcattcggtcgcggtgtccggcggccgggtcaccggcgtgcggctggagccggccgacccgccggcctgcccgcaggcggtggcggcggtgctggcggcggactggctgatcttcgggccgggcagctggtacaccagcgtgctgccgcacctgctggtgccgggcctggcccgggcgatcgtggcgagcccggcccgccggctggtcaccctgaacctgggcaccgacaaggagacccacggcctgtccgccgccgggcacctcaccacgttgcaccggtgcctgccggagttgcgggtggacaccgtgctggccgacgtgaaatgggcaggcgaacccgaaccggtacgtgtcgccgcccgggagatgggcgccgatctggtattggcacccgtcgccgttgcggacgggagcccacggcatgatcctgaggcactgggtgttgcactggtgccagtattgggcgccgctcgttaa

SEQ ID NO: 1207 - DNA, 915 bp, Actinoplanes utahensis
gtgacggaagcgatgcccgggttcggagccgacggcgtggtcgacccggacgaggcgggcaccgacctggtggtggtcaccgggctgtccggcggtgggcgcagcacggtggcccgggccctggagaacgtcgggttctatgtggtcgacaacctgccccaggcgctgatgctggagatggccgagctggccttcgcggccggcggcgccgcccggcgcaccgcgatggtgctggacgtgcgcagccgcgccttctccaccgacctggccggggcggtgcgcgccctcaaggagcgcggcttctccccgcgggtggtcttcgtcgacgccgacgacgaggtgctgatccggcgtttcgagtcggtccgccgctcgcacccgctgcagggcgacggccggctggccgacgggatcgccgccgagcgcaagctgctcgccgaggcccgtgagcaggccgatgtgatcatcgacaccagccacctgaacgtcaaccagctccgccgccgggtcgaggagctgttcggcggggaggacgcccgcaagctgcggatcaccgttctctccttcgggttcaagtacggcctgccgccggacgccgactacgtgctggacgcccgcttcctgcccaacccgttctgggtccccgagctgcgcgagcacaccggcctggaggagggcgtcagcagctacgtgctgggccaggagggcgccaccgacttcgtcgccacctacgcggggctgatcgcggccaccgcgcccggcttcgagcgcgagggcaagcgctatctgacggtcgcgatcgggtgcaccggtggaaaacaccggagcgtggcgataaccgaggagttgacttcgcggctcagtgccatgcgcctctcggcccacgcctcgcaccgcgacctggggcgcgagtga

SEQ ID NO: 1208 - DNA, 2010 bp, Actinoplanes utahensis
atgtcagtcccaggcactactgttgtggttgtgccagacccgtccacttatcgtccggcgcccggtaccattcccgacgctccgggcgtctaccgcttccgcgatccgtccggccgggtgatctacgtcggcaaggcgaagagcctgcgcaaccggctgaattcctacttcgccgacgtctggtcgctgcacccgcgcacccagcagatggtgaccaccgccggcgcggtcgactgggtcaccgtcggcaccgaggtcgaggcgctgcagctggagttctcctggatcaaggagttcgacccccgcttcaacgtgaagtatcgcgacgacaagtcgtacccgttcctcgccgtcacgctcaacgaggagttcccccggctgcaggtgatgcgcggcgccaagcgcaaaggggtccgctacttcgggccctattcgcacgcctgggccatccgcgagaccctcgacctgttgctccgcgtcttcccggcacgcacctgctcggccggggtcttcaaacgggccggtcagatcggccgcccctgcctgctcggctacatcggcaaatgttcggccccgtgcaccggccaggtcaccgcggccgagcaccgggtcatcgtcgacgacttctgcgacttcatggccggccgcaccgacgccttcgtcaagcggctggagcgcgacatgatggccgcctccgaggagctggagttcgagcgggccgcccggctgcgcgacgacatcgcggcgctgcgccgggccatggagaaacagaccgtggtgctcggcgacggcaccgacgccgacgtggtggccttcgccgaggacccgctggaggcggccgtccaggtcttccacgtgcgcgacggccggatccgcggccagcgcggctgggtggtggagaaggtggaggatctgtccaccggcgacctggtccaccacttctgcacccagatgtacggtgagtcggccggcgagaccgacgtcccgcgggagctgctggtcccggccctgcccgaggacgccgaggcgctcgccgactggctgtcggcgcgccgcggcagccgggtcagcctgcgggtgccgcagcgcggcgacaaggtcgacctgatggccaccgtggcgcgcaacgccggcgaggtgttgcagcgccacaagctgcgccgggccggcgacctgaccacccgcaacaaggccctggaggagatcgccgaggcgctcggactggagtcggcgccgctgcgcgtcgagtgctacgacgtctcgcagaaccagggcaccgacgtggtcgcctcgatggtcgtcttcgaggacggcctggcccgcaagtcggagtatcggcgcttcgcgatccgcggcaacgccgacggcagcgggatggacgacctgtccgcgatgagcgaggtgatgcgccgccggttcgcgcgataccgggcgcagcccggggcggacgcgccgcgcgacgagccggagccgccggccgaggagctcggcgaggcgaccggcgagctggagaccgccgacctgccggggatcgacccgctcaccggcaagccgcgccggttcgcctaccccccgcagctggtcgtggtcgacggcggccagccgcaggtgaacgcggccgccgcggtcctggccgacctgggcatcaccgacgtggcactgtgcgggctggccaagcggctggaggaggtgtggctgccgggcgacgactacccggtcatcctgccgcgcacctccgaggggctctacctgctgcagcgggtgcgcgacgaggcgcaccggttcgccatcaccttccaccggcagcggcgttccaagcggatgaccgagtcggcgctggacagcgtggccgggctgggcgagacccggcgcaaggcgctgctgcggcacttcggttcggtgaagcggctcgccgcggcgaccccggaggagatcatcgaggtgccgggggtgggccggcggaccgccgaggcggtgctggccgcgctgaacgggcccggcggcgggtga

SEQ ID NO: 1209 - DNA, 264 bp, Actinoplanes utahensis
gtggccgacgtgccctcgggtggcggcatcatccagggcgactacgtcatcacgcagcccaagcagggcaccttcaaggcgttcaccaagatctgcacccaccagggctgcgaggtcagcgaggtgaagaacggcacgatcaactgcccgtgccacggcgcgaagttctccatcgaggacggctcggtggccggtggcccggcgccgaagccgctggccgagacgaaggtcaaggtggacggcgacaagatcgtcgcggcctga

SEQ ID NO: 1210 - DNA, 243 bp, Actinoplanes utahensis
gtgacatcgggcgcggaccaggtactggaggggcgatacatgactgacgtgcagaccgggaccggcgtcgacacccaggcggagccggcgggccccgcatcgacgcgccgcgtcgttctgctgggcgccggcggcctcggcgcggccgccgtcctgagcgcctgtggcaccagcaccaccacgacgaacccgaacggcagcgacttcgccgccgagccggcgccggccggcctagctagctag

SEQ ID NO: 1211 - DNA, 3021 bp, Actinoplanes utahensis
ttgtcataccccgtcgttagagtggcctgtctgctttcaaacacctgtacggagaggctagtagtggccgaccgactgactattcgtggcgctcgcgagcacaacctgcgcgacgtcaacctggacctgccccgcgacgccatgatcgtcttcaccgggctctccggttcgggcaagtccagcctcgcgttcgacaccatcttcgccgaggggcagcgacggtacgtggagtcgctgtcgtcgtatgcgcggcagttcctcggccagatggacaagcccgacgtcgacttcatcgagggcctctcaccggccgtctcgatcgaccagaaatcgacctcgcgcaacccccgctccaccgtcggcaccatcaccgaggtgtacgactacctgcggctgctgttcgcccgcaccggcatcccgcactgcccggtctgcggtgagcggatcagcaggcagacgccgcagcagatcgtcgaccgggtcctggcgatgcccgagggcacccggttcatggtgctcgccccggtcgtccgcggccgcaagggggaatatgtcgacctgttcgccgagctgcaggccaagggctacgcccgggcccgggtcgacggcgtggtgcaccagctcaccgagccgccgaagctgaagaagcaggagaagcacaccatcgaggtggtggtcgaccggctcagcgtcaaggcgtccagcaagcagcgtctgaccgactcggtcgagtcggcgctcggcctggccaacggcatcgtcctgctcgacttcgtcgacctcgccgaggacgacccggagcgcgagcgccgcttctccgagcacctggcctgtcccaacgatcacccgctggcgatcgaggacctggagccccgggtgttctccttcaacgcgccctacggcgcctgccccgagtgctccggcctcgggacgaagaaggaggtcgaccccgagctgatcatcccggacgaggagaagagcctcgccgagggggcgatccagccgtgggccggcggcaccacccaggagtacttcctgcgtctgctggaggcgctggccaaggccgagggcttcaagctcgacacgccgtggcgggcgctgccggcccgcgcacagaagacgatcctgcacggctccgaggaccaggtccacgtgcgctaccggaacaagtacggccgcgagcggtcctactacaccggcttcgagggcgtcgtgcagtggatcgagcgccggcacaacgacaccgagagcgattggtcccgcgacaagtacgaggggtacatgcgcgacgtgccctgctcggtctgcggcggcgcccggctcaagcccgaggtgctcgcggtcaccgtggccgggcggagcatcgccgaggtctgcaacctgtccatcggcgactgcgccgagctgctcgccgggctggagctcgacgaccggcagaagatgatcgccgagcgggtgctcaaggagatcaacgcccggctgcgcttcctggtcgacgtcggcctggaatacctgtcgctggaccgcggcgccggcaccctctccggcggtgaggcgcagcgcatccggctcgccacccagatcggctccgggctggtcggtgtgctctacgtgctggacgagccgtccatcggcctgcaccagcgggacaaccaccggctgatcgagaccctggtccggctgcgcgacctgggcaacacgctgatcgtggtggagcacgacgaggacaccatccggaccgccgactggatcgtcgacatcggcccgggcgccggcgagcacggcggccacatcgtgcacagcggcaccgtcgagggtctgctcgcgaacgagaagtcgccgaccggcgcctatctctccggccgtaggtcgatcccgctgccggccacccggcgcccgcagaccgccgggcgcgaggtggtggtgcacggcgcccgcgaacacaacctgcgcaacctgacggtcccgttcccgctcggccagttcatcgcggtcaccggggtcagcggctccggcaagtcgaccctggtcaacgacatcctgcacaccgtgatggcgaatcagatcaacggcgcccggcaggtgcccggccggcacatcaaggtcaccgggctggagcacgtcgacaaggtggtcggcgtcgaccagtcgccgatcggccgcaccccgcggtccaacccggccacctacaccggcgtcttcgaccacgtccgcaagctgttcgccgagaccgccgaggccaaggtgcgcggctacggcccgggccggttctcgttcaacgtcaagggcggtcgctgcgagaactgctccggcgacggcaccatcaagatcgagatgaacttcctgcccgacgtctacgtcccctgcgaggtgtgcaagggcgcgcggtacaaccgggagaccctggaggtccactacaagggcaagacgatctccgaggtgctccagatgccgatcgaggaggcggccgagttcttctcggcgctgccggccatccaccggcacctgcgcaccctggtcgacgtcggcctcggctacgtccggctgggccagcccgccaccaccctctccggcggcgaggcccagcgcgtcaagctcgcctccgagctgcagaaacgctccaccggacggaccgtctacgtgctcgacgagccgaccaccggcctgcacttcgaggacatccgcaaactgctgatcgtcctcaacggcctggtcgacaagggcaacacggtgatcaccatcgagcacaacctcgacgtgatcaagaccgcggactggctgatcgacatgggtccggagggcggcagcaagggcggcctggtgctggccaccggcaccccggaggagctcgccgaggtgccggacagtcacaccgggcagttcctgcggcacacactggggctgtcgggctccggcgccgggtcaccggccgcggtcgcccgcgcggccaaggccaacggcgagaaggcccccgcggcgaaggcgcgggcgacgcggtcgcgggccaaggcggccgtctga

SEQ ID NO: 1212 - DNA, 1827 bp, Actinoplanes utahensis
ttgtcgcacccctctggcagaatccggccggtgcgtgcggtggaggaagtggcggggaaacgggacgagacggtcgtcacggaggcgcggagcggcttcggcggctggcggcggaccgatctctgggtcctgctgagcttcctggcgctggccgggctggtgatgatccagctgtggatcgatccgaacgggcgggtgctcgccggcaaccgggacgaccacgggatcttcctattcatgctggcccacggcgagcgggtggtgttccacggcgcgccgctgttcttcgagagccacctcaacgcgccggtcggcgtgaacatgatggccaacacggcgatcctcgcgctgagcctgccgctcgccccggtcacgcacttcctgggcggcggcttctcggtggtcttcctgatcaccttcggcctgttcggcaccgccgccgcgtggtactggctgttcgcccggcacctggtgaccagccggcgggccgcggtgctcggggcgttctggtgcgggttcgcgccggcgatgatctcgcacgccagcggccacgtgaacttcgtcaaccagtatctggtgccgttcatcgtctggcaggtgctgcggctgcgggagccgggccgggcggtccgcggcgggctgatcctcgggctgctgctggtcctgcagatcttcatcaacgaggagacactgctcttcaccgcgctgaccctgggcgtcttcgtggtgtcctggtcgctgctgcggcgcgacgaggcgcgggcggtggccgggcggttcgtggccgggctcgcggtcgccgccgggaccgcgtcggccctctgcgcgtatccgttgtggtaccagttcttcgccgccggcaactaccacggtcagccgttcgagcccgacaagatcgtcaccgacctgctgtcgatcggggcgtacccgcggcaggcggtggccgggatcgggccggtggcccggcggctgagcctgagcccgaccgaggacaacacgttcttcggaccgttcggcctcgtcatgatcatcgtggcgatgcggatgctgtggcggtcggcggcggcccggtcggcggcgatcgccgggctggtgctgctggtcatgtcgttcgggccgaggctgcaggtggccggcttccgcacctggatcccgatgccgttcgccctgatcagtcacctcccggtgatcgacctggtgagcgtgagccggttcgcgatggtgcccgcgacgatcgccgggatcctgctggccctcgccgtcgaccgggtgggcgagctcaccccggtgcaccgccgccggttctggatcggcctgacactggcgctggtcccgctgatcccgaagccgctgccggtggtcgcgggcgacccgctgccgccgttcctgaccgccggcatctggaagcagtacgtgccggcgggccggaccctggtgccggtgccgctgccggaggtcacctacggccggaccgggcagcgctgggccaccctggagaacctggacttcgccgtgccgggcggctacttcatgggcccggtcaaccccccgtcggacaccaccgggtcctggcgcgccccggccaccttcacgaacacgatcctcgtccaggcgcagctgaccgggcgccggccggtgctgaccggcgccgaccgggagcggatcgcggctgacctggcctactggcgggcggcggtggtggtgctggtcccacaggccaagaacgtggacgtgctgcgggccaccctggtcgacgcgctgggccggccgccgcagcccgtcggcggcgtggagatctggaccgtcccggctcacccgcaggagtga

SEQ ID NO: 1213 - DNA, 1032 bp, Actinoplanes utahensis
atgtcgtatgacctgtcccagctcggctgggacgagctcttcgtctccgcgttccgtccctacgaccgggccgacagccgccccggccgggtgctgcgcgccgaccggggcgtcagcaccgtgctcaccgcgaacggtgtgacccgggcctcgctgggcggcaacgcgctgctcgacgccgcgcgcgacccgtcccggctgccgtgttccggcgactgggtggtgctgcgcgactggcccgaccgccgggtcacgctggagctggtgctgccccggcgcaccacgctgatccgccgcaccgccgacaaggactcgtccggccaggtgctggccgccaacatggacacggtggcggtggtcgagccgatcttccccgagcccggcgacgcccgggtggagcggctgctcgccctggcctgggagtccggcgccgacccggtgctggtgctgaccaagagcgacaccacccgtgatccgcgggcggtggcccggcagctcggcgagctggcccccggcgtcccggtgctgccggtgagcgtgcagcgcgggaccgggctggaaccgttgcgcgagctggccggcccgggccgcacgctggccctgctcggccggtccggggccggcaagtcgacgctggccaacgcgctggccggggcgtcggtgatgccggtgcaggcgatccgggacgccgacggcaaggggcggcacaccacggcgtaccggagcctggtcaccatcccgggcgggggtggcgtgatcgacactccggggatccgtggcgtcggcctgctcgacaccggctccgggctggagcgggcgttcgccgacgtgaccgagctggccggacactgccggttcgacgactgcgggcacgagtccgagccggggtgcgcggtgcaggcggcgctcggcgacgggtcgctgccgccgcggcggctggccagctggcgcaagctgcaccgggaggtggtggtgcagagccggcggcgcacggtgcggctggcgaccgcgccgcggcggcgggaccggtga

SEQ ID NO: 1214 - DNA, 702 bp, Actinoplanes utahensis
gtgacgatcgatccgctggtcctgatgaccgacgtggaccaagccaccgacaacctgctgcgcgccgccggggagctggacgactcggcgatcggcgagccctccgcgctgcccgggtggacggtgggccatgtgctcacccacctggcccgcaacgccgaggctctgaccaacctgctgacctgggcacggaccggggtggagaccccggcgtacgcgtcccgcgaggcccgcgacgccgccatcgaggccggtgccgggcggccgctggccgaccagctcgccgacatccgcaccgcgcacgagcggttcgccgacgccgcggccgcgatgcccgccgaggcgtggacgttccgctacccctcgttgatgccgtccgcggccgtggtgccgtgggcgcgcctgcgcgaggtcgaggtgcaccacgtggacctgggccgcggctacacgccggccgactggtccgacgcgttcgcactgcggctgctccgcgagatcgcgggcgacctgccggagtccgcgccgcccatggtgctgcacccggccggcgtcgaccacccgctgctgatcggctccggtgacggcccggcgatcggcggcccgacccggtcgatcgcggcgtggctggccggccgcgccgacggcgccgacctgaccgtctccccggacggggagctcccgcaaccagcgaggtggaagtga

SEQ ID NO: 1215 - DNA, 717 bp, Actinoplanes utahensis
gtggctggccggccgcgccgacggcgccgacctgaccgtctccccggacggggagctcccgcaaccagcgaggtggaagtgacgtacgacggcaccgctcccggcacccgcgacctgggcggcggtctcacgctgcgcaaggtctcggtcggcccgatggacaacaacgcgtacctgttgagcgccggcggcgagcagctgctgatcgacgccgcgaacgacgccgccaccctgctcgacctcgccggtccggccgggctggccaccgtggtgaccacccaccagcatcaggaccactggttcgcgctggacgaggtggtcaaggcgaccggcgcggcgtcgctggcgcacgaggcggacgccggcccgctgccggtggtcacccgcaccctgcgcgacggcgatacggtgacggtcggtggccacgagctcgaggtgatccacgtggtggggcacacgcccggctcgatcgtgctggcccttccggagccgggcggcggccgggtgcacctgttcaccggcgacagcctgttccccggcggggtcggcaacacccgcggggtgaaggagaatttcgcgtcgctgatcgaggacgtcgagcgcaggctgttcgaccggttcccggacgacacctggttctatccgggccacggcaaggactcgacgctcggcgccgagcgcccgcacctgcccgagtggcgccggcgcggttggtga

SEQ ID NO: 1216 - DNA, 714 bp, Actinoplanes utahensis
atgaccactttgcgtgaccagctcgccgacctcgccgggtcgccgggcgcacccaccaccgtccaggccgaggccgacctggcccggggccgcgccgcgctgcgccgccgccggatcctgcagtccgcggccggctccgccctcgtcgtcgcggtcgccgccgcggccgtcggcttcggctcagccggcgggccgtccggtgccggcacccccctggccggcggcaccacggcggccgcgaccagcgcgccggccggtaccgcggcgttcgacctggtgtcctacaccggcaagcagcctgccggtttctcggtggacagggtgccggccggttgggaggtgcagggcgtcaccgagtcctcgctgaccctggccccggtcggcgccaagccgcacaacagcgccgtgccgcagggtgacgtcgccgactccgacccgaacagctacgtcggcaaggtcgccgtgatgctgcagtcggtcgacgagcacggcgcgatgccgggcaagccggagaaggtgagcgtcggcggccgggagggcttcttcgccaagcggtccgacgccggtgacggcatcaccctgttcgtcaagcagccgaacgggatcaacctggaggtccaggtctgggacggcatccactggagccgcgaccagatcgtcgccttcaccgccgggatccacgtcaacccgaacgccaagcagggccggggctga

SEQ ID NO: 1217 - DNA, 513 bp, Actinoplanes utahensis
gtgagaagcgagcgcgacgaacagttccaccgcttcgtggtgtcccggagatccggcctggtgcggaccgccactctgctcaccgcgggggacgcgcacctggccgaggacctggtccagtcggtgctgaccaagttgtacgtggcgtggccggcgttccagcgggccgacaacccggacggatatctgcgccgggtgctggtcaacgcgttgaccgacgaacggcggcgctggtggcggcggcgggaggagtcgatggcagacgtgccggacgtgcccgcggctgacccgggcgggaccggggagacgaccgacgggctgcgcgcggccctgcggcagctgcctccgcggatgcgggcggccctggtcttccgttatttctacgacctcgacgtcgctgccaccgccgacgccctcggctgttccgagggcacggtgaagagccagaccgcccgggccctcgaccggctccgggccgtcatcggcccgtccctgaccaccgttcaacgctga

SEQ ID NO: 1218 - DNA, 132 bp, Actinoplanes utahensis
gtgccgggtcacgggtcgcgtcgcttctccggtggagcgggccggtccccggacggcgacggcgacgagttcgccgcctgtttccgccgggcgtgcaacccgggggtggccgggaccgtcagggaggtgtga

SEQ ID NO: 1219 - DNA, 612 bp, Actinoplanes utahensis
atgaatctcagacacgacccgtcgcggtggggcgtgccccagcagcagcccccggtgccggctcccgggccgctcttccccggctggctcgaggagcgcctgttcgaccagcggatcgtgatgctccgcgggcatctcagcagcgaggcgtcgaccagcatctcggcggcgctgctcaccctggacgcggccggccaggcgccgatccagctgcacgtggcctgtccgggcggcgatctgagcgcggcgctcgccgtggtcgacgtgatcgacgcgctggtgtcgccggtgcacgcgctggtcaccgcggaggccggtggggcggccctggccgtgctgaccgcggccgaccgacgggccggctatcggcacgcccggttcaaactcagcgagccccgggcggccggggtcaccggaacggctgacgaggtggccgcggcggccgggcagcacctgcgcgaactggaggaggtcgtggtccgcctcgccgagctgaccgggaaaccgcgcagccggatcgaggacgacctgtccggcggccggagtctgagcgccaccgaggccctcgactacggcctgctcgacgaggtcatcacgccgaaggcccgctga

SEQ ID NO: 1220 - DNA, 426 bp, Actinoplanes utahensis
atgcctcccaagaagaagacccatgaggtaaccctcgcgcttgaggcgggtaacgccgcgatggtcgacctcggtaagatgctcggcccgaccggtgccaacatgcgtgccgtcaaggtcgagtacgacgaggccaccgcgaagaaccggggcgagatcatcccggtcatcgtgtcggtctacgaggaccgcagccacacgctggcctacaagacgccgccgaccagcttcctcatccggaagacgctgggtatccagtccggcgcgtcgaacccgctcacccagaacgtcggcaccctcagtgccacccaggtccgcgagatcgcggagcgcaagctccccgacctgaacgcgaacgacctggacgccgccatcaagatcgtggccggcaccgcgcgttcgatgggcgtcaaggtcgcctcttga

SEQ ID NO: 1221 - DNA, 558 bp, Actinoplanes utahensis
gtgaacaacttcgaggtgtccgcctgctccaccaagaagggcaccgcggtcgccaagaccaaggtgaaggcggcgctgaagacggcggccggcaagacctactggacgcacgaggcgccccagctgaagctgaactacccgctggtcaaggcgatcgcctggcacgagagcggctggcagaccaacgtcttcaactgtgacggcgggcagggcctgatgcagctgatgccggacacggtcaacatgatcaacggccggttcggggtgagctacaacgtgtcgaactaccaggagaacgccaccgcgggcgccaactatctcgcctggctgacccggtacatgtcgcagaaggccttcgaccaggacaaggtcttcgacctgagccccggcaagtgccggacgcacagctcgtggtgcctgctcaacatcaccatcgcggcctaccaggcgggcccggacgccgtgctgcagaacctcaagaccaagaaacttcccaatccggcgtacgtcgactcggtgcggtcgctgatggccgactgcttctgcgacaagtactga

SEQ ID NO: 1222 - DNA, 2289 bp, Actinoplanes utahensis
gtggagcaggcggacacctcgaagttgttcacgtcctccggcggggtggccgccctggtggtcggcttcctcgtcggggtggccgtcggcggggtcggcgagggggtggtttccgccggctccggactgctctgctcgggcgccggcgagtcggacggcaccgactgcgccaccggcgcgctgcccgccgacttctggtcgtccccaccaccgaacaggccgcagcccgccgtcatcgccagcatcgccaccacggcgaacaagcgcaccttcatcgacgtagtcctccccgtaggtatatcgatgaagacgctaacagtggcgatctctttgcatggggcgcgggaatatctcaaaaaattttcccgacccccagacatgaccccgtgtcacgatcggcaacctggaccggggacaatgggtgccatgcagacccgcaccgacctccgtaatgtcgccatcatcgctcacgtcgaccatggcaaaaccaccctggtcgacgccatgctccgacagggcggtcagtcccacgcacgtggagagatggccgaacgcgccatggactccatggacctggagcgggaaaagggcatcaccattctcgccaagaacaccgcgatcagttaccagccggccgagggcgacccggtcgtcatcaacatcatcgacactccgggccacgccgacttcggtggcgaggtggagcgcggcctgaccatggtcgacggcgtggtgctgctggtcgacgcgtccgagggcccgctgccgcagacccgcttcgtgctccgcaaggcgctctccgccaaactgccgatcatcctggtgatcaacaaggtggaccggccggacgcccggatcaaggaggtcgtcgacgacacgtacgccctcttcttcgacctggacgccgacgaggaccagatcgagttcccgatcgtctacgcctgcgcgcgcgacggcatcgcctcgctgaaccagccggccgacggcgccgtcccgagcgacagcgccgatctggagccgctgttcagcacgatcctgaacaccatcccggcgcccacctacaccgagggcgccccgctgcaggcgcacgtggtcaacctggacgcgtcgccgttcctgggccgtctcgcgctctgccgcgtgcaccagggcaccatccgcaagggtcagaccgtcgcctggtgcaagaccgacggcacgatcgccaacgtccggatctccgagctgctgatcaccgagggcctggagcgcaagccggccgagagcgccggtccgggcgacatcatggccgtcgccggcatcccggagatcatgatcggcgagaccctggccgacgcggagaacccgatcccgctgcccctgatcacggtcgacgagccggccatctcgatggtcatcggcaccaacacctcgccgctggtcggcaaggtcaagggcgccaaggtcaccgcccgcatggtgaaggaccggctggacaaggaactgatcggcaacgtctcgctgcgcgtcctgccgaccgagcgtccggacgcgtgggaggtgcagggccgtggcgagctcgccctggccatcctggtcgagcagatgcgtcgcgagtcgtacgagctgaccgtcggcaagccgcaggtggtcaccaaggtcatcgacggcaaggtgcacgagccggtcgagcgtctgaccatcgacgcccccgacgagtacatgggcgccatcaccaccctgctcgccacccgcaagggccggatggagcacctgaccaaccacggcaccggctggctccggatggagtggctggtcccggcgcgcggcctgatcggcttccgcaccgagttcctcaccgagacccgcggcaccggcatcatgcaccacctgtacgaggaccacgagccgtggttcggcgacctccgcacccggcagaacgggtcgctggtggccgaccgggccggcgcggtcaccccgttcgcgatgatcaacatccaggagcgcggtcagctcttcgtcgagcccaccaccgaggtctacgagggcatgatcgtgggtgagaactcccgtgaggacgacatggacgtcaacatcaccaaggagaagaagctcaccaacatgcgcgccgccagcgcggacaacaccgagaaggtgatcccgccgcgcaggctgtcgctggagcagtcgctcgagttctgccgcgaggacgagtgcgtggaggtcaccccgaacgcgatccggatccgcaaggtcgtcctggaccagacggcccgtgcccgcaccgccgcccggcgcaagcaccagtaa

SEQ ID NO: 1223 - DNA, 1002 bp, Actinoplanes utahensis
ttgaacgtttcagcctggatctggttcgccaccctggtggcgttggtggccgtgctagccgtcgatcttctgatcatcgggcgccggccacatgagccgaccatgaaagaggccggtggctgggtcgccttctatgtcgccttcgcgctgctcttcggggtgggtgtgtgggcggtctccggggggcgggccgcgggcgagttctacaccggctggctcaccgaatactcattgagcgtcgacaatctcttcgtcttcgtcatcatcatgggccggttcgcggtcccgcgccgcttccagcagaaggtgctgctgatcggcatcgttctggcactggtcatgcggggcgcgttcatcgccgccggggccgcgctgatctcgcagttctcctgggtgttctacatcttcggtgcgttcctggtgtacaccgccgtgaccctggtcaagggcggcgagggcgacgaggacgaattcaaggagaacctgctgatccgctgggcgaagcgggcgctgccgctctcctcgtccttcggcgacgggcagttccgggtggtcaccgcggccggcaaacgcctgttcacgccgatgctgatcgtgatgatcgcgatcggcaccaccgacctgatcttcgcgctcgactcgattccggccatcttcggcatcaccaaggagccgtacctggtcttcaccgcgaacgtcttcgcgctgatgggtctgcggcagttgttcttcctgctcggtggattgctggaacgcctggtctacctgaacgtcggcctggccgtggtgctcgcgttcatcggcgtcaaactgttcctcgaagccctgcacaccaacagcctgtcgttcatcaacggcggcgacggcctgcactgggcgccggaaatcccgatctggctgtccctgctggtgatcctcggcacgctgggcgccgccaccgtcgccagcctggccaaatcggcgcgagaccggaaaagtgacctgatcaccgccgggcgctga

SEQ ID NO: 1224 - DNA, 333 bp, Actinoplanes utahensis
atgatcctcgaagtcacacttatcgacatcctccccggccgggaggacgatttcgccgccgcctaccagctcgcccgccccctgatcgccggcgccgagggctgccacggtctgcgactcaagcgcggccacgagtcctccaaccgcttcctcctcctggtcgaatgggactccatggacgcccacgaccacaatttccgccgcaccgaacgcttcgcccagtggcgcgcctcgatcgccgccacgctcgctcagcccccgctgaccgaatacttcaccgacctgcccgccttggccggtcgccccgacgccgaccacgacttcttcgcctga

SEQ ID NO: 1225 - DNA, 273 bp, Actinoplanes utahensis
gtgcgcaggcgaagccgatcgcgaccgtggtcgccctgggagggcacggcaggggtcgtggactccaccggtcgagtgacgatacggccggtcggcgtcggcacggcatcggcatgctgggttccggccgccgggattcgtacggagccatatctgcccgcgctgcccgcgctgcccgcgctgcccgtgctgcccgtgctgcccgtgctgcccgtgctgcccgtgctgcccgtgctgcccgtgctgcccgtgctgcccgtgctagctagctag

SEQ ID NO: 1226 - DNA, 2106 bp, Actinoplanes utahensis
atggcgctcgacatcccacgactcgacggccggttcgaggtcgtcagcgactaccagccggccggtgaccagcccgcggcgatcgatgagctggagcggcgggtccgccgcggcgaccggcacaccgtgctgctcggcgccaccggcaccggtaagagcgcgaccaccgcctggctgatcgagcggttgcagcggcccgccctggtgctcgcgcccaacaagacgctctgcgcccagctggccaaggagttccgcgagctcctcccgcacaacgcggtggagtatttcgtcagctattacgactactaccagcccgaggcgtacatcgcccagtccgacacctacatcgagaaggactcctcggtcaacgaggaggtcgagcggctccggcactcggccaccatgtccctgctcacccggcgcgacaccatcgtggtcgccaccgtcagcgcgatctacggcctcggcaccccgcaggagtacatcgagcgcgccgtgaaggtgaaggtcggcggcgagatcgaccgggacaagctgctgcgccgcctggtcgacatccagtacacccgcaacgacgtcgccttccagcgcggcacgttccgggtccgcggcgacaccctggagatcatcccggcgtacgaggagctcgccgtccgggtcgagctcttcggcgacgaggtggagaagctctactacctgcacccgctcaccggtgaggtgatccgcgaggtcgacgagctgatcatcttcccggccacccactacgtggccggcccggagcggatggagcgggcgatccgcgacatcgaggcggagctcgccgaccggctggccgagttcgagcggcagggcaagctgctggaggcgcaacgactgcggatgcgcaccacctacgacatcgagatgatgcgccaggtcggcttctgcaacggcatcgagaactattcgatgcacatggacgggcgcaccttcggcgagccggcctacaccctgctcgactacttccccgacgacttcatcaccgtcatcgacgagtcgcacgtctcgatcccgcagatcggcgggatgtatgagggggacgcctcccggaaacggatcctgatcgagcacgggttccggctgcccagcgccgccgacaaccggccgctgcggttcgacgagttcctggagcgggtcggccagatggtcttcctctccgcgaccccgggcaactgggagatggagcaggcacagggagagttcgtcgagcaggtgatccggccgaccggtctggtcgacccgcaggtcgtggtgaaacccaccaagggacagatcgacgacctgatgcacgagatcaagctgcgcaccgagcgggatgagcgggtcctggtcaccacactgaccaagaagatggccgaggacctgaccgactacctgctggaaaacgggatccgggtgcgctatctgcactccgaggtggacacgctgcgccgggtggagctgctcaaggagctgcgaaaaggcgactacgacgtgctcgtcggcatcaacctgctgcgggagggtctcgacctgcccgaggtgtcgctggtggcgatcctcgacgcggacaaggagggcttcctgcgcagcggccggtcgctgatccagacgatcgggcgggcggcgcgcaacgtgtccggcgaggtccacatgtacgccgacaagatcacgccgtcgatgcgggacgcgatcgacgagacggaccgccggcgggccaagcagatcgcccacaacgaggcgaacgggatcaagccgcaggcgctgcggaagaagatccacgacatcctggacgacatctaccgcgaggcggaggacaccgactcggcgatcgtggggggcgcggggcggcagatgtcccgcggcaaggccccggttccggaaacccgatccaaggcccgggcgggcaacgggccggcccgcgaggggatggcgcgggccgagctggcgcagctcatccaggacctgaacgagcagatgctgggggcggcccgggagctgcagttcgagcttgcggctcggatccgggacgaggtttccgagctgaagaaggagctgcggggaatggatgccgctggggtgaagtaa

SEQ ID NO: 1227 - DNA, 1206 bp, Actinoplanes utahensis
gtgctgagggtcgggctcaccggggggatcggcgcgggcaagagtgcggtgtcggcgcggctggcggaactcggagcggtgatcatcgatgccgaccggctggcgcgtgaggtggtggcgcccgggacggacgggctcgccgagatcgtggcggcgttcggcgacgggattctcggtgcggacggcgggctggaccggccggcgctcggggccaaggtcttcggcgacgagccggcccgccgccggctggagcagatcatccacccgcgggtgcgggcgcgcaccgccgagatgatcgaggaggcgcccgccggcgcgatcgtggtcaacgacgtaccgctcctggtggagaccgggctggcaccgacgtaccacctggtcgtcgtggtgacggcgaaccgtgaggtgcgcatcgggcgtctcgtccgcgatcgtggcatgtcggcggcggaggccgccgcccggatcggcgcccaggccgacgatgccacccggcaggccgccgccgacgtgatcctgcccaacgaggatgatcttgctgcgttgcgcgcccgggtcgacgcgctgtggcgtgaccggctgctccccttcgagcggaacgtccgggccgggaccgccgcccgcaaagcccccgaactgcacatcgtaccgcccgatccgggctggccgcaggccgccgagcgactgatcacgcggatccggcaccagctcggcgacgccgacgtgcggcacatcggatcgacggccgtcccgggcctgccggccaaggacatcatcgacctgatgctgtccgtgcgaaccctcgacgaggccgatgcgctcgccggtcgcctggccgccgccggattcccggcgcgatcgggggagtgggccgacaacgcgcgcggactgcccgggcagacgtggccgaaacgggtgcacgggtcgtcggatccgggacggccggtgattctgcacgtgcgggtcgccggatcgccggggtggcggttcgccctgctgatgcgggaccacctgcgggcggtgccggcggcgcgggacgcctacgcggcggcgaaggccgagctggcgctgcgcttcccggaccgggccgggtatgcggcggcgaaggagccgtggttcgacgaggaggctgcggcggccgaggcctgggcgaccgcgacgggctggcagccggctgccggcgagagctcgcctcgggcggattag

SEQ ID NO: 1228 - DNA, 1503 bp, Actinoplanes utahensis
atgacgagcagcatcgaggccacctcgagcgccaacaaggtcaccgtcgacgacctcggctctgaggaagctttcctcgcggccatcgacgagaccatcaagtacttcaacgacggcgacattgtcgaaggcaccgtcgtcaaggtcgatcgggacgaggtcctgctcgacatcggctacaagaccgagggcgtcatcccctcgcgcgagttgtcgatcaagcatgacgtggaccccgcggaagtggtgtcggtcggtgaccacatcgaagccctcgtcctcaccaaggaggacaaggaaggccgtctgatcctctcgaagaagcgcgctcagtacgagcgggcttggggcaccatcgagaagatcaaggaggacgacggcgtcgtccgcggctcggtcatcgaggtcgtcaagggtggtctcatcctggacatcggcctccgtggcttcctgccggcctccctggtcgagatgcgtcgcgtccgcgacctgcagccgtacgtcggccgcgagctcgaggcgaagatcatcgagctggacaagaaccgcaacaacgtggttctgtcccgccgcgcctggctcgagcagacgcagtccgaggttcgcaccgagttcctcaacaagctgcagaagggccaggtccgcaagggcgtcgtgtcctccatcgtcaacttcggcgcgttcgtcgacctgggcggtgtggacggcctggtgcacgtctccgagctctcctggaagcacatcgaccacccctccgaggtcgtcgaggtcggccaggaggtcgaggtcgaggtgctggacgtcgacctggaccgcgagcgcgtctcgctgtcgctgaaggcgacccaggaggacccgtggcgtcagttcgcccggacccacgcgatcaaccagatcgtgcccggtaaggtcaccaagctcgtcccgttcggcgcgttcgtccgcgtcgacgacggcatcgagggcctggtgcacatctccgagctggccgagcgtcacgtcgagctgcccgagcaggtcgtccaggtcggctccgacgtcctggtcaaggtcatcgacatcgacctggagcgccgccggatctcgctgtcgctcaagcaggccaacgagggcttcgtcgagggcgaggagcacttcgacccgaccctctacggcatggccgcgacgtacgacgccgagggcaactacatctacccggagggcttcgacccggagacgggcgagtggctcgagggcttcgagaagcagcgcgagacgtgggagaagcagtacgccgacgcccgcgagcgctgggaggcccacaccaagcaggtgcaggcgtcccgcgacgccgacgccgaggccgcgctcaacccggctccggccggcggcgtgaccacctcgtcctcgacctcgtcgagcacgtcgaccccggcgcgctccgccgaggagcccgcgggcaccctggccaccgacgaggctctcgccgccctgcgcgagaagcttgccggcggcaagaactga

SEQ ID NO: 1229 - DNA, 837 bp, Actinoplanes utahensis
gtgaccgagatccccacgatcgagaaagccgcgtccgcccggccggccgccgacgagcgctcccgggcgttcgaggatgagacgcgccacgccaaccggtcctggtgggacctggacgccgacgactaccaggacgagcacggggccttcctgggcgacgtcgacttcgtctggtgcccggagcggctgcgcgaggccgacgcggggctgctgggtgacgtacacggcaggaaggtcctggaactcggtgccggcgccgcggccggagcccggtggttgcgccggcagggcgccgaggtcgcggccatggacctgtccgccgggatgctgcggcacgcccgggcggcggccgcccgcagcggtgtcgaggtgccgctggtccaggccgacgcgctggcgctgccgttccgggacggggctttcgacatcgtctgcaccgcgttcggcgcgatcccgttcgtggcggactcggccgccgcgatgcgcgaggtggcccgggtgctgcggcccggcggcagttgggtgttctcggtcactcacccgatgcggtggatcttctgggacgagccgggcgaggacgggctggtggcccgcaactcctatttcaaccgttcgccgtacgtcgagcggggcgacgacggccggatgacgtacctggagcagcaccggacgctcggcgaccggatccgcgagctggtcgccgccgggttcgtgctgcgggacctggtggagccggagtggccggagggccacgaggggatctggggccagtggagcccgctgcgcggccgcctcttccccggcaccgccatcttcgtgtgcgacctgcccggctga

SEQ ID NO: 1230 - DNA, 213 bp, Actinoplanes utahensis
atggcagaagagaacctgaaaaagggcgacaaggtcacttggcgcagccacggcgagaccgtccacggccaggtcgaacagaagatcaccaagcgcaccgaggccgccggacggacggtcgccgcctcctcggacgacccgcagtaccgggtgcgcagcgacaagaccggccgggacgcggtgcacaagcccggatcgctgcaccgtggctga

SEQ ID NO: 1231 - DNA, 324 bp, Actinoplanes utahensis
gtggctgacctctacgccgacttccgcgcagcggtcaccatgaccccggccgccttgcgcacctggctcggcaccgaggagtcgaaggaggtcggccagaagtcgtcggcgggcgccgagtcggtcggccacgactccggccgccggatcctgcgtctgctggagaagaagaagtccgagctgaccgcggacgacgaggagcacatgcgcaaggtcgtcggctacgtacaccgccacctcgcccagcgccccgccggtgacgtccgggagacgaagtggcgttactccctgatgaactgggggcacgacccgctgagggactga

SEQ ID NO: 1232 - DNA, 396 bp, Actinoplanes utahensis
atgtcgatggagcagaccgtgatcacggccgtgccccggcccgccggcggcttggggatcgagttcgatgacgcgatcctgatcgaggggcccgggctggccgccgcgccgctggaggcgccgcgggccaccgcgttcgccgcgatgttcaaggctctcggcgacccggtccggctccggctgctgtcgatgatcgcctcggcgcccgacggggaggcctgtgtctgcgacctgagcagcgccttccacctgaccggcccgaccatctcgcaccacctgcgaattctgcgcgaggccggcctggtcgacagcgaccggcgcggcacctgggtctactaccgggcggtcccggcgacgctgattctgctggcgggcctgctccagccggcgtcctga

SEQ ID NO: 1233 - DNA, 2700 bp, Actinoplanes utahensis
gtgagcgacgacgcgacgaccccccgcctgctgctgctggacggccactcgctggcctaccgggcctatcacgcgctgccggtggacaacttctccacggtcaccgggcaggccaccaacgcggtgttcggcttcacgtcgatgctcatcaacatgctgcgcgacgagaagccgacgcacatcgtggtctccttcgacctctcccggaaatcgttccgcaccgagagatacgcggaatacaaggccggccgctcggagaccccggcgccgttccagggccaggtcagcctgatccaggaggtgctgcaggcgctgcgcatcccggtggtcaccaaggagaactacgaggccgacgacgtcatcgccaccctcgccacccaggcccgcgcggccggcatggaggtgctgatctcctccggcgaccgggacgcgttccagctggccgacgagcacgtcaccatcctctacccggtccgcggcgtctccgaggtctggcggatgacccccgaggcgatcgaggcgaaatacttcgtgccgccgtcgcgctaccgggacaaggccgccctggtcggcgagagcagcgacaacctgatcggtgtccccggcgtcggggacaagaccgccgccaagtggatcaatgagtacggcggcctcgacggcgtcatcgcccaggccgacaagatcaagggcaaggccggcgagagtctgcgcgcccacctcgccgacgtgatccgcaactacgacctcaacgctctggtgtgcgatctggagctgccgctgcgtcccgaggacgtccgctggaccgggtgggaccgcgaggccgtgcaccaggtcttcgacgcgctcgagttccgcgtcctgcgcgagcgcctctactcgtacctggaggccgtcgagcccgaggccgagtccggcttcgacctggaggcccgcgtgctgcgcgccggcgaggtggccggctggctcaccgagcacgccgcggcggctccggtcggcgtcgccgtgaccggcgccttcggccgcggcaccggccaggtcaccggcatcgcggtggccaccggcagcggtccggccgcctggttcgacccggccgcgctggacgaggcggacgagcaggcggtcgccgcctggctcgccgacccggcccggcccaaggtcatccacgacgccaaaccggcgctgctggccttccgcgcgcacggctgggagctggccggcgtcaccaccgataccgcgctcgccgcctatctggccaagcccgaccagcgggggtacgacctgaccgacctcgccctgcgctacctcaagcgcgagctgaaggtcgacgctcccgacaacggcggccagctggccctgtcgttcggtgacgaggccgaggacaccgccgccgaggagggggtgatgctgcgcgcccgggccaccctcgacctggccgacgtgctgatcgccgagctctcccaggacggcggcgagtcgcagcgcctgctcgccgaggtggagcagccgctctcggtggtgctcgccgagatggagggcaagggcatcgccgccgacacggagtatctctccgagctggagtccaccttcggcgccgaggtgaaagccgctcagcaggccgcccacgaggtgcacggccgggagttcaacctgggctcgcccaagcagctgcaggagatcctcttcgtcgaacgcaacctgcccaagacgaagaagatcaagtccggctacaccaccgacgcggacgccctgcaggacctgttcgccaagaccgaggacccgctgctcgcccacctgctgcgctaccgcgacatggccaagctcaagtcgacggtcgacgggctgctcaagtcggtctccgacgacgggcgcatccacaccacgttcaaccagacggtcgccgccaccggccggctctcgtccaccgaccccaacctgcagaacatcccgatccgcaccgaggagggccggcggatccgccgcgcgttcgtcgtcggcggtgggttcgagcagctgatgaccgccgactacagccagatcgagatgcggatcatggcgcacctgtccgaggacgcggcgctgatcgcggcgttcaactcgggcgccgacttccacgcggtcaccgcgtcgtcggtcttccaggtggagctcggcgaggtcaccgccgatcagcgccgcaagatcaaggcgatgaactacggcctggcgtacgggttgagttcctacggcctgtccaaccagctcaccatctccaacgacgaggccaagacgctgatggaggagtacttccagcgtttcggcggcgtccgggactacctgcagtcggtcgtcgcccaggccggcaaggacgggtacaccgcgaccatcctcggccgccggcgctacctgcccgacctgagcagcgacaaccggcagcggcgcgagatggcccagcggatggcgctgaacgcgccgatccagggctcggccgccgacatcatcaaggtcgcgatgctcaaggtcgacgcggcgctgcgggcttccgggctgacctcccggatgctgctgcaggtgcacgacgagctggtcttcgaggtggcgccgggggagcgggagccgctggaggagctggtccggcgggagatgggcggggcctacccgctcgcggtcccgctggaggtgtcggtcggtaccggccgcgactggaacggtgcggaccactag

SEQ ID NO: 1234 - DNA, 762 bp, Actinoplanes utahensis
gtgaccgagatggtgcgtgcggagaacgtccacaagtccttcggggctctggaggttctcaagggtgtcgatctggtcgtgccgcagggcggggtgagctgcgtgctcggcccgtccgggtccggcaagtcgaccttcctgcgctgtatcaaccacctggagaaactcaacgccggccggatcctggtcgacggcgagctggtcggttaccgggagcgtggcggcaaactgcacgagctgggcgagcgtgaggtcgcccggcagcggcagtcgatcggcatggtcttccagcgcttcaacctcttcccgcacatgaccgtcctggacaacgtcatggaggccccgtgccgggtcaagggggagaacaagggtgaggtgcgcgagcgcgccctgtccctgctcgaccgggtcggcctggccgccaaggtcggcaactacccggggcagctctccggcggtcagcagcagcgggtggcgatcgcccgggcgctggccatgcggcccaaggtgatgctcttcgacgagccgaccagcgccctcgacccggaactggtcggtgaggtgctcgaagtgatgaagggcctggcccgggacggcatgacgatggtcgtggtgacccacgagatcggtttcgcccgtgaggtggccgacgaggtggtcttcatggacggcggcgtggtggtggagaagggcgctccggccgaggtgatcaccaacccgcagcaggagcggaccaaggcgttcctcagcaaggtgctctga

SEQ ID NO: 1235 - DNA, 1008 bp, Actinoplanes utahensis
atgacacaagcgacagagtccgagcgggcacggccggcagcgatcaaggccgtgcccgtccggcatcccggcaggtgggcggcgatcgtcgtcctcatggtgctggtcgccatgttcctgcatctgatcattacgaaccacgcgttcaactggtcgttcatcttctcctcgtacgcccccggcaagcgcggcgtgatgttcaccgagccggttctggagggtctgcggggcaccatcctgctgaccatcctgtcgatgttgatcggcgtcaccctgggcgtcgtgatcgcgatcatgcggctctcgccgaacaaggtgctgtcctcggtcgcctgggcctacacctggttcttccgggccgcgccgcgcctggtgctcgcggtgatcttcggcaacctgaacatcctgtggagccggatcggcttcggcctgccgttcgaccggcagatcggccggctgttcgggatcgacaacttcgacggccagttcttcagcatcaggtcggtcgacctgctcgccgggttcgtggccggcatgatcgcgctcgggctctccgaggcggcctacatggccgagatcgtccgggccggcatccagtcgatcgacaccgggcagtccgaggccgccgtggccctgggcatgtcccgtggccaggtgttgcgccgggtggtgctgccgcaggcgatgcgggtgatcgtgccgccgaccggcaacgaggtgatcgcgatggtcaaggacacctcgctggtggcctacgtgccggtggccggggagctgttcttccagctcacccaggtcgaggcacggaccttcatcgtgctgccctgcctggtggccgcgctgatctggtatctgatcatctgcagcgtgctgatgatcgtccagttcttcgtggaacggcacttcggcaaggggtacggcgcggccggacaggcccgtcagcggctccgggacatccaggtggagcagggtggccggatgaccgtcaccggggagggggcgccgtga

SEQ ID NO: 1236 - DNA, 903 bp, Actinoplanes utahensis
atgttccgcatcacccccggccggcgggcgatcctcggtgtggccgtggcggcggcgctcaccgtgtcgctgtccgcctgcggcaaggagaccgacacgagcagcggctcggctgccgcgccgagcgcctccaccgacacctcgctcgcgggtaaggtcccggccgacatcaaggcggccggcaagctggtcatcggcaccgactcgtcgtacgcgccgagtgagttcctggacaccgacggcaagacggtcaccggtttcgacgtcgacctgttcaacgcggtcggccagaagctgggcctgaccaccgagtggcagtcggccaccttcgacagcatcatcccgggcgtcagcagcgggaagtacaccgtcggggtgtcgtcgttcacgatcaacccggaccgcctcaaagtggtcaacatgatctcctacttctcggccggcacccagtgggccgccaaggcgggctccacgctgagcctggacgacgcgtgtggcaagaagatcgcggtgcagaccgcgaccgtgcaggtggacgacctgaccgcccggtcgaagaagtgcaccacggcgggcaaggccaagatcaccgtggaccagtaccagaagcagtcggacgccaccaacgccgtggtcaccggcaaggacgaggctatgctggccgactccccggtggtcgcctacgcggtcaagcagaccaacggtcagctggcgctgctcggcgacatctacgactcggcgccgtacggctacgtcgtggacaagaagcagaccgagttcgcgaacgtgatcgccgaggcggtcaagtcgctgatcgcggacggcacctacaagacgatcctcgacaagtggggcgtcgcggccggcgggatcaccactcccgcggtgaacccggcgagctga

SEQ ID NO: 1237 - DNA, 711 bp, Actinoplanes utahensis
atgctgcttgagctgaaggacatcacgctgctgtacgggcggatccaggccctgcacggcatcagcctgaccgtgggccagggtgagatcgtcgcgctgatcggcgcgaacggcgcgggcaagtcgaccaccatgcgggcgatctccggcctgcgcccggtcgcccagggttcgatcatgttcgacggcgaggacatcaccaagctgcgcgccgacctgcgggtggtgcgcggggtgtcgcagtcgccggagggccgcggggtcttccccggcatgacggtgcgcgaaaacctggagatgggcgcctacacccggcgcaaccgtgccgagatcaatgaggacatggagcgggccttcaccctgttcccccggctcaaggagcgggagaagcaggtcagcggaacgatgtccggcggcgagcagcagatgctcgcggtcggccgggcgctgatgagccggcccaagctgctgctgctcgacgagccgtcgatgggcctcgcgccgatgctgatccagcagatcttcgacatcatcgtggagatcaaccagcagggcaccacggtgctgctggtcgagcagaacgcgcagcaggcgctctcccgggcgcaccgggcgtacgtgctggagaccggccggatcgtgaagcagggcaccggtcaggagctcctgcacgaccccgcggtcaaggacgcctacctcggcgtcgcctaa

SEQ ID NO: 1238 - DNA, 870 bp, Actinoplanes utahensis
atgagcgagccgcacatcgagacgcccgaagaggccgatcgggccaacagcgagccggtctccttcagcaagcccgacccggacgtcaagccggccggcgacgtgcttttggagatggacgacgtcacgctgcgcttcggcggcgtcgtggccctcaacgggatcagcttcgccttgcgccgcggtgagatcttcggtctgatcggcccgaacggcgccggcaagaccacctgcttcaacgcgatgaccggtgtctacagcccgaccagcggtcagatccgcttccagggccagtcgctgatcggcaagaagaagcacgagatcacccgcggcgggatcgcccggacgttccagaacgtccggctcttcccggagatgaccgcgctggagaacgtgatggtgggtgccgacgcccacttcaagaccagcgtgctcagcgccctgttccggctgccccgcttctggcgggaggagcgcgagggccgggccaagtcgctggaactgctccgcttcgtcggcatcgcgcaccgggccggcgaggtcagccgcaacctctcctacggcgagcagcgccgcctggagatcgcccgcgcgctggccaccaaccccaccctgctctgcctggacgagccggccgccggcttcaacccggcggagaaggaggacctgctcaacctgatccggaagatccgggactcgggcgtcaccgtgctcctcatcgagcacgacatgcgcctggtgatgggcgtcaccgaccggatcgtcgtgctcgagttcggcaagaagatcgccgagggcacgccggccgaggtgcgcgacaacccggcggtcatcgccgcctacctgggggtgcccaccgatgctgcttga

SEQ ID NO: 1239 - DNA, 1128 bp, Actinoplanes utahensis
atgagtgccgtcgctgacaagccggtcaccggcacccccaagcccagccgccagctgcgcggctggctgggccggcagcccgctccggtgcgctgggccgtgatcctgggcttcgtggtcctggcctacctgctgccgtacgtcgaccggattccggggatcgggccgcagatcgtcaccaccggcgtggactggcccaccgccctgttcgagatgtcgtactacgtgctgctggccctgggcctgaacgtggtggtcggcttcgccggcctgctcgacctgggctacgtcggcttcttcgcggtcggcgcctatgtcacggcgctgctcacctcgccggacagcgtgctgcacacgcagtacggctggctggtcgcgatcccggcctcgctggccgtgacgatgctggccggtgtcctgctgggctggccgaccctgcgcctgcggggtgactacctggcgatcgtgacgctcggcttcgccgagatcatccggatcatcgccaccagcgccacctgggcccgtggtgaccgcggtttctccagcatcccgcacccgccgggcaagctctccgacggcagcccgctcttcggggtcaccgacgccatcccgtacttctggctcggtttgtccgtggtgatcctggtcgtgctgggagtacgcaacctcgaccgcagccgggtcggccgctcgtggctcgcgatccgcgaggacgaggaagccgccgagatcatgggcgtgcggacgatcaagttcaagctgtgggcgttcgcgatcggcgcgttcatcggtggcctgggcggcgtgctgttctccggcgagaccggcttcatcaactcgcagacgttcgtcctgcagttctcgatcctggtgctggccggcgtggtcatgggtggctccggcaacatcgccggcgcgatcctcggtggcgcgctgatctcgtacattccgaaccgcctgcgcggcatccaggacccggtgttccacaccgacctgtacgagtaccgcttcgccctgttcggcgcgatgatcatcttgatcatggtggtgcggccgcagggtctgatcccgagccgtcgccgcgcgatggagctcaaggaccgggagaaggaggccgcgccgcaatga

SEQ ID NO: 1240 - DNA, 951 bp, Actinoplanes utahensis
gtgaatgtttccggtctgattcagaacttcgggccgctgacgattaccggccttgcgcagggcgccatcatcgccctgttcgccctgggctacaccctcgtctacggcgtgctccggctgatcaacttcgcccactccgaggtcttcctcctcggcacctacgcctgtctcatcgtctggggctggctcggcctcgaccagaactcggccaccccgtcggtcggcggggtcctgctgtacctggtcatcgggctggtcgtggcgatcgtcgcctccggtctcaccgcgctggcggtcgagctcgtcgcgtaccggccgctgcgcaagcgcaacgcccccccgctcgccttcctgatcaccgcgatcggcgcctcgctggtcatctccgaggtggtcggcgtggccacgcaccgcaatccgcgcggtgtgcccccgctgatccagccgaaagacgtgatcagcatcggcaacacgcacatcaccaacctgcagctcctgatcatcgggctggccctggtgatgatgttcctgctggaccgcttcatcaacacctcccggctgggtcgtggcatccgggcggtcgcacagaacccggacagtgccgccctgatgggcgtcaacaagtcccgggtgatcgcgctggtcttcctcctgggcggcctgatggccggtatcgcggcggtgatgtacgacctgaagatcggcgtcaccaagtacgacgccggcttcctgctcgggatcgaggcgttcaccgccgccgtcctgggcggcatcggcaacctgcgcggcgcgctgctcggtggcctgctgctgggcctgctgcagaactacgcggccggcctgttcggcacccagtggttgcacctcgcgtcgttcgtggcgctggtgctgatcctgctgttccgcccgaccggtctgttgggtgagtctctcgggagggcgcgcgcatga

SEQ ID NO: 1241 - DNA, 1182 bp, Actinoplanes utahensis
atgaggagggttccaaccttgaagcaggttctcgcgcgtgcgatcggcggggtggccctgatcggcctgctcgccggtactgcagcttgtaacaaggatacgagcagcgacacggcgtcaggttcgaactgcggctacaagctcgcgttcttcggcgcgctcaccggttcggccgccaacctcggcgtgaacatcgagcacggtttcgagctggccgtgaaccagtacaacgagaagaagggctcgacctgcatcaccgtcgagaagttcgactcgcagggcgcggctgaggtggctcccggtgtggcccggaagctggtcaccgacaagaagatcctcggcatcgtcggcccgccgttctccggcgagtccgaggccgccgacccgatcttccaggaggccgggatcccgacgatcaccccgtcggcgacccgcacctcgctgtcgaccaagaactggaagatcttccaccgcgccgtcgccaacgacgacgcgcagggcccggccgccgcgtcctacatcaaggacgtcctgaaggcgcagaaggtcttcgtggccgacgaccagtcggcgtacggcgccggcctggccgacgtggtgaagaccaagctgggcagcctggtcgtccagtcggacaagaccgagggcgacggcaagcaggccgacttctcggcgctggtccagaaggtgacctcgagcggcgcgaccgcgttcttctacggtggctactacaccaacgccggtctgatccgtaagcagctgaccggggccggttggaagggcaccctgctcggcggcgacggcatgaaggacccgggcctggccaaggcgtccggcaacgccgccgcggtcggcaccgtggtgacctgcccctgctccccgccggagcaggcgggccaggacttcaacaacgcctacaagaccaagtggggcgaggccgcgggcacgtactcggacgtcgcgttcgacgccgcgaacatcctcctgcagggcatcgacgcgggtaacaccaccgcggacaagctcaacacctacctgtcgacggtgaactacaagggcatcgcgaacacgtacaagtggaccgacaagggcgagctcgacccgaccctgatcaaggtctgggccttcaagttcgacgagtcgggcgacaccaaggccgaccaggagatcaaggcctcctga

SEQ ID NO: 1242 - DNA, 621 bp, Actinoplanes utahensis
gtggccgacacgcaggctggcgccgagcgcaggcgggtgctcatcgccgaggacgaggccctgatccggttggatctcgccgagatgctcgtcgaggagggctacgacgtcgtcggtgaggccggtgacggtgagacggccgtccggctggccgaggagctgaagcccgacctggtgattctggacatcaagatgccgatcatggacggcctggccgccgccgagcggatcgccggcgggcggatcgcgccggtcgtcatcctcaccgcgttcagccagcgggacctggtcgagcgggcccgggccgccggcgcgatggcctacctggtcaagccgttccagaaatccgacctggtgccggccatcgagatcgccctctcccggtactcggagatcgccgccctggagtccgaggtcgccggcctcaccgaccggctggagacgcgcaagtcggtcgagcgcgccaagggcgagctgatgacgaagtacgcgatgaccgagccgcaggccttcaaatggatccagcgcaccgcgatggatcaccggatgaccatgcgcgaggtagcagaccggatcctcgccgagggacaggaatccggcggcgctcctcagccgagttga

SEQ ID NO: 1243 - DNA, 843 bp, Actinoplanes utahensis
atgttgtggtccggttcctcaccactgaccgccgcgcgggcgggcatgtgggggttcctgatgttcgccggggccgcgtggctggtcgtcggctggagcgtgctgcgtctggaaccgaccgacctggcccgggtggccggcccgatcgtgctgttcggcgcggtctgcgaggggctgcgcgcactggccggcacccggacctggtggctgaacgcggtgctgaccgtgctgttcgccgcgaccgggacggtgatgctgctcagcgacgacaccggctggaccaccacggcctcgctgatcggctggtatctgctggtccgcggcgccgtcgacgtggctgtcgggatcatgacacggggcgtcgaccgggtgtggagcctggtggtcacggtcggcgtgctggagaccgccctcggattcctggccgcgagcccgctggcccgcggcgcgcagacgatcgtggtgatcctcggcgcgctgggggtgttgcgggcgatcgccgacctggtcaccgccctgcggctgcgggagatcgcggccaagggccgggacctgctggagttgccgccggaacgggcgaccgggctgaccggctactccgccgggcacgccgactatgaggggcccaaacaccgggcgaggcagggcgccaccgagtcgttccacgaccaggtggtgcggaccaccgccgacctcgacaggatgctggccgaggccgggatcaccgggccccgggtgccgaagaagaaggctccggacatccaggacctgccgccggcgcccgacacgctggagggtatcgagaacgccgccgcgccggagaaatccgccggcggtcactag

SEQ ID NO: 1244 - DNA, 882 bp, Actinoplanes utahensis
atgacgcagcagcctctgcagggccaggccgccgtcgaccagcttctggagatcctcgacctgaagcaggtcgacgcggccaccttcaccggggacagcccgcagaccggtgcccagcgcgtgttcggcggccaggtcgccgggcaggcgctggtcgccgccggccgcaccgtcgatccggcccgcatcgtccattcactgcacggctatttcgtacgacccggggacccgaccgagccgatcaccttccacgtggagacgatccgggacgggcgctcgttctcggtccgccggtcgaccgcccagcagtacggtaagacgatcttcttcatgtcggcgtcgttccaggcgctcgaggacggtctcgaccaccatgagccggccccgtccggggtgcccgccccggaggacgtgcccaccatgcgtgactgggtggcccggtatccgagccggcgggccgcgttcaacgccagcccgcaggcggtcgacgtgcgatacgtcggccaacccggctgggtgccgcccggcgaccgggatgccgagccgcagcagcgggtctggatgcggatcgacggcaggttgccggacgacccgctgatccacgcctgcgcgctgacctacgcctccgacctgtcgctgctggacgcggtgctgtcctatcacggcgaggtgtgggggcccggtggagtggtcggcgccagcctcgaccacgcgctctggttccaccgcacgttccgggccgacgagtggttcctctacgacagcgccagcccgtcggccggccgctcccgtggcctggccagcgggcggatgttcacccgtgacggccggcacatcgcctcggccgtccaggaaggcctgttgcgccgcgtcggcgcctga

SEQ ID NO: 1245 - DNA, 1440 bp, Actinoplanes utahensis
atggccgtgacacgccgcgtaaaaatcgtctgcacgatgggccccgccaccaagtcacccgagcggatgctcggcctggtcgaggcgggcatgaacgtggcccggatgaacttcagccacgacacccgggagaaccaccgggagatgtacgagctggtccggtccgccgccacgcaggccgaccgcccggtcgccatcctcgccgacctgcagggtccgaagatccggctcggcaagttcgccgacggcccgcaccgttgggagaccggtgaccgggtcgtcatcaccagcgacgacatcctcggcaccaaggaccgggtctcctgcacctacacgccgctgccgctggaggtcaaggcgggcgaccggctgctgatcgacgacggcaaggtcgccgtcgaggtcaccggcgtggtcgacggcaaggacatccagtgcctggtgaccgagggtggcccggtcagcaacaacaagggtgtctcgctgccgaacgtcgcggtcagcgtcccggcgatgagcgacaaggacgaggaggacctgcgcttcgccctgaagctcggcgtcgacctggtcgcgctctcgttcgtccgctcgccggaggacatcaagctcgtccacaaggtgatggacgaggagggccgccgtgtcccggtgatcgccaaggtggagaagccggaggcggtcgaccacctggaggcgatcgtgctggccttcgacggcgtcatggtcgcccgcggtgacctcggggtcgagctgccgctggaccaggtcccgctggtgcagaagcgcgccgtgcagctgtgccgggagaacgcgaagccggtcatcgtcgccacccagatgctcgactcgatgatcgagaattcccgccccacccgcgccgaggcctccgacgtggccaacgcggtgctcgacggcgccgacgcggtgatgctctccggcgagaccagcgtcggcaagtacccggtgctcacggtgagcacgatggccaagatcgtggccaccaccgagggcggcggcctgggcgtggcccggctgcagcacgacccgaagacgcacggtggcgcgctcaccatcgccgcctcgcagatcgcccgcaacatcggcgccaaggcgctggtggccttctcgcagaccggcgacaccgtgcgccgtctcgcccggctgcactgcgacctgccgctctacgcgttcaccccggtctccgaggtgcgcaacacgctggccctgagctggggtgtggagaccttcctgaccgacttcgtcgagcacaccgacgacatgttccgccaggtcgacgcgaagatgctgggcctgggcctggccaagccgggcgagtacgtggtcgtcgtggccggctccccgccgaacgccccgggttccaccaacaccctgcgcgtgcaccagctgggctccctcgtggacccgtccgccgtatga

SEQ ID NO: 1246 - DNA, 1470 bp, Actinoplanes utahensis
gtgcctgatccgaacggtttcctgcgctacgagcgccagctgccccggcggcgtccggtcccggtgcggatcatggactggaaagaggtctacccgcccgcgggcgaggagctgatccgcgaccaggccacccgctgcatggactgcggcatcccgttctgtcacgacggctgcccgctgggcaaccgcatcccggactggaacgacctggtgcgcaccggggcgtgggacgcggcgatcgagtcgctgcacgccacgaacaacttcccggagttcaccggccggctctgcccggcgccgtgcgaggcggcctgcgtgctgggcatcgccgacgacccggtgacgatcaagcaggtcgaggtcgagatcgcgaaccacgcgttcgcgcggggtctggtgccgcagccggcgccggccgcgtccggcaagtcggtcgcggtggtcggctccggcccggccggtctggccgccgcccagcagctggcccgggccgggcacgcggtcaccgtctacgagcgggacgaccggatcggtggcctgctgcgctacgggatcccggacttcaagatcgagaagcacgtgatcgacgagcggctcgcccagatgtccgccgagggcgtggagttccagaccggcgtcgaggtgggtgtcgacatcaccgccgacgacctgcgcgagcggtacgacgcggtgctgctcgccgcgggcgcgctggccggccgggacaccccggaaaccccgggccgccacctcaacggcgtgcacctggccatggaccacctggtcccggccaaccggatcgtcgccggcctgcaggacaccacgccgatcgacgccaagggcaagcacgtgatcatcatcggcggcggcgacaccggggcggactgcctcggcgtcgcgcaccgtcagggcgccgcctcggtcacccagctcgaccagtacccgctgcccccggagttccgcaccggcgtcaaggacccgtggcccacctggccggtcatcctgcgcaactacgcggcgcacgaggagggtggcgaccgggtcttcggcgtcgcggtccaggaattcgtcggcgacgcggacggcaacctggtcgcgatccggctggccgaggtgtcggtgcgccggatcgacggggtccgcacggtctccgtggtcccgggttcggagcgcgagctgcgcgccgacctggtgctgctggcgatcggcttcgagggcaccgaggaccagccgctgctggcccagttcgggctgacccgcaaccggcgcaacgtgctggacgcggacgccggctggcagaccggggccgagggggtcttcgtggccggcgacatgcacaagggcgcgtcgctgatcgtgtgggcgatcgccgagggccggtcggccgcgtcggcgatccacgactacctgggttcggcgggggaactgcccgcaccggtccgctccgaccagcagcccctgtcggtctga

SEQ ID NO: 1247 - DNA, 4530 bp, Actinoplanes utahensis
ttgtacgacccggcgttcgagcgtgacgcctgcggcgtggcctttgttgccgacattcacggccgtcgtagccatgacgtggttgccaaaggcctgtcggcgctcatccgcctggaccaccggggcgcgcgtggcgccgagcagaacaccggcgacggtgccgggatcatgattcaggtcccggacgagttctaccgcgcggtcaccgatttcgacctgcccgaggcgggcgcctacgcgaccggtctggcattcctgccgaccgatccggatgaggcggcccgggcgatcaaagtcttcgagaagtacgccctggtcgagggcggcgatctgctcggctggcgcgacgtcccggtgaaccccgccgatctgggcgccaccgccgaggacgcgcgcccggccatccgccaggtgttcctggccgcgcaccggctggtcgactcgccggccgggcgggccggcgagcgcctgaccggcatcgagctggaccgggtggcgttctgcatccgcaagcaggcggagcgggagagctcgcagcgcggcgtcgcggcgtacttcccgtcgctgtcctcgcggacgatcacgttcaagggcatgctcacgcccgagcagctgccggagttcttcccggacctgaccgacgagcgggtcaccagcgcgatcgccctggtgcactcccggttctcgacgaacacgttcccgtcctggccgctggcgcacccgtaccggctgatcgcgcacaacggcgagatcaacacgatccgcggcaacaagaactggatggccgcccgcgaggcgctgctgtccacgcctaacctgccgggcaacatcaagcggctgttcccgatcaactcgccggaggcgtccgactcggccagcttcgacgaggtgctggagctgctgcacctgggcggtcgcagcctgccgcacgcgatgctgatgatgatcccggaggcgtgggagaacgacccgggcatggacccggcgcggcgtgccttctaccgcttccacgcgagcctgatggagccgtgggacggtcccgccgcggtcgccttcaccgacggcaccgtgatcggcgcggtgctggaccgcaacggcctgcgcccgggccgctggtggcacacccgggacggcctggtcgtgctcggctccgaggccggggtgatcgacctggacccggccgacgtggtcgccaagggtcgcctgcagcccggcaagatgttcctggtcgacaccgcggccggacggatcgcgcacgacgacgagatcaaggccgagctggccgccgccgagccgtacgcggagtggctgcacgccgggctgatcgagctggccgacctgccgccgcgcgagcacgtgatctacacgcacgactcggtgctgcgccgccagcaggtgttcgggtactccgaggaggagctgaagatcctggtcggcccgatggcccgcagcggcgcggagccgctgggctcgatgggcacggacaccccgatctcgccgctgtccagccggccgcgcctgctgttcgactacttccaccagctgttcgcgcaggtcaccaacccgccgctggacgccatccgggaggagttggtcaccagcctgggcaccacgatcggcccggaggcgaacctgctcaagcccggtccggccagctgccgtcaggtggtgctgccgtacccggtgatcgacaacgacgagctggccaagctgctctccatcgacgaggacggcgacctgcccggcttcaaggcggtccgggtctccggcctgtacccgctgcgcgacggcgccgccgggatcaaggcccggctcacccagatctgccggcacgtctccgaggcgatcgaggacggcgtccggatcctggtgctctccgaccgggactccaacgccgacctggcgccgatcccgtcgctgctgctcaccgccgcggtgcaccagcacctggtgcgcgagcagacccgcacccaggtggccctggtggtggagtccggtgactgccgcgaggtgcaccacgcggcggtgctgatcggcttcggggcggccgcggtcaacccgtacctggccttcgagagcgtcgacgacctgatcgccaccggcgcgctggccggcatcgaggcgcgcaaggcggtccgcaactacgtcaaggcgctcggcaagggcgtcctgaagatcatgtcgaagatgggcatctccacggtgtcctcgtactgcggcgcacaggtgttcgaggccgtcggcctggacaacaagctgctccagcggtatttcgcgggcacctcgggccggatcggcggggtcggcctggccgagatccacgccgaggtcaaggcgcgccacgagaaggcgtacccggcgaacccggccgagcgggcgcaccgccgcctcgaggtcggcggcgagtaccagtggcgccgcgagggtgagatccacctgttcaacccggagaccgtcttcctgctgcagcacgccacccgcagcaagcagtacgacgtgttcaagcgctacaccagcaaggtcgacgagctggccggcgccgcgggttcgttgcgcgggctgttccggttcgacagcgaccgtacgccggttccgatcgacgaggtcgagccggccgccgagatcgtcaagcggttctccaccggcgcgatgagctacggctcgatctccgcggagtcgcacgagaccctggcgatcgcgatgaaccggctcggcgccaagtcgaacaccggcgagggcggcgaggacgtcgagcgcctgtacgacccggagcggcgctcggcgatcaagcagatcgcgtccggccgcttcggtgtgaccagcgaatacctcgtcaacgcggacgacctgcagatcaagatggcgcagggcgcgaagcccggcgagggcggccagctgcccggcaacaaggtgtggccgtggatcgccaagacccggcacgccaccccgggcgtcggcctgatctcgccgccgccgcaccacgacatctactcgatcgaggacctggcgcagctggtccacgacctgaagatggtcaacccggcctcccgggtgcacgtcaagctggtctccgagatcggcgtcggcacggtcgcggcgggggtcgccaagctcaaggccgacgtcatcctgatctccggccacgacggcggcaccggcgcgtccccgctgaactcgctcaagcacgccggcaccccgtgggagctgggcctggccgaggcgcagcagaccctgctgctgaacaagctgcgggaccgggtcaccgtgcaggtcgacggccagctcaagaccggccgggacgtggtggtcgcggccctgctcggagccgaggagttcggtttcgcgacggcgccgctgatcgtctcgggctgcatcatgatgcgggtctgccacctggacacctgtccggtcggcatcgcgacgcagaacccggtgctgcgcgagcggttcaccggcaagccggagttcgtcgagaacttcttcctcttcctcgccgaggaggtccgtgagctcctcgccgagctgggcttccgcagcatcgaggaggcgatcgggcacgccgagatcctcaacgtgaccgaggcgatcgaccactggaaggccaagggtctcgacctggcgccgatcctgtacgttcccgagctgcccgagaacgcggcccgccgcggcgtggtggcccaggaccacggcctggagaaggctctggacaacgagctgatcgcgctggcccagccggccctgatcaagggcaagccggtccgtgccgcgctgcgcacccgtaacgaccagcgcagtgtcggcgccatgctgggcggcgaggtgagccggcgctacggcggcaacggcctgcccgacgacaccatcgagttcaccctgcggggcaccggtggccagtcgttcggcgccttcctgccgcgcggtgtcaccctgcggctgatcggcgacagcaacgactacgtcgccaagggcctgtccggcggccgggtgatcgtccggccggccgaggacgcgccgttcacggcggaggacaacaccatcgccggaaacacgatcctgtacggagcgaccgcgggcgagctgttcctgcgcgggcgcgtcggcgaacggttcgccgtccgcaactccggcggcgccgcggtcgtcgagggcgtcggcgaccacggctgcgagtacatgaccggtggcacggtggtggtgctcggcccgatcgggcgcaacttcgcggccggcatgagcggtggcaaggcgttcgtgctcgacctgttccaggatctggtgaacccggagctggtcgacctcgcgccgctgaccgacgaggagcgcgacacgctgcgctcgttggtcgagaagcaccacgcggagaccgagtcggcggtggccgagcgtctgctcaaggactggccggccgcggtcgagcggttcaccgcggtggtgccgcgcgactacaagcgtgtgatggagctgatcaggaccgccgaagccgccggtcacaacgtggacgaggcggtcatgggggtcaccggtgcctga

SEQ ID NO: 1248 - DNA, 870 bp, Actinoplanes utahensis
atggcacgagcggaatccgaccacttcgaccggctcgaacagttctacgatgctttgccccggccgtgggcgcggaccgaggagatcggttccctggtgctcttcgtccgcgacggcgagggctggccctactatgcccggccccgccgcggcgcgcccaccccctccgcggccgacctcaccgcggcccgcgcccggcagcgggagctgggcgtcccggagtccttcgagtgggttcacgagaccacccccgacctgctcgcggtggcccggtcggccggcctggaggtgctgctcgcgccgctgctcagcctcgacccgcaggccctggtcccggacctgccggtgcccggcgcgacgatccggctgctggaccccgacgaccccgatctggccgcccggctggccgcctcgcgggccgtcgcgcggctcgccttcgccgcgccggcgtatcgcaccccggccgaggtcgccctggtcatcgacggtgcgggcggtaccgaacgggatgccgcggcgggcctgggggtcagcgaggagcaggtgcggcagacgcgcgagatgctggccggcggggattacgagatggcggtcgtcgagtcgccggccgagggcaccctggccaccgggatcagtcagcgggtgggcgacgtggcggagatcgccggggtggcgacgctgccggccgcgcgcgggcgcggctacgcgtcccagctcaccgcgacgctcgcccggaatctgctgggccgcggcgtcgagctggtcttcctctcggcgggcgacgacgacgtggcgcggctgtacacgcgggtgggtttccggcggatcgggacggcctgcatcgccgaaccggcggcggcgccgctgtga

SEQ ID NO: 1249 - DNA, 945 bp, Actinoplanes utahensis
gtgccgccccgccagcggaccggcgccggcggcccggccccggccgtggcgcacctggaggacctttacgacgcgctggtcgcgggcctcggcgacaccgagatccggaccggtttcgaggtgaccacggtccgcaccggcccgcgggaccgcccggcggtcggtgacggccgcaccctgatcgaagccgacctgctggtcgccgcggacggcatcgacagccggatccgcgccgcgctggcgccggagtcggtcgcggtcggttccggtttcgccgcctggcaggcggtcatcccgggataccgggtgccgcgactgatcggcggccgggcgctgggcggcgagacgctcggcgccggataccgtttcgtcagcatcccgctcggcgcgcacgccgccggcaagggcggcatctactgggtcgcgacggcggccggtgcggcccgcccggagccgccggccacccagctcgccctgctgcagcggtggttcgccggctggcacgagccggtcggtgagctgctgtcgctgacccggccggaggagctcgtcccgcagggtgtccgcgagctgcggccgctgccccgcacctacgcctttcccagtggtccgggcggcgtcctgctgatcggtgatgccgcgcacgccatgccgcaccacctgggtcagggcgcgtgcctcgccttcgaggacgcggcgaccctgcgcgcgctgctggccgacgccgcgccgggggaggcgctgctgcgggcgatggccggatacacccggctgcggcagccgcggaccacgaccgtggtgcggcagaaccgccggatgtccgcggtggtccaggctcgggggcggctggcgctgcgggcccgggacgccgccctgaaccacatgcgcccccgcatcctggggcgcaccctcgacccggtgtcggactggtcgccaccggactga

SEQ ID NO: 1250 - DNA, 207 bp, Actinoplanes utahensis
atgcggacggccgtggtggtgggcgcgggaccggccggtctggccacggccggcgcgctggcgcgcaccggctggcaggtcacgcttgtggagcgcgccgagcggatcgccgccccgcccaccgccgtggtcctctggcccaacggccgccgtgccctggactcgctcgacccggacggtgcctggtcggcctcggccgccccctag

SEQ ID NO: 1251 - DNA, 1197 bp, Actinoplanes utahensis
gtgaacttcgccctcatccccagtcccaccacgtcggtgtggcacctgggcccgttgccgatccgggcctacgcgctctgcatcatcgccggcatggtcgtcagcaccctgctcatggagcagcggctgcgtcaccggggtgtcgcgccctgggtgtcgctggacctggtggtgtgggcggtgccgttcggcatcatcggcgcccgcatctatcacctgattacctcgccgcaggactacttcggctccggtggtgacccggtccgcgccctgtacatctgggagggcggcctcggcatctggggtgcggtggccggcggcgcgctcggcgcgtggatcgcggctcgccagatcggcctgccgctgagcatcttcgccgactcgctcgccccggccctgccgatcgcgcaggccatcggtcggttcggcaactggttcaacaacgagttgtacggcaaggtcaccaccgcgccgtggggcctgcaggtgcacgagatggactcggccaacccggggcacgcctcgcaggtcgacggccagccgatcacgctgcccgacctctaccaccccaccttcctgtacgaggcgatctgggacctcggcgtcggcggcctggtgtggctgctggaccggagattcaagttcggtcggggccgggccttcgccctgtacgtgatggcatacaccgcgggccgctgctggatcgaggcgttgcgcaccgacgaggcgaaccacttcttcggcatccggctcaacgtcttcacctcgatcgtcgtcttcctcggcgcgctgatctacttcatcgtggtgcgtggcccgcgggcgtacgcggtgccgatcgacgccccggacaccgagccggtcgccgccgcccccgccgcttccgccgctgagggcggggtctccaccgtcgacgtcgacgccaccccggcggtgaagaaggcgccggtcgcctatcagatcgtcaccgaggaccgtttccgggcgtaccaggagaccggcgtgctccctccggagaccaccgccggtcatgacgactccgcgccgcaggcaacgccggtggtcgaccgcgccgacgagcccgcctcgtcggcggccccggcggctccggtggtcgatcgtgcggacaggtcgggcgagccggaggagcccgccgggccggtggaaacggccgaccgccccgccggcgaccgctga

SEQ ID NO: 1252 - DNA, 654 bp, Actinoplanes utahensis
atgggggacatcggctggttgctgcggagcctgccggtcatggcgggcgacctgccccgcttcgacccgggcgacaccccggacgacccgttccagctgttccggtgctggctcggggcggcggtggtcgccggggtgcgcgagccgcacaccatgttcctcagcaccgtcgatgagcaggcccggcccgacacccgggtggtgatgctgcgcgacctggacgcccggggctggcagttcgtggcgaaccggaccagcgccaagggccggcagctcaccgcgaacccggccgccgccctcggcttgcactggcacgagcagggccggcagatccgggtccgcggcaccgtggtcgacctcggcccggaggccgccgccgcggacttcctcggccgcccccaggggagccggctggccaccctgaacagcgcgcagagcgacgtgatcgccgacccggccgacgtgggcctggccgccgccgaagcggagcgactgctcgccgagcatccggatttcgtcccggccagtcacgtcctctatgccgtggccccggacagcgtcgaattctggcagggtgacgcatcccggcggcacgtccggctgcgctatcgccggacctccgacgggtggcaccgggaacagctctggccctga

SEQ ID NO: 1253 - DNA, 825 bp, Actinoplanes utahensis
gtgagcggcaccgtgcgcatcgccgagaccttcgccaaggcccggtcggaggaccgcgcggtgctggtcggctgcatgccggccggcttcccgacgatcgactacagcatcgagcagatgatcgcgatgcacgaggccggctgcgacgtgatcgaggtcgagctgccgtactcggacccggtgatggacggcccggtgatccagaaggccagtgacatcgcgctggccggcggggtccgtacccgggacacgctgaagatcatcgaggcggtggcctcggccggcgccacggtcgtgctgatgacgtactggaacccgatcgagaagtacggggtggacgcgttcgcccgcgacctcgccgcggccggggccaccgggttgatcacgcccgacctgatcccggacgaggcgggcgactggatcgccgcctccgaccggcaccggatcgaccgcaccttcctggtcgccccgtcctccaccgacgagcggatcgcgatgaccctgggcaactgccggggcttcgtgtacgcgaccgcgctgatgggcgtcaccggcgcccgcaagacggtctcctcgcaggcgcccgacctggtctcccggatccgggcgatcgacccggacctgccggtcggggtggggctgggcgtcggcaacggcgcgcaggccgccgaggtggccgccttcgccgacggggtgatcgtgggcagcgcgctgatccgctgcgtgctggaggcgcccgaccgcacggccgggctggaccgcctgcgggcgctcagcaccgagctggccgagggcgtgcgcggccgcttcgacgccgcgagctga

SEQ ID NO: 1254 - DNA, 1242 bp, Actinoplanes utahensis
atgaccgtcccgacgctgcccgacctggccggccacttcggccggtacggcggccggttcgtccccgaggcgctgatcaaggcgctggacgagctggaggcggcctaccgttcggccaaggtggacgaggccttccaggcgcagttcacggatctgctgctgaactacgcgggcaccccgtcgctgctctaccgggcgacgcggctgtccgagcggctcggcgccgacatctggctcaagcgcgaggacctgaaccacaccggcgcccacaaggtgcgcaacgtgctgggtcaggcgctgctcgccaagcggatgggcaagccgcgggtgatcgccgagaccggcgccggccagcacggtgtggccagcgcgaccgcggccgccctgctcgacctcgagtgtgtggtctacatgggggagaccgacaccgagcggcaggcgctcaacgtggcccggatgcggatgctgggcgccaccgtggtgccggtcaccaacggctcgcgcaccctgaaggacgcgctgaacgaggcgctgcgcgactgggtctccaccgtcgagaccacgcactacctgctcggcacggcggccggcccgcacccgttcccggagatcgtccgggacttcgtgggcgggatcggcgtcgaggcccggcagcagtgcctggaccagatcggccggctgccggacgcggtcgcggcgtgcgtcggcggcggctccaacgcgatcggcatcttccacgcgttcgtgccggattccgcggtgcggctgtacggcttcgaggccggcggcgacggcgtggagaccggccggcacgcggcgtcgatcaccggcgggtcggtcggcgtgctgcacggcaaccgcacctacctgctgcaggacgaggacgggcagaccgtcgagtcacactcgatctcggccggcctggactatccgggcgtcggcccggagcacgcctggctgcacgacaccggccgggccagctacgagccggtcaccgacgccgaggcgatggccgcgttccagctgctctgccgcaccgaggggatcatcccggcgatcgagagctcgcatgcgctggccggcgttgcgaagatcgccccgcggctgcgcgaggagctgggccgcaccccgaccatcgtggtcaacctgtccggccgcggtgacaaggacgtgcacaccgccggcgcgtacttcggcatcctcgacccggtcgagacggtcgtccccggggagaacacgtga

SEQ ID NO: 1255 - DNA, 858 bp, Actinoplanes utahensis
gtgacatccgatcaggcggaagcgggcagtggcggacccgtgcggccgcagaacgttctcgaggagatcctcgccggtgtgcgcgaggatgtggcggcacgccaggcgcggacaccgctggagcaggtgcgtgagctcgcggcggccgcgccgccggcgatcgacgcctacgcggcgctgcgcaagcccggcgtggcggtgatcgccgaggtgaagcgggcgtcgccgtccaagggcgcgctggccgacatccccgacccggccgagctggccggggagtacgcggccgggggcgcccggtgcatcagcgtgctcaccgagggccggtggttcggcggctcgctggacgacctggacgcggtgcgtgccgcggtcaagatcccggtgctccgcaaggacttcgtgatctccagctaccaggtgcacgaggcgcgggcgcacggcgccgacatggtgctgctgatcgtcgccgcgctggagcagaacgcgctggtcggcctgctggagcggatcgagtcgctggggatgaccgctctcgtcgaggtgcacaacgaggaggaggcggaccgcgccctggaggcgaacgcgaaggtgatcggcgtgaacgcccgtgacctgcgcaccctcgaggtggaccggtcggtcttcgagcggatcgcccccggccttccgcagaacgtcgtgaagatcgccgagtccggcgtccgcggcccgcacgacctgatccgctacgcgtcggccggcgccgacgcggtgctggtcggcgagggcctggtgacccagaagtcgccgcgggacgcggtggccgagctggtcaacgccggcaaccatccggcgaccccgaggccggtccgatga

SEQ ID NO: 1256 - DNA, 279 bp, Actinoplanes utahensis
atggccactgatcagaacggtttcgccgaggtttcgcgggccctcgtcgccatcgccgctgacgtcgtgaccggcgtgcagcgcgtggtggtgggtccggacaacatgcgcaccgcgcgggacaacgcgtggtcggccatcgaggccgaccgggcgcgggccgcggcccgcgccgagaccagccgggcggtcgccgccatgctggcctccggccggacccgacggacggtcgcggccacccgccaccgcacccggcaggtcgccgccacggtccgctga

SEQ ID NO: 1257 - DNA, 162 bp, Actinoplanes utahensis
gtggtcgcggcaggcggggtgctcgccgcccgccacggccacgagtgggccgcgatgtccgcccgatatgagcgcaagccgcaggtcagcgcggtctccgcgcccgacggcaaccgggcggtctgggacgcgctggaccgcggggacgatccgaccgcttaa

SEQ ID NO: 1258 - DNA, 1509 bp, Actinoplanes utahensis
gtgaccagcggagcgacccttccggacgaggcggcgttcgtccggatccaccgccgggtcgtgccggtcacccggaaactgctggccgacggggagacgccggtgggcgtctacaccaagctggccggcggcccgggcaccttcctgctggagtcggccgagcagggcctggcctggtcgcggtattcgttcatcggggtgcgcagcgccgccaccctggtcgagcgggacggccaggcggcctggctgggcacgccgccggacggggtgccgctggacggtgacccggtggccgcgctgcgggcgacggtggccgcgctgaccggcggcgccgttccggacgccggcctgcccccgctgaccggcgggatggtcggctatctcagctacgacctggtccgccgcttcgagcggctgccggccaccgcggccgacgacgtgccgctgcccgagctgggcatgatgctcgccaccgacctggtggtgctcgaccaccacgacggctcggcgctgctggtcgccaacgcggtgctggccgaggacgcgagcgaggcggaccggcgcgcggcgtaccaccacgcggtcggccggctggacgcgatgaccaccgcgctgtcccggcccaccccgccgatggtctccacggtggagcgccgcccgcccggcgagccggtcagccggaccgcgccgggcgactaccagaaagcggtggagcaggccaaggaggcgatccgggccggcgagtgcttccagatcgtggtggcccagcggttcgagcggccgaccgacgcgaacgcgctggacatctaccgggtgctgcgggcgaccaacccgagcccgtacatgtacctgctgcgcttcgacgacttcgacatcgtcggctcgtcgccggaggcgcacctcaaggtcagcgcgaaccggaccgcgctgctgcacccgatcgccggcacccgctggcgcggcgccaccccggagcaggacgccgcgctcgccgccgagctgctggccgacccgaaggagcgcgccgagcacgtgatgctggtcgacctgggccgcaacgacctgggccgggtctgcgagccgggcagcgtcgaggtgccggagttcgcccggatcgagcggtacagccacgtcatgcacatcgtctccacggtggtcggccggctgcgcgcggaccggaccgcgttcgacgcgctggccgcgacgttcccggccggcacgctgtccggcgcgcccaaggtgcgggccatggagatcatcgaggaactggagccgacacgtcgcgggctgtacggcggcacggtcggctacttcggcttcgccggggacatggacatggcgatcgccatccggaccgcgctggtcaaggacggggtggcgtacgtcggcgccggcgccggcatcgtcgccgactccgacccggtggccgaggagcaggagacccggaacaaggcggccgccgtgctggccgcgatcgccgccgcggagacccggcgcgccgcccgatga

SEQ ID NO: 1259 - DNA, 366 bp, Actinoplanes utahensis
gtgatcgtgtcagatgcagagacctcactagacgcgtcgatcgccgcccggctcaaacgcacccccgacggcctggtcgccgcgatcgtccaggagcacggcaccggcgaggtgctgatgctggcctggatggacgacgaggcgctgcatcggacgctgaccaccggccgggccacctactggtcgcgcagccgcggggagtactgggtgaagggcgccacctccgggcaccaccagcgggtccgccgggtggcgctggactgcgacggcgacgcgctgctgctgaccgtcgagcagaccggggcggcgtgccacaccggagcgcacaactgcttcttcgacgagctgcctcgggagggccagtga

SEQ ID NO: 1260 - DNA, 891 bp, Actinoplanes utahensis
atggagccgacgtccagccccgacaacccccggccggccccgggactcgcccgtttctggcaggtccggccccacccggacagcgccgcggagatcccggtggccgccccgacggagcaccgccggccggtcgacccgctggagctcgggctgcccaccgacctgctgaccggcgcatccatggcgttcagcgtgcgtggcgcgtccccgttcggcccggtcgccgcggccgacgggccacacggcgccaacggctccgccggggaaccgggcgatccgccggccggcgatccgttcggcctgaaccgggccgcgagccggggccccggcgccgcccggggtgaccacagcggccgcccgccggcccgttcccggcacggcgattctgatcactcgaccccttcggaccctgaaccggagggcacccaggacgtagagtcccaggagcccgcggccggttcacccgtccgggagacctctttcgggggattccggctcggcggcaccgggcgcttcctcttcggcggacggacccacgacgcgcaaccgggcgtcaacgggcacggccccgcggaggagtcatcggccgcggaggagactcccggcgacgctcaggtcgccgaagcaccggtcgacgaggagtccaccgggaccgctccggaggacgagccggcggacgacgctccgccggaggccgggcaggacaccgccgacgcggcggaacgcgacgagaacggacgtgagcacatgaacggacgggcaggagcccccgggtacgcccaggcccccgacatgccgggcccggcggaggcacccgcggcggacggcccgctcgacgacgccgccgagccgcacccggccgccggctgggcgtcggtcccggtgccctag

SEQ ID NO: 1261 - DNA, 129 bp, Actinoplanes utahensis
gtggtggccggcgagccgaacgcgaagctggtgtccggggcggccggcggctggtcgaccggggtgcggctggccgggatctgcggcgtggccggcgtcggcggagcggccggcggcctagctagctag

SEQ ID NO: 1262 - DNA, 792 bp, Actinoplanes utahensis
gtgtacggggtcgcctcggtcaccccggccggcccgtccgcgccgcagcccggctcggtcaccccgccgccgctggagttccagccgttcccggagtccggcctgagcggcatctcggtcggcaccggccgccgcggccgcaccgacgacgccccgcacggtgctccggacgggacgccgctcgacgggaccccgctcgacggtgccgccgacacgacccgcggcctggccgacgagacgctgcgtggcgcgtccggcaatgccggccgtgggctgatcgacgacgtctaccgcgtcccggcgcctgacgccccccgcggcctgaccgatgaggccctgcgcagcctcgccgacggcgagctgaaccgcggtctcaccgacggcgagccgggccccgccgcccgtcgctcggccagcctggaggacgccgagccggtccgccgcccgggtcggcgcgccgtgcccgacaccgacgacaccggcctggacggcgccgccggcgacgaggagagcgcggcggtcatccgccccacggtctgggacgaggacgccgcccgccacttccgcgccgcctggcacgaggtgaaagcggagttcgtcgacgacccggtcaacgccctgaccagggcacacgacctgctcaccgacgcggtcaacgagctgaccgaggtcctgctggccgaacgcgacgacctcgacccgctgcgcggcaccgacaccccggacaccgagagcatgcggatggcgatgcgcggttaccgggaattcctggagcgcatcctctccctgtaa

SEQ ID NO: 1263 - DNA, 843 bp, Actinoplanes utahensis
atgcccagcgcccgggacagcttcgctttgggtcgggagttgttcaacgcggttctcctgttacggttagccttgcctaacttaggtaagcctaaccggtgcccggaggtgctcgtcatgcaacccagtcccgccgagatcgcgcgaaccctcgccgccggtcacctgcccgccgtcgcccacatcgcctgccaccccgggccgctgccggtccggcacgtcaccgacgcgcaggggcggccgctgctcctggtgccggccggcagcgcgctggccgccgcgctgcggccgcagccgggcaacgacgacgccgcgctggtgctggacatccgggacgtgccgccgatggtgacctcgccggtgatcggacgggtctgggtgtccggctgggcggcccggctcgacggcgacgaggagcgggccgcggccctcgactacgccgacacggatgcctgcggggacctgctcgacgtgggcgggacacaggcgatctaccggctggacgtggccgaggtgcgcttcgagcgcggtgggcacctggtcgagatcgaccctgacgactacgccgcggcggcgcccgatccgttgcgcgccgtcgaattcgatctgatcgctgacctcgccgaccatcattccgccgagatgggcgattacgtacgacgtcagctgggccccgccgcgcatcccggcgacgagccgcgcgtggtgcggatggaccgctacgggttcgtggtccgtctgaacggccgcagcgcccggctggcgtttccccgcccggtcagcgaccggcaggacctcgcccacctcctgcaccccatcctctgccgccgctgcgccgcctga

SEQ ID NO: 1264 - DNA, 681 bp, Actinoplanes utahensis
atgacgagcacctccgggcaccggttaggcttacctaagttaggcaaggctaaccgtaacaggagaaccgcgttgaacaactcccgacccaaagcgaagctgtcccgggcgctgggcatcccgctgacccgcaagtgtgtgaagtacttcgagcggcgcccgttcccgccgggcgtgcacggccgcggccggcgcaagagctcggactaccaggtccggctgctggagaagcagcgcctgcggcaccagtacaacatcagcgaggtgcagatgcgggccgcgtacgacgccgcccaccgggccgggggcaagaccggcgagaacatggtcaccctgctggagcgccggctggatgccaccgtctaccgggccgggctggcccgcaccatctaccaggcccgccagctggtggtgcacggccacttcacggtcgacggcaggaaggtggaccggcccggctaccgcgtgcagcccggtcaggtgatcgaggtgcgcgagtccagccggcagaagccgccgtttcagatcgccgccaccggcgcgcacctcgacgggccgaccgcgccctacctgtccaccgccctggcggagctgcgcaccacggtggtgcgcgtcccgcagcgcaccgaggtgccggtcctctgcgacgaacagctggtcgtcgagtactacgcccgctaa

SEQ ID NO: 1265 - DNA, 1764 bp, Actinoplanes utahensis
atgagcgccgaggggacgctggccaccatccggcgcgggctggcgctctcgccggagctgcggaccgggctgggcggcacgatggtcctggcgttgctgcagatggccgggcgggtggccgtgccgatcgcggtgcagcagggcatcgaccacggggtgcgcgccccgggcggcccggacgtcggtgtcgtggtgcggatcgtcgggctgaccctgggcgcgctgctgatctcgacgctctgcggctatctgatgacccggcggctgttcacggtcagcgagaccgcgctgggcgggctgcggtcgcggaccttccggcacgtgcacgacctgtcgatgctgcaccagcagtccgagcggcgcggttcgatggtgtcccgggtgaccagcgacgtcgaccagatctcccagttcctgcagaccggcggggtgcagctgctgctggcggccgggcagcttctggtgtcggcggcggtgatgttcgcgtacagctggcagttggcccttgtggttctcctcgccttcgggccggccctgggggtgagccgcctgttccagcggcggctgcgcgcggtctatcaggcgtcccgcgagcgcaccggcgtgatgctgggcgcggtcgcggagagcgtcgtgggcgccacggtgatccgggcgtacggggtggccggccgcacccaggcccggctggacacctcgatcgactcgctccgggtggcccagcagaaagccctgcggaccagcgtgaccagcttctccagcggcgagatcggggccggtctggcgctggccggggtggtggtgaccggggtctggctcggcgtggacgggaagctcacggtcgggcagctgaccgcgttcctgttcctggtcacgctcttcatccagcccgtgcagatcgccaccgacatgctgaacgaggcgcagaacgcggtggccggctggcgccgcatcctggacgtgctggacgtcgagccggacgtcgccgacccggacgaccgcggtgtcgaactgcccgccgggccgctgtcggtgcgcttcgccgacgtgtcgttccgctatccgggcggtccgatcgtgctcgccggcgtcgacctggatctgccggcccggcgcaagtatgcggtggtgggcgagaccggcagcggcaagaccacgttcgccaagctgctgacccggctgatggatccggcgcaggggcgggtgctgctctccggtacgccgctgacctcggtgcggttctcgtcgctgcggtcgcgggtggtgatggtgccgcaggacgggttcctgttcgacgcgacgatcgcggagaacatccggttcgccgagccgtcgctgaccgacgggcagctcaccgcggccttcgccgagctcgggctcggcgactggttggccgggctgccggccggcctgcaaaccccggtgggggagcgcggagaggcgctcagcgtcggcgagcggcagctggtggcgctggtccgggcgtacgtggcggaccccgacctgctcgtcctggacgaggcgaccagtgcggtcgatccggccaccgaggtgcgcctgcagcacgcgctggacctggtcacccgcgggcggacgacggtggccatcgcgcaccggctgtccaccgcccaggccgccgacgaggtgatcgtggtggacgcgggccgcgtcgtgcaacgcggcccgcatgcccggctcgtggccgaggagggctcgacctacgcgaagctctatgccagctggttggaacagacccgcagttag

SEQ ID NO: 1266 - DNA, 1830 bp, Actinoplanes utahensis
atgggatcggtaaggccggaaaccccggccaatgcttaccagtcaggtaggaaattgaccagcagcgccagccgtgacgtgctgggacggggtctgcgggtgctcggccacgcgatccgcacggagcctcggctcttcaccgtcggcacgatcggcagcagcctcttcgggctgctcatcatcgccaactcatacgtggtcggctgggtgatcggccatgtcgtcgtgcccgccttcgccgagcaccgggccaccgctagccggctcggcctggtcgccgcgatcttcctgggtgtcagcgcgctgcgggtggccagcatcttcggccgccggctcggcgccgggtacatgcagttccggctgcaggcgcggtaccgggccgcggtcacccggcgctacctgtcgctgccgccggcctggcaccagcggcacgccaccggcaccctgctgtccaatgcgaactccgacgtggaggccgcctgggcgccgatcgcgccgctgccgttcgcggtcggcaccgtggtgatgctggccggcgcgctggtctcgctgttcctcaccgactgggtgctggccctggtcggagccaccctgttccccgcgctgttcgggctcaacctggtctactcccggcggatgtcgccgcggcagatccgggtccagcagaaccgggccacggtcagcgcggtcgcgcacgagagcttcgacggcgccctggtggtcaagacgatgggccgggaggccgacgagtcccgccggttcggggtgttcgtcgacgagctgcgcgactcgctgatcgcggtcggccggctccgcggcctgttcgacccgctgatggacagcctgcccagcctgggcacgctggccgtgctgctgctcggcacctggcggctgcggtccggcgcgatcggggtcgccgacctggtcagtgtcgcgttcctgttcaccgtgctggccttcccggtgcgcgcgatcggctgggtggtgggcgagctgccgcgcagcgtggccggttgggaccgggtccaggcggtcctcggcgcggagggcgacctggcgtacggcgagggcacgctgcccggcaccggccccgccgagctgcgcttcgaccgggtctcctaccggtacgcggacggccccgaggtgttgcacgacgtgagtttcaccgtcccggccggccggaccgtggcgctggtcggcgcgaccggctcgggcaagtcgacgatcgcctcgctcgccgtccggctggtcgacccggagtccggcacggtcgccgtggacggcgtgaaacttcccgacctggcgctgtccgcgctggccgggtccaccgcgctggtcccgcagatcccgttcgtcttcgacgacacggtgcgcggcaacatcgccctggaccggccggaggtggacgacacgcgggtccggacggcgctggaactggcccaggccgcccggttcgtcgacgggctgccggccgggctggacaccccggtcggcgagcgcggcacgtcgctctccggcgggcagcggcagcggctcaccctggcccgggcactggccggcaagccgcggctgctggtgctcgacgacgcgaccagcgcggtcgacccgcgggtggaggcggccgtgctcggcgcgctgcgcggggcggacgccggcgcgtcgatcctggtggtggcatatcggcgggccaccatcgcgctcgccgacgaggtggtctacctgaaccgcgggcgggtggtggcgaccgggacgcacaccgggctgatggcggcgcacgagggctatcgcgagctggtcaccgcatacgagaaggccgaggagcggcgatga

SEQ ID NO: 1267 - DNA, 1794 bp, Actinoplanes utahensis
gtgggagccgcgaccgctgcccgccgggcaccaggccgcgctctggcgcagcgtccgactcaccgcccgggtcgccctgcgccgggccggggtgcaggccgaggtgatcgccgacgggttcccgccggtgcgcaccgggccggccccgcaggtccggatcaccggggacgccggcgagctcgccctgttcttctccgggcggcagcgggtcgcgacggtgcggatcgacggcgacccggcgaccgccgaacggttgcggggcgccaggctcggcttctgaattggcccacccggaacggcccggattggctttcccgccgaggccaatccggctctagattcaaggtcatgaccgcccgactctcggtgtcccagggtgccgccctctccatcggcgccgtcctgggcaccggcctgatctcgctgcccgccctggccgccgcggccgccggccccgccgcgctggtcgcctggctcgccctgatcgtcctctccgcgccactggcctggaccttcgccgcgctcggcgcgcgctatccggacggcggcggggtcgccacgtacgccggcatggccttcggccgccgggcgtccgccgcggtgggctggtgcttctacttcgccgttccgctcggcgccccggtcgccgcggccttcaccggcgggtacgtggcgggcgccgtcggcggcggccggaccaccgaattcgtcaccttcctcggggtggtcaccgcgggctacgcgatgaactggttcggcctgcgcgtctccggccgggtccagctggtgctcaccggcaccctggccaccctgctggtggtgaccgtgctggccgcgctcccccacctcgacctcggcaacctgcacccgttcgccccgcacggcctcgccgggatcggctcggccaccgccctgctggtctggggcttcgccggctgggaagcactgtcctcgctgtccgcggaataccggaacccgcgccgcgacgtgccccgggccaccatgctcgcggtcgccgtggtcggcgtgctctacctggcggtggccgcggtcagcgtgctggccctcggtcccgccctggccggcagccgcgcgccgctggccgacctgctggcgatcgggctgggcgggccggtgcgggcgatcaccgcggtggtgtcggtggtgctcaccctcggggcggtgaacgcgtactacgccgggtcgagccggttgggggtggcactggccgcggacggcgccttgccggcccgggtcttcgggggccggcgccgctcgctgaccttcatctacgtggcgagcatcctgtgcgcgctgctgccgctcggactgcgaacctcggcgctgctggtcaccggatgcttcaccctggtgtacgtgttcggcacggccgccgcggtacgcctgctgccgcggggctggtcgcgggcggtggccggggtggcgttcgtggcggtgtgcggactgttctggctgaacgggtggccggcgctgctcagcctggtgttcgcggcgggcgcgctgatctaccgcttcgccgtcgaccgggcggccggccgggccggcaccgtacggtccggcgccggtgccgccgcctcccgtacggacgcgggcgccgggtccgccatcggcgcggcgcctgacacccacccggcgtcgggcgctcgcgcggggtcagagcagttcggccagaagtgccaggccctcgtcgatgagcgcggggtcgacggcgccgaagccgaggacgaggcccggccggtcgccgccgtaccggctcaggtcgtcgaccgctag

SEQ ID NO: 1268 - DNA, 1644 bp, Actinoplanes utahensis
gtgcggtgggcgcgggctcgttcatctccggggacgaactggagctcagagcagcgagaccgcgggaccggtgagcagggccacccccacgccgctcagcaggctgaccgcggccacggccaggaccatcagggcgctcgtccggaacagtccacgacggatcctcatgccacatccccctcgggtggtcgtcttcgacttccgggcttgagcgtaagcgcccggttactaccgacgggtataccggattgtctataccgttcaggcgtggatctggtcatcgacggacggacgaccgcggccgtctaccgggcgttgcgggcggcgatcgcggacgggcggctgcccgccgggcaccggctgccggccagccgggcgctcgccgccgacctcggggtgtcccggggcagcgtcgccggggcgtatgaacggctcgccgccgaggggcacctgaccgcccgggtcggggccggcacgttcgtggcggtggcccggacgccccggccggcgccccgcgcggtgccggacccgttgcgaccgcgcgccggatgggccttcgcgccggtgctgaccagcggctcggtgccggcgccgaaatacgacttccggatcggcatcccggacgcgtcgctgttcccgttcgacacctggcggcggatggtcgccgccgagctgcggctgcgggcgaacgggccgggcacctacgccgacccgtacggtcatcccgccctgcgcgccgcgatcgcccgctacctcgggtacgcccggtcgatccgggtcaccgaggatgaggtgctggtcaccaacggggtgcagcacgcgctggacctgatcgggcgggtgctgctgcggcccggggacacggtcgcggtggaggagccgggatatccgccggcccgggcgctgttcgcctcgctcggcgcgcgggtggtgggcgtgccggtggacgatgccgggctggtcgtcgaccggctgccggcgcacgcgcggatcgtctacgtgacgccgtcgcaccagtttccgctcggggcggttctcagcctggatcgacggcggcagctgctggactgggcgcggcggcggcagagcgcgatcgtcgaggacgactacgacagtgagttccggttcgggagccgtccgctcgaacccctgcgggccctcgaccggtgcgggcgggtgctctacgtgggcaccttctccaaaaccatgctgcccaccatccgtacggggttcgtgctgaccccgccgggactgcgggatgcgctggccgccgcccggcagctcggggacgggcacgggcaggtggcgatgcaggcggcgctggcccggttcatcgacgaggggcagctggcccggcacgtgcggcgggcccgccgggagtacgcggcacgccacgcccggatcgccgggcttctgagcgatatttcgggatgtgaagtgctgccgtcggccgcggggctgcacgtcaccgtgctgatgccccgcgaccagcccgacatttccgaaatcgcgggcaagagagggctagcggtcgacgacctgagccggtacggcggcgaccggccgggcctcgtcctcggcttcggcgccgtcgaccccgcgctcatcgacgagggcctggcacttctggccgaactgctctga

SEQ ID NO: 1269 - DNA, 1917 bp, Actinoplanes utahensis
ttgccggggtgctctagccctgccaccgccatcgcattactctgcggtaacaacgatgttaacgtcccccggttcagtcttaggcggcgcttgatggctctcgaggttccctaccggtcgatcccggacatgcttttccagcgcgtggccaagacgccggacgcgcaggcgttcgccgggccgaacgcgaccgacaccgggatggactggctgacctggcgccaggtgggtgagcggaccagggccatcgcggccggtctgcgcgagctcggcgtcgggctggaggaccgggtcgcgatcctgtccagcacccgcctcgagtggatcctggccgacctcgggatcaacgtggccggcgcggccgccaccacggtctacccgaccaccgagccggaggacaccgcgttcatcgtgtccgactccggttccaaggtgctgatcgcggagaacccgaagcaggcgctgaagatctccggcgcgccgaccgcgatcaccaaggtggtgctgatcgacggcccggccgacgccggcgccaccccgccgcagatcaccctggccgagctggaggagttgggcgcggccgcgctgcgccgcgacccggagctgatcgagcgggtgatcgccgagctcactccggagcacatcgccacgctgatctacacctccggcaccaccggtcggcccaagggcgtcgagctgctgcaccgcggctggacctgggagggtgtcgcacagaacgacctgggcctgttcaacccggacgacctgcactacctgtggctgccgatgtcgcacgcgttcggcaagacgctgctctgcggcatcctgcacgtgggcgtgccgacctacgtcgacggccgggtcgacaagctggtcgacaagctcgcgctgatccgccccacgctgatgtgcgccgccccgcgcatcttcgagaaggtctacaacaagacggtgaccagcggcctggccggcggcggcctgaaagccaagatcttcacctgggcggtggccaccggcaagcgcaaggtcgcgctggagcaggccggcaagccggtcggcgcggtcctctccgcgcagtacgcggtggccgagaaactggtcttcgccaagctccaggagcggctcggcggccggctgcgggtgctggtcagcggctcggccgcactgtcccgggacatcgccgagttcttcgccgcggccaacctgccgatcctggagggctacgggatgaccgaggcctccgcggcgaacttcgtcaaccgcaacggccgcctcaagatcggcacggtgggtgaggcgatcggcgacctggagatccgcatcgacaccgacggcgaggtgctgatgcgcggcgccccggtgatgcgcggttaccacaacctgcccgaggcgacgaaggaggcgttcaccgacgacggcttcctgcgcaccggtgacatcggcgagctcgacgccgacggcttcctgaagatcaccgaccgcaagaaggacctggtcaagacgtccggcggcaagttcatcgcccccagcgccatcgagggcgcgttcaaggcggtctgcccgtacacgtcgcaggcgatcgtcgtcggccagtcccgcaacttcgtcaccatgctgatcaccctggacgaggacgcgatcgccgtctgggccgccgacggcccgctcgccggcaagacgtacgccgagatcgtcgccgcccccgaaacccacaagctggtcgagggctacctggccgagctcaacggcaaactcaaccgctgggagacggtgaagaagttcgccatcctcccccgtgacctgagcatcgaggccggcgagatcacgccgtccatgaagatcaaacgccgcagcgtggagaccaacttcgccgaccagatcgagaagatgtacgagggctcgctcgcccagatctga

SEQ ID NO: 1270 - DNA, 708 bp, Actinoplanes utahensis
atgagcctggttcgtcgcgtcacaccatccgccctctccacgaacctggttcgccgcgtgccgcagctgctgctcggtctgttcctctacggcgccagcatggccctgatgatccggtccgggctcggcctcaacccctgggacgtcttccaccagggcctctccgagcggaccgggatcgagttcggctggatcgtgctgctcgtcggcatcccggtgctgctgctctggatcccgttgcggcagcgccccggtgtcggcacgatcgcgaacgtgctgctcgtcggcttctccgcggacgccgtgctcgccgtgctgccgcccgggtccggccttccggcccggatcggcctactggtcgccggcatcgtgctcaacggcgtcgcgaccgggctctacatcggcagccggatgggcccgggcccgcgcgacggcctgatgaccggactggcccgccgcttcccccggctgtcgctgcgggtgatccgcacgtcgatcgagctgctggtcctcggcgccggcttcctgctgggcggcacggtgggggtcggcacggtggcgtatgcgctggccatcgggccgctggtccacctgttcctgccgaagctcacggtcggtgaacgccgacggacgacatcggccgctcgcccgccggccgcctcggaagccggacgctcccccgagcagcacaccccggtggaggcctga

SEQ ID NO: 1271 - DNA, 1455 bp, Actinoplanes utahensis
atgacaacgtcggttcgaggggaccaattggcccggctactcggccggtggcattcactgccgggccggcatcgcagccccgactacgccgccctggccgccgccgtgcgcgggctgctcgccgacgggcggctggcgctcggtgtccgactgccggccgaacgggaactggccgagtcgctcggggtcagccgcaccacggtgtccgcggcataccgcgcgctgcgcgagagcggccacctgaccagccggcgcggtgccggcagctggaccaccctgccgcacgggcaccgggtggccacctccggcctgtggaccccggacgacgacctcgacatgatcgacatgggggtggccgcgtcggccgccccggtcgagctggtcccggccgcccgggccgccgccgacgacctgccccgctatctgggcagcgccggctaccacccgaccggcctgcccgagctgcgcgccgcggtcgccgacatctacaccgcgcgcggcgtgcccacctcggccgagcaggtcctcgtcaccagcggcacgcagcaggccctcgacctggtgctgcggctgtccgttccggccggcgcgccggtgctggtggagacgcccacctatccgaacgcgctggccgccctctccgcccgccgcgcccggatcagcacccacggcatggacaccgccaccggctgggacggcgagatgctcctcggcgcgctgcgccagacccggccgcggctcgcctacctgatcccggaattccacaacccgaccggccacctgatgcccgccgagctgcgcgagcgcctggtcgccacggcccactcgaccggcaccgagctggtcgccgacgaatccttcgtcgacctgccgctggacgacccggcgatgccgccaccggtcgcggtcttcgaccggcactcccgggtgatgtcgatcggcggaatgagcaagccctactggggcggcctgcggatcggctgggtccgcgcctccgccccgatggtccagcggctggccgcgatccgggtcggcgtcgacatggccagcccggtcctcgaacaactcgtcgccgtccacctgttgcgactcgctccggaaatcgtcgcggcccgccgggcccagctgcgcttccgccgcgacgccctggtcacggcgctccgcgaacagctgccggagtggcggttcttcgtccccggcggcggcgtcaccctctgggtggagatggacgggccgatctccagcgccctgtcccgggccgccgaggacgtcggcgtgcgcctggcgcccggcccgcgcttcggactggacggcacgctggaacgcttcctgcggctgccgttcaccctgccggccgacgacctgacggaagcggtccgccggatcgcctcggtccgccacgacctcgaccgcaccccacgacccacctggcgcaccccggccgtcatcgcctga

SEQ ID NO: 1272 - DNA, 342 bp, Actinoplanes utahensis
atgcctattcgaacgatcaccgtcccggtcaaggacctggacgcggccagggctctgtacacccggctgctcggcgtcgaaccctacgccgacgcgccgtactacgtcggattccgtcccgacggtggccccgagctgggactcgacccgcacggtgacgtcgccgccgggccgatcgtctactggcacgtcgacgacatcaacgccgaactcaccgcgctgatcgcgggcggcggcaccgaggaacgcccggtccacgacgtcggcggcggcacgctgatcgccacgttccgcgacgccgacggcaacctcttcggcctgcaccagggcgccgcttcctga

SEQ ID NO: 1273 - DNA, 456 bp, Actinoplanes utahensis
atgccggcggcacggcatcattgcggcatgggggccggcggctggaattggaacgacgcgtggatcttcgtctccgcggtcatcgctgagcgtctggagcgtgaccgcgcgctgcacgccgccctgccggtgaccggcgccacgctcgccgacctgatcgccgcggccgacttcctgcaccacagcgtgccggcccgcgccgagctggaggagtcggtgcgccggctggccggcgccggcctgatcacggtggccgacgacatcgtccaggtcgccccggccggcgagcagctctggcgcacccgcccgttcagcggcctctcctcagcggtgatgaccttgcagacccagctgaaccgcgccgcctcccccggacggagcgagtggaccctggaggagtccacctacaacgccgccgtccgcgagtacagcctccgcctcgccgacggccgctga

SEQ ID NO: 1274 - DNA, 762 bp, Actinoplanes utahensis
atgacggtcgcggtgcgtgtgatcccctgcctggacgtggatgccggacgggtggtgaaaggggtcaacttcgtcgacctccgggacgccggcgaccccgtcgaactcgccgccgcctacgacgcggcgggggccgacgagctcacctttctcgacgtcaccgcgtcgtccgacgaccgtgggacgatgctcgacgtggtacggcgtaccgccgaatccgtcttcatcccgctgaccgtgggcggcggtgtgcggtcggtggcgaacgtggacgtgctgctgcgcgccggcgccgacaaggtcggggtgaacaccgcggcgatcaaccggcccgagctgatcagcgagatcgcggagcggttcggcaaccaggtgctggtgctgtccctcgacgtgcgccgggccgcgggtcagccgtccgggtgggaggtcaccacccacggcgggcgccgcagcgccggcctcgacgcggtcgagtgggcggcccgggtggccgaactcggcgccggcgagatcctgctcaactcgatggacgccgacggcaccaaagccggcttcgacctggagctgatccgggcggtgcgggccgtggtggacattccggtgatcgccagcgggggagccggggcggtggagcacttcccgccggcggtggcggcgggggcggacgcggtgctggcggccagcgtcttccacttcggtgacctgacgatcggcgaggtcaagacgtcgctccgggatgcgggcaacgcggtgcgctga

SEQ ID NO: 1275 - DNA, 726 bp, Actinoplanes utahensis
gtgacgcttcaactgctgcccgccgtcgatgtcgccgacggccaggcggtccgcctggtccagggcgccgccggctcggagaccgcctacggcgatccgctggaggccgccctggcctggcagaacgacggcgccgagtggatccacctggtcgatctggacgccgccttcggtcgcggctcgaacgccgacctgctcgccggcgtcgtcgcccggctcgacgtcaaagtggagctctccggcggcatccgtgacgacgaatcgctgacccgcgccctggccaccggcgcccagcgggtcaacatcggcaccgccgcgctggaggacccggagtggtgcgaccgcatctgcggcgaatacggcgaccgggtcgcgatcggcctcgacgtgcgcggccggaccctgtccgcccgcggctggacccgcgacggcggcgacctctacgaggtcctcacccgcctcgacaaggccggcgccgcgcgatacgtggtcaccgacatcaccaaggacggcaccatgcgtggtccgaacctcgacctgctccgcgaggtctgcgccgccaccgacaagccggtcatcgcgagcggcggtgtctccaccctggacgacctgcgcgccctggcgaccctggagccgatcggggtggagggcgtgatcgcgggcaagtcgctgtacgccggcgccttcaccgtgcgcgaggcgctggacgtgctcgcccgggcctga

SEQ ID NO: 1276 - DNA, 321 bp, Actinoplanes utahensis
atgagcaaggaacgcgcgcgacgccgagccgaacggctcgtcgtcctcgaacgcgagaaggccgcccgggctcggaaggtggcccggcggcagcgtcgccgcgctctgctcaaccggctccggctgccgagactcggcagcgacggccgtctctaccatcgcagtcggcggcagcggatcggcatcgtgctggtcccgctgatcgccatcgccgcggtctggatcctcatccccgacccggcgctgcgcatcctgctcaccgttctgatcgtcctcgccgcgccggccatggtcgtcgtggcgctgggccgccgttcctag

SEQ ID NO: 1277 - DNA, 621 bp, Actinoplanes utahensis
atggcggcccgggtggtgatcctcgactacggatcgggaaacctgcgcagcgccgagcgggccgtcgcccgcaccggtgccgacgtgacggtgaccagtgacctgacgctggccgccgaggccgacgggctggtcgtgcccggcgtcggcgcctacgccgcgtgcatggccggcatcgacgacctgggcgccggcccggtgatcgccggacgcatcgcgcagggccggccggtgctgggcatctgcgtcggcatgcagatcatgttcgagtccggggtggagcacggggtgcagaccaagggcctcgggctgctgcccggctcggtcacccggctgcacgccgcgcggatcccgcacatggggtggaacacggtcaccgtgccggccgggtcgcggctgctggccgggctggccgcggacacccggttctacttcgtgcactcgtacgcggcccaggacctcggcgcgctcggcgacgccgcggtgaccaccgcggcacacgacgagccgttcgcggcggtggtcgagcggggtgcgctcagcgtcgcccagttccacccggagaaatcggctgacgccggcttcgcgctgctgagcaactgggtcaccgcgctccgatga

SEQ ID NO: 1278 - DNA, 612 bp, Actinoplanes utahensis
gtgacccgcaccggacggatcgaccgcgtcaccaacgagaccaaggtgctcgtcgagatcgacctcgacggcaccggcaagggtgacctgagcaccggcgtcggcttctacgaccacatgctcaaccagctcgccaagcacggcggattcgacctgctggtgcgcaccgagggcgacctggagatcgacgcgcaccacaccatggaggacaccgcgatcgcgctgggcgaggccttcgcgcaggcgctcggcgacaagcggggcatccggcggtacggatcggccaccatcccgatggacgaggtgctcgtccgcgcggccgtcgacctgtccggccggccctacgtggtgcacgacgagccgctgctcacgccgtacatcgggccggtctacgcgaccagcatgacccgacacatcttcgaggcgttcgggcacgcggccaaggtcaccctgcatgtcgacgtgctgcgcgcctgccggccgggcggccaccccgacgcgcatcacgtggtcgaggcccagttcaaggcgttctcccgggcgctgcgcgaggccgtcgagatcgacccgcgcaacgccggctcgctgccgtccaccaagggcgtgctctga

SEQ ID NO: 1279 - DNA, 1080 bp, Actinoplanes utahensis
gtgaccaccatcgacgatctgccgatccgcgacgacctgcggggcaagtcgccctacggcgcgccccagctcgacgtcccggtccggctgaacaccaacgagaactcgtacccggtgcccgccgatgtggccgaggcgatcgccaaggccgtccaggccgagctgcacgacctcaaccgctatccggaccgcgacgtgatcgccctgcgcaccgagctcgcggcctacctcggccacgggctcaccatggccaacgtgtgggccgccaacggctccaacgaggtccagcagcagatcctgcaggcgttcggcggcccggggcgcaccgcgctcggcttcggcccgtcctactcgatgcacccgctgctcgcgcaggggaccggcaccgggtggatcggcgcgctgcgcgaccccgacttcggcctcgacccggagcgggccgtcgccgagatccggcggcacgaccccgacctggtcttcgtctgctcaccgaacaatccgaccgggaccacgctggacccggccgtgctcgaggcgatcctcggcgtggcccgcggcatggtggtcgtcgacgaggcgtacaccgaattcgcgcgccccggcaccccgagcgcgctcaccctgctgcccgggcacccgcgtctggtgatcagccgcaccatgagcaaggcgttcggcttcgccggcggccgcctcggctacctggccgccgacccggcggtgatcgacgcggtgcagctggtccgccttccgtaccatctctccgcgatcagccaggccgccgcccgcgccgccgtggtgcaccgcgcgtcgctgctggccaccgtcgaggcgatcaaggagcagcgcgaccggatcgtggccacgctgcggtcccggggcgtccgggtcgccgacagcgacgccaacttcgtgctgttcgccaccggcgaccaggaccagagagccgcctggcagcggttcctcgaccgcggggtgctgatccgcgacgtgggcctgcccggctggctgcgggtcaccgccggcaccgagaccgagaccaccgccttcctgaacgccgctgaggagatcttgtcgtga

SEQ ID NO: 1280 - DNA, 1311 bp, Actinoplanes utahensis
gtgctgaatcggatcgacctgcgcggctcccgcccggacccgcgcggtctgctgccccgtgcccagctcgacgtctccgtggccgtcgagaggattcgtcccgtcgtcgaggcggtccatcagcatgggttcagtgcgatccgcgaggcgaccgagcggttcgacggggtcaccctggagcgcctgcgggtgcccgccgaggcgatcaccgcggccgccgacaccctcgaccccgccgtgcgcgccgccctgctggaggcgatcaggcgggcccggaaggtgcacgccgaccagcgccgcaccgacaccaccaccaaggtggtcgacggcggcacggtcaccgagcgctgggtcccggtccgccgggtcgggctctacgtccccggcggtctcgcggtctacccgtccaccgtggtcatgaacgtggtgcccgcccaggaggccggcgtcgagggtctggtggtggccagcccgccgcaggcggacaacggcggcctgcccgactcccgggtgctcgccgcctgcgccctgctcggcgtcaccgaggtctacgcggtcggcggcgcccaggcgatcgccatgctgggctacggggcggacggggtggacgcgggtgaccgctgcgagccggtcgacgtgatcaccgggccgggcaacatctgggtcaccgcggccaagcggctgctgcgcggcacggtcggcatcgacgccgaggccggccccaccgagatcgccatcctggccgacgagaccgccgacccgcggcacgtggcggccgacctgatcagccaggccgagcacgacccgctggcggccagcgtgctggtcaccgactcgacggcgctcgccgacgcggtcgacgccgagctcgccgcccgggtccccgcgaccaagcacgccgagcgggtgcggatcgcgctcaccggcgagcagtccggcgtggtgctggtcgacgacctggagcagggcctggccgtcgtggacgcctacgcggccgagcacctggagatccagacccgggacgcgcgggagtgggccctgcgggtccgcaacgccggcgcgatcttcgtgggcgcctggtccccggtgtcgctcggcgactacgccgccggttccaaccacgtgctgccgaccgggggctgcgcccggcactcgtccgggttgtcggtgcagtcgttcctgcgcggcatccacgtcgtcgaatacgaccaggccgccctgcgcgacgtcgccggccacgtggtggcgctggccaacgcggaggacctgccggcccacggcgaagcggtcaccgcgaggttcggccggtga

SEQ ID NO: 1281 - DNA, 708 bp, Actinoplanes utahensis
gtgagcgatcggctgccggtcttcccgctgagcacggtgctcttccccggtctggtcctgcccctgcacatcttcgaggagcgttatcgcgctctggtgcgggagctgtcggcccgcccggccgagccgccggctgagttcggcgtggtcaccctgcggcacggcagcgaggtggcggaggggttcggcgacggcccggtgcccgatccggccccggtcggcgccggtgatctcttcgaggtgggctgcaccgccgagctgcggcacgtgagcgagctgccggacggccggttcgacatcatgacggtcggtcgccgccggttccgggtgctcgccgtcgagcagggcaccgagccctatctgtgcgcccgggtcgagtggctgcccgcggaggacatccccgacccggccgccgacctgctgcggccccgggtgctggcggccttccagcgttatctgacgctgctgcggccgagcgccgacatcctggaccagatgccggaggacgcgaccgtgctgtcccacctggtcgcggcgaccgcccagctcaccgtcgaggagcggcacgcgctgctggccgccacggacaccgtcgcccggctgcgcgccgagctgcggctgctcaaccgcgaggctggtctgctggcccgggtgcgggcggtgccggtgccgctgtcggatctggcgcgcccggcgagtccgaactga

SEQ ID NO: 1282 - DNA, 750 bp, Actinoplanes utahensis
gtgcagccagaggactccgtgatcgtcgaccagccacccgcgggaccgtcctggtggcgtccgcagcgcggcggcagccaccgttcgctgcgccgcacgctcgccaccggcctgggcagtgccgccgtgatcgccgcgctcggcgccccggtcgggctgctctggcacacgctggcgccacgcgtggaggtggtcgacgccggctcctccggtttcctggtcaccgacccggccgagcagttcatcgccgccgatggctggctgaccctgctcggcctcggcttcggcctgctggtggcggtgctcgcctggctggtgctgcgccgcgatcgggggccggcactgctgctgggcgtcgtcgccggcgccgccgccgggatccgctgggtggcggtcccgctcggtcagatgatcggccgagccgactacacccactggaaggcgaccgccgcgaaaggcgacacctacctggccccgccgcagatccacgcgcacggcccgacgctggtcgcggcgttcgtcgcggcgatcgtgctgaccctgctggccggctggtccaacgacccggacctggacagtccgggtgcacagcccggttacggccccaaccacgggcagtacgaggcggagccgcccggctcggcgccgttcagggcgcaacagctcagttcggactcgccgggcgcgccagatccgacagcggcaccggcaccgcccgcacccgggccagcagaccagcctcgcggttga

SEQ ID NO: 1283 - DNA, 3531 bp, Actinoplanes utahensis
gtgtcagactccttcgtgcacctgcacgttcacacagagtattcaatgctcgacggagcggcccgggtcaaggaactcatcagtgaggcgaaacggctcggcatgccggccgccgcgatcaccgaccacggcaacatgcacggcgcctacgagatgtacacgcagtccaaggcggccgggatcaccccgctgatcggcgtcgaggcctatgtcgccccggattcgcggctgaacaagagccggatcaagtggggccgcccggagcagaaatcggacgacatctccggtaacggtgcgtatacccacatgacgatgtgggcacgcaacgcggtcgggctgaagaacctgttccggctgaactcgcgggcctccatcgagggccagctcggtaaatacccgcggatggacttcgacatcatcgccgagcacgccgagggcatcatgggcaccaccggctgcccgtccggcgccgtgcagacccggctgcggctcggccagttcgacgaggcactgaagtcggccgcgatgtatcaggaggccctcggtaaggactactacttcctcgagatcatggaccacggcctgtcgatcgagaagcgggtccgcgacggcctgctggagatcggccggaaactcaacatcccgcccctggtcaccaacgactcgcactacaccttcgaggcccaggccgaggcgcacgacgtgctgctgtgcgtgcagaccggcagcaacatcgccgacccgaacaggttccggttcgacggcaacggctacttcgtgaagtcggccgagcagatgcgcgcggtggactcctccgaggcctggcagcagggctgccgcaacaccctgctggtcgccgagaaggtggacatcgaggggatgttcacgttcaagaacctgatgccccggttccccatcccggacggcttctccgaggaggagtacttccggcacgtggcgttcgaggggctgcgcaagcggttcccggccggcatcccggacacccacgtcacgcaggccgagtacgagctcggtgtgatcatcagcatgggcttcccggcgtacttcctggtggtcgccgacttcatccagtgggcgaagaacaacgggatcgcggtcggcccggggcgcgggtccgcggcggggtcgctgatcgcgtacgccatgggcatcaccgacctcgatccgctgccgcacggcctgatcttcgagcgcttcctgaacccggagcgcatttcgatgcccgacgtcgacatcgacttcgacgagcgccggcgggccgaggtgatccgctacgtcaccgagaagtggggggacgacaaggtcgcccagatcgccacgttcggcacgatcaaggcgaaggccgcgatcaaggactcggcccgggtgctgggctacccgttcgcggtcggcgaccggatcaccaaggcgatgccgccggacgtgatgggcaagggcatcccgctctccggcatcttcgacaaggaacacaagcggtacaacgaggccggcgagatccgtcagctgtacgagaccgacccggacgtcaagaaggtgatcgacaccgcgcgcgggatcgagggcctgatccggcagaccggcgtgcacgcggccggcgtgatcatgtccgccgagccgatcatcgaccacatcccgctgatgcgccgggcctcggacggcgtgatcatcacgcagttcgactacccgacctgcgagacgctcggcctgctcaagatggacttcctgggcctgcgcaacctgacgatcatcgacgacgccaacaagaacatcgagctcaaccacggcgccccgctcgacctgctggccctgccgctggacgacaagccggcgtacgagttgctcgcccgcggtgacaccctcggtgtgttccagctcgacggcggcccgatgcgctcgctgctgcggctgatgaaaccggacaacttcgaggacatctcggccgtgctggcgctgtaccggcccggcccgatgggcgtcgactcgcacaccaactacgcgctgcgcaagaacagactccaggagatcaccccgatccacccggagctggaggagccgctgcgcgagatcctggagcccacctacggcctgatcgtctatcaggagcaggtgcagcgcgccgcgcagatcctcgccggctactcgctcggccaggccgacctgctgcgccgcgcgatgggcaagaagaagaaggagatcctcgacaaggagttcatcccgttccgcgacggctgccgcgagcacggctactccgacgaggcgatccaggcggtgtgggacgtgctggtgccgttcgccggctatgcgttcaacaaggcgcactccgcggcgtacggcctggtctcctactggacggcgtacctgaaggcgcactacccggcggagtacatggccgggctgctgaccagtgtcggcgacgacaaggacaagatggccgtctatctggccgagtgtcgccggatgggtatccaggtgctgccgccggacgtgaaccagtcggccggcccgttcaccccggtgggccgggacatccggttcggtctgggcgcggtccgcaacgtcggcggcaacgtggtcgaggcgatcgcccggtgccgcaaggagaagggcgagtacaccgacttctacgacttcctgtccaaggtggacgcggtggcctgcaacaagcggaccatcgaatcgctgatcaaggccggggcgttcgactcgatgggccactcccgcaaggggctgctcgccgtgcacgccgaggcgatcgacgcgtacgccggggtcaagcggaacgaggcggccggccagttcgacctgttcggcgcgttcggggacagcgccgggtcgtcggcgaccgtggcgatgcccaccattccggacagtgagtgggacaagcgcgacaagctaaccttcgagcgggagatgctcggtctctacgtctccgaccatcccctggccgggctggagcaggtgctgcagagcaacgcggacatcagcatcgccgcgctcaacgaggacggttcggtgcaggacggccaggtggtcaccatcgcgggcatcctcaccggggtgcagcgccggatcaccaagcagggccgggcctgggcgtcggccaccgtggaggacctggccggtggggtcgagacgctgttcttcccgaacacgtacgagctgatcgggcagtacatcgccgaggacgcgatcgtggtggtcaagggccgggtcgaccggcgcgacgacaccccgcggatcatggcgatggacatgtccattcccgatatatcccataacccggacagcaagccggtggtcctcaccatgccgatcaccagggtcaccccgccgctcgtcgacgagctcaaggacatcctggtcagccaccccggcgacaccgaggtgcacgtccacctgcagaacggcaagcggaccacggtggtgcggctggtcgcggcccgggtcgcggccacccccgcgctgcgcgccgacctcaagatgatcctcggcccggcggcggtggcctga

SEQ ID NO: 1284 - DNA, 786 bp, Actinoplanes utahensis
gtgctgcgccgcacgctcggcaagccgcgcgtgctggccttcgccaaccctaagggcggcgtccacaagaccaccgcgaccgtgctggccgcggccaccatcggcagcgtccgcggccgcggcgtgctcgcctgggacgacaacgagctgcgcggcacgctcggcctgcgggccggcagcgcccggcacgcccggacgatcaagcacctgctcgccgacctggaccggatcgagggcctgcacggcgacgcgctgctgcaggagctcgacgcgtacctgcggcacgcctccgacgggtcctacgacgtgctcgccggcgaggagaacccgcgcttcgcccagcggctggaccagggcaccgtgcgccgggtgaccgacctgctgcgccgcacccacgacgtgatctgtgtggacaccggcaacaacgtggagagcgtgaactggcagacggtcatgcggatggccgaccagctggtgatcaccacggtgccccgggaggacgccgcgttcaccgccgactggatgctcgacgtgctggaggagagcgggatgggcgacatggtggccaacgccgtgacgctgatctcctgcccctcgccgggagccctgccgctgctggcggacttcaagaagcacttcgcgacccgcacccgcgcggtcgcggtggtgccctacgacccggcgctggaggtgggttcgtcgatcgagtacggcgatctgcaaccggagacccggcaggcgtggttgcgggccgcgtcggtgatgctggagcccttcgcggagtaa

SEQ ID NO: 1285 - DNA, 522 bp, Actinoplanes utahensis
gtggacgggaccgagaccggctggggccggcctgcggagccggccccgcgctggcgggccctgctcgaccgggcccggcacggtcaccgcgccgaggagccggcggacgagccgcgggccgatccggccgcggtgccgcagcagtgggggcagcagcagccgccggcgccgccgacccgggcgtcggcccggccggtgaacccgctggagaaccggggttacgagggccagcgccaggccgagccgaggtacggggccgcggaaccgcagcggccgatgccgcagcggccggtcaaccccctcgatccgcgctggcaggcccgcccggaccagcagcagcacagcttcttcgagccggcgccgcggtcgccgcagccggtcaccccgccgcccgcaccgcccgcacgggctgactatccgccggcgcccggctatccgcctcaggtgccgcagccgaacggtcatcccgcgaccaacggctacgggcagcccccggccgccccgcacgcctatgctagctag

SEQ ID NO: 1286 - DNA, 999 bp, Actinoplanes utahensis
gtggggcccgcgcatcgtgtgcgagcggtcctcgtcaggttcgggggcggctcgctccggttgcagatcatgaccggggtggcggccgccgccaccgcgacgctggtgctcgccgtcgcctgggccggccactccggcgacccgtccggcggcgacccgggtgacgtggtgcgggtcggggtgatcgagggccagacggtcggcggttacctggactcctcgcggcgtgagctcagcatgctcaccgacccgtccggcccggccgccggggacacctgggcgctggtcagcctccgcgactacaccgcgccggcccagctgccggcgctgctggcgggcgcgacggtggcccaggtgtacgcgcgggtgccgctgcccggggtgcgcacccaggtgtcgctgatcccggtctactcgatgcccggggacgtgaccgccgggatgctcgacgcggccctggtgcgcgaccgggagcaggccgacctgtcccggctggaacgctcgctgaccggcgaggggcagcgcgagcagcggctgcgcaccacgtacggcacggccgctctggtcgcggcgcaggaggccgcggcgtaccgggccggctgctcctgtgtcttcgcggccgtgatccgcgccgcaccggcgaccctgggcggcatcgcgtcccggccgggggtgcgcggtgtcgacccggctcccgaggtgcgcagcctggaccacaccgagttccggccgccgcggcccgaggagagcggcctggtgaccgcggacccgtcggtgcggcctgtgccaaccgcgacaccgggcgttgcctccggatcgcccggacggttaccgtcgtcgatcggaggcactgtgacttcccactcatccgggcgtggtcccggccggtcaccctcggtcgccgtctcgtcgacggctccggctgacgtaccctcggaggacgaagtgggcacagctcaggcctcatccgtcgcgtcgatcgccgaacccggccgctga

SEQ ID NO: 1287 - DNA, 930 bp, Actinoplanes utahensis
gtgagcgacacgcgttcgctgcccgtcccggacgggctggacgggatgcggctggaccaggcggtgtcccggctgttcgggctgtcccgcacggccgcggccgacctggtcgaatccggggacgcgctggtcgacggcgccccccggccgaaatcggacaaggtcgccgcgggttcctggctggaggtgaccctgccgcggccggtgactgctccggtgctggtcgcccagccggtgcacggcctgtcggtgatctacagcgacgacgacatcgtggtggtggacaagccggtcggcgtggccgcccacccgagccccggctggaccggtccgaccgtggtcagcggtctggccgcgatggggcagaacgtggcgaccagcggcgccgccgagcgccagggcatcgtgcaccgcctcgacgtcggcaccaccggcctgatggtggtcgccaagtccgagatggcgtacagcgtgctcaagcgggcgttcaaggagcgcgaggtggacaagcggtaccacgcggtggtgcagggacacctggacccgctgcgcggcaccgtggacgcgccgatcgaccgacacccgacggccgactaccggttcgcggtgatgtccggcggcaagccgagcgtcacccactacgacacactggaggcgttccgcgccgccagcctggtcgacgtgaagctggagaccgggcgtacccaccagatccgggtgcacttctcggcgctgcggcacccttgcgtcggcgatctcacctacggtgcggatccgaccctggccgcccggctgaagctgaaccggcagtggctgcacgcccgggaactgggcttcctgcacccccggacgcatgatgaggtccgcttcgtcagcgactaccctgacgacctgaaattcgcgctggacgtcctgcaggacgccggctga

SEQ ID NO: 1288 - DNA, 660 bp, Actinoplanes utahensis
gtgcgagcggtgcggcaaccagatcccggtggagcggattgccgccttcccgtccgcgactctctgtgtgtcatgcaagcaactggaggaacgacgctgaacgccgacaaggctccccggttcgccgcgcgcgccgtcgcggtgctgggtgccaccgcgctgctggcgctggcgctcgaccagtgggtgaagtacctctccaccgagcatctcgacccgaacgagccggtccggatcctcggtggcctgatctacctgtccctgctgcgcaacagcggggcggcgttcagcttcggcgacacgcacacctggatcttcccggtgatcaccctggtggtgatcggctggatcggctggatggcgacccggctgcgttcggtgccgtgggcgctcgctctcggtctggtgctcggcggtgcgctgggcaacctggccgaccggctgttccgggcacccggcccgttccagggcaaggtggtcgacatgatcagtgtgttcgcgccgtacgcggagaagttcccggtgttcaacatcgcggacagctgcctgaccgtgggcgtctgcctcgcggtgcttctggagctcaccggccggcagcgggacggcagccggctgaagaacacgaagaacgagcaggtcgagaccgaggagacggcgtga

SEQ ID NO: 1289 - DNA, 285 bp, Actinoplanes utahensis
atggtgtcagtgccggttcgggtgcggccgggagccgggcggacccgggtcggcggcggctaccccggcccgcacgggacggcggtgatcatcgcggtggcggcgcccgcggtcgacggccacgcgaccgaggcggcccggcgggcgctggccgccgcgttgggggtgcgggccgccgcggtgagcctgcgggtcggtgcgacgagccgggacaaggtcttcacggtggatgcgccggccgcggaggtggccgggctcttggccgcactggtggccgagaggtag

SEQ ID NO: 1290 - DNA, 840 bp, Actinoplanes utahensis
atgatccctgctagtttcccgctcatcctcgtcgcggtggtgtgcctcgcgatcggcctggtccgcgggtcgagcagccttctcatagcgtcgatcgtggccagcctgctggccgcggtcgccctcgtcatcggcgcgcggcgcaatgccgcggcgcaccgtccggagtcaccggacgacgacttcccgccgccgccggctccgcgccgcaccaccggggcgccgtccgacgcccacgattctgccccggccggcgacgcgttcgcagccgattcgcggtacgccgagccgcccaccttcgcctccgccccgcccaccgccccggagccgccggcgggtggccaggtatacgagcagcgggccgcggcggatcacggcgagccggtcgatcttccgccggcgaccgatgacgcgggtgccgcgggaacacacctcccggacgaaaccgtcgtaacgccggtgcccgcggccgactatcaggccgcgtcgtcgaccatcggggcggcccgcggcggacacgacgacgaccagtcgtggcggcggccgatggccaccgacgccgggctcgacgacgggttcggggaaccggacgccgacgatccggacgacgaaccgctgccgcaggcggtgcgccccgccgacgccgtgcaggtggcccggttcgacaccgaggtgctcgtggtggacgggcggccccgctaccacatggcggactgcccccacctggtcgggcggctgaccgagcccctgccggcggccgaggcggtggagctcggcttcagcccgtgcggcctgtgccggccggtggaccggctgctgggcgcgaacgcgcgccgctga

SEQ ID NO: 1291 - DNA, 813 bp, Actinoplanes utahensis
atgccgctgaccccggccgacgtgcataacgtcgccttcaagaagcccccgatcggcaagcgggggtacgacgaggaggaggtcgacgccttcctggacgaggtcgagcgcgagctcgcccgtctgatcgaggagaacaacgagctgcgcgcccaggtggagcgcggcggccggggtggcgcaccagccggcccgagcgccgacccccgcctcgcggccgagctcaacgacctgaaaggccagcttgaccgcgtccagcgggacaagacggcggccgagcaggcggcccggcagatgcaggccgagctggagcaggtgcgtgcccagggccccggcccgggtgccggcccgaccggcgccgacggcgagcagcaggcgctgcgggtgctgatgatggcccagcgcaccgccgacgaccacgtgtccgacgcccgccgcgaggccgacaagctgctctccgacgcccgctccaaggcggaggaggtcacccgggaggcccgggccaaggccgatgccctcgagcgcgacgcgcgccagcggcaccaggaggccatgggcggcctggacgccaagcggaccgcgctgcagaagcacatcgaggagctgaagcagttcgagcgggagtaccgcacgcggctgaaggcgtacctggagagccagctgcgcgacctcgacggtcgtggtcagggcctggaggccgagatggcgcgcgccgacgcgagccgtgcggtcggcggttccggcggcctcgccgcggccggcctggccgggtcgtacggcggccggtcgaacgccatcgaaacgggccgctga

SEQ ID NO: 1292 - DNA, 306 bp, Actinoplanes utahensis
gtgctgtcgatcgtgttccagattctctatctgttggtttacttcttcttcctggtgctgctgagcaggttcgtcctgggtgcggtgctccagtacggacgccgatggcagccgggccggggcgcgtccgccgcactcgaggtggtgtggagcgtcacggatccgcctttgaaggcgttgaggcgtgtgatcccaccgctgcgcattggtaacgtgagtttggacctggcttccatcgtgctgctggttatcctgttcgtgctcatgcagttagtgctccttcagctcatcttgaactacagatag

SEQ ID NO: 1293 - DNA, 738 bp, Actinoplanes utahensis
atgagtactttccgtaaggcggccgtctggctgggtcttgccgaggaggaggacgagcgcgactacgaggagcggggataccgcgagagctcctaccggtcgtcgcggtccgatcggcacgatcgcgaccaggaccgctactcgtccggcgaccgctactccggcgacttcgacgacgaggaggaggacgagcggcccgcgccccggcgtccggtccgctccgagcgcaccgagcgcacgtcccggctcagcgaccgcgcctcctcggtgcgcgccgagctcgaccgggacgacgaggaccggatcgagcggtccagcgtgcgctcgatcacccggccggccgcggtggcgcccgagcagccctcggcgctcacctactccacccgggagaacctcgcgctcgccccgcagccggtgcaccagccgcaggtgcagcagcgtccgatcgaggacgagcagcggtatcagatcaccacgctgcaccccaccacgtaccgcgaggcgcggaccatcggcgagcacttccgggacggcacgccggtcatcatcaatctcaccgagatggatgaatcggacgctcgccgactggtggacttcgccgccgggctggctttcggcctgcggggtacgatcgagcgcgtgaccaaccgggtattcctgctctcaccggcgaatgtccaggtcaccgcggaggacaaggccaagatcgctgagggcgggttcttcgcccagagttga

SEQ ID NO: 1294 - DNA, 714 bp, Actinoplanes utahensis
atggagttcgacgaggggcggcgggccgagctcgccgccaatctgcgtgcggtgcgggagcggatcgagcgtgcccgggtggcggccggacggccgcccggggcggtcacgctgaccgcggtgaccaagacgtatccggcgagtgacgtgctgttgctcgccgggctcggcgtgaccgacgccggggagaacaaggatcaggaggcggccggcaaggctgccgaggcgcgggccgccggggtcgccctgcgctggcacttcgtcggccaactgcaacggaacaaggccaaatcggttgcctcgtacgccgatgtcgtcgagtccgtggattcggtgcgcctggtgacggcgctggaccgggccgccgtggcggtccgcgattccccgctggaggtgctggtccaggtcagcctggacggcgatccccagcgcggcggcgcgagtggggatgatctctggcgggtatccgacgcggtggcggcgtcggacggtctccggctcggcgggctgatggcggtcgcaccgctaggcgaggatcccgaccgggccttcgcccggctggccgagctggccggtgccctggtcagcacgcatcccggggccaccacgctgtccgcgggcatgagtggcgacctggaggcggcgatccggcacggggcgacacacgtacggatcggtacatctttactcgggatgcgaaactcgctgcggtag

SEQ ID NO: 1295 - DNA, 1140 bp, Actinoplanes utahensis
atgacacctccgcacaactaccttgcggtcatcaaggtcgtcggcatcggcggtggcggcgtgaacgccgtgaaccgcatgatcgaggttgggctcaaaggcgtcgagttcatcgcgatcaacaccgatgcccaggccctgctgatgagcgatgccgacgtgaaactggacgtcggtcgggaactgacccggggactgggcgccggcgcccagcccgacgtcggcaagaacgccgccgaggaccaccgtgacgagatcgaggaggtgctcaagggcgccgacatggtcttcgtgacgtgtggcgagggcggcggcaccggtaccggcggcgccccggtggtcgcgaacatcgcccgcaagctgggcgcgctgaccatcggcgtggtgacccgcccgttctcgttcgagggcaagcggcgccaggtgcaggccgaggccggcatcgacgagctgcgcaaccagtgcgacacgctgatcgtgatcccgaacgaccggctgctcgcgctcggcgaccgcgggatcagcatgatggacgcgttccggcaggccgaccaggtcctgctctccggcgtgcagggcatcaccgacctgatcaccacgccgggtctgatcaacctcgacttcgccgacgtcaagagcgtgatgagcaacgcgggcagcgcgctcatgggcatcggcagcgcgcgcggcgacaaccgcgccgtcgaggcggccgagcgggccatctccagcccgctgctggagcagagcatggacggcgcgcgcggcgtgctgctctccatcgccggcggctccgacctcggcctgttcgagatcaacgatgcggcgcagctggtcaccgacgcggcccacccggatgcgaacatcatcttcggcgcggtcatcgacgacgcgctcggcgacgaggtgcgggtgaccgtgatcgcggccgggttcgacgggggctcgccctcgtacaagccggtcgagacggtgcgcaacaaggtgctcccgcaggccgagccgcgcagctcggcgccggtcagctcgacctcgctgaccccgcaccaggcgccgtccgccccggccacgccggcgccgcgcaagcagatcctgttcgacgacgtggacgtgcccgacttcctgaagaacgggtcctga

SEQ ID NO: 1296 - DNA, 768 bp, Actinoplanes utahensis
gtggccgggccgggcacgcgcaactggcgactggtgcgcgcggacaccgacgcggtgccgccgtcggcccgccggttcatggcccgtgcccggcagcggcggctgcgggccgcgctgccctggctgatcggggccggggtgctgctggtcgccggcggggtggcctggctgttctacggcacggcggtgctcggggtgcggaccgtcgacgtggtcggcgtgcagacgctggacgcggctcaggtgcgggccgccgcggcggtgccggaccggcagccgctggcccgggtcgacctgggtgacgtgagcgcccgggtgcgcggcctggccgcggtcgaccgggtggtggtcacccgggcctggccgtccaccctgcggatcgaggtggtggagcgggtcgcggtggccgcggtgccgggccggagcggtttcaccctgatcgaccgggccggcgtgccgttccggtcggccgagcggaaaccggacgggctgccgttggccaaggtcgcgaccccggggccgaacgacgctaataccgggtcggcgctgaaggtgctggccgccctcagtgacgagttgcgcgagcagctggacgccgtgtcggtcatctcaccggtggcgatccggctggagttgcgcggcggccgggtggtgatctggggagacgacaccgagagcgacctgaagagcaaggtggcgacggcactgttgaagaacagggcgtcggaaatcgacgtgagcgcaccgaagatcgttactatccggtaa

SEQ ID NO: 1297 - DNA, 1440 bp, Actinoplanes utahensis
gtggtgaacacggcggagttgacgccggccggtgagatgaccgccgaggaactgggcagcgtgcacctgatcgggattggcggcgtcggcatggccggcctggcccggctcctgctgacccggggcatcccggtctccggcagcgagctgcgcgagtggcccgccctggccgggatgcgcgcgctcggcgggaccgtgcacatggcccacgaggcgtcgaacctcgacggggtcgacacggtcgtctactccaccgccatcccgaaggaccacgtggagatggtcgaggcccgccggcgcgggctgcgggtcctgcaccgctcggaggcgctggccgcggcgatgaccggccgacagaccatcgcggtggccggcacccacggcaagaccaccaccacctcgatcatgacggtgatcctgcagcacgccggccaggacccgtccttcgtgatcggcggcgagctctccgcggccgggtcgaacgggcaccacggcagcgggccacacttcgtggccgaggccgacgagcacgaccggtcgttcctgatctaccgcccgcacgtcgcgatcatcaccaacatcgagggtgaccacctcaacaactggggtgacctggagacgctcaaggcgggcttcctggagttcggcgggctggccgacgggttcgtggtgacctgcgccgacgggccgggcaccgaggagctgatcgccgggctccgggcgcagggcaggacggtctacacctacggcgagtccgccgacgccgacctgcggatcaccgacgtggtctcgaccgtcagcggggtgcgctacacggccatcctgcacggcgagacgctcggtgagttcaagctcgcgctgcccggcaagcacatgggcctgaacagcgccgcgaccgtgctcaccgcgctcaagctgggcctgccgctggccaagatcaccgaggcgctggagtcgttcccgggggtgcgccgccgtttcgagcgcaagggcatcgcggccggcgtgcgggtctacgacgagtacgcgtaccacccgacctcggtgctggccgcgctgcgcacgctgcgcgaggtggccggcgacgggcgcctgctggtggtcttccagccgtaccgggtgtaccgcacccgggacctgcaggccgaactcgccgaggggctggcgctggccgaccaggcgatcatcatggaggtgttcgggccgggggagacccgcggtcccggtgagggcggcctcgccctgaccgccgcgatcgacctgcccgccgaccgcaaggtcttcgttccggactgggatgacgtcccggccgaggtggtccgccgcagccgccccggggacgtggtggtgaccatgggcgcgccgccgatctcgctgatgggcgacgagctgctggccgcgctcgccgaggccgacctgaccccggatttcgcgggctga

SEQ ID NO: 1298 - DNA, 1107 bp, Actinoplanes utahensis
atggttcagctgcggtcggtcgtgctcgccgggggaggcaccggcggacacatctatccgctgctcgccttcgccgacgccttacgccgccatttcccgcagatccggatcaccacgctgggcagccccaagggcatggagaaccagctgatcccggcggcgggctacgacctgcgggtgatcccggcgttccagctgccccgctcgctcaacttcgacctgctgcgcaccccggaccggatgtacaagtccacccatgcggccggggagatcctcgacgaggtgcaggccgaggtggtggtcggcttcggcgggtacgtgtcggtcccggcctacctggcggcctggcgccgcgagctgccgatcgtggtgcacgaggtgaacgtgccgcccggcgtggcgaaccggatggggatgaaattcaccaagcgggtcgccgtgggtttcccgcaccagctggagcaggccgagtcgctgcgcaacgcgcgcctggtcggcgtcccgctgcggaccgggatcacccggatggaccgcccggcgttgcgcccgcaggcgctctaccacttcgggctgcgccccgacctgccggtgctgttcgtctccggcggctcgtccggcgcccgcacgatcaacctggcggtggccgccgcggccaagcggctggcccacgccggcatccaggtgctgcacgtgcagggcgggcgcaacgacccgttcgaggtgcccgacgacctgccggtgccctatgtcgtcgtgccctacctgtcggacatgcagctcggatacgctgccgccgacctgatgctctgccggggcggggcgatcaccgtcgccgagaccaccgcgctgggcatgccggcgatctacgtgccgtacccgttctccaaccaggagcagcggcgcaatgcgatcccggtggtcgaggcgggcggcggcatgctggtcgacaacagcgagctgaccccggagtggatcgagcggaacatcatcccgctggcccgggaccggcagcggctggccgcgatgggtcacgccgccggccggtacggccggcgcgacggcgacgagcagttgctgcgcttcgttctggaagcggtggaccggtga

SEQ ID NO: 1299 - DNA, 1410 bp, Actinoplanes utahensis
atggtcacgtcgatggcgtgtccgcccgacgatgatgtgggcatggcggacgaccgtacccgacaggaccgcccgtcactgagccggcagttgctgcccgcggtgcacgggctgctggcccgacccctctcgtcgtactacctgctgatcgccagctccgggatgctgctgctgatcgggctcaccatggtgttctcggcgtccagcgtgcagtcgtacgcggccgacggcaacgccttctccggcatcgccaaccaggcggtcttcgcgctgctcggcctggtcgcgttctgggtcttccagcggttgccggcgatcaccctgcgggccgtcggcaagtacgtgctgggcctcgccatcctgctgctggtgatcctcgacgtgctggtcgaggtgaagcacgtcaccgagaaccacagcgcccaggtcggcccgctgcgggtcagcctgctctggctctccttccaggggctcgtcatccaaccctccgagctggccaagctgggcatcgtgctgtggggcgccgacatgatcgcccgcaagggcccggcgctgagccgctggcgtgagctggcgatgccgctgttcccggtggtcggtctgctgttcctcctggtcggctacaacgacgtgggcaccatgctggtgctgctcgcgctgatcgtcggcctgctctgggcggccggggtgcggctgcgggtcttcggcgcgctcggggtgttcggcctgaccggcatcgccctgctgatcgccgcggcgtcccggggtggcgggtcgggctcgaccgacgcgccgaactaccgcgtgcagcggatcaccgcgttcctcaccccgctggacaagtgtgacccgaacggcgtctgctaccagatcgtccagggccgctcggcgatcttcgagggcggctggttcggcgtcggcctgggcaagggcgcgctcaagtggggctgggtgccggaggcgcagaacgacttcatctacgcgatcgtcgccgaggagctcggcctggtcggctgcgtcgtggtgctggcgctctacgcggtgctggcctactccggattccggatcgcccgccgctcggccgacccgttccgccggctggcggccgccgcgatcaccacctggctggtcgcccaggcggtgatcaacatgggtggggtggtcggcctgctgcccatcaccggccttccgctaccgttcatctccgcaggtggtagcgctctcgtggtggccatggcggcgatcggcatgctggcctcgttcgcccgggcggagccggacgcggcccgagctttgaacgcccgtccgacgccccgatgggtgcgactagtctgggccccgctgccgccggttcctccgcagcggcggccgggacaaccggtgcgtacggggggcgaggggagacggtga

SEQ ID NO: 1300 - DNA, 1116 bp, Actinoplanes utahensis
gtgagggcagtcatcgtcgcggccgcggtcgcctttctcatctcgctcttcggcacccccattgccatcaaggtcttctcggcgctcaaggccgggcagccgatccgcaccatcgggccggcgacccacatgggcaagaagggcaccccgaccatgggtggcgtggcgttcatcctcgccacggtcttcgcgtacgtcgccgggcacctcgccctgaccacgctcccggaccggcagatcgcccaggagcggcccaccatgaccgccctggtgctgctgggcctgttcgtcttctgcggcgcggtcggcttcctggacgacttcctgaaggtccgcaagcgcaactcggacggcctgtccgccaagggcaagctgctcggccagttgctggtcggcaccgggttcgggatcgccgcgctgtacttcccgagcaccaacggcgaaaccgtggccagcgagcacatctccttcatccgggacgtgagctggctggacgtcggcaaggtcggctcggtgatggtcttcgtcttcgtgatcatggcgatgtccaacggggtgaacctgaccgacggcctggacggcctggccaccggctcgtcgatcctggtcctcggggcgtactcgctgatcggcttctggcagtaccggcactggtgcggtgacaacgactaccggctcaccaacgagctcacccagacgcactgctaccaggtccgggacccgctggagatcgcgctgatcgcggcggccgcggccgccgcgtgcgtcggcttcctgtggtggaacaccaacccggcgcggatcttcatgggtgacaccggggcgctcggcctgggcggcctgatcggcggcctcgcggtggccacccggaccacgctgctctcggtgatcatcggcggcctcttcgtgatcatcacgatgtccgtggtgatccagatcatctcgttcaagaccaccggcaagcgggtcttccggatgtcgccgttgcagcaccatttcgagctggccggctggtccgaggtgaacatcgtggtgcggttctggatcatcgcgggcatctgcgccgcgatcggcctggggctgttctacagcgaccatctcgcggtgatgggctaa

SEQ ID NO: 1301 - DNA, 1392 bp, Actinoplanes utahensis
atgatcccgatgacactggccgagatcgccgccgtgaccggcggccacctggtcaacagcgacggctcggagacggtcaccggcggcgtggagtacgactcccgccgggtgggcccgggcgggctgttcgtggcgttcgccggggagaaggcggacgggcacgacttcggcccgaaggtggtcgcggccggggcggccggggtgctcggcacccgggacgccggcgcgcccggggtggtggtcgaggaccagctggccgcgctcgcgaagctggcccacgaggtgctcacccggctgcccgagctgaccgtggtgggcctgaccggctcgtccggcaagaccaccaccaaggactacctggggcagctgctgtcccggctggggcccaccgtggcgccggccggctcgctcaacaacgagctcggcttcccgtacacggtgctgcaggccggccgggagacccggttcctggtgctggagatgggcgcccggggcatcgggcacatccggtacctgaccgggatcgcccggccgtcgatcggcctggtgctcaacgtgggtgccgcgcacctcggcgagttcggctcgatcgagggcaccgcgcgggccaagggcgagctggtcgaggcgctgccggcggacggggtcgcggtgctcaacgcggacgacccgctggtcgcggcgatggcgtcgcggaccggggcgcgggtgctgcgggtcggcgaggcggccgacgccgatctgcgcgccacgggggtcacggtggactcggcggggcgggcgtcgtacgtcctccatcatggtcttgaagtgaggaatgtccggctcggcgtggccgggcggcatcaggtggcgaactcgctggccgccgcggcggccgcgctgaccgccgggatgccgctggacgacctggccaccgcgctcggcgaggtgggcatcgtctccgggcggcggatggacgtgatcgagcggccggacggggtgacggtcgtcgacgactcgtacaacgccaatccgtcgtcgaccgcggcggcgctgcacgcgctggccgcgatgggcgccgggaagcgcaccaccgccgtgctcggctacatggccgagctcggcgagcacgaggtgtccgggcatgccgaggtcggccggctcgccgccgaactgggtgtggaccggctgatcgcggtggcggacaacgcccgcccgatcctggacggagccgcggcggcacccgggtggcgggggaccgccctgttcgccgccgaccaggccgccgccatcgagattctgcagtccgacctgcgcgccgacgacgtcgtgctggtcaagggttcccggtaccgcacatgggacgtcgccgactggctgcggcgccccgaggaggttcagcccacgtga

SEQ ID NO: 1302 - DNA, 1503 bp, Actinoplanes utahensis
gtgtccggcattccccgacccgagaccgtcgcaccgctccccctcacgcggctcgctgagctgctgagggcaacgctgcacggtggtgacatcgatgtcaccggggtcactcacagtagtggcgcggtgcgcccaggtgatctgtacgcggcgctgcccggcgcgaaccggcacggcgccgagttcgtcgacgcggcggcctcagccggcgcggcggccgtgctgaccgatccggccgggcgggacgccgcgctcgccgccgggttgccggtgctgacggtcgacgacccccgagcggtgctcggtgcggccgccgcggcgatctacggcgagccgtcccggcggctcaccatgatcggcatcaccgggacggccgggaagacctcgacgtcgtacctggtggaggccggcctgcgggccgccgggcgggtgaccgggctggtcggcacggtggagacccggctcggcgacttcaccgtgaagagcgtgcggaccactccggaggccaccgacctgcaggcgatcctggcggtcggggtggagcgcggggtctccgcggtggtgatggaggtgtccagccacgccctggtgatggggcgggcggacggcatccggttcgccgcgtccggctacaccaacttcggtcaggaccacctggacttccatccgacgtcggaggagtacttcgcggccaaggcccggctcttcgacggccggtccgcggtcggcgtgctcaaccgggacgacgctgcggtgatgtcgctcgccaccccggaaacggtgacctattccgcggccggggacgaatccgccacgtggtgggcctccgatgtccgcccgtccgcgttcggtcagctcttcaccgcccacggcccggacggcgtgacggtcgagacgggtgtggcgctgcccggcctgcacaacgtcgccaacgcgctgctggccatcgcgctgctggtcgcgaccggcatcgatccgcgggtggccggcgccggcgtgcgggactgccggggcgtgcccgggcggctggaacaggttccggcgcagagcgggatcctcggcgtggtcgactacgcgcacaagccgaacgcgatcgtcgccgccctggccgcgctgcgtgacctggccaccgcccgcggcggccggctgatctgcgtgatcggcgccggcggtgaccgcgacaggggcaagcggccgctgatgggcgaggcggcggcccggggcgccgacctggtgatcgtcacggacgacaacccccggaccgaggaccccgctttcgtacgggacggggtgcgccgtggcgccgaggacgcgcacgccggcaaggtcgtcgaagtggccgggcggcgggccgcgatcgtcgaggcggtccggctggccgccaccggcgacgtgatcgccgtgctgggcaagggcaacgaacagggccaggaggtgaacggccaggtgctgccgttcgacgaccggatcgaactggccgccgcactggagggccgcgcatga

SEQ ID NO: 1303 - DNA, 1821 bp, Actinoplanes utahensis
gtgaccggcggaagcggtccgggccgggagccggcgcgccggctccggccggtgcccgccgagccgccgaagctcgccaacagcacacggcggctgcggctgggcacgatcctggcgctgtcgctgttcaccatgatcggcatccggctggtggtgctgcaggtggcgacctcgccggccgaggtggacaagctggtcgatctgcgcaacgaccggatgcattcgatcaagctgccggccgcgcggggcagcatcctggaccgggacggcaacatcctggcgaacagcgtcgaggcgcgctacatcttcgccgacccgagcaatccccggctgcagaacgacatcccgggtacggcggcggcgctggccaggctgctcggcgtgccggcctccaaactggccgcgagcatgcagccgaagatggtcgacggaaaggcgtcgcagttcagctacctggcccggggcgtcgacgtgtcggtggccaaccagatcgaggcgctgaagaagccgggcatctacacgcacgccgacgagcggcgtgagctgcccggcaaggacctggcggcgaacctgatcgggttcatcggcgacgatcagcacggtctggagggactggaggcgcgctacgacgacctgctgcacggcaccgacgggatgtgggtcttcgagtccggcaagggcaagctggacggtccgatcgccggcgggtaccagcaggagacgccggccaagccgggtggctcgctgcagctgacgatcaacagcttcacccagtggaacgcgcagcacatcctggacgccgaggcggagcgcaaccacgccacggtggccggcgcggtggtcctggacgtcaagaccggggagatcctggcccaggccagctatccgtactacaacgcggccaaggcgctggagtaccagccgtccgaccggatcgacgtgcccaccgcggtggtcaccgacccgggctccacgcacaaggcgttcgtcatcggggcggccctgcaggagggtctgatcaccccggactcgacggtggaggtcgcgccggcgatcgtcgagggcggcaagacgttcaacgacagccacgtccagcccaagggcagcaggctgaccatcgccgggatcctcgcctactcgtccaacgtgggcacgatccagatcggcagccggctgggcaaggacaagatctacgagtaccagcagaagttcgggctcgggaaggcgaccggcgagggcatgcccggtgaggcgcccggtgagctgctggcgccgcagaactggagcgggtcggcgaaggggtcggtgccgatcgggcacagcgtctcggccaccctggtgcagatggcggccgggtacggcgcgatcgccaacgacggcgtgtacatccagccgcacctgatcaaggcgacggtgtccggaaccgatcacacgacgaccccggcgccggcgcccgagacgcaccgggtgctggacgccaagatcgccgcggagctgcgcacgctgatggagacggtggtcgaggacagcgagggcaccggggtgaaggcccaggtgcccggttaccgggtggccggcaagaccggcaccggcaagatggtcgtcgacggcgagtacaccagccacaacgccagctcgttcgtcgggatggcgccggcggagaacccacgctacgtggtcgcggtcgcgatggacgtggctaagggcaccggcggtgaggtggccgctccggcgttcgcccagatcatgtcggacacgctgctgcgcaattcggtgccgccgtccacgacgaaaccgccgactttcaagatccatggatga

SEQ ID NO: 1304 - DNA, 1182 bp, Actinoplanes utahensis
atggggatctggcggtacggatgcgcggccgggccggtacggatcagcagggcacggcaacacggcaacgaaccgagtggaacgcgagcgggtgggtcaatgggggtcgacatgggggagccgcgcggcgcgcacgttccggtgctgctggaacgctgcctcgagctgctcggtccggctctggcccggcccggcgcggtgcacgtcgacttcacgctgggtctgggcgggcacgccgaggcggtgctggagcggttcccggaggcggtcctgatcggactcgaccgggacaccgaggcgctcgcccactcgcggcaccggctggcccggttcgccgagcggatccatctggtgcacgcggtctaccacgagctgccccgggtgctcgacgagctcgacatcccggcgatcgacagcggactcttcgacctgggcgtgtcctcgctgcagctggacgaggcggaccgcggtttcgcgtacgcgcaggacgccccgctggacatgcggatggaccagtcgcgggggatcaccgccgaagaggtcgtcaacacgtacgagccgggcgagctggtgcggatccttcggcagtacggcgaggagaagttcgcgccacgggtggtcagcgcgatcgtgcgggagcggcagaaggcgcggatcgtctccacggcccggctggcggagctgatcaaagacgctatcccggccgccgcgcggcgaacgggtggaaatcccgcgaaaaggtcattccaagcactacgcattgaggtcaacggcgagctggatgtgctcgagtccgcgattcccgcggctttggacgtcttgtcgcccggcgggcgacttgtggtgatgagttatcaatctctggaggaccggatcgtcaagcgggcgctcaccgcgagagcgcgcagcaccgggccgatcgacctgccggtcgagctgcccgggacgggtccgacgctgcggctgctgaccagggggtcggagttgcccagcgaggcggaggtggcggagaacccgcgggcggcttcggtgaagctgcgcgcggtggaacggatcgaactgggtaagacggcgaaccagccgggcggggccggccgcgaacggccccggatggtcgccgagcacgggggacaagggcggcgacgcccggggctgaaccaggagggggaggggaaagcatga

SEQ ID NO: 1305 - DNA, 432 bp, Actinoplanes utahensis
atgttcctcggcacgcacacccctcggctggacgagaagggccggctgatcctcccggcgaagttccgcgacgagctggcgggaggtgtcgtgatcacgaaagggcaggagcgctgtctgtacgtgttcccgatgccggagttccagcggatcgccggccagctgcgtgaggcgccggtgacgaacaaggccgcccgggcttacagccgggtgttcttcgccagcgcgcacgacgaggtccccgacaaacagggccgggtcaccatccccacgcatctgcgggagtacgcgagtctcggccgggatctcgtggtgatcggggccagcaccagggtcgagatctgggaccggcagtcctgggacgactacctctcggcgagcgaggaagacttcgccgacatccaggagggggtgctgcccggcggactgtag

SEQ ID NO: 1306 - DNA, 831 bp, Actinoplanes utahensis
gtgcacgaacaccgttcgagccatggccgccgcatgtccggcgccggtaccgcagcactctccctggggctctgcctctgcgccggccagctgatcggcgcgtcgcccgccgtagcagccgaggcgacgccggtcaccaccgccgcgaacaccgtccgggcagtcgcgccggccgccgccaaaaccctcgtgcagcccaggctgaccaccacgaccaccgctcgccggatcaccgcgggatccgtcctcaaggtcaccgccaaggtgatcaacccgaagaccggcaagatcgccaagggcaccatccgcctgcagggctaccgcggcggcaagtggcagacgtgggccaccaagagcagcaccggcgcggtcaccttcaccaccgggcccaagtcgtcgatctacatccggaccctgttcaccggcaccggctacgcgcagacctccagctcacgcatgctgatcacggtccgcgccaacggcggcgcacgggtcctggccgaagccaagaagcacgtcggcgccctgtacaagttcgccgccgccggaccgaaacggttcgactgctccggcttcaccctctacgtctacaaggtcgcggccggcaggagcctgccgcacaaggctgacgcccagcagcgctacggcagcgcggtgagcaagagccaggcccagcccggcgatctgatcatcttccggtccgggtcgtacggctaccacgccgggatctacgccggcggcggctacatgtacgactcgccgcacaccggggcccgggtcggcaagcacaagatgtacggcagcaactacgtcgtacgccgcatcgcctga

SEQ ID NO: 1307 - DNA, 1221 bp, Actinoplanes utahensis
atgcccttgcgggcgatagtcgcgaccaccgcgtcgaagaccgcggcggcgctctccagggccgcgggccgcggcgacggctcggtgatcggcggctggatcggcctcaagatcgaccccgacctgctggcgcatctctcctcgggccgggcggtggcgctggtctccggcaccaacggcaagacgaccacgacgcggctcaccgcggccgcggtcggcgtgctcggccgggtcgccaccaactcgtacggcgccaacatgcccaccgggcacacctccgcgctcgcgaaggaggggcacaccccgttcgccgtgctggaggtcgacgagcactacctggcccaggtgatcgacgccacccggcccaaggtggtggcgctgctcaacctctcccgcgaccagctcgaccgggccaaggaggtggcgatgatggcgcagctgtggaagaccgcgctggccggccaccccgagatccgggtggtggccaacgcggacgatccgatggtcgtctgggcggccgccggcagcccgcagtccatctggttcagcgccggtcagcgctggcacgacgactcgttcgtctgcccggagagcggccacccgatcgagcgcgcgaacggcgactggtggtgcaccggctgcccgctgcgccgcccgaccccgcagtgggtggtcgaggaggacggcgtgatcgacccgcgcggcgactggcacctggtcaagctgcagctgccgggcaaggtcaacctgggcaacgcggccaccgccctcgcggtcgccggcgaattcggggttcgcccgatcgaggcgctcccccggctctcccgggtgacctcgatcgcgggacgctacgcccaggtcgaccgggacggccgcaacatccggctgctgctcgccaagaacccggcgagctggctggaggcgttcgacatggccgaccaggcgccgaccctgctctcgatcaacgcgcgggaccccgacggcctggacacctcctggctgtgggacgtcgacttcgccccgctgcgcgaccgtccggtcctgatcaccggcgaccgggcgttcgacctggccgtccggctgcaggtgaaccaggtgccgttccggcacgtacacaccttcgacgaggcggtggcgcaggtgccgccgggccggctcgaggtgatcgccaactacacggcgttccaggacatccgcgcggtgctcgaccgtgtcaactaa

SEQ ID NO: 1308 - DNA, 714 bp, Actinoplanes utahensis
atgaacgacagcaccctccggatcgtctggatctaccccgacctgctctccacctacggtgaccggggcaatctgctgatcctggcgcaccgggcggcggcccgcggcatcccggtcgagacctacgaggtccgctcggacatgccgatgccgacgaccgccgacatctatctcatcggtggcggcgaggacggcccgcaggcgctggccgcccagcgactgatcgccgacggcgggctgcaccgcgcggtcagccagggcgcctcggtgctcgcgatctgcgcgggttaccagctgttcggtcactcgttcttcgccaaggggaccaaatgtgccgggctcggcctgctcgacatcacctcggaccggggtgagagccgggcggtcggcgagctgcggggcgacatcgacccgcggctgggcctgcccccgctgaccggtttcgagaaccacggcggccgcacccacctgggcgcacacgccgcgcccctggcccgggtgaccggtggcatcggcaacgacgggcagaccgagggggcctgggccggcaagatcatcgggacgtattcgcacggccccgcgctgtctcgcaacccagcgctagccgatctgctactgcgttggtccacgggcgcggataggcttgcgcccctcgacgactcctgggccgaccggctccggggcgaacggctcgccgcggcgagcccggcttaa

SEQ ID NO: 1309 - DNA, 273 bp, Actinoplanes utahensis
atgaccgacacacctgatcaccacacgagcgtgccgtcccgccggaagcgcctggtccggctcggtctgctcgccgtcgtgatcggcgcgctggccgcggcctccgccctgctcccgctccgcgacatcggtgacgcggtggtcgcgctcggcccgggcgcggcggtcgccgtcgcggttctcggcggcctgctgctgtcggcgctggtcccgcggaccgcggtcacggtcgcctgcggcgcgctgctgggcgccgcgatcggcgcggtctag

SEQ ID NO: 1310 - DNA, 375 bp, Actinoplanes utahensis
gtgctgcaggcgcgggccggcggccggctggcccggctggacggctggctcaaccgccgcggcctggccgccgtgctgctggtccggttcctgccgctggcgccgttcggcctgatcggctacgcctacggcaccaccagcgtctgccgcaagcgctacctgctgggcaccacgatcgccgccatcccgtccacggtgacctacgcggtgatcggcgccgcggtggcctcaccgggccggatgaacgcgatcacgatcgcccccgcggtggtcagcttcatcctgtcgacggcgatcgtgctccgctggcgccacaccgcccgccgcgacgccgcaacggcaccgtcaactgccgattcggccgtacgggcgtag

SEQ ID NO: 1311 - DNA, 2796 bp, Actinoplanes utahensis
atggtgaagatgagcgagaccgacaacccgttccgctacaccgccgcgctggccggcgagatcgagctgcgctggcagcggtactgggcggagaacgggacgttccacgcgcccaacccgaccggcgagctggccgacccgggacacccgcgggccggcgccccgaaactgcacgtgcaggacatgttcccgtacccgtccggggcgggtctgcacgtcgggcacccgctgggctacatcggcaccgactgttacacccggttccagcggatggccggttacaacgtgctgcacccgatgggcttcgacgcgttcggcctgccggccgagcagtacgcggtgcagaccggcacccacccggcggtcaccaccgcggccaacgtcgagcggtaccggcagcagctgcgccggctgggcctggcgtacgacgagcgccggtccttctccaccaccgacccggagtactaccgctggacccagtggatcttcctgcaggtcttcaactcctggttcgacccggagcagggccgggcgcggccgatcgatgagctgatcgcctcctacgaggccggcgagcggggcgcggcctgggccaccctgtccccggccgagcggcgcaaggtgatcgacggccaccggctggcctacgtgagcgaggcgccggtgaactggtgccccggcctgggcaccgtgctggccaacgaggaggtgaccccggacggccggtccgaacggggcaactacccggtcttccagcgcagtctgaagcagtggatgatgcggatcaccgcgtacggcgaccgcctggtcgacgacctggacgcgctggactggccggagccggtcaagctgatgcagcgcaactggatcggccggtcgcagggcgcgcatgtcgacttcgccgtcgatgcggaccggatcacggtattcaccacgcggccggacacgctgttcggcgcgacgtacatggttctggctccggagcacgcgctggtctcgaagatcgtgcccgccgcatggccggccgggacgaaggaggcctggaaggtcgccggcaccccggcggaggcggtcgaggcctaccgggtcaccgccgccgccaagaccgaggaggagcgcaccgccgacggcaaggtgaagaccggcgtcttcaccggggcgtacgcggtcaacccggtcaacggcgcgagcatcccggtgttcatcgccgactacgtgctggccgggtacggcaccggcgcgatcatggcggtgcccggccacgaccagcgcgacttcgagttcgcgacggtgttcgagctgcccgtcgttcggacgatcgccactccggaaggttgcgagggtgcctacgtcggcgacggcgaggtgatcaactcggagttcctgaacggcctgaacaaggacgaggccaaggcggcgatgatcgcctggctggaggagcggggcaagggcgccggcgccaccacctaccggctgcgggactggctgttcagccggcagcggtactggggcgagccgttcccgatcgtgtacgacgagaccgggctgccgatcgcgctgcccgagtcgatgctgccggtcgaactgcccgacgtcgacgacttctcgccgcgcaccttcgacccggacgacgcggacaccgagccggagaccccgctgtcccgcaagaaggagtgggtgcaggtcgaactggacctgggcgacgggcccaggatgtacacccgcgagaccaacaccatgccgcagtgggccggctcctgctggtacgagctgcgctacctggacccgcacaacgatcacgcgctggtcgacccggccaacgaggcgtactggatgggtccgcagcgccccggcgacccgggcggcgtcgacctgtacgtcggcggcgtcgagcacgcggtgctgcacctgctgtacgcccgtttctggcacaaggtgctgttcgacctgggccacgtctcgtccttcgagccgttccgcaagctgttcaaccagggctacatccaggcgtacgcgttccgggacgcccgtggggtcatcgtgccggccgaggaggtcgtcgagcgcgacggcaagtggtaccacggtgaccaggaggtcgcccgggagtacggcaagatgggcaagtcgctgaagaacgtggtgacccccgacgagatgtgcgaccagtacggtgcggacaccttccgggtgtacgagatggcgatgggcccgctggacgtctcccgcccctgggagacccgcgcggtggtcggctcgcagcgcttcctgcagcgggtctggcgactggtggtcgacgaggagaccggggcgatccgggtcaccgacgccgagctggacccgaagtcgcgcaaggtgctgcaccgggtcatcgccggggtccgcgaggacatggccgagctgcggttcaacaccgcgatcgccaagctgatcgagctgaccaacacgctgaccccgctggcgacggtgtcccgcgaggcggtcgagccgctggtgctgatgctgtcgccgttcgccccgcacctggccgaggagctgtggggcaggctgggccatgcggggacgctggcgtacgccgacttcccgcaggccgacccggcccagctggtcgccgactcgatcacctacccggtgcaggtcaacggcaaggtccgcggccgggtcgaggtcgctccggacaccccggaggcggaggtacgggcgcaggccctggccgccgtggccgaggcgctgggcggcaaggagccgaagaaggtcatcgtggtgaagggccgcctggtcagcgtcgtcgtctga

SEQ ID NO: 1312 - DNA, 2382 bp, Actinoplanes utahensis
gtgagtcgtccaccgcggggtacgtatcacttggaggaagcccgtgacaacgccgacctggggcgagccgaccggaccgctgtcgaacgccgagttccgcaccgcgacgcaggccatcatgaccaacatcgagcaggtcatcgagggcaagagtgcgacggtgcggctggccctcgcggtcctgctggccgagggtcacctgctgatcgaggacgtgccgggcgtcggcaagaccaaactcgccaaggccctggcccgctccatcgactgctcggtccgccggatccagttcactccggacctgctgcccagcgacgtcaccggggtgagcgtctacaaccaggagacccgggacttcgagttcaagccgggcgccgtcttcgccaacctggtggtcggcgacgagatcaaccgcgcctcgccgaagacccagtccgcgctgctggagtgcatggaggaacggcaggtcaccgtcgacggcaccacctacgagctgcaggcgccgttcatggtggtggccacccagaacccgatcgagatggagggcacctacccgctgccggaggcgcagcgggaccggttcaccgcccggatcgcgatggggtacccggacccccgggccgagctggccatgctcggcctgcacggcgaccacgacccgctcaacgacatccacgcggtggccgatgccgcactggtccgccggctgatcgacacggcccgcgcggtgcacgccgcggacgccgtccagcagtacgcgatcgccctggtcaccgcgacccgggaggcccccgagatccgcctcggcgcgtccccgcggtccaccctgcagctgctgcgcaccgccaaggcggtcgccgcgctggagggccgcgactacgtgctcccggacgacctgcaggcgctggccgtgccggtgctcgcgcaccggctgatcccgaccgcggacgcccagctgaaccggcgcaccacggacaccatcgtctcggagatcgtgcaccggctgccgatcccggtggccaaccggaatccgtacgacacccggaccggcggcacgcagtacgagtcccgggggcgatgaccatgcgggaggcgctgcggggactcaccacgcgcggccgctcgttcctggccgccgcgatcgccgccggcatctcggcgctcatcctgggtgagcgcgacctgctgcgcgtggcggtgctgctggccgccctgccgttgctggccgcggcgtacgtcggccggagccgctacaagctggcctgcacccggtcgctggagccgggccgcgccccggtcggctccagcgcccgggtgatcctgcgcctgcagaacctgtcccggctgcccaccggcaccatgctgctggaggaccgcctgccgtacgcgctgggcagccgcccccgggtggtgctggaacgtctcggcgcgcaacaggccagctcggtggcctacaccgtgcgcgccgacgtccgtgggcggtacccgatcggcccgctggtgatccggctgaccgacccgttcggactgtgcgagctgacccgttcgttccccagcgtcgaccagctcaccgtgatcccgcaggtcacgccgctcccccgggtgcggttggccggggagtacgcggggaccggggacagccgggcccgctcggtggcggtgcacggcgaggacgacgcggccacccgggagtatcggcgcggcgacgacctgcgccgggtgcactggcggtccaccgcccgcaccggcgagctgatggtccgccgcgaggagcagccctgggagagccgggccaccgtggtgctggacacccgggcgatcgcgcaccgcggcgagggtccgaccgccagcttcgagtgggccgtctcggcggccgccagcatcgcggcgcacctgcgcgaggccggctacaaggtgcgtctggtcaccggcgacgggtccgacctcgacggcagcgagcccggcggtgacggcctgatcctggacgccctggccgacgtgaaactcgccgcggccggcgacctggcgctgctggtcgagcaggtccgccggcgatccgacggcggcctggtgatcggcctgttcggcactctcaccacggccgaggcgcagctgctcgggcagctccgcggcaacggcgcgacctgcatcgggttcgccatcgacagcgacacctgggtgccgatgaccgccggggaccggcaggagtcggaccgggagcacgcggcggcgtcactggcgctggtccgtggcggctggcgctcggtaccggtcacgcacggcgacaccctgccggcgctgtggcccacggtgggccgcggctcacagggcttcgcctaccgcgcggcgatggccgagacggtcagcggggtgacccgatga

SEQ ID NO: 1313 - DNA, 2466 bp, Actinoplanes utahensis
atgaccggccgccgtcgtctcggactcgtcgcggccggcgccaccctgctcggctcggccccgctcgccaccatcttcgacacctggagctggctgctgcgggtggtcttgaccgtcgtgatgatcgccggcaccgcggtgctcacccggaccctgcggttccccagctgggcgcaggcgctcggcatggtcgccggcctgctgatcacactcacctggatcttcccgagcgggcacgagctgctggtgccgaccccggccacgctggcgcacttcggcgacctcatccagcaggccggggacgacacccgggcgtacgccgtgccggtgcccgaccgcgacggcctgctgttcgtggcgacgctcgggatcggcgtggtcgccatcgtggtcgacctgctcaccgcggtgttccggcggccggccctggccgggctgccgatgctcgcgatctactccatcccggtcgcggtctacctggacagcgtcccggtcaccccgttcatcatcggcgcctgcggctacctgtggctgctggtcgccgacaacgtggaccgggtgcgccggttcggccgccggttcaccggcgacggccgggacgtcgacgtctgggagccgtccccgctggcctcggccggccgccggctcggcctggccggcgtgctggtggcggtgctgctgccgctgatcgtgccgaccgtcaacggcggcctgctgtcccagctcacccagggtggcagcggggccggcggcggcctcggcaagggcggcggccagatcaacctgttcgccaagctcagcggccagctgaaccagaccaccacggtcaacctgctcaaggtgcgcaccgacgagaaggacccgttctacctccggttcggcgtcgccgacctgctcagcaacgacggcttcagcaaccagccgccgggcggcaacacgctcaaggcgggcagcctgcccgacccgcaccacgacggcgcgaccgaccaggtggccttccagcagcatcacgccgacatcgaggtcagcgacctgctgcggcagagcatggccccgatgtactcgaacccgatcgcgatcaaggatctgtccggcaactgggcgtacgaccccaaccagcaggtgctgtactccaaccgcagcaacaccggcaagcagaagtactcgatcgactatctgcgggcgctgtacacgccggcccagctgcggaccgcgccggccctcgggccggacgacccgatgcgcaagctgttcaccgcccacccggacaacaagtacgtggacacgctggtcgccgggctggtgaaggggaagacgaacgactacgacaagatccgcgcgatctacgagttcttctcccgcaagaacaacttcaactacagcgtgtcgacccagtccaccgggaacctctccgacatcgaggcgttcctgaggaacaagaccggttactgccagcagtacgcggcggccatggcgtggatggtccgcgacgccggcatcccgtcccgggtggcgttcgggttcacccgcggcaccccgcaggacaacggtgcgtacgtgatcaccaaccgcaacgcgcacgcctggaccgaggtctacctgcagggcttcggctgggtgccgttcgacgcgacaccggccggctcggtggccggcgcgtcccgctcgaactgggcgccggacaccgaccggaccgcgacaccgaccgcctcggcgacgaccgcaccggtcgccggtgccagcgcgtccgccgccgcggccggcaccggcaagcgccccaaccgggccgatgacggcagcgacctggccaccggcggcaccttcgagagcgaccagcagagctggaccggcctgatcgtcggcgcggtggtcgccacgatgattgcgctgctgctggtcccggccctgcgtcgggtcctgctccggcgccaacggcacgccgcgaccgtcgggccacccccggcgacctcggtcgacccgggcatcgccggaccgtccggcgcggtcaccgggatcgaggtgtcccccgggtcggcgcaggcccgggccgacgcccacgcggcatgggacgagctgatcgacaccatggtcgacttccagttcgcggtcgacccgaccgagaccccgcggctgaccgcccagcggttggtcaaggaggccctgctggaagcggacgcggccggcgccgccgagctgctcggcacggccgaggaacgggcccggtacgcccgccagccgatgcagggcgccgaactgaccacggccctgcgccgggtccgcgccggcctggcccactccaccaccgggtgggtccggttgcgggccgcgctgttcccgccgtcgatcctgctcagctggcgtctcggcctggccgaggcgggcacccggacgatggaggcggccgccagcaccggcgatttcctgacccgcttcaacccccgccgcctgctcccccgcgggcggtag

SEQ ID NO: 1314 - DNA, 393 bp, Actinoplanes utahensis
gtgccgctctcggagcacgagcagcggctgttcgatcagatcgagcggtcgcttgccgaggaccccaagttcgcctcggctgtgcgggccagcgacccgcgtttccacgcacggcgccggctcatcatcgccgcgttcgtgatcgtgctgggcctggccctcgtcgtctacggagcggcttccggcaccgtgttgctcggcgtcgccggcttcgtcgtgatgctgggggcggccgcgttcgcgatgcagtcgcgcaaacgcgggcaggcccccgacctcaagtcggtcggcgggaccgcctcgcggcgcacccgtcagggccgtaagggcaacggcggtctgctggaccgcctggaggaccgctggaggcagcgtccggaggggcatcgctga

SEQ ID NO: 1315 - DNA, 1317 bp, Actinoplanes utahensis
atgagcgctgtcccggccgccggcgctgacccgggcggctcgtcgtccgccgctgatcgtctttccggcgccggtgcggatccgggcggcctgtcgtccgccgctgatcgtcttgtcgatgccggtgtggatccgagcgggccggctcccgacgacgggctgcatccggacgcgctgcggaccgttcatccggcgtacgggtcgggcagcctcgccgacctgctgcccagcgtcagtgccgtgctcggcgtgccgggcgcggccgacgtgctcggtctcggcgcccgcctggacggcgtcgaccggatcgccgtgctgctgatcgacggcctcggcgcctaccagctgccgctcgccgcgccgcacgccccggtcctggccgacctggccgccggcgggcgtgggcacgccgcgacgctgaccgccggtttcccgtccaccaccccggtcagcctggtcacgctcggtgccggggtgccgcccggcgcgcacggggtgctcggattcaccgtccgccgcccggacggccggccgctcacccacatcctgtgggacgacgacccggacccgcggcgatggcagccggtcccgacccggatggagctggccgccgcggccggggtgcgggtcaccgtggtcagccggccgcagttcgagggcagcgggctgtccctcgcggcgaaccggggcggcgtctaccgcggcgccgcggacggtgccgcggtcgccgacgggatgctggccgcgctgcgcgaggcggacgggccggcgctggtctacgggtaccaccccgatctggaccacttcgggcacgaggacggggtgggttcgccgagctggcgggcggcggcccgcggggtggaccggctgctggaccgggtggtgcacgggctgccgccacgctccgcgctgctggtggtcgccgatcacggccagctgaacgtgccgatcgagggccgccgggacatcgccgcgatcccggagctgcgggacggcgtggtcggggtcgccggtgagtcccgggtccgctacctgcacgtggcggacggcgcgcgggatgacgtgatcgccagctggcgcggggtgttcggcgccgaggcatcggtactgacccgcgaggaggcgatcgccgggggctggttcgggccggtgccggccgcgcacgccgggcggatcggcgacgtggtggtgatctgccacggccgggcggtggcgatcgcctccgggtgggaaccggtcaaggcgggacagctggtggcgtaccacggatcggtcaccgcggccgagatgaccgtgccgttgttgatcgcccgctga

SEQ ID NO: 1316 - DNA, 282 bp, Actinoplanes utahensis
gtgcgggcggcgtcggcgctggtcaccgacccggagggccggtccgggccgcgcgacacgctgcgccggcggtacgacgcggagaccgccgccgcgctcctgcggaccgcggggttcgaggtggagcagacccacggcgtacgggtggtcgccgacctgttgccggccgccgtgctcgacgaggacccgcaggcggtgctggagctggagctcgcgctgagcgcgcagccgccgttccgggacatcgcctcccagctgcacctgttcgcgcgccggccatga

SEQ ID NO: 1317 - DNA, 384 bp, Actinoplanes utahensis
gtggacaccgctatcgcacgtaccggccggccgctcgtcaccgcccgcaccgccgcggtctgggccgtcctgcgccgtgaactggagcgcaacgccggccgcgagctgaccgtcctggacgtcggcgggggcaccggcgggttcgctgtgccgctggccgaggccgggcacaccgtcaccgtgatcgacgccagcccggacgcgctggccgcgctgacccgccgggccgccgacgccggggtcgccggccgggtccgggccgtgcagggcgacggcgacgcgctcgccggcctggtcgagccgggcagcgccgacctcgtcctgtgccacgccgtgctggaggtggtcgacgacccggcgcgggtggtcaccgcgactagctag

SEQ ID NO: 1318 - DNA, 375 bp, Actinoplanes utahensis
atgttgctacgcatctgcaccggtttcgtcgccgcggtcgtcctggccaccgccgcgccggccgcggcggcccgaccggaatcccggctcgtcctcacctacgccggcgagacggggcgtccggcggccgtccggctcacctgcgacccggacggcggcgagcacccgaaagccgcccaggcctgcgccgaactcggccgggtcggcgccgacccgcggagactcaagcccgccgaccggctctgcttcatgctctaccagccggtgaccgcgcagctgcggggcacctggcggggccggccggtgaagtggacccagcggttcggcaacggctgcgagatgacccgcgccaccggggtgctcttcgccttctga

SEQ ID NO: 1319 - DNA, 3288 bp, Actinoplanes utahensis
ttgtgggccgctcccgggccggagcaggtcgccgatccgctcgtggtggacggtgacggcggtgatgcaccggcctggacccgcaagcgggagccgtaccgggcggctcccgggttggtccgttcggacgccgaggtcgcgtacgccgagttgcactgtcacaccaacttcagcttcctggacggcgccagccatcccgaggaactggccgaggaggccgcccggctcggcctgaccgggctggcggtcaccgaccacgacggtttctacggtgtggtccggttctcccaggcggcccgggagctgcgcctgcccacgattttcggggccgaactgtcgctgggcctgacccggccgcagaacggcgagccggatccggagggcacccacctgctggccctggcaaacggtcacgacgggtatgcgcggctggcccgggtcatctcgcaggcccagatccgtggcggggagaagggcaagccggagtacgagagtctggaacagatcgccgagatcctgcacgaccacgtcctggtcctgaccggctgccgcaagggcaccgtccggcaggcgctggccaccgaggggatggacgccgcggcctgggagctggaccggctggccgacctgttcggccggtcgaacgtggcggtcgagctgaccgatcatggtcatccgtacgacggggacttcaacgacgcgctgtgcaccctggcccgggagcgccggctggaggtggtggcgaccggcaacgtgcactacgccaccccggcacgccgtcggctggccaccgcgctcgccgccgtccgcgcccgccgcgggctggacgagatggacggctggctgcccgcggccggcaccgcccacctgcgcagcggtgccgagatggcacgccggttccgggactatccgggggcggtggcgaacgccgcgatgtacggcgaggggctctccttcgacctgaacctggtcgccccgcggctgccggactacgacgtgccgcccgggcacaccgagatgagctggctgcgggaactgaccatgcggggcgcccgggtccggtacggggagcaccatccgaaggcgtacgcgcagctggagaaggagctgcggatgatcgaggagctcgggttccccggctacttcctggtcgtgtacgacatcgtggacttctgccggcgcgagaagatctactgccaggggcgggggtcggcggcgaactccgcggtctgctacgccctgtggatcaccaatgtcgacgcggtggagtacgacctgctcttcgaacgcttcctcgccccggagcgggacggcccgccggacatcgacgtggacatcgagtcggaccggcgcgaggaggtgatccagcacgtctatcagaagtacgggcgggagcacaccgcccaggtcgccaacgtgatctcgtaccgcccccggtcggcggtccgggacatggcccgcgcgttcgggttctcggccggtcagcaggacgcgtggagtaaacagatcgatcgctggggcgacgtggccaccgccgacagcgacatccccgagatggtcgtcgactatgccaacgcggtccagaacttcccccgccacctgggcatccactccggcgggatggtgatctgcgaccggccgatcatcgaggtctgcccggtcgagtggggccggatgcccggccgcagcgtgctgcagtgggacaaggacgactgcgcggcggtcgacctggtcaagttcgacctgctcgggctcggcatgctgtcggcgctgcactatgcgtacgacatgatcgaggacgaactcgacatcggcaccatgcggctcgacgacgccgaggtctacacgatgctctgccgggccgactcggtcggggtgttccaggtggagagccgcgcgcagatggcgacgctgccccggctcaagcccacccggttctacgacctggtgatcgaggtggcgctgatccggccggggccgatccagggcggctcggtgcacccgtacatccgccgcaagaacggcctggagaagccggacgtgccgcaccggctgatggagaacgcgctgcgcaagacgctcggggtgccgctgttccaggagcagttgatgcagctcgcgatcgacgtggccggtttcgatccggccgaggccgatcagttgcggcgcgccatgggctccaaacggtccgtggagaagatggagaggatcaagaggcggttgtacgaggggatggccggcaacgggatcaccggggaactcgccgacgacctgttccacaaactgtccgctttcgccagctacggcttcccggagagccacgcgatgagcttcgcctacctggtctacgcgagcgcctggctgaagcggtaccacccggcggcgttctgcgcggcgctgctcaacgcccagccgatgggcttctactcgccgcagacgctggtcgacgacgcgcgccggcacggggttgaggtgcgccgcccggacatcaaccgcagcgacgcgatggccaccctggagaccaccccggacacccggcgcaaggccggggtgggggaggcgccgcaggtctgggggctcggcggcccggcggtgcggcaggggctgcgatcggtgcggacgatcggggccgacctggccgagctgatcgagaacgaacggcgggaacacgggccgtaccgctccatgaccgatcttgcccggcggaccggatgctcgatcgcgaacctggaggcgctggccacggccgacgccttcgcctccttcggattgtcgcgccgggaggcgctgtgggccgccggcgcggccgcccaggacaaaccggaccggctgccggggacggtgaccggcaccgaggcgccgacgctgcccgggatgagcgaggtggacctgctggtggcggacgtgtgggcgaccggactgtcgccggacacgcacccggcgcggttcctgcgggagcagctgaccggggccggggcgctgtcgatcgccgacctggggacggtggcggcgggcagccgggtgcgggtcggcgggatcgtcacccaccggcagcggccggcgaccgcgggcggggtgaccttcgtgaacctggaggacgagaccgggatgctgaacgtgacctgctcgccggggctgtggctgcggtaccgccgggtggcgcgcagcagtgcggcgctgctggtgcggggcaggctggagaaggtggaaggggtgctgaacctggtggcggacaggttggacgcgctgcacccgccggtcacaccagcctcccgcgacttccgctga

SEQ ID NO: 1320 - DNA, 1752 bp, Actinoplanes utahensis
gtgaggggaggggacgtgggggtggaggagggggtgcggacgctgatggtgtggtgtccggattggccggtggtggcggcggagatcgagttgggggtgccgggggacggggcggtggcggtgatggcgaacaaccgggtgctggcctgttccgaggcggctcggcgggagagtgtccggcgggggctgcggcggcgggatgcgcaggggcggtgtccgcatctgatcgtggtggagcacgacccggggcgggatgcgcggacctttgaggcggtggtggccgcggtggaggaggtcgcggccggggtggaggtggtgcggccgggggcctgcgcgctggctgcccgggggccggcccggtactacggaggggaggaggccgcggccgagcggatcgtcgagcatgtggcgcagacctgcgcggtggagagccaggtggggatcgccggtggggtgttcgcggccgggatcgcggcgcgcggcgggcagatcgtggcggtcggggggacggccgggtttctggccggcatgccggtggacgcgctggaccggcccgacctggccgacctgctgcgccggctcggggccaagacactcggggagttcgccgcgctgccggccggggacgtgctgacccggttcggcttcgacggggcgctggcgcatcggctggcccggggcggcgatcatcggccgctggcggtccggcagccgccggtcgacctggccgtcaccgagacgtacgacgagccgctggaccgggtggacaccgccgccttcgccggccgggtgctcgccgaacgactgcacgaacggctggccgggcacgggctggcctgcacccggctgggggtggaggcggtcaccgcggacgggcaggaactgcaccgggtgtggcggcacgacggactgctgggcgcggccgccatcgccgaccgggtgcgctggcagctggacggctggctgaccgggggccggcggtccgggccggcccggccgaccgccggcctggtccggctcagcctgatcccggacgggctgctggcgcacgccgggctgcaacccgggctgtggggggacgcgggcgccgaacgggaccgggcgcaccgggcgttcagccgggtgcagggcctgctcgggccggagtcggtggtgaccccggtgatcggcggcgggcggtccgggagtgatcaggtccggctggtgccgtggggggacgagcgcaccccggcccggccggccgcggtgcacgccgatccgattcccggtctggtcaccgttccggtgctcgaccgcgccatcgcccccgacctgcccggccgagagaacgggggcacggcaccccggaaaggcgcggcggcggagaggggcgcggcgggcgcggctgacggcgtacgccgcaatcggggtgaaggtgtgggtttgccgccgtggcccggacgtctgccgcggccgtcaccggcgatggtgctgcccgagccgcttcccgcggtggtgcatgacgagctcgggcttccggtcggcgtttccgcgcgtctggagctcaccggcacgccggccagcctggccgtcgggcggtcggcgccgctgccgatcaccgggtgggccgggccgtggccggtcgacgagcggtggtgggcgccggaggaggcgcggcggcgggcccggttccagatgtcgctggctgacgggcgggcgctgttgttgtcgctggcggcggggcagtgggtggtggaggcgatctatgactga

SEQ ID NO: 1321 - DNA, 972 bp, Actinoplanes utahensis
atggcagggcgcatgatcagcgggacggctgcgctcgcggaactggttcggccggcgagtgaggcggcggagccgggagcgcaccggatgctgccggtggccagtgagctgggcaacctgctgccggggcgcggactgcgccggggcagcacggtggcggtggccggaggccgggtggcgcgggccggcggggggacctcgctgatgctggcgctgctcgcggcggcgtcccgggcgggatcctggtgcgcggtggtcggactgccggcgctgggggcgctcgccgcggcggaaaccggcatcgtgctggaacggctggcgctggtgcccgaacccgggccggactggccgaccgtggtcgccgcgctgatcgacggggtggacgtggtggtgaccgcggtgcccgggccggtgtccgcgtccatcgccgggcggctggcggcccgggcgcggcagcggggcagtgtgctggtgccgttcggggactggaccggggccgacgtgacactgcgggtcggccgggggaactgggaaggcctcggagacggccgtggccggctgcgccggcgcgaggtcaccgtgctcgccggcggccgcggcgcggcggcccgccccaaagagctgaccctctggatgccgggcctgacgtcccgcccgggaaccccggcggccctgcccgtcggctcggccggcatgccggacgccccacccgtccgtccggtcgccgtacccaccctcccggaccttacggccgaccctcccggcagcacgctgcccgccccgggtaaccggccgctccgcgccgtcccggacctcaccgcgtcgacccccggcccggagcacccggagccgggggcgtccacgtcgcggcggggtggggcttcagcgcggcgtggacggtggggcaccggtccgcgtggcggtgagagggcgcggcatgaagtgccggccggggcctcagcgggcgagtga

SEQ ID NO: 1322 - DNA, 897 bp, Actinoplanes utahensis
atggcgagcagcacggcccacggcctgatgccggtcccgggtctgacagcggtttccggcccggatcccggcagggcggcacctcccgccccggcggcccccagccgcccaccttccgtcccggcggcctctgatcggccctcttctgctctggcggcctctgatcgggcctcttctgctttggcggcctctgatcgggccctctccgcttcggcggcctctgccctggcggcttccgccccggcctctgccctggcggcttccgccccggcctctgccctggcggcttccgccccggcctctgctctggtggcggctgcttcggcggcttccatcccggcatcttctactcaggcggtttctgcctcggcggtttctggcccggcatctcctgtttcggcggcttccgggcggggcctcgggtccgctcttgtggtgcccggtccggtgggcgtggggagtgcgcgggccgagatgccgactgttccggcgcatatgttgccgcagcggacccctgctcagctgctggcgatcgcgcggcaggggctggccgaggcggcgcatacggctcccgacggtctgcgatacgcggcggctcatctggccgccctgcgcgcggccgcggccctgctcgcggctcgggctcgtccgggcgcgcccggacggcgcaccaaggcgacgagcgtctggtcactgctggtgatggtcgcgccggagttcggcgagtgggcgggctatttcgccctaggcgccagcaaacgcgcggcggccgaggcgggcattccccaggtggtgagtgcccgggaggcggatgacctgctgcgtgcggccgagcagttcgtgacggtggccgagtcctccctgggcttctcctatcagcccccgttggcggcttga

SEQ ID NO: 1323 - DNA, 1059 bp, Actinoplanes utahensis
gtgggctggtggcagatcgacgccgacaccctggccggcagccggttcgtgctgtcgccgctggccgagacgaccgccgggctgatgcggctgcgctgggacagcgcggagcacccggccgaccggccctggctgcgcgcccaccggcccgcctaccgggcccggctggccgccgacccgatcaccgcgcggctggtggacgcggcgctgcggccgcactggatcgccgacttcatggcgccgccgcccgagatcgcggagcggtcgttcgcggcggaggtggcggtgatccgggccaccgtgccggcggcggcccggcagcacatcgcggagggattggccggtgggctgccggttgggcttggccgggaggatccgggggtgcgtgcctcggccgggcttgaccgggaggattccggtacgcgcagcctggccggcttgccggctgagcttgaccgggacgacctcggcgagcggatggccgggctgctgacctggctctggcagacggcgatcgcgccggactggccccgtcgccggcggatcctggaagccgacgtgctggcccggacccggcagctcacccagggcggctggcaggccgcgctgaacgggatgcgcgacgggatgcggtggctgggcggcgggcggctgcagatcaacgcgtacgactatccgccccgcgacatctccggggcgcagctgctcttcgtgccgaccacgctgggccgcggatgggcggcctgggagaatccggatccgacccggtacgcgctgatctatcgggcgtcgggcgtgctggccgagccgggacgggcggcgccgggggcgctggaacggctgctcggggccgggcgggccggggtgctggtggcgctggcgcagccgaagagcaccagccagctggtggcgatcaccgggctggggctggggtcggtggggcggcatctgagggtgctgctggaggcggggctggtgatgcggcggcgggcggggcggagcgtgctctacacccgcactccggcgggggagagtgtcgtgcgggcggcctcggtctga

SEQ ID NO: 1324 - DNA, 1224 bp, Actinoplanes utahensis
atgcgcacctatcgccagttgttccgcgtgcccggtttcgccccgctgttcgtcacctcgtgtctgcagaacgccgcggtcacggtggccgggctggccctggccaccggggtctgggaccgcaccggttcgccgctgctcgcggcgctgagcatgttcggtccgtcgctggcgcaactggccggcgcgacgctgctgatgtcggccgccgaccggtggccgccgcgggccgcgctgaccggggtggccgcgctgaccggtctgctgaccgcggtgttgagcgtgccggacctgccggtgccggcgctgttcggggtgctgctcgcgacgggcctggtcgcctcggtgggcggcggggtccgcaacggcctgctcaacgatctgctgccggcgggcggatacctgctgggccggtcgatgctgaacgtctcggtcggggtgacgcagatcgccggattcgcggccggcggcgcgctggtggccgtgctgtcgccggaccggaccctgctggcggcggcggccctgcacctggtggcggccgggctggcccgggtgggtctggcccgccgcgctgcgcgcgacccgggccggttgtcggtcgcggcgacgatgcgggtcaacgcgcggttgtgggcgatttccggcgtacgtccgatctttttgggcctgtgggtcccgaacggcctgatcgtcggctgcgaggcgatgttcgtgccgtatgcgccggccggggccgggctgctgctggcggcctcggcgctgggcatgctggccggcgacgtgctggccggtcgcctgctgccgccggtgtggcggcgtcgcctcgcgccgtttctgcgactgctgctggccgtgccgtacctgccgttcctgctgcatccggcgctgccggtcgcggtggtgctggccgcggtggcggcggtcggctactgctcgacgctgctgttgcaggagcgtctggtcgagctgaccccggccgagcaccggggtcaggcactcggcctgcacgcctcggggatgctcaccatgcaggcggtcggcgccgcgctggccggcacgctggccgagctgagctcaccggccgtcgcgatcagcgggatggccggcgcctcggtcgcggtcaccctggcgctggccggcccgttgcgcgcgacggccggccgggaaccgacgcccgcgacggcagaacccacggcggcggcagaacccacggcggcggcgtaa

SEQ ID NO: 1325 - DNA, 1950 bp, Actinoplanes utahensis
atgagcaccgagatcaacgttccggcggtggtggcgccggttcgcgagcggatgtcccagcggcccctgtcgaaatggctgctggcccaccgggtgcagccggtcggcccggagtcggagaatccggcccacgagcaggcctggtggaaggtgatgtgcctgaccggtgtggactacttctccacgctgtcctacctgccggcgatcgcggcgctggcggccggcgcgctgtccccgttggccaccctgttgatcgtggcgctgaccctgctcggcatgctgccgatgtatcggcgggtcgcccgggagagcccgcacgggcagggctcggtggcgatgttggagcacctgctgccgttctggcgcggcaagatcttcgtgctggtgctgctcggcttcgtctgcacgtcgtggatcatcacgatcacgctgtccgcggccgacgccaccgtgcacatgtcggagaaccccaatctcccgtccgccctgcacggccaccaggtgctgatcaccgtggtgctgctgctgatcctcggtttcgtcttcctgctcggcttcagcgaggcggtcggcgtcgcgatcccgctggtcgcgatcttcctgctgctcaacgcggtgatcacggcggtcggcctggccgacgtgttcggcaccccgggcgcgctgtccgcgtggaccgaccggctgaccgagcacggcagcggcttcttcgacgtcctcggcccggcggtcctcgcctttccggcgctggtgctcgggctctccggcttcgagaccggggtcagcatgatgccgctgatcaaggcggcggacggggaggcgcgggtccgcaacacccgcaagctgctcaccaccgccgccgcgatcatgagcgtctacctgatcgcgaccagcttcgtcaccacggtgctgatcccgcagaaggagttcgaggccggcggccaggccaacggccgggccctggcgtatctcgcgcatctgaaactcggcgaggtcttcggcaccgtctacgacatcagcagcatcctgatcctctggttcgccggcgcctcggcgatggccggcctgatcaacatcgtgccgcgctacctgcccggctacggcatggcgccggagtggggccgcgcggtccggccggtggtcctggtctacacggtgatcagcatcggcatcacgatcgccttcggcgccgacgtcaacgcgcaggccggggcgtacgcgaccggcatcctggcgatgatggtctccggcgcggtcgcggtgaccatctcggccttccgcgcccggcaccgcggcgccaccatcggcttcggcgtgctcaccctggtgctgctctacgcgctggccgacaacatcatcgagaaaccggacggcatcgcgatctccgcggtcttcatcgccgggatcatcctggtctcgctgatctcccgggtcacccggaccaccgagctgcgcgccgagcggatcgaattcgacgagccggcccggcgcttcatcgccgactcgatcaggcacgacggcgagctgaacatcgtggccaaccagcgtcaggacggcgacgaggcggagtacgcggtgaaagagggcgagcagcgcgggatgaacccggtgcccggccgggccgacatcctcttcctggaggtcgacgtggtcgacccgtccgagttcagcgaggtcctggcggtgcacgggatcgaggtcgggtcgcaccggatcctgcgggtgcagagcccggccgtgcccaacgcgatcgcggcggtgctgctcgcgctccgcgacgcgaccggggtgcggccgcactgctacttcgagtgggccgagggcagcccgctcggccacctgttccgctatctgctgttcgggcgcggcgacaccgcgccggtggtgcgggagatcctgcgccagaccgaggcgtctcccgacaagcggccgcgggtccatgtcggctga

SEQ ID NO: 1326 - DNA, 816 bp, Actinoplanes utahensis
atgacacagaccatcgtgatcaccggggccagctccggggtcgggctggccgccgccgagcagctcgccgcccgcggtgacgaggtggtgctggtcggccgcgacccgggccggctcgacgcggccgtgcagcgggtccgggaggccggcggcggccgcgcgccccggcacttccgggccgacttcgaacggctcgacgacgtgcgggagctcgccgccgggctgctggccgagctgccccggatcgacgtgctggccaacaacgccggcgggatcatcaagcggccccggcagacggtggacggccacgaggccaccatccagggcaaccacctggccccgttcctgctcacccacctgctgcgggagcggctgaccgggggccgggtggtgaacaccgcctcggcggcacacgtgcagggccggcccggcacccggttcaccgacgacccgaagtcgtacagtccgtggcgctcctacggggcgagcaaggcggccaacatcctgttcgccgccgaggccgcccgccgctggccggacgtgtgcagcgtctcgttccaccccggtgtggtgcgcaccaacttcggggagggccggctgatccggctgttctaccggtacgcgcccggcctggtcaccccggaggccgccggcgagctgctgacctggctgtgcaccaccccggccggggagctggagaacggcgcctactacgtcaagcgtcaggtgacccggccggccgcgcacgcccgcgacccgcggctggccgccgagttgtgggacgccagcctgaccgcgaccggcctcgccggatga

SEQ ID NO: 1327 - DNA, 675 bp, Actinoplanes utahensis
atgacgcacgtcgccctgcacgtctggcgggtgccgcgcagcgccgtcggctcggccatgctgcgcatggccttcgcgcggcgccatctggccggtctgcggttcggcaagttcctcggcaccggcaccggcaccggcttcggtcccggcgacaccgatctcacccggtgggcggcgatcacggtcagtgatgcgccggtacgtttccccgtctgggagcggatcgccgtcaacggcgcccggatcgatctggagccactgatcagccggggcacctgggccggccgtaccccgttcgagcccaccggccgccgcccggacggtccggtgctcgcgctcacccgggcccggctgcggccggctcgcgcgctgaccttctggcgggcggtcccggcggtggtgcgcgaggtgcaccgggcgcccgggctgctcgcccggttcggcgtcggcgaggcgccgatcggctggcagggcaccgtcaccgtgtggcgggacgcggcggatctcgtcgcgttcgcgtaccgtcagccggagcatcgcgcggcgatcgcccggaccccggccgaccgctggtacgccgaggagttgttcgcccggttcgcggtgctcgggatcagcggtgaccggtccgtgctgggctggaccgccgacgaaggggaacgggcggaagcatga

SEQ ID NO: 1328 - DNA, 579 bp, Actinoplanes utahensis
atgaggcttgtggcgtggcagccggacgacctgctgcggcggctcgacgacgtggtcggggtctacggcgaggcgatgggctaccgccaggagctgctgcagacccgccggggatacatcgggtcgcacgtgcgccggcccgggttccgggcggtggccacgctgaccaccgagggccggctgatgggcttcggatacggctacacctccgccgccggccagtggtggcacgaccaggtccggttcgctctcggcgaggacgaccgccggcagtggctgaccgactgcttcgaggtggtcgagctgcacgtgcgcccggccgcgcagggccacggggtgggcgcccggcagctgcgcgcgctgctggccatggccaaaggccgcaccgtgctgctgtccactccggaggccgacgagcaggcgtcccgcgcctggcggctgtaccggcggtacggcttcgccgacgtgctgcggcacttctacttcccgggtgacgagcgggccttcgcggtcctcggccgcgagctgccgctggccgagcgtccgctcgaggacgcaccgggcatcgccggcgcctga

SEQ ID NO: 1329 - DNA, 1374 bp, Actinoplanes utahensis
gtggcggcacccggtgcccgcgctgcccggcgtgcccggtgtgccgctcggcaactacctgggctggctcggcttcgcgctgctgctgatgaccgcgctggccgccgtcgccggccgggccgccgaccggccgctgtccgccgaccggccggcgctcgccctgtggatctggacgtacgcctcgtcggtgctcgcccacgccgtcttcctgtcgctgccggcgtccgcggcgtggggcgcgctgatcatgggcgccgcggtcctcccgctgctcgcccggctgcgcgcacccgcatgatcgtcgcctggctgatcctgccgccgctgctgctgatcaccgcacacaccgccgtcaacgcgctgctgctgcgccgcccgcgccgggcggcgaccagcaccgaacgggtcgccgtcctgctcccgctgcgcgacgaggccacccgggtcaccccgtgcctgcgcgccctgctcgcccagcgcggcgtcgccgatctcaccgtgcacgtgctcgacgacggctccaccgacggcaccgcggacgtggtccgggcggtcgccggcgaccgggtccggctgcacaccggcactccgccgccgcccggctggctcggcaaaccggccgcctgccaacggctcgccgacctggccggggacgtggacgtgctggtcttcgtcgacgccgacgtggtgctcgcgccggacgcggtggccggggccgtcgatctgctgcgccgggccggagcggacctgctcagcccgtacccgaagatcgtcggtgccggccggctggtccagccgctgctgcagtggtcctggctgagtttcctgccactgcgcgcgatggaacgctcggcgcggccgtcgctggccgccgccggtggccagtggctggtgctggaccgggccggttaccggcgagccggtggccacgccgcggtgcgcggcgagatcctggaggacatcgcgctggcccgcgcggtcaaacgggccggcgggcggatcgccctggccgacggttccggcctggccacctgccggatgtacgagtcctgggacgagctcgccgacggatacgccaaatcgctgtgggcgtcattggggtccgcggccggcgcgaccgccgtcacgctcctgctgattctgctgtacgtggtgccacccctgctggcgcccttcgccccgcttccggcggtgctcggctacctgctcggcgtgaccggccggatgatcgccgccagggccaccggcggccgcgtcctgcccggcacgctggcccatccggtctccatcgtcctgttcggctacctgatcgcccgctccttccggctgcgccgggccggccgcctggcctggcgcggccgcccggtgccctga

SEQ ID NO: 1330 - DNA, 1437 bp, Actinoplanes utahensis
atgagcgacatcgtggtggtcggggctggggtcggcgggctggccgcggcgatccggctggccgaggcggggcatcgggtcagcatccatgagcggtccggcgtggtcggcggcaagctggcggcatacgagagggacggctaccggttcgacaccggccccagcctgctcaccctgccggacgtgttcaccggcctcggtctggacctgcgcccggagccgctggacccggtggtgcggcacttcttcccggacggcacggtgctggactcgtcgtcggaccacgagaccttcctggcccggatcaccgacgcgctgggcggtgccgcggcgcgcgactgggaccggttctggcgccgtgccgagcggatctggcacgcctcctgggagtcggtgctgcgccgcccggtgaccgcggcgtcgctggcccggctgtcctggcggctcggtgacctggccgcgatcgctcccggccggtcactgcggtcgctgggccgccgctatctgcgcgacccgcggctgcggatgctgctggaccgctatgcgacgtattcgggcgcggatccgcggcgggcgccggcggcgctggccgcgatcccctacgccgagctggcgttcggcgggtggtatctgccgggtgggctggtcaccctcgcggaggcgctgctcgcccgatgcgagaaactgggcgtacgggtgcatctgcactcaccggtcgcctcgatcgccacgaccggcgcccgggtgtccggggtccggctgggggacgggacccgcctcgcggcggacgtcgtcgtctccaacgtggacgccgtcacgctctaccgggatctgctgcccagtccgaaaccgctggcccgcctcgccgaccggagcctggccggattcgtgctgctgctcgcggtgcggggcgagactccgcggctggcgcaccacaacgtgttcttcccgcgggactacgacgccgagttcgacgcggtcttcggggggccggggcggcgggcgcggccggccggcgacccgaccgtcttcgtcacccgggccgcggatccggcggtgcgcccggccggcgacgaggcgtggttcgtgctggtcaacgcggcgccacacggcacctcgtggtccaccgtggactggctgcgggcggggctggccgacgcgtaccgggatcgggtcctcgaggtcctggcggggcgcggtctcgacgtacgcgatcggctgatcttcgccgagacccggaccccggcggatctggcggcgtcggccgcagcgccgggcggagcgatctacggcaccgccggcggcctggtccggccggcgaaccgcgcgccggtcgacgggttgttcctggtcggcggctcgacgcatcccggcggcgggctgccgatggtcaccctctccgccgagatcgtcgcgggcatgatcggatcgaactga

SEQ ID NO: 1331 - DNA, 1722 bp, Actinoplanes utahensis
atgcccgagaacgagtggcccgacgacccccgcccgcccgaccagggcgagtggagccagccgcatcacgagccgccacccggccgtggccgcgccctgctggccgccgcggtggtggtgctggtcctgctggccgccggcggcatcgcctggcgtctgatgagcagccgcggcgctacgccggtggcgcagcccaccgcgcccgccccgacgcccaccgcgcagaccgcgccaccctgcccacagccgcgcctgcgggtcgccgccgcgccggagatcgccccggtgatccagcaggccgccgccgcactcagccagcccggccagcgctgctccgaggtgctggtgcaggccgccgagccgggcgccgcgctgaccggcaagccggacgtctgggtgccgtccagcagcgtgtggctggccctggccaaaagccgcggcgacgtctacaccacgcagggcgcgtcgctggcctggtcgccgctggtgatcgccgggccggagtcgatcgccagcctgttcgcgccgaacggggtcacctcctggtccggcctggtccagggcaccatccagaaacgggtgccggcggtccggatgcccgatccgacgctgaccacgaccggactgctcagcgtctacgcggtgggccaggccacggtcaaggccaacccggacgccgggatcgcccagttgcaggcgctcaccctgcgcagccggctggagaacgcggccgccgacccggcggaactgttcgcgcagatgggcaagcagaccgacgcggccacggcgatctaccaggtcggggtcttcccgaccaccgagcagcagctgctgacctatcagaagagtcagcacgacgtccggctgtccggctcggcgcccgccgacggccagatcgacgccgactatccgtacgcggtccgcaagggcgccccggccgacctggtcgagagccttcgcgaggcgatcaccccggacgcgctgacgacggccggattccgggccaccgcgaccaagaacgcgctgcgcctgccggccccggccgtgctcgccggggcggcccggcagtggtcggcgtacaagtcggtggccttccaggtgctgctgctgatcgacgcgtccggctcgatgaacgagaagatcaccgaccgggccggccgcagcgtcaccaaggccgcgctgctgcgcgagtccgggaccagcgcggcccagctcttcggtgacgacaccagcctcggcctgtggttcttcggcaccccgacggcggacagcccggcgcacaccgaggaggtgccgttcggcccggtcatcgccaccgtcgacggcaagagccgccgtgacctgctggccgccaagatcggcgagtaccggccggtggcgaacgccgggaccccgctctaccagagcgtgctggacggcgtcgccgagatgcgcggccgggccaagccggacacggcgaccgtggtggtggtcctcaccgacggctcggacggcggcacgaagtaccggatgtccaacgcggacttcctgaagaagctgaccgccggtgccgaccccgccaagccggtgccggtgatcgccgtcggttacggcccggccgcgaacgccaccgccctgcaggccatggccaaggccaccggtggccaggcggtcaccgtcaagaacccggccgacctggccgccggcatcgcccaggccttcctcgccgcacacacccactag

SEQ ID NO: 1332 - DNA, 750 bp, Actinoplanes utahensis
atgggcgagttccacgacccgcgactcgtcgaggtctacgacgccgaatgtccctggggctgggacgacgacttcttcatggccgtgctcgccgaacgctccgcgcaccgggtcgccgacctggggtgcggcaccggccggctggccatcgcgatggccgcggccgggcacgaggtgatcgcgatcgacccggcgccggccgccctggccgcggcccgccgcaagccgggcggcacccgggtgcgctggctgcagggctcggccgagcggctcgccccgcgctcgctcgacgccgcgttcatgaccggtcacgtcgcccagtccttcgtcgacgacgaggaatgggacaccgtgctccgcgggctgcgccgggcgctggtcccggagggacggctggtcttcgacagccgggacccggacgaccggccgtggcagcagtggaacccgcaggattcgtggcgcaccgtggtgctcgacgacgggagggtggtggaggcgtggagcgaggccgagcaggtcgggctgaacaccgtgcgcgtcaccgggcgctaccggttcgccgacggaggggaactggcgaactcggcgaccctgcgtttccggaccgagccggagctgcgcgactcactgcgcgaggcgggcttccgggtcgagcggatctacggcggctgggggcgcgagccggtgggtctgagcggcgacggcgagttcatcgtgatcgcggtcgcgacgccccggctgatgtcctga

SEQ ID NO: 1333 - DNA, 933 bp, Actinoplanes utahensis
gtgcagctgcaacaactccggtacttcctggcggtggtggagacccggcatttcacccaagcagcggacattctgggcgtctcgcaacctaccttgagtaagcagattcacacccttgagatgtcactcggagccccgctgttcgagcggatgcgcggtgcggtgaccctgaccgtcgccggcgagacattgctgccgatggcccagcggatcgtcgccgacgccgacgcggcccgcgacgccgtgcaggacatcgtcggtctgcgccgcggcgaggtgcgcctgggtgccaccccgagcctgtgctcctcgctggtcccggccgtgttgcgcaccttccgcgccgaccacccgggggtcaagctgcacatcagtgagggcagctcgcacgacctgaccgccggcctgctggcgcacaccctggatctggccctgatcgtgcagcccgagcacggcgtcgatccggccctggtggccatcgagctgctgcgcgagagcctggtggtggcctcggtcgcggccggcccgccgcccaccgtgggccgccaactggagctctccgagctgcgccacaccccgatggtgatgttccgcgagggctacgacatccgtgaggtcaccctgcacgcctgcgagcgggccggcttcgcgccgaagttcgcggtcgagggtggtgagatggacgcggtgctcgccttcgtcgaggccggcctcggggtcgccctggtgcccagcatggtgctcgccaaccggccgctgctgcgggccaccccgctcgcgccgccggggatgcgccggaccatcgcgctcgcccagcgccgtgccgcggtgctgccgcatgccgcggccgcgctgcgtgaggtggtgctcgaccacatcggctcgggccggctgccgttcggcgtgcgcgccctggagagaccgtccacttag

SEQ ID NO: 1334 - DNA, 741 bp, Actinoplanes utahensis
gtggcggtagacactcctattcccaagaccaagaacgcggcgggggcgacggcaacgcccaccccgcgcaaggtcgtccggccctcgtcggtgaccctgaagatcatcatggcggtcagcggcatcctgctggtcctcttcctctacgttcacatgatcggcaacctcaagatcttcttgggtgccaccgacttcgaccactacgcgcactggctgcgcgcgctcggcacgcccctgctgccggacatgtggtacctgtggatccagcggaccgtgctcaccgtcgcggtgatcgcgcacatctggacggccgccgtgctgaccatccgcgccaagaaggcgcgcccggtcaagtacgcgcaccggcccaaggtgcagggcagctacgccgcgcggacgatgcgctggggcggcgtcatcgtcctgctgttcatcatcttccacatcctggacctgaccaccggcacggtgaacccggtcggggaccacgagcacccgtacgcgaacgtggtcgccgacttcgcgccgcaccgctggtacgtgacgctcttctacgccctggcgatcgtggcggtcggcttccacctgtggcacggcatcttcagcgcggcccgcaccctgggccagcagaccatgcggggccagcggcgcgccaagacgatcgccctggtgctgtcggtggttctggtcgtcgggtacctctcggtgccgttctcggtgctgaccggattggtggactga

SEQ ID NO: 1335 - DNA, 1947 bp, Actinoplanes utahensis
atggctgagacggatttctggaaagagggcgacccggtcgtcgacaaggccgccccggacggcccgatcgagacccgctgggagcgccgcaagttcgccgccaagctggtcaacccggcgaaccgccggaagctgacggtcatcgtggtcggcaccggcctggccggcggctcggccgccgcgaccctggccgagcagggttaccacgtcaagtcgtactgctaccaggacagcccgcggcgcgcgcactcgatcgccgcgcagggtggcatcaacgccgcgaagaactaccgcaacgacggcgactcggtctaccggctgttctacgacacggtcaagggcggcgacttccgcgcccgtgagtccaacgtgtaccggctggcccaggagtcggtgaacatcatcgaccaggccgtggcgcagggcgtcccgttcgcccgtgagtacggcggcctgctggacaaccgctcgttcggcggcacccaggtgtcgcgcaccttctacgcccggggtcaaacgggccagcagctgctgctcggcgcgtaccaggcgctggagcggcagatcggcctcggcaacgtcgagatgaacacccggcacgaaatgctcgagctgatcatcgtcgacggcaaggcccggggcatcgtggtccgcgacatgatcaccggcgagatcaccaccgagctcgcggacgccgtggtgctcgcctccggtgggtacggcaacgtcttcttcctgtccaccaacgccatgggctgcaacgtcacggcgacctggcgggcgcaccgcaagggcgcgctgttcgcgaacccctgctacacgcagatccacccgacctgcatcccggagtccggctcgcaccagtcgaagctgaccctgatgtccgagtcgctgcgcaacgacggccgggtctgggtgcccaaggcgcagaaggacacccgccgcccggcggacatcccggaggacgagcgcgactactacctggagcgcatctacccgtcgttcggcaacctggtgccccgcgacatcgcgtcccgggccgccaagaacgtctgcgacgagggccgcggcgtcggccccggcgggctcggcgtctacctggacttcgcggacgcgatcagccggctgggccgcaaggcggtcgaggcgaagtacggcaacctcttcgagatgtaccagcggatcaccggcgaggacccgtacgagacgccgatgcggatctaccccgcggtgcattacacgatgggtggcctctgggtcgactacgacctgcagtcgaccatccccggcctgttcgtggtcggcgaggccaacttctccgaccacggcgccaaccggctcggcgcgtccgcgctgatgcagggcctggcggacggctacttcgtgctgccgaacacgatcaacaactacctcgcggccgggccgttcaagaagatcgcgaccagcgacgaggcggtcgtgtcggcccgcaaggaggtcgaggaccggatcgccagattcctgtcgatcgacggcgaccggaccgtggactccttccaccgcgagctcggccacatcatgtgggagtactgcggcatggagcgcaccgaggaggggctgaccaaggcgatcggcctgatccgggcgctcaaggaggagttctggacccgggtcaaggtgcccggtaagggcgaggagctcaaccagaacctggagaaggccggccgggtcgccgacttcatcgagctgggtgagctgatgtgcatcgacgcgctgcaccggcgggagtcctgcggcggccacttccgggccgagtcgcagaccccggacggtgaggcgctgcggcacgacgacgagttcggttacgccgcggcgtgggagtacttcggtgccgacggcaagccgaccctgcacaaggaagagctcgttttcgagtacgtccacccgagcacgcggagttacaagtaa

SEQ ID NO: 1336 - DNA, 744 bp, Actinoplanes utahensis
atggacatcaaggtcagggtgtggcgtcagtccggcccctcctcctccgggaagatggtcacctacgacgtgaaggggatctccccggacgcgtcgttcctggagatgatcgacgtgctcaacgagacgctgatcctttccggtgacgacccgatcgcgttcgaccacgactgccgcgagggcatctgcggcgcgtgcagcatggtgatcaacggggtggcgcacggcccggagaaggccaccaccacgtgccagctgcacatgcggcacttctcggacggcgacgtgatcgacgtcgagccgtggcgtgccgccgccttcccggtgatcaaggacctggtcgtcgaccgcagcccgctggacaagatcatccaggccggcggttacatcagcgcgcccaccggcaccgccccggacgcgcacgccgccccggtcccgaagaaggacgcggacgcggccttcgaggcggccacctgcatcggttgcggcgcctgcgtcgcggcctgcccgaacggctcctcgatgctgttcaccgcggcgaagatcacccacctcggcctgatgccgcagggccagccggaacgcgacagccgggtgatcgacatgctgcaggcgcaggacgacgccggtttcggtggctgcaccaacatgggcgagtgcaccgaggtctgcccgaagggcatcccgctgagcctgatcggccggctcaacagcgactaccgcaaggccgtcgccaagcgctga

SEQ ID NO: 1337 - DNA, 399 bp, Actinoplanes utahensis
gtgacaccgcaggagatcttcgtgcgcatgcgcgagcgatggctgtccggcgacgcgacctatgacgaggcgatgctcgcggaggatgtggtggtcgagacgccgttcgcggcgccggggcggccgacccgcaccgaggggcgcgagcgggtcctggagcaggcccgggccgggcgggccgggttcccggtgcggttcgacgactgccgggcggtggtgatccacgagaccggtgaccccgaggtgatcattgtggaatacgagctggtggggacgcacacggtgagcggacggcgggcggccgcgccgttcatcggggtgctgcgtacccgggacggggtgctggccggctggcgggagtatcagcacaccatggccatcgccgcggccacggcctga

SEQ ID NO: 1338 - DNA, 561 bp, Actinoplanes utahensis
ttgccaccggatgccgacggtcccccgctgcgcgccgacgcccagcgcaatcgggcacgcatcctggacgcggccgagaccgtcttcgccgagcgcggggcgaccgcgtcgaccgacgaggtggcgcgccgggccggggtcgcgatcggcaccgtcttccggcacttccccaccaagaacgacctgctcgcggagatcatgaaacgcctgctccggcggttgaccgccgatgccggcgagctggccggccgcggggacgggctgttcgagttcttccgccggctgatcggcgaggcggccgccaagcgatcggtggtgcagctgctggccggctcgggtctcgagatccgcctgccacagaccatcggacagctggagtgggcggtcggcggtctgctgaccgaggcgcaggcggccggtacggtggccgccggcgttcagctgcccgaggtgatggccctgctggtcagcctctgtcagggggcgctgcacggcggctgggacgagacgctgcgggagcgcaccctggccgtggtgttcctgggtctgcgggcggcctga

SEQ ID NO: 1339 - DNA, 222 bp, Actinoplanes utahensis
gtggcggatggacgatctgcacgcgcccactcccgaggtgcccacaccctgccggccatgcccggcgcactgcccgtccatcacgtcacggccgccgcggcgctccgcgcttatgatgtacgtcaatccgccctgttcctgatccgtccggacaactacgtcgggtgtgccacggacgacccccgggacatcctcgatcacctgccgctgatcagcggctga

SEQ ID NO: 1340 - DNA, 1143 bp, Actinoplanes utahensis
gtgcgccggaacgccgtgctgttcgtgctgatctcgctctgctccggcttcggcggcagtgcgctcgccctcgccgccggactctgggtgctcgacctcaccggctcgcccgggctggccgcgctggccgggctcggcacgtacgccccggtgctggccgcgccctggctcggcgccctggtcgaccgcttcccccgccgcccgctgctgatcaccgtcgacgtgctggtcggcctggcgatcctggccctgctgctcgaccccgccccgaccggcatctacctggtcctgctcgtccgcgggatcggctacgtgctgctggacgccggggagaccgcgctgctgccggccgccctgcccgccgggctgctcggcgatgtcaacggctggcggtccagcgcccaggagggcatgaaactcgtcgcgccaccggccggggccgccctctatgcctggcacggcccgcgtccggtgctgctgctctgcgcggcgctcccgctggtcaccgcgctgctgtacgccatggtccggctgcgcgccgcgcccgcggtcccggcggccggcccggcgctcgaccggcgcggcgtccgggccgggctgaccgagctgtggcgggcgccgatgcgcaccccggtcctggtggcggcggtggccatcgcggtctccgggttcaccaacgccgcggtgctgcggcacctcgtcgacgacctgcaccgcccgtccacctacctcggcgtgctgtccggtctgcagggcgccggtgcgatcgccggtgggctgctggccggccggctgctcgcccgcctgcgcccggcccgggtcgcggcgctcggtgccaccctcttcgcggccgcctgtctgacctgggcactgccctggtggccggccatgccggtgggcagcgtgctgaccggactcgggctgccgtggacgctgatcgccgggatcaccgcgatccagaccggcaccccggaccggctgctgggccgggtcggggccaccggcagcatggtcatgttcgggccgatcaccctgggcatcccgctcgggtcggcgctgtccggcgcgggcgcccggccgccgctgatcatcggcgccgcgctgacgctcggcgtggcgctggccgcgcgggtcagccgctga

SEQ ID NO: 1341 - DNA, 252 bp, Actinoplanes utahensis
ttgcgggagagcgccgccgagctgcaccgacggatcggtgccgatcgccggtgggacgcccgtttcccgcgcgccgcgctggttcgcgagatcctgtcgagcgcccccgacgccccgcccggagcgctgttcgacctggttgccggtgctctcgcggacctgtccgggccgccggtgccgcgcctgccggccccgatgcgggccgccgtcgaccggcttgcggcgagcctggccgcggcaagcccggattga

SEQ ID NO: 1342 - DNA, 123 bp, Actinoplanes utahensis
gtgaccgacctcagtgcgttgcgggcaatccgggagcggcgggcccggctggacgccgaggaactggcgctgatcgatcaggctcgccgggccggggccacctggccggccctagctagctag

SEQ ID NO: 1343 - DNA, 708 bp, Actinoplanes utahensis
atggtcagcgagttgccgcgtacgttgaaggtgctctggggggtggcggagcgacccacccggggcccgcagccggcgctgagcctggaccggatcgtcgccgcggcgatcgggatcgccgaccgcgacggtctcgcggcgctctccatggcccgcctcgcggaacggctcggctgcgcgccgatgtcgctctaccggcacgtggccaacaaggacgagctgctggtcttcatgcaggacgcggcgcccggtgagccgccgcggttgccgccggggtggcgcgacggtctggccgcctgggcccgcgcgctgcgcgccgtgctcgccgcgcatccgtggatcctgcaggccaccgcgggccggccgcccctcgaaccgggtcagctggcctggctggaccggggcctctcggcgttcgccggtaccccactgagccaccggctccgcggcgagatggtgatggccgcgctctacctggcgcgcggcgaggcgcagatcagcgcggtgctgctcagcggggtgccggacgtggtcgccgactacggggcgctgctggcccggttcgtcaccgcggagcggttcccggccctggcggaggcggtcgcggacggcgccttcgcggaggctgccgggccggacgagtccttcgagatcggactggcccggctgctcgacggtatcgagctcctgatgtcaacgtttgattga

SEQ ID NO: 1344 - DNA, 627 bp, Actinoplanes utahensis
atgactcgatggtggcggcgcccgtggatcgtcccgctcgcggcgatcgtggtgctcttcgtgaccttctccctcccgccgtatctgagcttcgacccggcccgctcccgggtgccccagccgcccacgctcggcgtcgcgcacttctggctgctggtgccgcacgtgctcttcggcagcgtggcgctgggcaccgcggtggtgcagatctggccgtggttccggcagcggcacccggtggcgcaccggcggatcggccggctctacgtgttcggcggggtgctgccggccggagtgtgcgcgctgacgatcggggcgttcaccccgtacgggccggtcacccgggccagcgacgtcctgctggcgctgctctggctcacggtgaccaccgccggctggcgcgccggccggcgccgccggttcggcgagcaccgccggtggatgatccgcagcttcgccctgaccgcctcgatcatcaccaaccggatctggggagcggtcttcgtgatcgggctgaccccgcggctggacaccacgttccacggcgacgcgggcctgctgacctgggtggcgtcctcggcggcggcgtggctggggtggacggttccgctgctgctcgctagctag

SEQ ID NO: 1345 - DNA, 267 bp, Actinoplanes utahensis
atgaggcggcgatcgcccggggttaacctgtgcaccgtcgcgttgatgatcgttctggacagcaccatcgtcgccgtggccgtcccggtcatccagcgcgacctcggcttcaccccggccggcgtggcctgggtgatcaacggctacctggtcgccttcgccggcctgctgctgctcgccggccgcctcggcgacctgctcggcacccgccggatctgcctggccgggttgctcgtcttcaccgccgccagcctgctctgcggctag

SEQ ID NO: 1346 - DNA, 1077 bp, Actinoplanes utahensis
gtgggtgacgaccgcaccatcgccgcggtccgcgcccgggcggtcgatctgcggctggaccggccggtggagacggccggcggggtgatggcgaccaccccgctggtgctgatcgacgtccacacccgggacggggtggtcgggcggtcgtatgtgcgctgctacaccccactggcactgggcccgctggcgagcctggtcggtgcggtcggcgaggcgctcgtgggcagcagcgccgccccgctgaccgccgagcgggcgatgcgccggatgttccggttggccggtccgcaggggctggccgggatggcgacggccggcatcgacatggcgctgtgggacgcgcgtgcggtcgccgccgggctgccgctggtgacgctgctcggcggggagccggggccggtcgacgcgtacgcctcgctgcgggtgatggacgcccgcgccgccgcggccgaggcgcaggaactgctcggcctggggttcaccgcgttcaaggtgaaggtcggcgggcgatccctcgcggacgacctcgcggtgatccggacgctgcgcgcggtgatcggcccggacgcccggctgatggccgactacaaccagagcctcacggtgaccgaggcgatcgagcgggtccgggtgctcgatcacgagggcctgtactggatcgaggagccgaccaccgccgaggacttcgccggtcacgcgcggatcgccgaggcggccgtcaccccgatccagctgggcgagaactggtggggcgtgtccgacctggccaaaagcatcgcggcccgagccggcgaccacgccatgctcgacgtgatgaagatcggcggggtgaccggctggctacgggcgatggcggtggccgacgccgccggcctgccggtgtccagccacaccttccccgagttcagctcgcacctgctcggggtcacgccgagcgccacctacctggagtacctggaccacgcccggccgatcctgaccgagccggtcgtggcgcgcgacggtcaggtgtggatcgcggaccgtccgggcgccggcatcacgtgggatgaggcggcgatcgcccggggttaa

SEQ ID NO: 1347 - DNA, 1221 bp, Actinoplanes utahensis
atggtgctcaggaaagtggacgcggcaaccggggtcggccggcggcgactactcggctggggcggtctggccgcggccggcgcggtcaccggcggcccgccgacccgcgccggcgcggaccggttgccgccggacacccttcccggcggcgcctacgaccgctacgtggcacggctcgcggcgcagggccggttctccggcgtggtcatgctgtcgcaccgcggccggacggtgctgtcccgcgcctacggcatggccgaccgggagcggggcatccgcatccgggagagcaccgcgttcaccttgagctcggccggcaagccgttcaacgcgatcgccgtcctgcaactggcacagcagggccggctgcggctgaccgacacggtcggcgaccacctggacggtttcgaccgggacgtcgcccgtacggtgaccatccatcacctgctctccggcacctccgggctgagcatcccggacgaggacgtccagcggatcttccggagccgggccgaggtccacgagtaccagctgcggtgggcgcggcagtcgagactggtcggcattcccgggcagcaggaccgcgagcacgtcggcgccgagacggtgattccggccctgatcgtggagactgtcagcgggatgtcctactgggactacgtggagcagcacgtgttccggcgctgcgggatgaccggatcggcgttcttcacccggccgcagtggctcaccgacccgcgcctcgcccacccgtacatgaccatggccgacggcagccggctcgacgcggtccggcacctggaccggggcagcccgctcggctacctccgcgaccggaatccggggcgtgccttcatcgacgcgatcggggacggcggtttcgccaccgcaccggacctgatccggttcgcccacgcgctgcgcgacggcaccctgctcgaccggccctgggcggacgtgctcaccgcgccgaagatcccactggggccgggagcgttcggcacctacggcccgcccgccgcgatcaccggcggtcagtgggccgtgcagcgcgccggcggcaaccccggggtctgcgccaactggagcatctacccggacaccgggtgggccggcgtcatcctggccaaccgcgacgacgtgcccctgccggagatgatcgggcaggagacgctggcggtcaccggggtcgcacccgccgacggcggcagcggtgggtga

SEQ ID NO: 1348 - DNA, 438 bp, Actinoplanes utahensis
atgagcgcggttctggtgctgaacgcggactgcgggccgctgcaccgggtcagcctccggcacgcgatccggatgctgttccgtcaggtggcggtcgtgcacgaggcgcggccggacgcgaccatcggcgtctatcaggtgcccaccgtggtgcgactggtcagctatgtggtgacccgctggcggcgtggccgcggccccggctggtcccgggccggcgtgctggcccgcgaccgtcgcacctgcggttactgcggcgagccggccaccaccatcgaccatgtactgccccgctcgcgcggcggcgggaatgagtggctcaacaccgtggccgcctgcggccgctgcaacaaccgcaagggcgaccggaccccggccgaggcgcggatgccgctgcgcgtcacgccgtacgcgccggcctgggtgaccttcgcctga

SEQ ID NO: 1349 - DNA, 1158 bp, Actinoplanes utahensis
atgccggccgcagccgcttcccgccgcccagcacgaactcggagaccgtggcggacatctcggccagcgccgggtcgatcgccagcagccggtcacgctgcccggccaggaacacggtcagcgccttgtcgacacgcgaccgcagaccggcctcgtcgagcggggagttcgtcacgcgtcgacgctacttgttcgccgccgcgggcccgtccaccggcccggtatggttccggtgtgtctctcggacttccctcccggctgcccggcaccccgtcgatcggcgacctggtccgcggcgcggcgccgacgttctccttcgagttcttcccgccgaagacaccggacggggagcggctgctctggcaggccatccgggagctggagtcgctgcggcccagcttcgtctcgatcacctacggggccggcggcaccacccgggagaccacggtcgcggtcaccgagcgggtcgccaccgagaccacgctgctgccgctggcccacctcaccgcggtcgaccactcagtggccgacctgcgcaacgtgatcggccggctggccggcgccgggatccgcaacgtgctggcgctgcgcggcgacccgccgggcgacccgatgggcgagtgggtccggcacccggacggcgtcggttacgccgacgagctggtccggctgatccgcgagtccggcgacttcagcgtcggggtggccgccttcccgcacaaacacccccggtcggccggcgtcaaggacgacacccgcaacttcgtccgcaagtgccgggccggtgccgactacgcgatcacccagatgttcttcgacgccgacgaatatctgcggctgcgcgaccgggtggtggccgccggctgtcacaccccgatcgtggccggcgtgatgccggtgacccggatggccaccatcgcgcgctccacccagctctccggcgcgcccttcccgccggcgctgctgcgcgacttcgagcgggtcgccggcgacgacgcggcggtgcgcgagctgggcatcgagacgtgcgcggcgatgtgcgcccggttgctgcgggagggtgtgccgggcatccacttcatcaccatgaaccggtccaccgccacccgcgaggtctggcagcggctggcccccgcggaagtcgccgcgtcggcgtga

SEQ ID NO: 1350 - DNA, 1071 bp, Actinoplanes utahensis
gtgacgaactccccgctcgacgaggccggtctgcggtcgcgtgtcgacaaggcgctgaccgtgttcctggccgggcagcgtgaccggctgctggcgatcgacccggcgctggccgagatgtccgccacggtctccgagttcgtgctgggcggcgggaagcggctgcggccggcattcgcctactggggtttccgcggggccggcggcgccgactcggacgccgtggtggcggccgtcgccgcgctggagctggtgcaggccagcgcgctgatccacgacgatctgatggaccgctcggacacccggcgcggggtgccgtcggtgcaccgtcggttcgagaaactgcacgccggcgagggctggcggggcagcgcggccgggttcggcgactgcgccgcggtgctgctcggcgacctggccctggtctggtcggacgagctgctgcacacctcggggatggcggtggccgacgtgcaacgggcccgcccgatcttcgacgggatgcgcaccgaggtgaccgtcgggcagtacctggacgtgctcacccaggcgaccggcgacacgtcgctggagcgggccggcaaggtggccgtctacaaggccgcgaaatacaccgtggagcgtccgctgctgctgggcgcggcgctggccggagcggcccccggggtgcacgcggcgtactcggcgttcggcctgccgctgggcgaggcgttccagctgcgcgacgacgtgctgggcgtgttcggcgacccggagcggaccggcaagccggccggcgacgacctgcgcgagggcaagcgcacctatctggtcgcggccgccttcggcgcgctggacgcggccgggcgggccgaactggacgccgcgctcggcgaccccggcctggacgaggccggggtggcccggctgcgcacggtcatccgggacagcggtgcgctggccgcgaccgaggcccggatcgacgagctgatgaccgcgtcgatcggcgcgctggacgcggcaccgatcgatcaggacgcccgggaggtgctgcgccggctggccgacgcggctactcgtcggtccgtctag

SEQ ID NO: 1351 - DNA, 336 bp, Actinoplanes utahensis
gtgacctacaccaccgctgcggtgctcggcgtgctggccgccctcacgctcgacgtgctgatcctgcggacccggctcgtcgggcgactggtgttctgggccacgtaccccatcatcttcgtctttcagttgatctcgaacggcattctgaccgggcgcgacatcgtgatgtacgacccggccgcgatcctcggcccgcggctcgtccacgccccggtcgaggacctgctgttcggtttcgccctggtgctcggcacgctgtcgctgtgggtggcgctgggccggcgcggcatccagcgcaccccgcgagccgggtctagacggaccgacgagtag

SEQ ID NO: 1352 - DNA, 327 bp, Actinoplanes utahensis
atgaggcatttgtcgtacgtcgcggtgctggccggatgcctggccggggcgctgtggctggaaccgatcctgcgggtcaacgtgctgcgccggtggcgtcggctgctgctggccgtgctgccgatggcggtcgtcttcaccctgtgggacctggcggcgatcgcggccggccactggcacttcgacccggcccagatcaccggcgtctacctcggcggcgggctgcccctcgacgaggtgctgttcttcctggtggtgccggtctgcgcgatcctcggcttcgaggccgtgcgggccgtgctgcgacgtccggcgggggacgagtga

SEQ ID NO: 1353 - DNA, 768 bp, Actinoplanes utahensis
atggtgggtcgcggtcgggcgcggccggccggtcaccgtgcccagccgggccgacggcgacggcgacggcgacggcgcgggcaccgccacgggttgctcgccggccgccgccagaccgcgggtgaccagcagatacgacccggtcgcgccgaccagcccgagcgcgcacaacgcgacaaccacgacgaatcggcgccgcggccgggcgtcggtctccggcggcacggtgcgccactccatcagcgacccgggaaacgtgctcaggccggtcgaggtgacgtccggcccctcggtgccctcagccgggcggcggcacaggtcgtacttgaccgaacgccaggcgccggccagctcaccgcgcatccttcgccacaggctcatcaactgttctccgatctggtctggcacgctgtacgcgtgagcgaacccgtcatcaccgaaccggctgcctggatcaacctgcccgacctgtccgagaggctggacgtgtcgatcagcaaggtgcaccagatgatcagagacggcgacctgctcgcggtccgccgcgacggcatccgcgtggtgcccgccgaactggtggccaacgccaccgtcctcaagcatctgcccggtgtgctgaacgtgctccgcgacgccgggtacaacgacgaagaggccttccggtggctctacgccgaggacgccgaggtcggcggcagcgccgcgatcgcgctcggcggtcagcaggcgcgcgagatcaagcgccgcgcgcaggccctcggcttctga

SEQ ID NO: 1354 - DNA, 2004 bp, Actinoplanes utahensis
atggacaccacagtcgccgatacgttgatcggcacaacgattgacgggcgctaccggatcaccggtcgcgtcgcccgtggtggcatggcgaccgtgtaccgggccaccgacgagcggctcgggcgccccgtcgcgctgaagatcattcatccgtcccaggccacgaacgtgcaattcgtcgaccggttcaccgacgaggccaagacgatcgcccggctcacccacccgaacgtggtggccgtctacgaccagggtcgccatcagggcctgccctatctggtgatggagttcgtgcagggccgcacgctgcgtgacctgctcgcccagcggcgcaagctgaccgcggtcgaggcgctggcgatcctggagcagatgctcgccgcgatcgccgccgcgcaccgcgccggcctggtgcaccgcgacgtgaaaccggagaacgtgctggtcgccgaggcgcccagcggtggcatcagcgacctggtggacgcggtggtcaaggtcgccgacttcggtctggcgcgggccatcgaggccagcacggtcgacgagtccggccagctgatggccaccgtcgcctacgtcgcgccggagctggtccaggccggtcaggccgacgcgcgcaccgacgtctactcggccggcatcgtgctctacgagatgctgaccggcatcgtgccctacgacggcgccgacccggtcgaggtcgcctggcagcacgtcgacaacgacgtgccggccccgtcgctgctcgtccccggcctgccgcgggcgctcgacgaactggtcgcccgggccacccggcgccatccggcggagcggccgaccgacgccggccggctgctgaccgaggtccaggcggtccgcgacaacctgggcgcgatcaacctgcagaccgccctgatgagccaggtgccggcccgcccgctgggcggcgacgccaccacgatcgtcccggccgtgccggccgccgacgcgaccgccgtggtgccgccggtgccgggcggccatccgccggccggccggcagcgcccgtcctgggcccggttgcccgagcagaccggcaaccggtcggctccgcacggccgggccgccgaggagccgcccggcgagggcttcttcgccgacaagcgccgggtccggctgttctcgctgatcgcggtgatcgccgtggtcgtgctcggcagcacctggtggctcgccctcggtcggtacagcgatgccccgaacctggtgaatctgcccaaggcggcggccgagaacgccgcgtcccacgcccacttcggcgtcttctacggccagccgcagtatgacgacaaggtcgccaaggactcggtggtcagccagaatcccgcgcccggcgagcgcaccgtccgcggtgagacgctcaccctgatcctctcgctcggccccgaggtgcacgcggtgcccgacctcaccggtcaggaggcggccgccgccaagggctcgatcgaggagctcggcctgaaatacaaggagggcaagggggcgtacagcgacaccgtcccggagggcgtggtgatctccaccgacccgaaaaccgggacggagctgaagccgggcgacacggtcaccgtggtgctcagccggggccgcgccccggtcaccgtgcccaacctggtcgggatgaacatcaacgacgcccgcagcaagctgcaggagctgggcctgtccgcgctggagcgcaccaggcagagcaacgagccggccgaccaggttctcgcgcagaccccgaaggcgggcgccggcgtggagaagaacgcggagatcaccctggacgtcagcgccggcccgccgcaggtcaccctgcccgacctgaacaaccagaactgcaaccaggccaagggcacgctggagggccaggggctgcaggtccaggtcaacaacctgaacccgctgaacccgaacgcggccgtgcacgggcagaacccaggcccgaacacgccggtcgccccgggaagcacggtgcagatcacgtgctactag

SEQ ID NO: 1355 - DNA, 864 bp, Actinoplanes utahensis
gtgctactagaccggcggatcgggtcgcacaccaggacgtcgggcgggctggccaaggccgccctgccctacgccgacgcggccggctcggaaaccctgcaggtgtacgtcgccaactcccgtggctgggcgctgccgcccggcgacccgaagcaggacgtgctgttccgcgacgggatcggcgagcgcgggctgcccgcctacatccacgcgtcgctgctggtcaacctgggctcgccgaccgttctgacggtggagcgctcgctcgccgcgctggagcacgcgctgcgccggggcagggcgatcggcgccaccgcggtcgtctaccacgccggcagctcggtcgacgaggcgcacgccgagaaggccatgcaccagctgcacgagcagctgctgccgctgctggagacggccgccgccgaaggcctgccgcgcctgctggtcgagccgagcgccggcggcggccgcagcctggcctccaaggtgcaggacctggaggcgtacctggccgccgtcgagggccatccgtggctcggcgtctgcttcgacacctgtcacgcctgggcggccggccacgacctggccaccccgggcggcatgaccgagacgctggacgccctggtcaccgcggccggcccgggccgcctgcagctcatccacgcgaacgattccaaggacgcctgcggctccacgcgggaccgccacgagacgatcggcaagggcacgatcggtgccgccccgttcgccgagctgttccgccacccggccacggccggtgtcccgatcatcgtggagacgccgaccgtcgaccacgagggccacgccgccgacatcgccctgctcaagaacctgcgcgacacctga

SEQ ID NO: 1356 - DNA, 1218 bp, Actinoplanes utahensis
atggcgtactcgaagaagtcccgtgccgtggccggcgccgccgtcgcggccgccgtcctggccaccggcgtggccagccagtccggcgcgttcgccgccggctcgaccgacccggtcctgctcggcgcggaattcaccgacaggttcccggccaaggccaccgggggagcggtcatcccggtgacggtcaccggcggcaccgtgggcgccaccccggcggcgttcggcgcgctgcacatcgccgcccggatcggcggcatctcggccggggtggcctgggtggacgagacccacctcaagatcaccgcaccggccaccggcaaggcgaccaacgccaccatgcagctgttccgcaagggggcggccgggccgatgtccggcgcggtggtcgcctactacccgggcgtcgtctcggtctccccgtcgaagatcagctccgagggcggtgcgctggtcaccatcaacggcaacggctttctcggcatcgacccggacaccccgggcgcggtcaccttcggcgacgtcccggccaccgcgatcaccgtggtctcggccacccggatcaccgcggtcgccccggagggggccaacggcccggcgaccgtgcgggtcaagagtgacggtggtaccagcgaggtgagcggcggcggcaaggtcaactaccggggcgcgctgagcgtcgacaccaccgacgacccgaccgccaaggccagcggcggtccgctgctgctgaagatcaagggcggcacggtcggcgccagcgccaaggagttcaccgccgagcggatcgtggtgcgcctcgaccgcaaggcgctcaccgccacctgggtcgacgagagccacgtcaaggtcgtgatgccgccccggctcaccgataccgcaacgctcaccgtcacccatgacgacatcccgggcgacgaggccacggtgagcatcgccccggtggtgaccaacctgtcggcgaagaccgacacgctggccggcggcaccaaggtcctggtccgggtggccggcgccgacgcgggcaacgccacctcgttcagcttcggcgaccacccggccgactgcgccaagcagggctccggttccagcctctccttccagtgcacggtgccggcggccaccgatcccggcccggtcccgatcaccttcacctccggcaccggcaagcagagccacttcaccgcagcctcggtcttcaactacacggacaactga

SEQ ID NO: 1357 - DNA, 1503 bp, Actinoplanes utahensis
atgacgaagacaactcgggcccgccgggccaccgcactcaccgccgccgtggtcgctgtcgcgggcaccgtggccgtcgccatcgccgaaccgtccgccgcctactccgcgacgggcacgatccgggtcgcctccgacgtgttcccggtcgtcaccagcatctcgccgctcatgggcgcccccgacgggggaacgccggtcaccatcgtgggctccgggttccaggacatcgacaccgacaacctcagcaccgtgctgttcggcgacgtgccggccaccgggatctgggtcgtctccgacaccaagctcgtcgccaccgccccgccgggcaccggcaacgtgctggtcaaggtcgtcaccgatgccggcaccagcaagaacgtcacctcgatgttcggctaccggctcaagctcagcgccgacttcgacagcgtgacggccaaggccaccggcggcgccgagatcccggtcacggtctccggcgccaccgtgggctccaccgcgtcacagttcgccgccctcaaggtgaccgccaaggtgggcggcatccccaccaccaaggtcacctgggtggacgacacccacgtcaaggtcgtggtgccggccaccaccagggcggtgcccagcaagctgcaactggtccaggacggcttcaccgggcccgagtcgaccgcgacggtcaactacgcgccggtgatcacctcggtgacgccgggcgcggtcgcggtggccggcggcgacacgatccggatcgtcggcagcggattcggcggggtggacccgaaggacccggacgcggtcaccgtcggcggcgtcgacgcgagctacttccaggtggtgtccgccggtcagatcgacgccgtggtgccggccggagccgccgccggatacgccgccgtcaaggtcaccgcgcccggtggggccagcgccgaggcggcgcggatcgcctaccgcagcgccctcaccttcgccggcgaccagtatctgcgcgccaacggcggagtgcacctgctcaccgtcaccggcggcacgctcggggcgaacctcgccgactacgccgcggccgggatcagcgtgcggatgggtgccagcaagctgaccgccacctacgtcgacgccacccacctgcgggtcaccctgccggtgctgaccaccgacagcctggccctcaccatctaccaggagacggtcgccggtccggtcgccaccatcccggtcgccccggtggtgaccagcctctccgcggtcagcgacacggtcggcggtggctccacggtcaaggtgaaggtggccgggccgggcgtgacgaccgcgtcgaacttcctgttcggcacgtacgcggcggtctgcccgggcagcggctccggctccggcctggtgttcacctgcgtcgtcccggcggcggccgcggccgggccggtgtgggtcaggttcacctccggatccggcaccgcgagccggttcaccccggcggcctcgttcagctacaccgacatcgactga

SEQ ID NO: 1358 - DNA, 1020 bp, Actinoplanes utahensis
gtggttgatctgcgttccgacaccgtcacccgtccgacggacgggatgcgggaggcgatggccaccgccgtggtgggtgacgacgtgttcggcgacgaccccacggtcaacgccctcgaggagcacgtcgccaccctgttcgggcacgaggcggcgctgttcgccccgtccggcacgatggccaaccagatcgccctgcaactggtcaccccgcccggcggcgagctgctggccggcgccgacgcccacgtggtcacctacgagctgggcgcggccgcgctgctcggcggcatctccacccgcacctgggcggccaccggcgcggcgctcaacgtcgaccggatcgccgcgatgatccgcccgcccggtttcccctccgtgccgaccgcggcgatcgccgtcgagcagacccacaatctgggcggcggcggggtgatcccgctcggcacactgcgcgacctgcgcgcggtggccgacgcgcacggggtcgccctgcactgcgacggcgcccggatctggcacgcgcacgtggccgacggggtgccgctggccagttacggcgcgctcttcgacaccctgtcggtctgcctgtccaaggggctgggcgccccggtcggctcgctggtgatcggcagccgggaccggatcgcccgggcccgggtgatccgcaaacggatgggcggcggcatgcgccaggtcggcatcctggccgccgccggccggtacgcgctcgaccaccacgtcgagcgcctcgccgaggaccatgcccgggcccgccggctcgccgagggcctcgcgccgctcggcgtggtggacccggccctagtgcgcaccaacctggtcccgctggacctgaccaaggccccgctggacgctccggaactggccgccgcggccgcccgccggggcgtgctgatcgccgccatgctgccgaaactggcccgcctggtggtccacctggacgtcaccgacgacgacgtcgacgaggcgatctcggtgctcaccgtgttgctcgcctga

SEQ ID NO: 1359 - DNA, 1392 bp, Actinoplanes utahensis
atgcgccgtgagtggcaccagctcagtcacccgggagtcgcgacctcccgcccctccaccgactccgccgaggacgaggccctgggcctcgaccggtggcgcgagctgccccgggtgcagatgccgccctggccggacatggccgaggtggcctcggtctgcgaggtgctgtccaacgtcccgtcgatcgtcgcgccgtacgaggtcgaccagctgcgcgccaagctcgccgaggtctgcgagggccgggcgttcctgctgcagggcggcgactgcgcggagaccttcgccgacaacaccgagagccacctgctggccaacgcgcgcacgctgctgcagatggccgtggtgctgacgtacggcgcctcgatgccggtggtcaaggtggcccgggtggccgggcagtacaccaagccccgctcctcgctgaccgactcgctgggcctgccggcctaccgcggcgacatgatcaactcgctggacaaggacgagacggcgcggatcgccgacccgcagcggatgatccgggcgtacgcgaactcggccgccgcgatgaacatgctccgtgcctacctggccggtggcctggccgacctgcacgggctgcacgactggaacaaggacttcgtccgcgcctcgccggccggcgagcggtacgaggcgatcgcccgggagatcgaccgcgcgctggacttcatccgcgcctgcgggatgaccgacaacgaggcgctgcgtacggtgagcctgtactgctcgcacgaggccctcgcgctggagtacgaccgggcgctcacccgggtctccggcgacaaggcgtacgggctctccggccacttcctctgggtcggcgagcgcacccgccagctcgaccacgcgcacatcgacttcatctcccggctggccaacccgatcggcgtcaagatcggccctggcaccagcccggagaccgcgatcgagctgtgcgagaagctcaacccggagaacatcccgggccggctcaccctgatcagccggatgggcaacggcaaggtgcgcgacgcgctcccgccgatcgtggagaaggtgcacgccaccggcgccaaggtggtctggcagtgtgacccgatgcacggcaacacccacgagtcgtccaacggctacaagacccggcacttcgaccggatcgtcgacgaggtgctcggctacttcgaggtgcaccgcggcctgggcacccaccccggcggcatccacatcgagctgaccggtgaggacgtcaccgagtgcctgggcggcgcgcagggcatcgaggacctcgacctgccggaccggtacgagaccgcctgcgacccccgcctgaacactcagcagtcgctggagctggccttcctggtcgcggagatgctccgtggttga

SEQ ID NO: 1360 - DNA, 1491 bp, Actinoplanes utahensis
gtgggcaaaaccctccgccgggcgctgctcgccggtgcggtggtgatcggcgcctcggcctcgatcccgctcgtgtcggcgaacgcggccaccgcgtgtgccaccgcctggtctgccagcaccgcgtacgtgaaggacaacgtcgcttcacagaacggtcataactacaccgccaagtggtggacccagaacgagtccccggccacgcacagcggccagtgggacgtctgggccgacggcggcgcgtgtggtggcacgaccactcccaccacctccccgaccgcatccccgaccgtgtccccgacggtgtcgccgaccagctccccgacgagcagcccgtcgaccaccacgtcgagcccgtcgaacccgggcaccggtggcaagaacgtcgtcggctacttcgccgagtggggcgtgtacggccgcaactaccacgtcaagaatttggtgacctccggctccgccgcgaagctcacgcacatcctgtacgcgttcggcaacaccaccggcggccagtgctcgatcggtgactcgtacgccgactacgaccgcgcctactcggcggccgagagtgtcgacggcgtcgccgacacctgggacgcgggcgccctgcgcggctcgttcaaccagctgcgcaagctcaagaagcagtacccgaacctcaaggtgatctggtcgttcggcggctggacctggtccggcggcttcacccaggccgccgcgaacccggccgcgttcgccgactcctgctacaacctggtcaaggactcccgctgggccgatgtcttcgacggcatggacatcgactgggagtacccgaacgcctgcggtctgcagtgcgacaccagcggcccggacgcctacaacaaggtgatcaccgcgctgcgcaccaggttcggcacgaacttcctgatcacctccgccatctcggcggacggctccaacggcggcaagctcgacgtggccgactacgcgtccggcatcgcgaagctgaacctggtcttcccgatgacctacgactacttcggcgcgtgggacgccaagggcccgaccgccccgcactcgccgctgacctcgtacaccggcatcccgaaggacggcttctactcggacgcggcgatccagaagctgaagagcaagggtgttccggccaacaagatcctgctgggcgtgggcttctacggccgcggctggaccggcgtcacccaggcggcgccgggcggcaccgccaccggggcggccaccggcacctacgaggccggcatcgaggactacaaggtgctcaagggcagctgcccggcgaccggcacggtggccggcaccgcgtacgccttctgcggcggcaactggtggagctacgacaccccggcgacgatcgcgggcaagatggcctacgtgaagaaccagggtctcggcggcgccttcttctgggagttctccggtgacaccagcaacggtgagctgatcaccgcgatcaagggcaacctctga

SEQ ID NO: 1361 - DNA, 471 bp, Actinoplanes utahensis
atgaccatcttcgacgtcgacattgacgcactcaccggcggcacgaccgatttggaccgctaccgcggatcggtgctcctggtggtcaatgtggcctcgcgctgcggactgaccccgcagtacgacaagttgcagcccctctacgacacctaccgcgaccgcggcctggtcgtgctcggcgccccctgtgaccagttcggccaccaggagcccggcaccgccaccgagatcgacgaattctgccgggccacctacggcgtcacgttcccgatgaccgcgaagatcgaggtgaacggcgccggccggcacccgctctatcagggactcgtcggcgacggcccggacatccagtggaacttcgagaagttcgtggtcgccccggacggcacggtcgccgcccgcttcgcgcccggggtcgaacccgacgacccggagctcgtcgcgaccatcgagaagctgctgccccactga

SEQ ID NO: 1362 - DNA, 678 bp, Actinoplanes utahensis
atgagcatccatgtgatcggggtcgacgcgtacgcgctcggctgggtcggggtcgagctccgcgacggcgccttcgggcgcgcggtgctcgcctcgacgctctacgagatcgtcgcgggcagctcgggcgccgcggtgatcggcgtcgacatccccctcggcatgctgcccgaccgctggcgggccgccgacacgctggccgccgaccagctcggcccccggcgcggcagcgtcttccgggtgccgccgcgcgcggtctgggcggagccggacttcgcggccgccaaccggctctgccgcgagctgaccggcgccgggctcagccgtcagtcctgggcgctgcggcccaagctgctggaggcgaacgcgatctgggaacgccacccgggcctgctcttcgaggcccacccggaggtctccttccgcaccatggccggcgagccgctgccgtacgccaagaagacctggagcggccagtcgcgtcgccgggaactgctggcccggcacggcatcaccctgccggaccggctcggcccggccgggcaggcgccccccgacgacatcctggacgcggccgcggtcgcctggaccgcccaccgcgtcgccaccggcaccgcactgtccttccccagcccgcccgaggaggacaacggctccaagatcgctatctactactag

SEQ ID NO: 1363 - DNA, 1854 bp, Actinoplanes utahensis
atgagggtccagccacggcagcagctgctggagatctggcaggcggtgctcgactactcgttccgggacggccgatggcactggggcggccgcgacgggcgcaattcgatcagcgacgccgagcagctgctctgcattctcggcccggccaccacgatccgggcgttcaccctggaccagccggatcgggtggaggacgacgtgctggacgcgatgcgcgcgctcggcggccggctggacatcccgatcaccctgctccgggtcgtcgaggagtatctgacgacgtacaccgacgcgaccggcaccccgaccttcgcggccgagggctacttccgggtcgccgagacgcaggaggagaagcccagtcccgagcagctggcccagccggtggtcgactcgttcgccatctcgctctcgctgtcgctggccatcatcggtttcgcccgccagttccggagcaatctgaaacgccgcagcgcccgcgccgacatcgacaagctcgaggcgatggccagcaagcggctgaccgccgcgatgatcggcctgctgcgcagcttcacggtggacatcttcgaggtggactcccgcgagggccgcgccctggtccgcacggtgaaccagcgcgggctggccacccgccggatcgtgccgctgatccaggagtcgctgcaggagatccgggccagcctgcgggacgtcacgatgggttccggcgccggcctggccgacgacctggaccacccggaccgactgttcgagtgcggctggagctggggcgtggtccgcgacgcgccggcgatcgtgaccagcgagaaggtcggcgatcagcccgccggtttcgccgagccggcaccgtacatctacttcaccgcgctcgccctggacgccatcgagacgctgctctccccgcggacccggcagctcggcctgctcaacgaggagcagctgcgcctgtcccaggggctgcagctgcgctgggacctcacccagtcgtactggtcgacgatcgccaccgcgaacatcggcggtgcccgctggcccctggaggacatcccctggcagcgcatcaccgagaacgagtcggagtactacagcctgcacgtctcctcgatcgtggtgcaggacctggtccgcaagcgggcccgggacgtcgatctggaccgggtcggcctggtcctggaggagctggcgaaccggtcgcggatcacccgccgggtctacgccggggacaagtcctatcaggtgcacgcgccgggcttcccgatcgagctggggggcagcgacgccgacatcggcccggccctcacgtggtatctgtcggatttcgcaccgctgctgctcaagcggacgatcagcctggccggcctgctcggcgacccggatctgcgcggccggatgctggagctggccgacgagatctggggacagctggacagccggcggctgcccggtgagcgccggcgcgggctctgggaccagcccagcctggtcttcgaggactacgacgtccggtacgacgcgccgtcctggtatcacaccaagcgggtggtcgactgcctggtgaccgcggccgaggtgctcagctcgccgccactgcgcagcacccggctcaccgaccatgccggtgacctgctcagcgaggccgaccatctctacgaccaggagctgctgcagggctcaccgaacgggggtcaggcgatgcgcaccgagttgcaggagctgcagtcccggctccagcgcgcccggtccgtcctggacgagaagccgggcaccgcggccgcgctcgccagtgacgtgctgctgcgcctggaccggttcgccgcggcccgcagcgacctcgacggcgagtcgtga

SEQ ID NO: 1364 - DNA, 906 bp, Actinoplanes utahensis
atgctggtcttcgcgacctccgacaaggggggcaccgggcgttcggtcaccaccagcaacgtggcctaccagtgcgcgctgggcggccacgacgtctgctacctggatttcgacttcgggtcgccgaccgccggcgcggttttcgacgtggacaccggcaagctcgtggtggacggcggcggcctgcactcctacctgctgggcacggtggccgacccgcaccgctgcgacgtgttcgccgattcggagcggctgagcatgcgggagcggccgctgggcgcgggccggctgaccctgctgcccggcgacagcggcggcggcgagttccccagcaccccggagatgatccgtcgctgcaaggaactgctggtccggctggatcaggagttcgacgtggtgttcgtggatctgagcgccggccggtcgtacgcgttgcagatggcgctcgccgcgatggccggcgtgcagcccgcgccgaccacccgctggttggtctaccaccgctggacccagcagcacatccaggcggcggccagcctggtctacggcgagcacggcatcctggccaccggactgaccctgggccacgaccgggagcgactgctcggccagctgcggttcgtccggacggcgatggtcagcccagccgcgcagggcctcaccgcggagcaggccgcctgggtcaaggactggaacggtgacctgcagaacctcgcccgggagcgcggcgccggcgcgctctacctgctcggctcggtgccgctggacccggtgctgcagtggcgcgagcagctgatcaccaaccacgacctgacggtcagccggatcgccaaccgggccaccgccgacgccttcgccgagctggcccagctgatcgtcgacgacgacgtgtgggacgaccggtga

SEQ ID NO: 1365 - DNA, 981 bp, Actinoplanes utahensis
gtgaccggcccgcaggcacactacgaggagcggtcggcgcagccgcgcgtcgagcagttgccgctggcgcacctctcgatcgagctgggccacctgtacaaggaggatttcgccggcggcatcgagcagttccgccggcacttccggcagatccggccgtacgtggccgccgcgcgggaccgcctggccggcatgctcgagcccgggcgcacgccccgggtcagcacctgcttcatgatcgacgactacttcgaccggttcgaggatccaccggccgcggtcgtcgacgagctggtcaaggccgccgcggagaacgatctcacgatcgactacctggcccgggaggcgggctgcgcccgggccggcgaggtcagcccggccgagctggtcctggaccgcctggtcgccgacccgccgcccggcaccgacggggtgtggcagccgccgcaggagagtggctggctgaccaacggcgactggccgccgggcgccgcggcgccgcccgcgatgagcgcgcgcaccggcccggcccggccgaccgagaacgcgcgcaaccggcattccgtcttcttcgccgtggagatcttctcgacggtgtccggctcgcggctctgggcctgcccccacctggccgcggtgtggcagctgatgcgtctgggcctgttgcgccaccacgggcgcccggtggccccggcccggcccgccggggagatcccggccacctgggccgagatgccggcggtgctgcagctcaacgcggccgccgcgccgttccacgcgtaccggacgcactcggtcctggcccgccggttcctcaacatcgagaccgcggtgggcatcgtgctcagccaggtcgcggtcgacgaggaggtgcggctgcaggtcgcccgccgggcggcgggtgagggcttcgccctgtccgacaaccttctcgagcggatcgcgtacgtcttcgacggcgagacggcccgcctggtctga

SEQ ID NO: 1366 - DNA, 1047 bp, Actinoplanes utahensis
gtggaccgccaccgtgcagcgcatccgcgaccacctcgcgctgagcaccctgcgggagctgggccggctgaccggatcggcggcgtcgtgaaccggctgtccgccaccaacggcgaccccggcgagcgaggcgtgtccgaggtggtgcgcaaggtcggcgtcgcgctgatcaccggtggcgtcgccttcgccctgaccaacctggcccaccaggacccgatactgtcggtcaccctgtccgtgctgatcggcggctccgcactggtcgtgcaattcctcgtcgacttcgagagccggctgcgcgaggtccagatcggtcagcgggaccaggctcggcagatccgcgagtgcgtcgacgagcggttccgggcgatcagcgaggccaccgagctgtacgggctgatggaggactcgatggtgcagaccgaggtgctcagccagctgatccgccactccacccggatcggaccgaactcctccgcgctggcccaccggctggcccagcgggaactgcaccggatggccgagttcctcaaggagctcggcgacggcggcgaggccatctacgacggggaggaccgggactggctgctcggcctgacctgctcggccgagaagtgcatcgacgccaccagcctgaccaccgtcgacggcggcgggatgtggtccaccgacctcgggcagcgctatctggacgcgcagcgggaggcggtgcagcgcggcgtccgggtccgccggatcttcatcctggaccggcccgacccgcagggcgccgaccggctcgacgaggtgtaccggcagcacgcggacatcggcgtggaggtgcgggtgctcgactccgccgcggccggccagctgcgccggacgtcgctgttcgacttcatcctgttcgacggggtgatcggctacgaggtgaccaccggctcgtggatcgacgagagcgccccgccgatcgtggtgaacacccggctggtgctgcggccgagccgggtcgaggagcggcgcgaccggttcagtcagctgtgggaggcggcccggccgcgctga

SEQ ID NO: 1367 - DNA, 912 bp, Actinoplanes utahensis
ttgttaccgacgtccgcggccctcccggccgacgtcggggtgcgactgctcgccctgaccaccggggcgcaggtgctgcggaccgaccgcccgatgccgtacgtggtctcaccggaccggctgaccggcgtggattgccaggtcccgatcggcgcccggcgcacggcccgggcgatcgggacggtcaccacccgggcgttgctggtcggcggtcacgtgttgcagtcctcggcccgcaccacggcggtgcgcagcgagcagaacaggcggctcccctggtcgcactatctggcccgaccccacaccgtcgagatcgtcgggaaacaccgggagcgggacaccgccgaggcgtacctcgccaccacgcccgtctcgccgctgctcaacctcggggcgatcgccgggcacaccgcggaacgggtccggggcagctcgatgatcgactcccgggtgccgttccgcagcgggcggatcacgctgcgctggacggcgatgctcggcgacacccagccggacagcgtccggttcaccgtggagggcgagggccgccgcaccgtccgggtgcacacccgggacgaggacgcgctgcccggcgtggtggccctctgcgaggacctggcgttgcacgactggctgctgaccacgctgaccggcatggtggcccgggcgccgctgagcggcccgcgcgcgccggccgcgctggaccggatccggccggccctcgaccacctgctgcacctctggatgccgggcgcccggctggaggtcaccacccgccggttctgggacgagctggagcggcatgcgggcttcggccggcagtggaccgccaccgtgcagcgcatccgcgaccacctcgcgctgagcaccctgcgggagctgggccggctgaccggatcggcggcgtcgtga

SEQ ID NO: 1368 - DNA, 1083 bp, Actinoplanes utahensis
ttggaccgcacgaccatcgatcgcgcaatgtccccgtattgtcaccttacgcatccggatccactgtcgatcgtcgatcctttcgcccggttcgtctacgctggaccgatgagccagcgcgcggacgtggtcgtcatcggcgccggggtctccggtctgaccagcgctctgtgcctcgccgaggcggggttcggggtgcgcgtgcacagcgccgatccgccggggcgcaccacgtcctgcgcggccggcgcgatctggggtccacacctggtggctcacgagcgggcgctcggctgggcgctgcgctccctggccgtgttccgcgacctggccgccgacccgcggaccggggtgcggctggtcgacggcgtcgaggccagccggggcgacctggtgacgccgcgccccggggccggcccggacgacgtgcgccgctgtgacccggcgacgctgccgcccggtttcaccaacggctggcgctaccgggtgccgctgatcgacatgagccgctacctcgaccacctgtgcgcccggctggccgggttcggcgtcgagatgacgatcggcgagccggtcaccgcggccgccctgccgggcttcgggccggtggtggtgaactgcaccggtctgggcgctcgcgacctcatccccggcgacccggtcgccccggtccgcggcgacctgctggtcaccgggaatcccggcatcaccgagttcttcgtcgagcacgacgacgacgcggacggcctgaccacctacgtgctgccgcagggcgaccgggtgatgctgggcggcagtcggcgcaccggggattactcgaccctgccggagccggcggcggcccgggcgatcctggaccgctgcacggcggccgagccgcgcctggccggcgtccaagtcctgcgtcatcacgtggggctgcgcccggtgcgcgaccgggtccggatcgggccggacgagacccacccgcacgtgatccacaactacgggcacggcggcggcggggtcaccctctcctggggctgtgctcaggaggtcgtcgcggtcactgcggccgcagcacgtaccatccgtccgcgctga

SEQ ID NO: 1369 - DNA, 774 bp, Actinoplanes utahensis
atggctgccagcccgcgtccggagatccgcgaactcgaccagatggacgaattcgaggctgcggtcggcgtgctgtgccgggcctggggcgcggagaacgcgctcgacctgatcaacgcgtccaccctgtgtgccatggcgatggcccgcaactacgtggccgggatcttcgtgcagggcgagatggtcggcgcggcggtcgccttccgcggcccggaccatctgcatctgcacatcgccggggtgctccccggccagcagaacctcgggctgggctaccgcctgatggagcatgagcgggactgggcggtcgccgagggtctgtccagcatccagtggaccttcgatccgctggtccggcgcaacgcgtacttctacctcaccaagttcccggtcaccgtgcagtcgtaccggcggaacctgtacggcagcctgaccgacggggtgaacgacggggacgacaccgaccgcctggtggtggcctgggagttcggcgccggccgcccggcgccggggctggcgcccgtcgacgcgccgttcgaccccggattctgggacttcggccggtcgtcggtggccctgctcccggtcgaggacggcgcggtgctgctggtgcccaccccggccgacatcgacgcgctgcgcaccaaggacccggacctggcccgcacctggcggatcggcgtgcgcgccggcttccagaaggcgctcggctccggttaccgggtgaccggtttcagcgcggacggatggtacgtgctgcggccgcagtga

SEQ ID NO: 1370 - DNA, 804 bp, Actinoplanes utahensis
gtggctcagcagaccgtcgcgttgctcggcaccggcaagatgggcgaggccgtgctggccggcctgctccggtccggatggccggccgaccggatcgtggtcaccgcccggcgcccggcccgcggcgcggagctgaccggcaagtacggcgtgacgctggccggcaacaccgcggccgccgggcgcgccggcatcgtggtggtcggcgtgaaaccgcaggacgccggcccgctgctcgacgagatcgcgccggaactgtcccccggcacgctcgtggtctccctgtgcgccggcctgaccaccggcttcttcgccggccggctgcccgccgacaccccggtgatccgggtgatgaccaacaccccggccctggtcggcgaggcgatgacggctctctccgcgggcgcgcatgcgaccggcgagcacctggacgccgccgaggagctgttccggccgctcggcgcgaccgtccgggtcccggagtaccagcaggacgcggtcaccgcgctgtccggctccggcccggcgtacttctacctgatcgccgaggcgatgatcgacgccggcgtgctgctcgggctgccccgggcggtcgcgcatcggctgatcgtgcagaccgcggccggttccgcggcgatgctgcgcgactcgggggagcatccggtgctgctgcgcgaggcggtcacctcgccggccgggacgaccgccgcggcgctgcgcgagctggagcggcacggggtgcgcgcggcactgctcgcggcgctggaggcggcccgggaccgggcggccgagctcgctgggtga

SEQ ID NO: 1371 - DNA, 1029 bp, Actinoplanes utahensis
atgcgtatcggcgtgctcaccggtggcggcgactgccccggtctcaacgcggtcatccgtgccgtggtgcgcaagggcgtcaccgcttacggccacgagttcgtcggcttccgcgacggctggaagggtccgctggagggtctgacgaagccgctgggcatcgcggaggtccggggcatcctgccgcgcggcggcaccatcctgggctcctcgcgcaccaaccccttcaagatcgagggtggcgtcgagcggatcaaggccaacctggctgagcagggtgtcgacgcgctggtcgcgatcggcggcgaggacaccctcggcgtcgcgaccaagctgcacgacctgggcgtcaacgtggtcggcgtgccgaagacgatcgacaacgacctgaacgccaccgacttcaccttcggcttcgacaccgcggtcaacatcgcgatggaggccatcgaccggctgcacaccaccgccgagtcgcaccaccgcaccctggtcgtcgaggtcatgggccggcacgccggctggatcgcgctgcacgccggtctcgccggtggcgccaacgtcatcctgctgccggagcgcaagttcgacgtcgagcaggtcgcgacgtacgtgaccaagcgcttccaggtggagtacgcgccgatcgtggtcgtcgccgagggcgcccagccgctcgacggccagatggtgctgcacaaccaggagctggacagcttcggccacgtccgcctcggcggcatcggccagtggctggccgagcagctggaggagaagaccggcaaggaggcccgcacggtcgtcctcggtcacatccagcgcggcggcaccccgaccgcgttcgaccgggtgctctccacccgcttcggcctgcaggcgatcgacgccgtgcacgagggcgacttcggcaagatgatggcgctgcgcggcaccgacatcgtccgggtcccgctgatcgagggcaccggcgagctgaagaccgtcccgctgtcgcggtacgaagaggccgaggtcttcttcggcaactga

SEQ ID NO: 1372 - DNA, 1488 bp, Actinoplanes utahensis
atgagcacccttcttgatcgaccccggaaagccggacgtgaggcgtcggccgacaccggccgctggtgggcgctggtggtgctctccctggcgcagctgatggtggtgctcgacgccacgatcgtgaacatcgcgctgcccaccgcgcaggcctcgctgcacttctcgaacgccgaccgccagtgggtggtcaccggatacgcgctcgccttcggcagcctgctgctgctcggcggccggctctccgacttcttcggccgcaagcggatgttcctcatcggcctgatcggcttcgcctcggcgtccgctctcggcggcgccgccaacggcctggagatgctgatcgtggcccgcgcgctgcagggcgcgttcggcgcggcgctggccccggccgcgctctcgctgctgtccaccacgttcaccgagccggccgagcgcggcaaggcgttcggcatcttcggcgccatctccggcgccggcggcggcatcggcctgctgctcggcggcgtgctcaccgagtacgtgtcctggcgctggtgcctctacgtcaacctggtgatcgccgccctcgcggtggccggcgcgatgctgaagctcaaggacgagccgtccggcgcgcacggccggatcgacgtgcccggcaccatcgccgccgtggtcggcctggtcggcctcgtctacggtctgggcaaggcggagaccgacggctggacggcccgcgggaccctcggcccgatcatcgtcggcgtcgtcgccctgatcctcttcgtgctgatcgagcgccgcgtcgagcacccgctgctgccgctgcgcgtcgtcctggaccgcaaccgcggcggctcgtacgcctcgatcgcgatcgccggcgccggcatgttcggcatcttcctgttcctcacctattacctggccgtcgtgctgcacttcaccccggtgaagaccggcctggcgttcctgccgatgctcggctcggtgatgctgaccgcgaccacggccggctccatcctggccccgaaggtcggcccgcgcccgctggtcccgctcggcgccctggtcgcggccggcggcctgctcctgctcacccgactggacctggactccacgtacgcttccggggtcctgcccggcctgatcgtcatcggtctcggcctcggcctggtcttcgcacccacgcagaacgccgccacctccggcgtcgagcaccgcgacgccggcgtcgcctccgcgatgatcaacacggtgcagcagatcggcggctcgatcggcaccgcgctgctcagctcgttcgcggccaccgccgccaccgactatgcgaagggcaagcagcccagccagctgctgcaactgcaggcccagatcgagagctaccacacggtgttctggtggtcggccggcttcttcgtcctggccgcggtcgtcgcgctggtgctgttccggaccggcccgctcgacgtcgacccggacgccccgcccgcgatggcgcactga

SEQ ID NO: 1373 - DNA, 657 bp, Actinoplanes utahensis
atgaccgagaccacccgcccgctgcgccgcgacgcccagcgcaaccgggagcgcatcctgcacgccgcgcacgacgtgttcgcggcccgcggtttcgccgcgaccctggacgacgtcgcgcatcacgcgggcgtcggggtgggcacggtctaccgacgcttcccgaccaaggaggcgctgatcgaggcgatcttcgcggagcggctggaggatctggtctcgctcgccgaggacgcgctggcgctgcccgcgggctgggacgggctgaccatgatgctgcgccgctcgatcgagatgcacgcggtcgaccgcgggctgcgcgacgcggcgctctgcgtgggcgtcggcaagcagcacttcgccgaggtcgccgaccacctggtgccgctggtccaggagctgatcgaccgggcgcacgcggagggctcactgcggcccgacgtgggactgcacgacctgccggtgatcatggccacggtgaccgaattggcccagcacagcagcgccggccgaccagccgtctaccgccgcttcctggagctgatcatcgacggcctccgcgcccggccggacaacggcgacctcggcccggcgatgacccaggccgacgtcgaggccgtcgtcgacgactgcgtgccctcgatcaagaggacctag

SEQ ID NO: 1374 - DNA, 495 bp, Actinoplanes utahensis
atggtctaccgctatttctacgactgtgaattcatcgaggacggccggctcgtcgacctggtctcgatcggtgtcgtcgacgagttcggccgcgagttctacgcggtcagcaccgagttcgacgacagtcgcgccgtgccctgggtgcgccgcaacgtgctggacaagctgccgtcgccggccgacaaggcgtggcgcagccgggagcggatccgtgaggagctctacgagttcctgatggagccgctgcgcgggcgtaacgagcagatggagctctgggcgtggtacgcggcgtacgaccacgtggcgctggcccagctgtggggggcgatgccggccctgccgcgggagatcccgcggttcaccaaggacctgcgccagcggtgggacgaccggggacggccggcgctgccggagatggccgggcggcatgacgcactggtcgacgcgcggcacaacctggcgcgctggcaggccatggggtccggttcctag

SEQ ID NO: 1375 - DNA, 954 bp, Actinoplanes utahensis
atgtcgtctcagtcgctttctgtaaacacctcatcgccttctgtgattgtcaccctggctgtccgtcgcatttgggtggtgtgccgtgataatcccgcggtgccggaagatgagattctgcgaatcgctctgcgcgaccagtggcacctgaatcccagcgggatcaccgcgctgccgagggccgtgatgtcgcgcgactgggaggtcaccgcgggacgtgagcgctacgtggcccgtctcgtggagaccgccgcgcgactgcccgccgaagccggtctggccgccgccgtgcacctgcgcggcgtgcggatcagcgccggcgaaccggtccggaccctggccgggcagctcaccgccgaaaccccgctcggggccctcgcggtgctgcgccggccacccgggcgccacctcgacggcgccgacccgatcgaccagcagtggtggggcgaacggctcggcgcggtccaccgggccctggacggcttcgtgcaccccgggctgcggccctggcagccggtcgaagcggacgcggcgcacctggacgccgaaccgtggctgcggcccgccgtcgccgccgcggtcaccgccgccacccggctcaccgtgaccgaccggctcacctacggggtgctgcacggtgacccggcccccgaggcgttcgtcctggacgtcgacaccggccgcaccgggctgctgcactgcggtaccagcggcaccgggccgctcgtctacgacgtggccgccgcggtgatctacgccggcgggccggaccgggccgccgaactgctcgacggctaccgctgcgccgggccggtggccgccgacgagctggaagccgccctgccggtgctgctgcggctgcgctgggcggtgctggccgagcggtccgcccgccggggctgccccaccgggctggcggcggcgcgggaggccctgacgtccatgcccggatga

SEQ ID NO: 1376 - DNA, 687 bp, Actinoplanes utahensis
gtggaccatcgcatgccggattccggtgacgcgctcaccggcgtcgaaatgttcgccgggctcgagccggatgtccgacagcgggtgatcgccgcggcggttccgcgccattaccgcaaggggcagatcctcttcgtcgagcacgatccgggcgactcgctgatcatcatgaaacggggcgcggtggcggtcttccgcaccgcgccgaccggtgagcgcgcggtgctcaccgtggtccgcccgccggacgtgctgggcgaggtgtcgctgctggacgccttgacccgcagcgcatcggccgaggcgatcgaggactcgcaggcgctgtcgctgtcccgggccgccttcatggacctggtccactcgaacccgcggatcctcgatgcggtgatgcgatcggtcggggggctgatccgtcgtctcaccgagcagaacgccgaccacgtcttcctggacctgcccggtcgggtggccaagacgctggtccggctctccggggagagtcaggcgccgatgatcaccatcgagctgaaccagagccagctggccgagatggccggcgggtcccggcagagtgtgaaccaggcgatcggctcgttcgccaaccgcggctggctgcgcaccgagggccgccggatcgtggtcaccgacgtgcaggccctgaaacgccgggcgggcatgaactga

SEQ ID NO: 1377 - DNA, 753 bp, Actinoplanes utahensis
gtggcgcgccgcccccgcttcgtacccttcttgcgccccgggacgccggcggcatccgctgaaaggacggcagtgttctactggctgctcaagttggtggtcctcggacccgtgctgaagctcgtcttccgcccccacgtcgagggcctggcgaacgtgccgcgttccggcccggtgatcctggcgtgcaaccacctctcgttctccgactcgatcttcaccccgttggtgatgaagcggaaagtgaccttcgtcgcgaaagctgaatacttcaccggcaaggggatcaagggctggctctcccggatgttcttcgtcggcgccgggaccatcccggtggaccgttcgggcggcgaggctgcccaggcggcgctcgacaccctcctgagggtgctccgcgagggcaacatcgccggcatctacccggagggcacccggtcgcccgacggccggctgtaccgcggcaagaccggcgtggcccgtctggcgctggagagcggcgccccggtcgtcccggtggcgctgctcaacaccgacgagatccagccgaccggcacgctggtcccgacggtcaagcgggtccggatgcggatcggcgcaccgctcgacttctcccgttacgccgactcgcgcggggaccggttcgtcgagcgcgcgatcaccgacgagatcatgttcgagctgatggcgctctccggccgggagtacgtcgacgtctatgccgcgaagctgaaagacccgcaacccgcctga

SEQ ID NO: 1378 - DNA, 801 bp, Actinoplanes utahensis
gtgacagcgggcggcgcccgtcgcgggcggcgggacaacggactcgacgcgaccgactacgcggtcgcgggcgacgtcgacccacgcgtaggggaacatctgctcgacgtgctcgccggtgacggcatcgcggcatatctgcaacccaccgcggatctcaacccgatcctgcgggccaccacgctgcccgcccggccgatcgaccggctctacgtggaccgcctccacctggacaccgcgcgggagcacctgcagcaggtgaccgggggcgtgccgcccaccccgccggccgagccggcgccggcaccccggccgcagtccgaggtcgacgccgagtgggaccggatcatcgccgggttccacaccacggtcgacccggccgcggcgccgtggccggagtccgagggcaccacctccgacgccgaccgcaaggaccggagccggcccgtcggtgaggacggccgcccggtcaaccggcggcgcaccgatcccccaccgccggagccggtggtctatccggtgatcgacccgttcggcttccccgacgtcgccgacgaggacgagcggtatgtgccgccgccgcccccgccgctgccgcacatctcgaaatacacggtcgccggcacgctcggcgtgatcctcggcttcgtgctgttcctgttcccgacgctgatcccggtcgaccgcaacttcgtgatgttcttcggcttcgccgggatcgtcggcggggcgatcaccctggtgtggcggctgcgctccggtgacgacgacgacgaattcgacgacggcgccgtggtctga

SEQ ID NO: 1379 - DNA, 1416 bp, Actinoplanes utahensis
atgcgccagagttcgctcgtcgtcgtcgcacaccgtctgcccctcaacgacagcgccgccgccgacggcgcctgcgagtggcggcagagcccgggcggtctggccagcgccctgcacgccatcctgcagcagaccccggccacctgggtcggctggagcggtgtggtcggcccggccccccggctgccggacatcggcagcctgcgcctgcgaccggtcgcgctgagcgatgacgaactgcgcggccactacgaagggttcgcgaacgcgacgctctggccgctgtaccacgacgccgtccagcagccggtcttccagcgcgagtggtgggagacctaccgcgcggtcaaccagcggttcgccgaagccgccgccgaggtggccggccgcaacgcggcggtctgggtgcaggactaccacctgcaactcgtcccgcggatgctccgcgagctgcggcccgacctgctgatcggcttcttcatgcacgtgccgttcccgccgccggaactgttcatgcagctgccccgccgggtcgagctggtgcacgggctgctcggcgccgacctggtcggcttccagcgggaacaggccgcgcacaacctcgcccagctggccaagaagctgctcggggcggacgccaccgacgacgcgatcacggtcggcgggcggaccgtgcgcaccggggcgttcccggtctccatcgacgtggccgagatgagcgcgctggccgcccggcccgatgtggcggcccacgcccggcagctgcggcacgacctcggtgagcagaaacgggtgctgctcagcgtcgaccggctggactacaccaaaggcatcgagcaccggctcaccgcgtaccgggaactgctgcgcgacgggtacgtcaaggtccgcgacacggtactggtgcaggtcgcggtgcccagccgggaacgcgtcgacagctatcgcgacctgcgggaccgggtcgagggtgaggtcggccggatcaacggggagtacgggcgggtcggcgaacccgccatccactacctcaaccagccgttcgaccgctgggaactggccgcgctgtaccggaccgcggacgtgatggtggtgaccccgctgcgggacgggatgaacctggtggccaaggagttcgtggcggcccgcgcggacggcaccggagcactggtgctcagcgagttcgccggggcggccgccgagctcgacgaggcgttcctggtcaacccgcacgacctggacgggttgaagcagacgctgctgcgggcgctggaggcggacccggccgacctggccgcccggatgaccgcgatgcgccggcacctggccgaacacgacatccacgcctgggcccgcgcctacctcaccgccctcgaccacaccggccgcctcgcccagcggctaggcgcgcggtag

SEQ ID NO: 1380 - DNA, 780 bp, Actinoplanes utahensis
gtgactggttttgatctgctccggttcgacgattggaccgatccggtgccgccggcccagcgggagatcgtgtcccggctgccggacgaggatcgcggccgcccgccggtggtgttcgtgcccgggctggggcacggcggctgggcgttcgccgagcattggctgccgcacaccgccggccgcggtttcccggcgtacgcggtcagcccgcgccccggcggggatctgcgcgccctggtgcacgacgtggtgcagaccgcggccgggttgccgcggcaggcggtgctggtcggccacggcgtcggcgccctggtggtggcccgtgccctgggtcgctatccggcgcgcgccgcggtgctggccgcccctgtgctggacggctggtcggcactggggtcggcggtgcgggccaatccggccgggacgctgcccgccctgttcggcggccggcttcggctgtccgcccggcagctgttcagcgccggagtgccggccgagcaggcgtccgcgtacctgggccggatccggccgcggccgcgggtcgagctgctgcgtcgggtcaggccgccgcgtccggtcggtgcgccgccggtgctggtggcgggcagcccggacgaccgggtggtgggccgcaaggcgctggaccgggcggccgcggcctatgccggcgccccgctgatgtttcccggcatgggccacgagctgatgctggagccgagctgggcggagccgatcgacgccgtcctggactggctggacaagcagctaccgcgcgcctag

SEQ ID NO: 1381 - DNA, 1344 bp, Actinoplanes utahensis
gtgcacgactccccggacatcggtgaccgccgtgacgccgtctgcgtcgtcggcgccggccccagcggcctgaccgccgtgaagaatctgcgtgagctgggcttccaggtcgactgctacgagcgggagaccggggtgggtggcgcctggaactggcggcacgaccgcagcccggtgtcggccggcacccatctgatctcgtcgcggccgctcaccgagttccccgatttcccgatgccggacacctggccggactacccgcaccacagccaggtgctgacctacctggagcggtatgccgcgcatttcgggctgggtgagcacatctggttcggcatggaggtggtgtcggcggcgccgaccggggacggcggctgggaggtgaccacccggtcgaccggcggtggcacgtcccgcacctcgcggtacgccgcgctgatcgtggcgaacgggcacaactgggatccgcggaagccggagattcccggcgagttccggggccgggtgatgcacgccggggcgtacaaggatccggctgtgctgcgtgggcgcaaggtgctggtgatcggcggcggcaacaccggctgcgacatcgcggtggaggccgcgcagcaggccgcccaggtgtggcattcgacccgccgggggtactggtacgcgccgaagtacgtgctgggtcgccccgccgaccaggtcaacgatcggctgctgaggtggcggctgccgctgcgcctgcggcagtggctctatcgccgcacggtccggctgaccaccggcgacctgacccggttcgggctgccggcgccggaccaccagccgtacgagacccatccggtcgtcaacagccagctgccgtatcttctcggccacgggcggatcaccccggtgccggacgtgacggcgttcgacgacgccgcggtggagctggccggcgggcagcgcatcgagcccgacctggtgatcaccgcgaccgggtaccgtccgcggttcgagttcctggagccgggcctgctcgacgccgacgagcacggccgccccgacctgcacctgcacacgttcgcccggaagaatccgacgctcgtggtgatcggcctgctgcagccggattccgggttgctgccgctggcgcactggcagagcgtggcggcggcccggtggctgcggctgcggctgaccgatccggcgcgggccgccgcggtccagcagagggagtcggcgaagccgctgtcggcctggtcacggcgccgggtggtggacaccgaacggcactggttcgaggtggaccacgtcgcctatctccgttgcctgcagagtctgctcactgagatggagccggccgcgtga

SEQ ID NO: 1382 - DNA, 678 bp, Actinoplanes utahensis
atgtccggggttccgttgcgcgtgctcagctggaacgtgcacgggttgtccgacgaccgggcggcgctgaccggcctggtccgcgagctggccccggacgtcctgatcgtgcaggaggcaccgcgccggttccgctggcgggagaagtcggcgacgctggccggcgagtgcggcctggtggtcgccgccggcgggctgcccgcactgggcaacctgctgctggtcgacctgcgggtggcggtcggccagacgtggaacctgcgctatccgctgaccccgggccggcatctgcgcggcgcgttcttcgcccggggccgggtgcgcggggcgtccttcaccgtgtccggttcgcacctggccaccgacccggcggagcgcccggcccaggccgcgctctggaaggacgagctgtccgcgctgaccggtccggtgatcgtggcggccgatctgaacgagggcccgggcggcggcgcctggcgcaccgtcgaggacgggctgctgaccacccgggacgacgagccgacctatccggcgtcggcgccgagccggcggatcgacgccctgttcgtcaccccggacgtcaccatcgagcggtacgagatcatcgcgaccgaccgggcgcgcgtcgccagtgatcatctgccgattctcgcggaccttctgctgccgccggactga

SEQ ID NO: 1383 - DNA, 1257 bp, Actinoplanes utahensis
atgcgggttcggtggccggtgaggcgccgaaggctgcccggaagcgggccgctccgcgcaagcgcgcggccggggatgccggcgggaccgccggggcgggccggagtggggacggggaggccgcggccggacggaagcgggcggctgcggacatccggtccgtgggcacggcggaggccgccgaaggtggcgcgggcccgacccgtagcgtggatcatgtgcggggcgcggaagcgcccgaggatcgcggggccggggcgggcgatggcgcccgggacggcgacgcggtgtgaagaggggacgggcagcgtgacgctgaccatcggaatcgacgtcggcggcaccaaggtcgccggtggtgtggtcgacgagcacggcaacgtgctcgcttcgaaccggcggccgacaccggccgacgacccggccggcacccgggacacgatcgtcgaggtggccgccgagctggcggcgcagtacccggccgcgaccgcgatcgggatcggcgccgcggcctggatcgacgcggccgggtcgacggtgctgttcgcgccgaacctggcctggcgggacgagccgctgcgcgactacgtgtcgaaggccgtgggcctgccgaccgtgctggagaacgacgcgaacgtcgcggcctgggccgagttccggttcggggtggccaagcacgccgacgactcgatggtgatgatcacggtgggcaccgggatcggtggcggcatcgtgctgaacggcaagctgtggcacggcgccaacgggatcgccggtgagctcggtcacctccagtcggtgccggacgggcatccgtgcggctgcggccggctcggctgcctggagcagtatgcgagcggcaacgccctggtccggttcgcccgcgccggcgcccggcaggagccggagcgggcggcgaagctgctggagctggccggtggggacgcgctggcgatcaccgggcggcagatcaccgaggcggcccgggccggtgacggtgtggcgatggacgcgttcgcgcagatcgggtactggctcggggtggccctggccgacctggcgcagagcctggacccgcagatcctggtgatcggcggtggggtgatcgacgccggcccgctgctgatgggcccggcggagcggacctaccgcgatcagctcgcccagcgggaccggttcccggtggccgaggtgcgcgccgcccagatgggtaatgtggccggcgtcgtgggcgcggccgacctggcccggcgttag

SEQ ID NO: 1384 - DNA, 1065 bp, Actinoplanes utahensis
atggccgggtccgcacgtgacgaggcggagcgactggtggcggcgatcatcgccagggccgcgacggccggggtgtcagccgcggcgtcggccgcctcgtccgccgacgcggggaaggtcgcgggcgccgcggtctccgggacggcgaagctggtgggcaacaccgtcgacggcttcttcgggatgctcaacgacgtggcccgcggcggagcgggtcaacccggcacgcccgggcccggcggacgctgggcgaccggcagcccggaatgctgcgtgtgcccggtctgtcaggcgatcgcggcggcgcgcaaccccagcccggaaaccgtcttcaaggtcgtgaccggggccggggacctggccggcggggcggcgggcgtgctgcgcggtctgtcgtcactggccggcgccgtgctgggggagcggtcgcggccgacccggaaatctcccggcgggggcgcggggcggcaggcgccgggcggggaacggcaggcgcctggtgcggggcggcagccaacgagcggggaacggcaggcgccgagcccggggcggcaggcgccgagcggggaatggcaggcgccgggcgcggggcggcaggcaacgggtgaagggcggcgtgcgccgagctccgatcaggcgtggtcggcggcgacccgggcggcagatccggccagaccgaccaatccgcatgatctcgccgaaacgacaggatcagtgtccgcggcgggcgtcccggcccggccggtggaccgggacgagtctgggcagactgcgggtcgggtggcaggtcaggctggcgtcgcgcaggcggcacgtccggccggctctccaccggtgacgggtcaggccggttatccgtcggcggcggatcaggccggctcgccccggccggcgaccacggtgcgcgcggcttcctggacgggtgcggtcgccggggccgatgcttccggttcggatcgggaggccgacccgtgggccgccgcgacggcggacagcgccagggaggccgaggaggcgcgcgcccgggctcgggcggcggagcaggcggtggccctagctagctag

SEQ ID NO: 1385 - DNA, 453 bp, Actinoplanes utahensis
atggcggacacctcgacccagtcgatccaggtcgctgcgcccccggcccgggtggccgaggtgatctgtgacttcccggcctacccggagtgggccgaggcgatcaaacaggccaccgtcgtcgaggagtacgaggacggatatgccgcacaggtcgccttccggatcgacgccggggtgatggccgacgagtacacgttggagtacgcgtacgccgacgacctctcccggatcgagtggcatctcgtcgcgccctccaagacccagaagtcccaggagggggcgtacgaattggtccccaccgcggatggcgggacgacggtgacctacacgctcgccgtcgagctggcgatcggcatgctggggatgttccgccgcaaggcagagaagatgatcatggatacggcgttgaaggagctcaagcggcgggtcgagagcctgcccgcggcctga

SEQ ID NO: 1386 - DNA, 1617 bp, Actinoplanes utahensis
atgctcgcgctggtcgccgtgctctccctgatcgccagcggtgacccgcgccagctgggctgggtcgccctgctggcggtcgccgcggtgcccgccttcgtggcccgccggcatccggtgctggccccggccggccggttcgccgaggtgatcgtgaccggtctcgcggccggtttcatcgccaaggcgtcgaccggggcggtgcagggtttcggcgccgaggcgatcctgccgtacctcgcggtgccgctgctgaccgcggcgctgcgccgcaagccgaccgagggtgccgcgctgctcggcgtggccgcggtggcgatggtggccggcggcgcgctggccggaccgaagacggtgctggccggcaccggctatctggcggccggcgggcagtggctggtgctgggcgcgatcgtgacgttcgcggccgaggcgatgcgccagttcctgcagccggccgaggcgaccccgcagccgtacgcggaggccacccgcctgctcacccagctgcgcagcgtcgcccgttcgctgcccggcgcgaccctggacccgggcggcatctccgagcacctgctggaggagttgcgcgcggtcaccccggggcaccgggccgcggtgctctcggccagcggcggcggccggctggtggtgctggcgcagaccggggcggagcgggtcgactgggagaccacgctcgacgccgactcggcgatcgccgacgcctgggccacccagcagccgcacgtggcgagccggtcgcaggcccgcacgcaccggggcggcgaggtgtcctcgctggtcgtcccgctggtcgccggggtccggacgatcggcctggtgattctggagacggacgccgcgggggcgtacccgtcgccggtggtgcagagcgtgaccgaggtgaccgagccggccgcgctgcggctggaggccgccctgctcttcgacgacgtccggtcgctggccaccaacgaggagcggcagcggctggcccgggagatccacgacggggtcgcccaggaattggtgatggtcggctacggcatcgacaacgcgcaggccaccctgccggagggggccgaggagacggcggaggagctgcgcgcgctgcgcggcgaggtgacccgggtgatcaccgagttgcggctgagcctgttcgagcttcggtcggaggtcgaccgcaacggcggtctggccgccgcgatcgcggagtacgcgcggaccctgggcaccagcgccggcctgcgggtgcacttcaccttcgacgagtcgaccgcgcgtctgcccgcggcgacggaggcggaactgctgcgcatcgcccaggaggcgatcacgaacgcgcgcaagcacgccggcgccgcgaacctgtgggtcacgtgcacggtggatccgccgtacgcggaaatcgaggtttctgacgacggcaagggtttcgccgacaatcggcccgatggccggtacggtctcaccatcatggccgagcgggccgaacgcatccggggtcgtctcaagatcactccacgacaccccagcgggacaaccgtcgccgtagtgctcggaaccccgcctcggcgcgatagcgtgcgggatagcgtttccgctccagaaggggagtaa

SEQ ID NO: 1387 - DNA, 669 bp, Actinoplanes utahensis
atgtcgaccagtcctgcgccgacgacgcgcaccaaggtcctccttgtcgacgatcacgacttgatccgtaaggggctgcgacacgcattcgagcgcgaccggcagttcgaggtcgtcggcgaggcggcgacggccgcggaggcggtgcgccaggccggtgcgctgcagccggacgtcgtgatcatggacctccggctgccggacggcagcggcctggaggccacccgcgccctgcgcaagaacaacgccaacatgggcatcgtggtgctcaccatgtatgcgggcgacgaccagctgttcggcgcgctcgaggccggggccagcgccttcgtgccgaagacggccccggccgacgaggtggtggcggcggcccggcatgccgcgtcggcgcccagcgcgttcaccgcggccgacctggccgaggcgatgaaacgccggctcgccccgtccggtccgcagctgtcgccgcgcgagggtcaggtgctgcggctgctggccgacggcatgagtgtggccgggatcgccaagcagctgttcgtctcggagtcgacggcgaagacgcacatctcgaagctgtacgagaagctgggtgcggcgaaccgggcgcaggcgctcatgacagcgctgcggctgggactcctggaagccccggacgccccgaagttctag

SEQ ID NO: 1388 - DNA, 417 bp, Actinoplanes utahensis
atgctcctcgacccgcgtggccagcgcttcgccgcggccatcaccagcatcgtcatcgccctcgtgctgatcaccggctccggctggctggcgctcgctcaggccgcggtcttcgcggtcaccgcgtaccggccgaaatggggtccctacccctggatcttccggctcctggtgacaccgcagccgtccgaacccgctgcccccgtgcgctttgcgcagctagtcggattcgcctttttgagcgtctccgcggcgggttacctcgcgggtgcggagacagtcggtcttgtcgccgcggccttcgggctgctcgcggcgttcctgaacgcggctttcgggctctgcctgggctgcgaggcctatctggggattcgcaggctgacgggcagaaacgccgaaggtgtcggcaatgtctag

SEQ ID NO: 1389 - DNA, 480 bp, Actinoplanes utahensis
gtggcccggtgggcggcgttctggaaggacgagccgcagttcgcgcccgaggtggagggtgccctggtgcggatgaagcacatcctgcgccggatcgagcgggccgacgcggcggcgttcgcccgcaacggcgacgacttcacgctgcaggactacaagaccctgcacgtgttgatgatccagccgtggccgaccgaggcgaccccggcgcaactggccgaagcggcgaacgtgacccgggccgcgatgaccagccggctcgaccggctggaggcggccggcctggtgacccggaccgtcgatgcgcaggaccggcggcgggtgctgatccggccgacgccggccggccgggaccggtggagtgcggacatcttcgcgggtatggcgcgcgaccaggaggcgctccgggtgctctccctggaggagctggagcagctcaacggcctactgcggaaagtcctacattccctgggggaataa

SEQ ID NO: 1390 - DNA, 1206 bp, Actinoplanes utahensis
atgacacgcgacttccggcttctcgctgccggccagaccctgtcctggctgggcaccggcttccagaccgtggccctcgcggtcgcggtcttcgcccacggtggcagcgtccgcgacctcggcctggtgatggccgcctcggtgctcaccatgctggccggcacactgttcggcggcgtctgggcggaccggctgcagccccggcacgtcatggtcgtctccgacgtcatccggatgctgtccaccgccggcctggcgctgatgttccgcggcggcggctaccacctgggcgccctctgcgcgctcacggtggtctcggccggtgccggcgccttcttcaccccggcgatgagcgcgctcaaaccgctgctggtcccggccgtcgatctgcagcgggccaacgccacactgagcatgctgcagaccggctgcggggtcgccggcccggtgctcggcggcctcgtcgtcgccgccgtcggcgctccggccggcttcgccgtcaactcggtcagcttcctggcctccctggtcaccgccgcattgattcgcgtacgcgtggagcgtggcccgcatgagccgatgctgcgtgagctgggcgccggatggcaggcgatccgcagccgggactggctgctgggtgggatgctcagcgccaccgtctaccacgtggcgaacgggatcatcctggtccttgtgccgttgatcgcatggcagcggctcggcggcgcgcacgcgatcggctggatctccggcgccgagggactgggcggcctgctcggctcggcgctcgccctgcgcgtgcggccccgtcgcctgctccgggccgggtggctcacgctgatgctgatgccgttctgggcgttgtcgtacgtctggcccggcaggctcaccgcggtgctggccggcgcgatcgtcggatacggcggcctgatgttcttcgcggtggcctgggagaccgcgatccaggaccgggtgccacggaccatgctgggccgggtggcgtcctgggactacctgacgtcgttcctggcgatgccggtgggcaacgcgctggccggcccgctgaccgcccggttcggcgtcgatcgggtgctggtggcctgcgcgttcgtgctgttcgccgcggccgcgtccccgctactgatccgcggctcccgcgatctgacccggtccgccgagccggccggagtcgccgcgcacgcctga

SEQ ID NO: 1391 - DNA, 480 bp, Actinoplanes utahensis
atggatccggtgggtttggcggcggtcggcgtggtgctcgtggccggggccggcgtcgggtggtggcggcgccggacggatggcggcgtgcggcagactggggccgtggacacggtggatcgcgccctgctcgtccggctcggggtggagcccggccgggtcacgctgctgcagttctccaccgcgttctgcgcgccctgccgggccgtgcgccgggtcagcgccgaggtggtggcgctgctccccgaggtgcggcacgtcgaggtggacgcggagagccacctcgacgaggtccgcgagctggacatctggcgcaccccgacgctgctgatcgtggacggcgccggccgggtgaccagacgtgccaccggggtgccggccaagccgcagctgatcgcggccctggccgagtcaggcgtgcgcggcgactccggccggctcggcggaccgggtcagatcgcgggagccgcggatcagtag

SEQ ID NO: 1392 - DNA, 1983 bp, Actinoplanes utahensis
atgccggacgccgacaccgcccgacccgccaccgccgaccacccgccgcctgcggccgtgcccgccgccggcgcctccccaccgacgacggaggacgaccagccggtggtgctggaggctgggggagagggcgagctggagctgccctactggctgaccagcacccaggaggccgccgacaccaccttcctgcagatgttgcggcggctgccgaggctgctcaggcaggcttggctgttgggctggcgggccagtcccggtaccaccgtcgcggttctcgttctgcaggtggcggccggggtggcgggggcgctggggctgatcagcgtggtgggggtgttcgacgggctgctgcaggccgggccgacgccggagcgggtgcgtgcggcggtgccgtcgctgctgttcctggtggcggcgctggcggtgcggggcttgctggccagtgcggcgacggcggcgcacgggcggctgtcgccggcggtgtacgaggcggccgagaaccggctgctcgatctgaccacgcgggtggatctggcgaccttcgacgatccggactggcgggacgccatggaacgggcccgcgaccgggggatcgacgcggcacagcaggtggtggacttcggcatcgaggtgctgacccacgtgatcgggctggtggcggcggccggggtgctggccgtgctgcatccggcgctgctgccgctgctgatcctggcggtggttccgaccggctgggcggcggtgcgggcggcgcgtgccgggtatcgcagccggctgcggttgatcgccgtgtggcggcgccagcggatgctcgcctacctgttggcggcgcgggaaccggccgccgaactgcgggccttcacggtacgccggttcctgctcgccgaggtggcccgcctgctgcggatctccacggtggaggagatccgtatggtgacccggcaggtccggacgaatctggccgggcaggcactgagcgggctgctcaccgggctggcgtatgtgacgctgtgctggctgttgtggacggggcggatggagctcgccgccgggggcgccgccgcgtacgccatcaatatcggtatttccaaactgcgcgaactggccttctcggcgaaccgggtgtacgagtacgggttgtacttcgccgatttccaggggttctgcgagctgtccgaggcgcgggccgagccagcgtccgaggtgcccgcgccggcgacgttcggcgagatccgggtggacggcgtgacgttccggtatccggatgcggagcgggccgcggtggacggggtgagcatgacgctgcgccgcggcgagatcatcgcgctggtcggggagaacggctccgggaagtcgacgctggccgcggtgctggccgggctgtaccggccgcagcagggcacggtcagctgggacggggtggacgtgacccggttccggccggagtcggtgcgcgagcgggtggcggtggtgatgcaggagccgacccggtggccgctgtcggcgcgggccaacatcgcgatcgggcggcacgaccggccggcgtcgctggccgaggtgcgcgaatcggcccgggccggtgacgcccacgggttcgtgacggaacttccccgggggtacgagacgctgctgtcccggcatttcaccgacggcgccgacctgtccggcgggcagtggcagcggctcgcggtgagccgggcgttccaccgggacgcgccgctgctgatctgtgacgagccgaccgcgaacctggacgcgcgggccgagcacgaggtgtacggccggctgcgcgggctggccgccggccggaccgtggtgctgatcacgcaccggatggccagtgtccgcgaggccgaccggatctatgtgctggatcacggcgcggtcgtcgagcagggcggtcacgacgagctgatggcggccggcgggttgtacgcgcagctgttcacgttgcaggccagcgcctatcaatccgcctga

SEQ ID NO: 1393 - DNA, 516 bp, Actinoplanes utahensis
atgacggagaagatctttccagccgaggccgacgaggcacgcttctggagcctgatcgagtcggcctggaccgccctcggcgacgaacccgcccgcctgcgccacgagctgctgaccggggcgcccggcacggatccatatgcgatcgacgcctggctggaccgcttcgtggagcagctcaccgccctctctgccgatctctcctcggccgaactgaccgctttggaccgggtgctggaacgcaaacttcacgacctcgaccgtgcggacatccacgaggtcaccgacggttccgacgacggcttcctctacgcgcgtggacacatcgtcgctctgggccgggcctactacgacgcggtcagcgccgacccgcagaaggccgtcgtggacgccgactgcgaagccatgtgctatctcttcgcgaacctccaccaggaacgcttcggtagctggccggaaaccggttccggcatcagccgcgaaagcggctccaactccagcggctggagcagctga

SEQ ID NO: 1394 - DNA, 1131 bp, Actinoplanes utahensis
atggcgcgcacgctgctggtcaccaacgactttccgccgcggcccggcggcattcaacagttcgtgcacaacctcgcggtgcgccagccggccggctcggtgatcgtctactcgtccacttggaaaggggcggccgcgttcgacgccgagcagccgttcgaggtggtccgggaggacaccgggatgctcctacccaccccggcggtcgccagacgggccggcgaactcgcccgcgcacacgggtgcgacagcgtcctgttcggcgcggccgccccgctcgggctgctcgcccacggcctgcgccgcaccgccgggatcacccgcgcggtcggcatcacccacggccacgagatcggctgggccgccctgcccggcgcccgttcgctgctgcgccgcatcgcccgcggcagtgacgtcatcacctacctgggggagtaccagcgggtccgcctcgacagggcgctgcacgggctgaccgacctgcgacgactcgcccccggcgtcgacgtcgacacgttccatcccggcgtcgacggctccgcggtccgcaaacggcacggcctcgccgaccgcccggtggtggtctgcgtgtcccggctggtcccgcgcaaggggcaggacatgctgatccgtgccctcccggagcttcgccgccgcgtccccggcgcggcgctgctgctggtcagcggcggtccgtaccgcaagaccctggccaccctggcccgcgatcacggcgtcgagtccgacgtgatcttcaccggctcggtcccgtgggcggaactccccgagcactacgcggccggcgacgtctacgcgatgccgtgccgcacccgcgccgccggcctggacgtcgaaggcctcggcatcgtctacctggaagcctccgccaccggcctcccggtcgtcggcggtgactccggtggcgcccccgacgcggtccgcgacggcgaaaccggctatgtcgtcggcggcaccgacctggccggcctcaccgaccgcctcaccaccctgctgtccgacccggatcaggcccgcaccatgggtcaggccggccgagcctgggtcgagaaggagtggcgctgggaaacccaggccgcccgcctcaccaacctgctcaccccacccgcctga

SEQ ID NO: 1395 - DNA, 1257 bp, Actinoplanes utahensis
atgactccccggatgtgggccctggtgtcgttcggggtgctgctcgtggcgctggtgctggtcgccgcgctcaccgtgccctggcaccgcgcccccgccccgcgtgccgaccaggtggccgcgctcggccgattcccggccgagcaggtcgcccgggcccggcagttccgcgccgagctgcgtcccggcacctacggcagcatgctgctcggcctggtggtggcgctggcgctcgggctcaccccgctcggcgcccggctggtcgagctggccggccggccgttcggcgggcactggctgggccgcgcggtgctcggcgggctgctcgtggtcctcgtcggcgagctgctcaccctgccgttcgcggcctggcggcacaccatcgtggtgcgctacgggatatccacccagtcgtggggcggctggggcaccgacctgctgaaatccttcgccgtctcggccgtgctgggcggcctggccctggccgggttcttcgcggtcacccgcttcgcaccacgctggtggtgggccttcggggcggccggtgccgccgggctcgtggtgctgctgtcgttcgtgctgccggtggtcgtcgagccgatcttcaacaggttcaccccgatgccggccggcccgctgcgcgccgagctgatcgcgctggccgccgccgacggtgtgccggtcaaggacgtgctggtcgccgacgcgtcgcggcgcacccgcgcggtcaacgcgtacgtgtccggcctcggccccacccggcggatcgtcgtctacgacaccctgctcaccgaggccacgccggacgaggtggtctcggtgaccgcccacgagctcggccacgccaaggacggcgatgtgctcaccggcaccctgctcggcgcgctcggcgccgcgctcgcggtgatcgcgatctacctgctcggcgcctggaccggcctgctccggctggccggcgtcgacacgatcggcgagccccgggcgatcggcctgctgctcgcgctggccgcgcttgccgggctgctcgccggccccggccaggcgttcgtctcccggcagatcgaggcccgtgccgaccggcacgccctcgacctgaccggtgacccgcagaccttcgaagccatgcaacgccgcctcggcaccgtcaacctgtccgaccccgacccgccgacctgggagttgctgatgttcgccacgcacccgtccaccgtgcagcggatggccgcggcccgcgcctacgcccggggcgaacgctga

SEQ ID NO: 1396 - DNA, 210 bp, Actinoplanes utahensis
atgatcatcgattgtggtcgttgcgtcgagcggaccgacgagtgcaccgggtgcctggtcagcgtgctcgcgcagacaccggacgggatcgccgacctgactcccggtgagctgcgggcgatcgaggtgttcgagctggccggtctcgaggtggagctgctggagacgccggagccgccggtccgggtcgcgctccgccggacggcatag

SEQ ID NO: 1397 - DNA, 1371 bp, Actinoplanes utahensis
atgtccgcgccgctgaaccccgacgaccgccccgcagaggaggcggcggccgcggctgtggatgtcacccccgagccgattctgccggaggtcgtccggcagcggatcatgacactcgccgccgccgcgctgcccgggctgccggccgacgagatcccggtggtgctgcgccgggtcgcccgcttcgcaccgaaccggcgggcccgcctcggcggccgggagatcgccgcccagctgaccgccgacccgctgttccggcagcggatcggtgcccggatcgtgaccgacgccggtgacctgggcgccgccgtgaccagcggggtcgccccggccgcggccgacccggtggaggtcgccgcgctggcctacctggcccgcccggacggctggcgggacctgatcgaggcggccggtgacgtggtccgggccgacgccgacagccacgccctggccgaccggatccgcgccgccgagcagcgggccacccgcgccgagcacgaccgggcggtggcccgggtcgaggccgacaagctgcgcgacgagctggcccgggtccgcgaggagctcggccaggtgcgcgaggaggcgcgggtcgcggccaaggcgctgcgcgagacccaggccgcccagaaacgcgcggccgacctgctagccaccgagaagggccgcgctgcgcgcgtcgccctggaccacgaggcggaggtacgccggatgcgctcgcgcctcgccgacgcggaagccgccgcggccaccgggaagcaggccgccaaggacgcccgcgcggtcgacgacgcccgcctctggctgctgctcgaaaccatcgggcaggcggccaccggcctgcgccgcgagctggccctggaccccaccgacaagctgcccgccgacttcgtggccgacgccgcggccgaccggcccggcgcacccgagcggtcccaggcccgcgcccaggacaccgacgacccgggccggctcgaccagctgctcgcgctgccccgcgcccacctggtcgtcgacgggtacaacgtgaccaagcgcggcttcgccgacatgtccctggagcagcagcgcaaacgcctgatcaccgggctcggcgggatcgccgcgcagaccggggacgaggtcaccgtggtgttcgacggggccgagcgggtgcacgggctgccgccggcgccgcgcggcgtgcgggtgctcttctcccgcaagggcaccaccgccgacgagctgatccgccagctggtccgggccgagccgcccggtcggccgctggtggtggtctcctccgaccgggaggtcgccgacggtgtccgtcgtcacggggcgtatccgatgggcgcggattcgctgctgcgccggctcgcccggtcctga

SEQ ID NO: 1398 - DNA, 1812 bp, Actinoplanes utahensis
gtgttgcccgccgtggcacaaccggcttatgtgcagggcactctggacacgctgctgtcggcggacggctcggtggatccggcggccgtctcgctggccgacaccaccttcgtggtgctcgacctggagaccaccggcggcgctccggacggtggcgggatcaccgagatcggcgcggtcaaggtgcgcggcggcgtgccgatcggcgagttcggcacgctggtgaacccgggtgagccgctgccgccgttcatcaccgtgctgaccggcatcaccgaggcgatgctgcgcccggccccgccgatcgagacggtgctgccggcgctgctggagttcctgcgcggtgccgtcctggtcgcccacaacgcgccctacgacgtgggcttcctgaaagccgcctgcgcccggcacggctatccgtggccggcgccccgggtgctggacaccgcggccctggcccgtcgggcgctgacccgcgacgaggtgcccaatcgcaagctcggcacgctggcccagttcttccgctccgcggtgcagcccaaccaccgggcgctcgacgacgcgaaagcgaccgtcgacgtgctgcacgggctgatcgaacggctgggcagcttccgggtgcacaccctgggcgacgcgatcgagttcgccaaggcggtcaccccggcccagcgcagccgccggcacctggccgacggcctgccgcacgtgccgggggtctacatcttccgggccgccgacgagcgcccgctctacgtcggcacgtcgaaggatgtcgccacccgggtgcgcagctacttcacggccggcgagaaacgcgcgcggatctccgagatgctcaccgccgcggtccgggtggaggcgatcgagtgcgcccatccgctggaggcggaggtgcgcgagctccgcctgatcgcggcgcacaccccgccgtacaaccgccgctcgaaatatccggagcgggtggtgtggctcaaactgaccgccgaggccttcccccggctgtcggtggtccggcgcttcgccgaggacggcgccacctatctgggcccgttctcctcgcggcgcaccgccgagctggccgccgccggcgtctacgacgccgtgccgttgcgacagtgcaaccacaagctgtcgctgcgcacccgcaccccggcctgcgcgctggccgagctgggccgctgcccggcgccgtgcgagcacgagatcaccccggaggagtacgacctgcgcgccgccgcccccttccgggtcgccacgtccggcgaccccggtccggtgatcgaggcgatcctggcccggctggacacgctgagcgaccgccggcggtacgaggaggcggccaccgtccggtcccgcctgatcgccctgctgcgcgcgctgatccggatgcagcggttggacgcgctgacccggctgccgcaggtcgtcgcggcccgccgggacgaccggggcggctgggagatcgcggtggtccggcacggccggctggccgccgcggccacctctccgccccgcgagcatccccggcccaccctggacgcggcactgttgaccgccgagacggtccttcccggaccgggcccggtgccgtcggccacggcggaggagaccgagcgcatcctggcctggctggagcggggggacacccggctggtggaaacctccggcgactgggtgtcaccggctcgtggcgcggcgcgtttcgcggtcctgctcagccgggccgaggcggccgcgtccgcacaagactcgaccgttcgcctatcggtaactgaccgttcggatgacgcccgctcgcttaggctgtaa

SEQ ID NO: 1399 - DNA, 1791 bp, Actinoplanes utahensis
gtggacgtcgacgccggccacggcgccgctctcggtcgtgcgctgccggccgccacgtccccgagcccgctcagcttcacccggcggctccgttcgctgctgagcttccagggcaacgacgacgatccggtttcgaccctggccaagacgcaccggaccatccacccggcggccgatgtggcgctgctgcgccgcagctacgcgatcgccgagagcatgcaccgcggccagttccgcaagtccggcgatccgtacatcacgcatccactggccgtcgcgcagatctgcgccgagctcgggatggacaccaccaccctggtcgcctcgctgctgcacgacacggtggaggacaccagctacacgctggaggctctggagggcgacttcggccccgaggtgacccacctggtcgacggcgtgaccaagttcgacaaggcgttctacggcaaggccgccgagggcgagacgatccgcaagatgatcgtcgcggccggcaaggacgtccgggtgctggtgatcaagctggccgaccggctgcacaacatgcgcacgctggacgcccgctcgccggcctcccgggcccggatcgccaacgccacgctggacgtgctggtcccgctctgcgaccggctcggcatccaggcgctcaaacgcgacctcgacgacgtggtcctgttccacctggagccggacgcgttcgcccggatcgacgagcacgtgcgcaaccggcccggctggggtgactacctggccgacgtctccgccaaggcgcgcgtcgcgctgcgccggtcccgggtcgacgccgaggtcaccgcgcgtccccggcactactactcgatctggaaggacaccgtcgccggcggccactcggtcccgctcgacctgccccggatcgcggtcgtggtggacggaccggaaaccgactgttacgccgcgctcggcgcgatccacggccgctggcgcccggtcgccggccggttcaaggacttcatcgcctcgccgaagaacaacctgtaccgctcactgcacaccaccgtggtcggcccggagggacgcctggtcgaggtgctgatccgcaccgagaccatgcatcgatactccgagtacggcgtcgccaccagctaccgatatcccaaggtgtccgacgagccacccggcgccgaccagctgacctggctgaaacgagtgctcgactggcagcaggacaccaccgacgcggcccagttcctcgattcgctccgatgtgacctggccgaggcccagatcacggtcttcgcccacggcaacgcgtacgaactgcccagcggctccaccccggtcgacctggcgtacgagctgggcccgtcgaagggcgaccagtgcctcgccgccaccatcaacggccgcctcgcccccctcagctccccgctgcgcgacggtgacgtcgtcgagatcttctcggagaacgacgggcacgtcgaggtcgagccgaacgccccgcgcggcccgcgtcgggagtggctcggattcgtcaagtcgagccaggcgcagatgcagatcaaccgcttcttcgacgagcggaacgagcccggcatcagcatcgccgacaaggtccgcctgggccgggcgacgatcgggctgaccctgcgcaaacacgaccgcggcctggccagtgaggtgccgttgcgccgcctcgccgaggacatgggctaccccgacctggaaaccctgctcgtcgcggtctgcgagcgcaccgtcgagccggactcggtggtcgagcagctgatcgccatggtggaccacccggactga

SEQ ID NO: 1400 - DNA, 564 bp, Actinoplanes utahensis
gtgaaccttcctcggcagctgcgtggcctcgcgtatcaggtcttctacggcctccccctgccgatgcggcgccacatcgcccgcgcggtctcccccaaattcctggtcggcgcggtggcggtgatccgggacgcggaggccgccgagccgggccgcatcctgctgctgcgccagccgcccggccgcggctggggtctcccggccggcctgctcaagcgcggcgagctgccagccgtcggcgccgcccgcgagctgcacgaggaggccggcgtccggatcgagccgggcgatctgcgccccggcgacccgaacgcgatcgtccacccgaacggcggggtcgtcgacacggtctggttcggctgggtgccggcgtccagcacaccgctggcggtcgacggcggcgaggtcctggaggcccgctggtggccggtcgacgacctgccgaagctgacctggccgacagcccggctgctcggcgtctacgggatcgggcccaaagccggcgagttgcccccgtcggtcccgtcgtccagcgccgccccgtcccgggatctcccccagtga

SEQ ID NO: 1401 - DNA, 978 bp, Actinoplanes utahensis
gtgacccaccggccgccccgcccctggagctccccagtgacccactcgcccaccggcccggccgtcgccggatccggtacgccgcgcagtcccgaggtgtgcggggtcgtgctcgccgccggcgaggggcagcggctgcgcccgctcaccgcgaccgtcccgaaagccctctgcccggtcggcaacctgccgctgctcgaccacgccctgcgccgcctggccggcctcggcctgctcggcccggaggacgtcgcggtgaacgcggcctacctcgccgatcaggtcgtcgcgtacgccaccggccgcgcgcacctgtcggtcgagccggacggcccgctgggcacctccggcggcgtcgcccggctgcgcaagtggatcgacggtcgcggggtgctggtcggcaacgccgacgcctacctggccgacccgttccgcgaccccggccgggacatcgaggccctgtgcgacggctggtccggcgacacggtgcgcctgctgaccaagccgtgccgtcccggcgaggccggcggtttcagcggtaaccgtttcgccggtttctccctgcttccttggcggtacgtcgccaccctgccggatgagcacagcgatctcgtccgcaccgcgtggcgtcccgccgaggccgagggcgccctggaactgatcggctacgagggccactacctggacaccggcaccccgtcgctgtatctggaggccaacctgcacgccgccggcgccggcctggtcgacccttctgccgaggtgaccggtacggccaccgggtcggtggtcggtgccggcgcccacgtggccggcacggccaccggttcggtcgtcggcgccggcgcccacgtggccggccgcatcacccggtgcgtggtctggccgggcgccaccgtcgagccgggtgaggacctcgccgaggtgatccgcgccccgggcgggctgaccgtcccggctgccgggctgggtggatag

SEQ ID NO: 1402 - DNA, 288 bp, Actinoplanes utahensis
gtgaacaccgcgatcgtccacatcgactgcgccaccgactcgatccccgaggtcgccgaggcgctggccgccctggacggcgtcagtgaggtctactcggtggcgggtggcgtcgatctgatcgccatcgtgcgggtcccgcggttcgaggacatcgccgaggtgatcgccggccgcatctccaagaccgccggcgtgatcaacaccgagtcgcacatcgcgttccgggcgtactccaagcatgacctggaggacgccttcgcgatcgggctgcccgacgccgactga

SEQ ID NO: 1403 - DNA, 1014 bp, Actinoplanes utahensis
gtgcgaaggaagatagtttttgcggtcatcacgacagtggccgccgtgatcggtgtcggtgtggccgtcctgctcgccggcaacgacttccggatcgacgtgcggcggctcagcgtccccgggccggccggtgcgcttgacgccgtgctcaccacgccggccggcggcgtgccacgcggcctggtggtgatgatccatggtgacgggccggtggaggccacccacgacgggctgtaccagccgtggttcgaggccgcggcggacgccgggttcgcgaccctgtcctggagcaagcccggcgtcggccgctcggcgggggactggctcgcgcagagcatggccggccgggcagacgaggcatcccgggtgatcgactgggcgcgtggccggccggacgtgccgcacgggccggtggtgctgtggggcgccagccaggccggctgggtggtgccgcggatcgtcgccgtccgggacgacatcagcgcggtcgtgctggccggtccggcggtcaactggctccgccagggccgctacaacctgctcgcggaactgagccacgacggggcgggcgatgccgaacgcgaccgggccctggcggtcagcgatcgcacccggcagcttctggacgagggcgcgacctatcggacctatcgcgcccgcagcggcgacccggagccgatggacgaggcccgatggggcttcgtggcccgcaactacacctcggacgccaccgccgatctgcgggccatggcggggcggcacgtgccggtgctgctgatgctgggcgagcacgaccgcaacgtcgacgtcgcggagaccgcggcaacctaccggtcgatcctcggtgaccggtatgttgccgtcgccatgttcgatgcggtgcactcgctggcccggccggtggtggccgaatcggacgcggcgggcctggtgatcgccgttttccggccacgggcgctgctggcgccgggggtgctggacacctaccgcgatcgcctggaacggctgcggtga

SEQ ID NO: 1404 - DNA, 588 bp, Actinoplanes utahensis
atgacactggagatcggatccggcttcaccgaggccgagcgaacccgggtcggcctgctgtactgggcggccttcgggcgcaagctgcgcctcgcgttccgcgacgaggccaccggcgtcacccgggtgacggctgcgctgctccccgaccggatgctgatcgcccgggccggcggcgccgtgaccggggtgtgcggcttccaccgggacgggcacggcgcggccgacctctcgtggtcccgcctccgaccccaggccggccgggcgagcgcactgcgcgcgctgctggccctcgccccgctggagcgacacccgcaagccggcgtgctcctgctggacggcgtcgccgtcgacgcggcgctgcgcggacgcggcatcggatccgctctgctggccgccgcggaggaacaggcccgtcggcagcatgcccggtgggtgcagctctcggtcgtcgacaccaaccctcgcgccgaggcgttgtaccgccggctcggataccagccggtcagcaagggatcgatcggcactctgcggcatctgtacggcttcgagcgtttcaccacgatgcggaagaggatcagcgcgtga

SEQ ID NO: 1405 - DNA, 843 bp, Actinoplanes utahensis
gtgacacccgctccgaggaccgtcgtcgaggcgttcctgcccgccgacggcgcggccgcactggaccagctctacgacaccgccaacgccgccgggctggacgaccagccggtgcgcctgacgatccggcgaatggtcgccgccggcgaggtcacccagtccgggcggggccgccgcggcaccctcgcactgaccgccaccggacgcgagcgcctgcgccgtgaccggctggcgctgcacctggccctcgcccaggaccgcgggcaggccccgtgggacagccggtggcggttgctcgcggtcagcgttccggagacggaccgcgccgcccgggacgccatgcgccgtgaccttctggctgccggggcggcgccggtctccacgggtctctacgccagcccgcacgacctgagcgcgatgctcggccctctcgacaccagcgccaccgtcgccggcactccgggcgcggacactcccggcaccggcgcgttgttccgggccatcgccaccgacctcgacgtgcgcggggtgaccgaccccgccgagatcgccgagatgctctggccggcggcgccgatcatcgaccggtacgccgtcgccgaccgggccgtcgagctggccggttccctgcggcccggcgccgacacccgagccgtgctgctgcgccagctgcgcctggccgatgcgtgggaactggcgatgcgacaggacccgctcatcccgccggaactgcgtggcgacccatggcctcccgccacgatccggcgccggtggcacaccgcctggacggagctggccgcccagctccccgatcagctgctctaccgcggctggctgccctga

SEQ ID NO: 1406 - DNA, 1611 bp, Actinoplanes utahensis
gtgaaacgccgaaagctagatccagccgaggcaacagccaacttcgccaagggcgtcgatgaccgcttccaggcggccaccccgctccgggcgctcctgaacaaggtcttccccgaccactggtcgttcctgctcggggagatcgccctcttctcgttcatcgtgctgctgctcagcggtgtgttcctgaccctcttcttcgatcccacgatgaaggaggtcacctaccacgggtcgtacctgggcctgcacggcgtgcagatgtccggcgcctacgagtcctcgctgaacctctcgttcgaggtgcgcggcggtctgttcatgcgccagatgcaccactgggcggcgttgctgttcatggcgtcgatcgtggtgcacatggcccgcgtgttcttcaccggcgcgttccgcaagccgcgtgagatcaactgggtgatcggcgtcctgctgttcctgctcgggttcttcgccggcttcaccggttactcgctgccggacgacggcctgtccggcaccggtctgcgcatcgcctcggcgatcatgctgtccctcccggtcatcggcacctggctgtccgcctcgatcttcggtggggagtaccccggcgagctgatcatcggccggttctacatcgcgcacgtgctgctcatcccgggcatcctgctcgcgctgatcagcgttcacctgggcatcgtgttcaagcagaagcacacccagtggccgggcccgatgcggaccaacgagaacgtggtcggcgagcggatgttcccgcggtacgcgatgaagcagggcggcttcttcatggcggtcttcggcgtgatcgcgctgatggccggcctcttccagatcaacccgatctggctgttcgggccgtacctggcctccgaggtctcctcggcctcgcagcccgactggtacgtcatgttcatggacggcctggtccgtctgatgccgaactggcagatctacatcccgttcggcgacggctacagcatcccgccgctgttctggcccgccgtggtcggcctcggcgcgctgttcacgctgccgatgctctacccgtggctggaagcgcggaagctgaaggacaaccggtcgcaccacctgctgcagcgtccccgggacaaccccgagcgcgtcggcatcggcatgatggccttcacgttcttcctggtcgccacgatctccggcggcaacgacgtgatcgccgacaagttccacatcagcctgaacgcgatgacctgggccggccgcatcggtctgctggtcctgcccccgctggcctactacgtctcgatccggatctgtctcggtctgcagcagcacgaccgggaggttctggcccacggcgtcgagaccggcatcatcaagcgcctgccgaacgggaagttcgtcgagatccaccagccgctcggcccggtggacgagcacgggcacccgatcccgctggagtaccgcggctgggtcgtgccgaagaagatgaacaagatcggggcgctcgcgccggcggtcaagggcttcttcttcccgatcgagaagccggccgaggcgccggtgtcgccggctccgatcggcgccaccaagcgcgaggagatcaccaccaagcgctga

SEQ ID NO: 1407 - DNA, 1098 bp, Actinoplanes utahensis
atgacagcgcaccacggcgtcgccggcgagccggtcgacgtgaccgatccgaagctgacccgcttcgacatcgtcaaagagggcctgcggcgcgacgacatcgagatcgtcacgtacgagtcgcagttcccgggtccgaactcgaaggccgagcggcgcatggtgcgcagcatctccttcctgttcatcttctccggcctggccgccctggccttcctggtcttctacatcgtgtggccgtggaagtgggccctgggcaccaccaggagcgacttcttcacgccgatcctcggggtgaccctgggtctgtcgctcttctcgctcggcatcggcatcctggcctgggccaagaaactgctgccgcacgagctgtcgatccagcagcggcacggcgacccgtccagcgacgaggaccggctgatcaccggccagaccatgatgtacgtcgcggacgagctgggggtgcagcggcgcccgctgctcaagggcgcgatcggtctcggcctggccccactcggcctggccgcggcggccccgctggtcggcggcctgatccagaatccgcataagggtccgcagcagatgatggaccacaccggcttcgacccggtgcccaacggcggcaagccggtccggctcacccgggaggacgggaccccgatccgtccggaggacgtcagcgcgggcggtcagatgacggccttccccggcatcccgggcggggcgaccaacaggtacgcggactcgccgaccctgctgatccacctccgtgacgccgacgccgccaaggcccgggccaacgcggacagcgacaagaacgggcgcaacaagggctcgatgtggggtaactacgtcgcgtactcgaagatctgcacccacgccggttgcccggccagcctgtacgagcagcagacgaatcgcctgctctgcccgtgccaccagtcgcagttcctgatcaccgacaacgcgcagccggtcttcggccccgccacccggcgtctgccgatgttgccgctgtcggtggacgcagaaggtttctttgtggcaacgtctgacttcaaggacactgtcggacccgacttctgggagcggccgtga

SEQ ID NO: 1408 - DNA, 849 bp, Actinoplanes utahensis
atgacttctgacacccccgcccgcaggcgcgcccgggtgttctcccggcgccgcggcgcgcccagccgggcacgccgccgggtcggtgcggcggtgcgcatgctcgcggcgctcgcgctcgccggcggcgtctacaccgccttcacccctggcgccttcgctgaggacaacagccagctctccaccgccgcgcagcagggcaaggagctcttcgacaacagctgcatcacctgccacgggcgggacggtcagggtgtccaggaccgcggcccgagcctgatcggcgtcggctcggcctcggtcgagttccaggtgggtaccggccgcatgccgatgacccgccaggaggcgcaggccgagcagaagaagccgcagttcaccccggatgagatcaagcagatcgcgcagtacatccaggagatcggtggcggcccgcagatcccgaccggcgagctggtcgagaacctgaagaacaaccccgaggccctggcccgcggcggcgagctcttccggaagaactgcacctcctgccacagcttcaccggcgccggtggtgcgctctcgtccggcaagtacgcgccgagcctgcacgacgccacggcggagcagatctacgcggccatgctgaccggcccgcagaacatgccggtcttcggtgacaaccagctcacgcccgaccagaagcgcgagatcatcacctacatcacgcagcagctgcagcagaacaaggacccgggtggcgtgttcaacctgggcggttacggtccggcgaccgagggcttggcgatcttcctggtcgggatcacgatcctggtcttcacgtcgctctggattgcggggaagtcatga

SEQ ID NO: 1409 - DNA, 597 bp, Actinoplanes utahensis
gtgacagcggcagccatcgacaagagccggatccactcgctcactcggccgaacatggtcagcgtcgggacgatcgtgtggctctccagtgagctcatgttcttcgcggcgttgttcgccatgtacttctccattcgcgcggccgcccccggcatgtgggcggagcacaccagagagctcaagatcccgtacgccacgaccttcaccacgatcctggtcctgtcgtcggtgacctgtcagctgggtgtcttcgcggcggagaagggtgacgtgttcgcgctgcggcgctggttcacgatcaccttcgtgatgggcctgatcttcgtgctcggccaggcgaacgagtaccgcaacctggtccacgagggcgtcaagctcaacggtgacgggtacggctcgatgttctacctgaccaccgggttccacggtctgcacgtgaccggcggcctcatcgccttcatcatctacatgatccgaacgaccatggggcgcttcaccccggcgcaggccacgtccgcgatcgtcgtgtcctactactggcacttcgtggacgtcgtctggatcgctctgtacgccatgatctattggctgaagtga

SEQ ID NO: 1410 - DNA, 972 bp, Actinoplanes utahensis
gtgcagtcagtcgaatttgcctcgctggcggacgggtccggggatactggactcccgcccttcaccgcggccgcgatcttcacccggttccacttcgtcagcctgatcgcggtgggtctgctggtcgccgcggcgctctacctgtacggcgtgcaccggctgcggcagcgcggcgaccactggccgggtggccgggtggcggcgttcgtcgccggtggactcggctcgatcgcggcggtctcggtgaccggcatcgagggctacgacaccacgctgatctcggtgcacatggtgcagcacatggtgctgtcgatggtgggcccgatcttcctggccctgggcgcgccggtcacgctggccctgcgggtgctgcccacgcagccgcgcaaggccctgctcgcggtggtgcacagcgggttcgtccgggtgctgaccttcccgctggtcgcgttcggactgttcgtcgcgaacccgttcatcctctacttcacgccgctgtaccggcagacgctggagcacgcctggctgcacgagttcatccacgtgcacttcctgatcaccgggtgtctgttcttctggccgctgctcggcctggacccgctgcccaaccgctggccgtacccggggcgggcgctgctgatggtgctgtcggtgccgttccacacggtgctcgggctgaccatcatgcaggcctccgacctgctcggcggcgactggtacccgagcctgcacctgagctggatggatccgcatgccgaccaggtcaccgcgggcggcatcctgtgggccggcggcgagatcgtcagcgtcacgatgctcggcatcctggtgatgcagtggatcaagcagtcggagcgggaggcccgccggatcgaccgggccctggaccgggtcgagatggaggaggccacggcggccgccaagatcacagatccgccgaacacggatcgcccgggccccgaggccggataa

SEQ ID NO: 1411 - DNA, 453 bp, Actinoplanes utahensis
gtgaagtggggcacaaagttgagcgacacagccacgacccagtacacggttctgctatacagcgacgacgccgcggtgcgcgaccggatccggctcgccatcggcacgcgtccggcggccgatctctccgtcgagttcaccgacgcctccacctgggaggagtgccggcgactgctggacgactacgagatcgacctgatggtgctcgacggtgaggcgacccccgccggcgggctcggcatcgcccggcagaccaaggacgagtatccggacccgccgcccacctgcgtcgtgatcgcccgcgcggcggatcgctggctggcagcgtattcgcaggtcgacgcgaccctgctggccccgctcgacccggtcaccaccggccagacggtggccgggctgctccgcgcccgccgctccggcgtggtcccgctgggcgccctcccccgcacctga

SEQ ID NO: 1412 - DNA, 1059 bp, Actinoplanes utahensis
atgggcgcacgcacctggccgaatctgacgagttccctgctgcgtggcgaggaactcgccgccgcggacacggcctgggcgatgagcgagatcatggcgggcaacgccacgccggtccagatctccgggttcgccgtggcgctgcgcgccaagggcgagaccccggccgagctggccggcctggtcgaggcgatgctgtcggccgccaccctggtggagctgccgccggagacccgggccgccgctgtcgacgtggtcggcaccggcggcgaccgggccaacacggtgaacatctccaccatggcggcgatcgtcaccgcctccgccggggtgaccgtggtcaagcacggcaaccggtcggcgtcctccaccaccggcaccgccgacctgctggagcacttcggcatcccgctcgacctcggcccggccggggtgaaccggacggtcgcggaggcgggcatcggcttctgcttcgccgcgcggtaccaccccggcatgcggcacgcctcggtcacccgccgtgagctgggcgtgcccaccttcttcaacatgctgggcccgctgaccaacccggcccgcccacgcgccgcagcggtcggttgcttcgagccgcggatggccccggtgatggcctcggtcttcgccctgcgcggtgactcggcgctggtgatgcgcggtgaggacggtctggacgagttcaccacggcggcgccgacccggctgtggctggcccgcgacggtcgggtcgacgagatgctggtcgacgccaccgagctgggcctggcccgcagcgagccgaacgcgctgcgcggcggggacgcgtcctacaacgccgacgtggcccgccgggtcttcgccggcgagtccggcccggtccgggacgcggtgctgctcaacgcggcggccgctttcgcggcccagggcggcttccccggtgatttccgcgacaccatgcgggccggcatcgcccgtgccgccgaggcgatcgactccggcgccaccaccaagctgctggaccgctgggtcaccgccgctcgagccgccaagaccgccgaataa

SEQ ID NO: 1413 - DNA, 354 bp, Actinoplanes utahensis
atgggtggtttgagggcactagttgctgaaaaatctggaaaaagactgcaacacaccgccggtgatgctcggaatcacccgcggggcgtgacaacgtctgaaggacattcgggtaatcccaccttcccgacgaaggagaagcccgtgcacgaacgtgaactgcgctgcgtcatctgcgacggcgacatgctgttcgagacaccgccctgcgacgacgggcacgacgactgtcccgagctggtctgcacccgctgcggtgccgccgaggtggtcgccccgatcgtcgtccacctgtggatggagccgaagggcccgcggcgcatcgccccgcatcagcgcaccgccgccgcctga

SEQ ID NO: 1414 - DNA, 426 bp, Actinoplanes utahensis
gtgaagaccgaatacaagatcttcctgggtgtctccctgttcctcttcggggcagccaccgtctacggcctgtacaccaagggccagcagcaccagaccgagtgggtcggcaccgtcgcgctgatcctgtccggcctgctctgctcgatgtgtggcggcttcttctggttcgtcgcccgccgcatcgacctgcgccccgaggaccgtgaggacggcgagatcgccgagggcgccggcgaactgggcttcttcagcccgggcagctactggccgttcggcatcgcgttctccgcggcgatcgccggtctgggcctggtgttctggatgtggtggctgctggcgttcggcctgctctgcgtgatcttcacggcttgcgggatgctcttcgagtactacagcagcacccggcagcccgcggagcactga

SEQ ID NO: 1415 - DNA, 930 bp, Actinoplanes utahensis
gtgggcgcaaggagttcggccacacggccgcgggcgattggccgggcggccgggctgggtctcggcggcgcgatgctgctggcgctgctcgccggttgctcggtcgaggacgtcgggagcaagttcggccacttcggatggcccggccggggtgtcagcctgcaggcccacgagatgtacgacctgtggatcgcctcggtgatcgccgcgctggtggtcggcgtcggcgtctggggcctgatcttctggtgcgtgatccggtatcgcaagcgcggtgacgagctgcccgtgcagacccggttcaacatgccgatggaggtcctctacacggtcaccccggtgctgatcgtcgcggtgctcttctactacaccgcgatcgtccagaccgacgtggacaagctgtcgaagaaccccgaccagatcgtccagatcaccgcgttcaagtggaactgggagttcgactaccgggacggcatgggcaaggacgcgcacaccgtcgcgtccaccgtgggctcctcggacgtcatcccgatcctggtcctcccggtcggcgagaagatccgcttcgaggagaccagcaaggacgtcatccactcgttctgggtgccggagctgctgttcaagcgcgacgtcatgcccggcaacatccgcaacgtgttcgaggtgaccctcgacaaggagggccgctacgtcggccggtgcgcggagctctgcggcacgtaccacgcgttcatgaacttcgagctggtcgcgaccagccaggccaagttcgaccagttcctggcggcgaagaaggccggccagtcgacgcaggacgcgctgagcgcgatcggcgagcagcccttcgcgaccaagacgcagccgttcgacacccgccgcggcacgcacacctggaaccagagcggcagcactgtcgccgcggggaagtag

SEQ ID NO: 1416 - DNA, 1137 bp, Actinoplanes utahensis
gtggattacacaggcgatccgccggtctacctggacgcggccagcgccgcgccgctgcatccggtggcccgggaggcgatgctcgcggcgctcgccgacggctgggccgatccggcccgcctctacgcggcgggccgccgggcccagcagctgcaggaggcggccacgtcggtggtcgcggaccttttgggcgtacgcgccgacgagctctcgttctggccctccggcgccgccgcggcacaggcggcggtgctcggcggcctggccggccgccggcgggccggccgggtgctggtgcactccgcgatcgagcactccactgtgctgcacgcggccgccaccactgaggccgttgaggtgggtgtgacccgtgagggccggctcgacctggccgcgtgggccgccgcggtggccgcccccggggtggccctggccagcctgatcagcgccagtcacgaggccggcacggtgcagccggtggccgccgccgcggaatactgcgccgaggcggggatacctctgttcgtcgacgccgcccagtccgtcggccggatcccggtgccgccgggctggtcgctgctgagcgcgagcgcgcacaagtggggcggcccgccgggcgtcggcctgctggtggtccgcaaaggagtgcggtggatctcacccaccccacaggatgatctttatcgcccccgtccgccgggcgccgccgacctgccggcaatcgtcgcggcggcggccagcctgcgcgcggtgaccgccgaggcgcgggccgaggcggtgcggctgagcgccctggtggaccggatccgggagcgggtggcggccaccgtcgaggacgtggagatcgtcggcgacccggtcgaacggctgccgcacctggtcaccttcagctgcctgtacgtggatggcgagacgctgctgcacgcgctggaccggcacgggttcgccgtctcgtccggctcgtcgtgcaccgcctcgacgctgcggcccagtcacgtgctggaggcgatgggggtgctcagccacggcaacgtgcgggtgtcgctgcaccgcggcaccaccgaggccgacgtcgaacggttcctggcggtgctgcccgggctggtcgccgagatccggaaggaggccgggttctga

SEQ ID NO: 1417 - DNA, 147 bp, Actinoplanes utahensis
atgccgggggtggcgatcggcgagatcatccgggtgctcgccgacgatccggccgcggccaacgacatccccgcctggtgccgcatgaagggccaggagttcgtcgccggccacggccagcggttcgacgtgcgaaggactacctga

SEQ ID NO: 1418 - DNA, 501 bp, Actinoplanes utahensis
atggttctcgcggttttcgccggcctccccggggtcggcaagagcaccctggccgcggccgtcgccgccgagctgccggccgcggtgctcgcggtcgacaccgtcgacttcgccctgcagcggtacgcggtgcacgagccgcggcccggctacgcggcgtacggcgtggtcgcggccctggccgaggcgcagctccggatcggccaccacgtgatcatcgacgcggtcagcccggtgaaggcggcccgcgacctctgggtcgagctggccgaccggatcggggtgccgttgcgcgtggtggaggtggtgtgcggtgacgacgccgagcaccgccgccgggtggaggcgcgctacgagacccgcgaccacgagggcgtgcccgactgggtgcgggtgctggaacgccagtcggagtacgagccttacctgggtccgcgcctggtggtcgacacccacctcgcccaggacccggcgccgcaggtcgtcgcgtacctcaggtag

SEQ ID NO: 1419 - DNA, 978 bp, Actinoplanes utahensis
atgaagatcgccgtcaccggctcgatcgccaccgaccatctgatgcacttcccgggccggttcgccgaccagctcatcgccgaccagctgcacaaggtctcgctctcgttcctcgtcgacgacctggtggtgcgccgcggcggtgtcgcgccgaacatcgccttcgggatgggcaagctcggtctgcggccgatcctgctgggcgcggtcggcgccgacttcgccgactaccggtcctggctggagcggcacggggtggactgcggctcggtgcacgtcagtgacgtggcacacaccgcgcgattcgtctgcaccaccgacgacgacctgaaccagatcgcgtcgttctacgccggcgcgatgagcgaggcccgcaacatcgagctggccccggtcgtcgaccgcctcggcggcatcgacctggtgctgatcagcgccaacgacccggccgcgatgatccgccactcgcaggagtgccgcacccggggttaccggttcgccgccgacccgtcgcagcagttggcccggatggacggctcggacgtgctcagcctgatccgtggcgccgactacctgctcaccaacgagtacgagcgctcgctgctggagaccaagtcgggcctgtccggtgaccaggtcctcgacgaggtccggatccgggtcaccacgctcggcaaggacggcgtcgagatcaccggcaagggcatcgagcggatccacgtgtcggtcgtcccggacgtgatcggcgaggacccgaccggggtcggcgacggcttccgggccggcttcttctccggcatctcctggggcctcggcctggagcgctccgcccaggtcggctcgctggtcgccgcgctggtgctggagacggtcggcacccaggaatacgagatccggcccgccgacttcggcaagcgcttcgccgcggcgtacggcgaggccgccgccgccgagatcgcgccgcacctgccggcctga

SEQ ID NO: 1420 - DNA, 369 bp, Actinoplanes utahensis
gtgaccactgaagcgcacaccgagtcgaccgaggcgaccgccccgaccggcgtcatcctcaccgacgtcgccgcggtgaaggtcaaggccctgatcgagcaggaggggcgcgacgacctgcgcctgcgcatcgccgtacagcccggtggctgctccggcctgcgctaccagctcttcttcgacgagcgctcgctcgacggcgacgtcgtgagcgacttcgacggcgtcgaggtcgtggtggaccggatgtccgcgccttacctggcgggcgccaccatcgacttcgccgaccggatcgacgcgcagggcttcaccatcgacaacccgaacgcgggcaactcctgcgcctgcggcgactcgttcagctga

SEQ ID NO: 1421 - DNA, 1128 bp, Actinoplanes utahensis
gtgtgctgccacactgccggggtgcgcgtactgatctgtccggacaagttcgccggcaccctgtctgccccggaagtcgcccaggcgatcgccgacgggtggtccgtccccaccgacgagctggtgctgcggccgatcgcggacggcggccccggcttcgtcgaggtgctggccaccgcgctgcccggccgccggatcccggtccgcacggtcgacccgctgggccggccggtggcgggcgagatcctgtacgcgaacggggtcgcctacgtcgagagcgcccaggcctgcggcctgcacctgctcacgaccgaagagcgcgatcccaccacgaccacgtcgtacgggctgggcctgctgctgacggccgcggtggagagcggcgccgcgcaggtggtgatcggcctgggcggctcggcggtgaacgacgccggggccggcatgctcgccgcgctcggcgccgccccgctggacgaggccggatacgccctgccctacggcggcgccgcgctgatcgccgcggccgcgctgggcggtgtcccgcggctgcgccaggtcgccctggtggcggccaccgacgtggacaacccgctgaccggcctgcacggcgcgagcaacgtcttcggcccgcagaagggtgcgacccgccaggacgtgctccgtctcgacgcggccctcgggcacttcgccggcgtactggagaaggcctttgatcttgaagatctggcgatccggcccggtggcggggcggccggcgggatcggtgccgcgctgatcgccctcggtggccgggtgacctcggggatcggtctggtcagcgacctggtcgggctggaccgggagctggacgcggccgacctggtgatcaccggggagggcagcttcgaccatcagtcgctgcgcggcaaggtggtggccgggatcgccgggggtgcccgtgaccgcggcctgccgtgtgtggtgctggccggccgcaacgagaccgggtaccgggaggccgcggcggcgggcgtgaccgagacgcacaccctggtggagcatttcggttcggtccggcaggcgatggcggaaccggcgcgtggcctgcgggaactggccgaacggatcgccgcccagtggagtcgctga

SEQ ID NO: 1422 - DNA, 1428 bp, Actinoplanes utahensis
gtgcggaccgggatccggcggccgggcagcgcggtggccagcacctcgacgaagccggggccgccgtccgcgatcggccgcagcaccagctcgtcggtggggacggaccacccgtcggcgatcgcctgggcgacttccggggcagacagggtgccggcgaacttgtccggacagatcagtacgcgcaccccggcagtgtggcagcacacgccccgcgggcgcagctaccgtcccacgccctgtgcaacgatgttcagcgtgacgtcgacctggaccgaacccgcaaacacccccgtcgcgctgctgcttctcggcaaaggcaccgacccggcgagcgagcggggcgtggactgccccggcgatctgcccgcacccagcgaccccgacctggtggcccgcgccaccgcggccaaggccgcactcggcgaccgggtgttcgtgctcgggcaccattaccagcgcgacgaggtgatccagttcgccgatgtcaccggcgactcgttcaagctggcccagcaggcggcggcccggccggaggcggagttcatcgtcttctgcggtgtgcacttcatggccgagagcgccgacatcctgaccaagccggagcagcgggtgatcctgcccgacctcgcggccggctgctcgatggccgacatggcggtgctgggtcaggtggagacggcctgggagcacttccaggatctcgggatcgcgaccgacatcgtcccggtgacctacatgaactcgtcggccgacatcaagggcttcgtcggccgcaactccggtgtggtctgcacctcgtcgaacgccaagcgcgctctcgactggtcgttcgagcagggctccaaggtgttcttcctgcccgaccagcacctgggccgcaacaccgcggtcctggagatgggcttcgacctcgacgactgcgtgctgtacgacccgcacaagccgcacggcggactgaccgacgagcagctgcgcaacgcccggatgatcctgtggcgcgggcactgctcggtgcacggccggttcaccctcgacagcgtccgcgaggtgcgcgagcgggtccccggggtgaacgtgctggtccacccggagtgccggcacgacgtggtccgcgccgccgaccaggtgggctcgacggagtacatcatcaaggccctggacgccgcgcccgccggctcggcctgggcggtcggcaccgagctgaacctggtgcgccggctcgccctggcccacccggacaagcagatcatgtttctcgaccggacggtctgctactgctcgacgatgaaccggatcgacctcccccacctggtctggacgctggaggagctggtcgccggccgggtgccgaacgtcatcacggtcgacgagaagaccgcccgcgaggcccgtgtcgcgcttgatcagatgctcgccctgccgtaa

SEQ ID NO: 1423 - DNA, 1356 bp, Actinoplanes utahensis
ttgaccgacgatgtcctgatcgtgcacggcggcacgccgctgcagggacagatccgggtccgtggcgccaagaacctggtttccaaggcgatggtcgccgcgctgctcggcgagtcaccgagccgcctgtacgacgtcccgcgcatccgcgacgtcgaggtcgtccggggcctgctcggcctgcacggcgtcaaggtcagcgacggcgccgaggatggcgagctggtgatggaccccacgaatgtggagagcgccagcaccgacgagatcaacgtgcacgccggctcgagccggatcccgatcctgctgtgcggcccgctgctgcaccggctcgggcacgcgttcatccccgacctgggcggctgccacatcggcccgcggccgatcgacttccacatcaaggcgctgcgcgaattcggcgcggtcgtcgacaagacgcccgagggcatgcatctgagcgctccgaacgggctgcacggcgccaagctggaactcccctacccgagcgtcggggcgaccgagcaggtgctgctcaccgccgtccgcgcggagggcgtcaccgagctgcgcaacgccgcgatcgagcccgagatcatcgacctgatctgcatcctgcagaagatgggcgcgatcatcacggtgcacaccgaccgggtgatcgagatccagggcgtgccccgcctctacggttacgagcacaagccgatcccggaccggatcgaggccgccagctgggccgccgccgcgctcgccacccgcggcgagatcgaggtgctcggcgcccggcaggccgacatgatgaccttcctcaacgtgtaccggaacatcggtggcgagctgaagatcaccgacgaccgggtggcccggcacggggtgaccggggccgagggcggcatcaagttctggcatcccggcaacgagctcaaggccgtggcgctggagaccgacgtgcaccccggcttcatgaccgactggcagcagccgctggtggtcgcgctgacccaggcacgcggcatctcgatcatgcacgagacggtgtacgagcagcggctcggctacaccgaggcgctcaactcgatgggcgccaccatccaggtgtaccgggactgcctcggcggcaccccgtgccggttcggccgccgcaacttcatgcactccgcggtgatcgccggcccgtccaagctgcacgccgccgacctggtcatccccgacctgcgggccggcttcgcgcacctgatcgcggcgctggccgccgagggcacctcacgggtctacggggtcaacctgatcaagcgtggctacgaggacttcgagcagaagctggccgccctcggcgcccacgtcgaacgcccctga

SEQ ID NO: 1424 - DNA, 750 bp, Actinoplanes utahensis
gtggctacgaggacttcgagcagaagctggccgccctcggcgcccacgtcgaacgcccctgagctgctttttcatgtcgatcaacggcgcggtgtacgacacaccgcgccgtttggctacgctcgtgtcgtgtccccgctgtttcgccgcaagccagccgacctcgtcgaagacgccaccgcctcggtgaccgagacgccgtccgacgacaatcgccgcaagaactacacgcccagcaagaaggagctgggcgtggtcacccccaagcgcgccccgcagggccgccgggtcgaggcggcgccggccgaccgcaaggaagcgctcaaactgatgcgcgagcggcagcggaccgagcgcgccgaggcttccgagggcatgcgcaacggcgacgagcgcttcctgctcgcccgcgaccgcggtccggagcggtccctggtccgcgacatcgtcgactcccggcgcaccatcggctcgttcttcatcgccggcgcgatcgtcgtgatggtcggctcggtgatcaagaaccagtcggtccagctcgccagcaacctgctgtgggcactgctcgccctcgccgtcgtggtggacagcgtgttcatcgcccgccggatcaagaaagcggtcaccgcccgcttcccggacacgacgcagcggctgggctcgctctacctgtacggcatcatgcgcggcctgaccttccggcggatgcgggtccccaagcccaaggtcgagctcggcgccaagatctga

SEQ ID NO: 1425 - DNA, 1365 bp, Actinoplanes utahensis
atggcggtccggctcgggggccgggcgcgcgggccgatggtgaccgccatgagacgtcgtaccctcgccgccgccgcggccgccgcgctcgtcgcctccggagtgccgaccgcggcccgggccgccacctccggcgccggtgtgctgaacggctccgccgagcgggacctgaccggctggacggccaccgcgcaggccggtgcggtgggcctgcgccgggtgtccggcctgcggggcgccccggccggcaccgcggtggagctgagccggccggccgcatccggtgcgtgggcctacgcgctcgccgcccagaacgtctcgttcgtcgcggggcgcacctaccggatgacggcctgggtgcgggatgtggccggcggcggtggccggttcggcatccagctggccaacggcgcctgggagcaccggccgagcggcgtcgccgagttcgtcacgctcggcggcaccgggtggcgcccggtcacccggacgttcgtggccacctcggccggttgcccggacaccgcgttctatctgagcctgccggccgatcgggcgttcaccctgcaggtgaccgcgctgtcggtgaccgcggtcgccgcgccggtgccgccccgggtgagcggcgccccggcccgggtgctgtcgttcgccgggccggccgggtcggcgccggacgccgccgtgtggaaccacgatgtgggtgccggtctctggggcaacggcgagctggagacctacaccgccgatccgcggaacgccgcgctggacgggtccgggcagctgaccctgaccgccctgcgggccggcaccgggttcaccagtgcccgcctgaccaccaagggcaaggtgtcgatcccggccggctcgtacgtggagacggcgctgaccgcgccggtcggggccggtgtctggccggccttctggctgctcggcacggcgatcgacacggtcggctggccggcctgcggggaactggacgtgttcgagggcaccggcgcacagccgaccctggcgaaatcggcggcgcacctggcggaccggaccgatcccggccgggaccggcagtacggctggggcgagggcggcgccaccaccgacctcggcatgccactggacgtcgcgccgcaccggttcggcgtctatttcgacgcgtccgtggtgcgcttctacgtcgaccgggcgcccacgatgaccctgtgggcctcggacgcgaacgcctccggccgggtctggccgttcggcaagccgcactacctgctgctcaacatcgccgtcgcgggcgacgtggacagctcggcgacggttttcccgcgcaccatgacggtcgggccgatcgcggtgtggcgcggcggcgtcccgttctag

SEQ ID NO: 1426 - DNA, 1374 bp, Actinoplanes utahensis
gtgtggcgtgctggtggtcgcggtccggctgaaccacatcgcgtggacgccgggccgggtggtgctggtcgcgctgtcgccgctggcctgcgcggtgttcgtcggcgcgatcttcgtgatcagcgcgagcctggccttctggtgggtggattcgggggagctgggcagcgcgttcacctacggcgggcgggatttcgcgtcgtatccgatcacggtgtacggcccgtggttccgcggcctgttcgcgtacggcctcggtttcgccttcgtcgcctaccaacccgccctggcgctgctcggccgcccggacccgctgggcctgccggcctgggccggcttcgccgcacccctggtcgcgctggtcgcggccgctgtcgccgccgccgtctggcgggtcggcatccggcattacaggagcaccggatcatgatcaagaccaaggatctccgcaaggatttcgcggtacgcgtgaagaacggccgtttccgccgggagaaacgcgtcgtcgaggcggtcggcggagtgtcgttgaccatcgagccgggcgagatggtcgggtacatcggccccaacggggcgggcaagtccaccacgttgaagatgctgaccggggtgctcagcccgtccagcggcacggtggaggtgtgcggtctgcgcccggtcccgcagcgcacccggctggcgctgcggatcggcgtcgtcttcggccagcgttcgcagctgtggtgggatctgccgctgcacgagtcgttccggctgctgcggcacatctaccgggtgcccgccgcggagcacgccgcccgcctgcgccgctgccgtgacctgctggatctggacgcgttcctggacaccccggtccggcagctgtcgctgggccagcggatgcgcggcgagctgaccgccgccctgctgcacggcccacgggtgctgttcctggacgagccgacgatcggtctggacgtggtcagcaagcaggcggtccggtcgtttctggccgagctcggcgcgaccggcgatgtgacgctggtgctgaccacgcacgacctggccgacatcgagcggctctgtgaacgcctggtggtgatcgatcacggtcgggtggtgcacgacggttcgatcgaggcgctgcacgcccggtacggttcgcgccgcagcgtggtcgccgacctgaccaccccgctcccacccgatttcgcgctgcccggcgccaccctgaccggggtcgaggcggaccggcaccgggtcaccttcgccctggacgacatcaccgcgggcgcggcggtcgcggccctggtcgccgccgtgccgatccgcgacctgtcggtcgtcgagccggacatcgaggacgtggtcgcccgcctgtacgccgggtag

SEQ ID NO: 1427 - DNA, 861 bp, Actinoplanes utahensis
gtggccgggaaggacgccagcgtgctcacgatctctccggatggtccgttccggggatggaccactactttcggtgcactggtggggtcgggtttccggcgctacaccacctatcgtcaggccaccatggccggaacgttcaccaatgtggtgttcggctacctgcgctgttatgtgctgctcgcggtggcggccggcacacacgggggacgcccgggagggtatgacgccgagcagctcgccacgtacgtgtggctgggtcagggactactgagtgtggtcatgttgtggggctggtcggagctggcggaacggatccggacgggtgacgtcgcggccgatctgttacgtccagtccccccggtgaccgcttatctggccgctgacctgggccgagccgcccacggcatgctcacccggttcgtggtgctgctcaccgtcggcgcgctgtgtttcccgatgcgggcgccggcgcgctggcagacggctccgctgttcctgctgtccgtgttgctcgcggtggtggtcagcttcggctgccgctatctggtgaacgccaccgcgtactggttgcaggacgcgcgtggcccgatcatgttctggacgctcggcgccggggtgctgggcggtctctatttcccgttgcggctgctgccgggctggctggcggcggcgctccggctgggcaccccgctgccgagcattctgcagtcgccgttggatgtggccgccgagcgggacggtccgggcctgcagctggccctggtcggggtccagctgtgttgggcggtggcgttgctggcgctggccgggttcgtgcagcgccgggccgagcgtcgcctggtggtgcagggtgggtga

SEQ ID NO: 1428 - DNA, 5274 bp, Actinoplanes utahensis
atgcccggtggcggggcggggccgcgcgggccgcaagggcccggcgggccggtgcctccgcaccccggcgggcccatgtcggcgccgcaagcaggtgggccgcagcagtccggtcaggcgcagcagcagtccggtcaggcgcagcagcggttcggtgggcccgaggcgtatccggcgcggcccgaacacgaatccgggttcggtgccggacgacgggcgatgcccgaggccgggcggtccggagacgggtcgcggcccgtgtcgccggcctacggcagcgcgcgtcccgcgccggccgaggcgttcccgactcgcggcgggcgggcgccggaggggccgttcgaccttcgaccgatgccgcaggaacggaacagcccggcgccgacccggcccgcggcacagccgatccggatgacgccaccgcagccggcggtgccgccggcaacgatgtacccggacgggcccggacagacttccgggcgccccggccagactccgggacagcatggtgtccggcccgaccagggaaccgggcagcccggcatgcggcccgatcagaggcccgggcagccgggcatgcggcccgaccggggattcggacagccgggcgctcgacccgaccaggaactcggacagccgcgtaggtggcccgatcccgaggcggggcagggtccgatccggcccgggcgggtgcccgggcgtgccgatcagacgccggtcacgccggggcacggtcaggttccgggggcgccgggctacggtcgtgagaatcgtggctgggccgccgaccagccggtttccggggtcgcgtcggcaccggtctccggaatcgccgccccgcccgtttccgggatcgcgcccgtgtcgggggtcgcggccacgcccccacccgggatcgcgccggtgtccgggatcgccgccacgcccccacccgggatcgcgccggtgtccgggatcgccgccacgcccgcacccgggatcgcgccggtgtccgggatcgcttccgcgccggtgtccgggatggcgtccggcgggcagtggccggtggacgacgacgagcgcaaccggctcatggatacgcagcgaatcgacttcggggatcatggggtgcgcaagccggtccccgcgccggaatccttcgccgggtcgcagccggtggccgtgccggaaccgatcaccgcgcccgatccggtggctgtgcagccgccggtgacgcagccaccggtcgaggcgccgcgcggtgcctcgcagccggtggccgtgcccgagcccgcggcgacggagccgcgggggctgggctggctgttgtcgatgagcgggctcggtgccgagatgccggtcccggagacctcaccgctggccgcgcccgaagagaccgtggtcgtggagagcctgcccccgaccggctggttcgcgccgtccgtcgacgacgaggaaccggccgtacccgaggcacccgacagcgagacgccgtccagcgctcccggcgcacggtgggaaggcggggcagcgagcgctgaacgggatgctcagccggcgggcgagctggagatccgcgtgctcgaccttcaggtcgacggcgtggtggacagcggcgtggccgatgccgaggcgacccaggcacgtccggccggggaggacgccgggcattccggcgcggcgtgggacctgaccgggtcgggacgggccgaggatctcgcgggtctggctgcgcgcgacgctgaccggggaatgcttccgcgggcgggagccgggcggcatgagcggcccggattcgatgagccggacgagtccggggcgggcacggaggtcggggagtacgccgaggacgtacggccgggacggcatggccgggtggaggccgagcctccggtgccggtcgtcaccgggatctcgacggagacttcgccgcccacgatcgatccgatggtggccgaactcgccgaggacaccgcgcatcggacgcctgccggaatcgccggagacgaggtttcccctgcggccgcgggaatcgtcggcgacgacgttgctacgacgaccaccggaatcttgggggacgacgtcgctgcgacgaccacggaaacggtcacggacgacgtcgctgcgacgacctccggaattgcggcggaaggtgcccgagagacggacgccggattcggcggggcggacgttccggaggtgagcggcggattcggcgggacggaggttccggagacgaccgtcgggtccttcgtggacgaggtgtctcccgcggcggtcgggtccgcggaggatgccgctccgttgggcccggccgagccggttgcggaggaagatctgtccacggtcgccgagtcggttgccgaggaggttttccgcaccgcggatgagccgatcgaggagaccgccggggtcaccgcggtcgagccggtcgtgcaggaagaatccggtgctccggtcgcggccgctgaacccggggtggacggcggttcggtgatcgccgatgaagacttcgatgtggccgccggaagcgccgcgcttgccgacgacgtcgagggagagcgggcgggcggcgatgcgacgaccgccgcgccggcggatgtcatcgctgagccggaggccatcgccggaccggatgccatccctgcgccggaggccggcgccgaggcggacgttgtcacggatgcggaatccggtggggacccgggttccctcagggagacggatgccgctgcggatgcggtcgtcacgcacgccggtgtccttgccggtgccgaggtcgtcggggacaccggcggccgcgccgagtccggtgcggacgggaatgttgtcgcagagtcccctggtgacccggtggggccggctacggcagggctccccttgtcgggggtgccggtgtggcctcccctttcggtggcaagcgtcatcgccagtgccgttgcggccggcacccgctcggccggtgaggatgacaacgaggctgacccggtgggtacggcccacggcgcggccccggcagtcatcgctgaaagcgacgctggctccgcggcaaccgctgaaggcgacaccggctccgcggccaccactgaaggcaacgctgacgcagcgggcaccgctgaaagcgacacgggctccgcgggcaccgctgaaagcgacgctgacgcagcgggcaccactgaaggcgacgctggctcggcggattcggatgcgggtgatgccgattccgccggcgaggttgcggcgctgggcgccggggtgctcggcggggaggtgagggacggcggcgcctcgggcgacgtggcgagtgctggtgcgggaccggcgtccggggacgcccacgacacgtccgaaccggggtcgaccgccgcgcaccaccacggcgggaccgggccggccttcgcgctcgccgacgacaccacgcccgaggcgtccgccgccgtctccaccatcgtggcggagaccgccgccgatgggacggacagcgagtccgcaccgggcgggccggaaacgggcgcggagacggctgagatcgtcaccccggcgcccgcgggcccggaccctgccccggtcgacaccgagggcgttccggacgctgaggacgctctcccggcggatgctcacacggggcacgccgatggtggaaccgtcggcagttctgagcgtgccgcggcggctgacgaccgtaccggcaaatcggcggacctcgcgaccggcgaccgtgccgaagaggcgggtccggctccggaggaggaccgcaccacagaagcggatcccgagccgcgggaggaccgtgccgtagaaggggatcccgagccgcgggaggaccgtgccgtagaagcggatcctgcgccggaggacatccgcgagaaggcggcggatgccgcgtcgtcgcgggagagtcccgcggcagcggcggatccggcgccggtgaccggccggaccgaagaggcggacgaggcgccgatccggcagcggcgggagcagcgggccccggctgaccggcgccgcgccgatccggaggagatcctggccgcctatccgtggatgttcgatccgcggacgctgcgcgagcaggtcgacgagccggaccggctgtgggatctcagtgaccggctgaccgaccggctggagttcgccgagcgggacaacgtccgggccgggctgctcagcctgcgggccgtcgtggggcgggtgctgggtgagctggacgacgctctcgcggacgggcgggccgggctgcggcatgcggaggcgagcggggaggcgcggaccgtcgcggtggcgcgggcccggctggcgcacgtgctgcagtggcggggtgagttcgccgaggcggaccggctgtatgcggaggccgactcggcggagctgccggcccgggtgcgggccgagattcgggagctggccgggcggtcggcgttcgagcagggccggttcctggaggcggtgaaccacttcgagcgggccctggacctgtgccgggacagtgatgccgagctcgtcgagcgggtcgaggtggccctcgacgtgatggcgcgccggtccggggacggctggggaccgtatccgcgcagccgggagcagctgctgaacctgccgccggcgccgacgccgctgcgcgacgacggcaccgggctgtgggggtacgcggcggcggtggagccgcggtacgcgcaggcgcagccgttcgccgagggggtggcgtgggtgcgccgcccggactcgccggcctgggagctgatcgacgcgtccggtgcggtgctgatcggcgccgactcgggctaccgggacgccgggaagttcgccgaggggctggcctgggtgagccgggaggccgagggcggctgggtcgccatcgaccgcgggaaccggctgatcgtgccgggcgggttcgaggaggcgcggccgttccggcgcgggctcgccctcatccggcgcggcggctggggtgccgtggacaagcacggacggatcgtggtgcagccgaagtaccggcagttcagcacggtgctcagcgcgggcgggccgatcgacgggttcagcgacgagggtttcgcggtggtggacgcgggcaccggcgccggggtggtggaccgcaccgggcagccggtgctgccgccggtgcacagggccgtggtgctgcacccgtcggcgttcctgatcgccgacgaggcggggcgctggggcgcgctggatcggcagggccggccgctggtggagacccgccacaccgagcgtgccgacgcggtcgccgaggtgctcaggctcaagccggacagcaggccggttctctag

SEQ ID NO: 1429 - DNA, 999 bp, Actinoplanes utahensis
atggagttccgtcatctcggccgttccggcctgctggtcagtgagatcgcctacggcaactggatcacccacgggtcccaggtggaggaggaggccgcgctcgcctgcgtgcgcgcggccctcgaatcggggatcaccacgttcgacaccgccgacgtgtacgccggcacccgggccgaggaggtactgggccgggcgctgaaggacgagcgccgggacggcctggagatcctcaccaaggtgtactggcggaccgggccgggcgcgaacgacagcggcctgtcccgcaagcacatcatggcgtcgatcgacgggtcgctgcgccggctcggcaccgaccacgtcgacgtctaccaggcccaccggtacgaccacaacacgccgctggaggagaccatggaggcgttcgccgacgtggtgcactccgggaaggcgcactacatcggcgtctccgagtgggacgcgtcgcagatccgcgcggccaaggcgctcgccgacgacctgcggatccggctcgtctccagccagccgcagtattcgctgctgtggcgggtgatcgaggccgaggtggtgccggcctcgcaggagctggggctgggccagatcgtctggtcgccgctggcgcagggcgtgctgaccggcaagtacaagccgggacagcagccgccggccggctcgcgggccaccgacgagaagtccggcgccggtttcatcgcccgctggctgcaggacgacgtgctgaccgcggtggcccggctccagccgctcgccgacgaggccggcctgaccctgggtcagctcgccatcgcctgggtgctgcacaacccgaacgtgtccgcggcgatcatcggcgcgtcccggccggagcaggtgcgggacaacgtgaaggcgtccggcgtgaagctcgacgacggcctgctcaaggcgatcgacgacatcgtggaaccggtggtgacccgggacccggcgctcacgaccagccccgcgaagcggccgtga

SEQ ID NO: 1430 - DNA, 792 bp, Actinoplanes utahensis
gtgacctacgaaccggtgtacacgcgcacgccgcggaacgcgttcgtcccgagcccgatcttcgtcggcatcgtcgcgatcttcgcggtgagcggcgtgctgatctggacgggcttcggcaacgtcgggttcgacgcgttcctgttcgtcgtctcgggctgggtggtctcgctctgcctgcacgagtacgcgcacgcggtcgcggcgtacttctccggcgacctgaccgtggccgagcgcggctacctgcggctcaacccgttgaagtacacgcatccggtgctgtccatcgtgctgccggtgatcgtggtgatcctcggcggcatcggcctgcccggcggcgcggtctgggtcgaccaccgatacatcaacagccgggccaaggattcgctgatcagtgcggccgggccggccaccaacgtgttgctcgcgctggtggcggccctgccgttcctgatgggtctgggtccggactcggtgttcgacgggcacatcgcgttctggcaggcgctgtcgctggtcgcgttcctgcagatcaccgcgagcgtgctgaacgtcctgccggtgccgggcctggacgggggcagcatcctgcgtccctggctgagcccggcgtaccggcgggcctgggacacgttcgcgcccttcggtttcctgctgctgttcgtggcgctctggcagacctcgctcggcggatacttctacgacgtggtctaccggatcgccgaccacctggggctgaacccgttgctggtcagcgacgggtacgacctgatgcggttctggacctag

SEQ ID NO: 1431 - DNA, 198 bp, Actinoplanes utahensis
atgccgtggagttggcggtacgaagacgtcgacggcaaaccggtcgacggtccggccgagacgttcagcagtcaggccgacgccgagtcctggatcggccaggagtggcggcagttgcaggccggcggggtcggcacggtcaccctggtcgaggacgaccgggtcgattatcagatgagcctgcagccggcggagtga

SEQ ID NO: 1432 - DNA, 717 bp, Actinoplanes utahensis
atgtccgaagatcggtggagcagcgtcctggtgctcggcggtatccgctccggtaaatccgcgttcgccgaatcgctggtggcggacgcgccggcggtgcgatacgtggcgaccgcggtcggcggcgaggacgacccggagtggctggcccggatcgaggagcatcagcggcggcgcccgcagtcctggtcgaccgaggagaccggggccgacccggcccggctcaccgagctgctgaccagcgcaccggccggtgacacgctgctcgtcgacgatctgggcggctgggtggccgcggtgctcgacccggcccgccagcccaacgacgacgaggcggacgtggcggcgctggccgacgcggtgcgcgcctgcgcggcccggctggtgctggtgagtcccgaggtgggcctgtcgctggtgccggtcaccccggtggggcgcgcgttcgccgacgcgctcggcacgaccaaccaggcgctggccacggcgtgcgacggcgtcgtgctcgtggtcgccgggcagccggcctggatcaagcgggtcaccgcgcccgcggtgaccaccccggtcacccaggcgccggtcacgcaggcgccggccgcgctggtcaccgcgccggcgacgcccgcgccgccgccaccgccaccggtcgtggtcaccccgcaggggccgcccacgccggacgccgacgaggccaccgtcgtgctgccggcctag

SEQ ID NO: 1433 - DNA, 939 bp, Actinoplanes utahensis
gtgatctccggagcacacgagggcggggccgcggccggcgccgacccggccgacaccgaacgccgggtggccgagaccgagcagggcggcgggctgctcggccggctcgccgggcaggccggggcggacctcgcggtgatccgggtcgcggactccggtgcgatggaggacggcccggtcgccgacgagcagtcggtcgaggccgccatccgccaggggtggcagctggccgacgacgcggtcgacgccgggcgggacgcggtgctgctcgccgggctcggcgtgggcctggaggcggtcgcgaccgcggtgctcgccgcggccaccggcgccgaggcggccgccaccctcccccgggtgctgcagcccggcgggcgcctcgacgatcacgcgtggatggtgcgttgcgccgcgatccgcgacgcgctgcaccggatccggcaggagccgcggggcgccgtcgacatcctgcgccagctcggcggcctcgacctggcggtcgccaccggtgtgctgctcggcgcgtccgcccggcggctgccggtgctcatcgacggcccgctcgggatcgccgccgggctggtcgcccgggatctcgccgggcagacccggcactggtgcctgctgcccgaggcgggcaccctcgccctggtcaggcagggcgccgacgtgctcgggctgaccccggtgctggagctcgggctggacctgggcgagggcgccaacgcgctggccgcgctgccactgctgcgcggcgtgctggggctggcagcggcgctgccggtgcaccccggtctgctcgccgggcacgaggacgccgggctcgccgacgcctacgcggccagcctcggcgacagcgacgcgaccgcggatgccgccctggacgtgctggacgacggcccgaccagcttcggcaacccggcgcccagccgctcgtga

SEQ ID NO: 1434 - DNA, 1146 bp, Actinoplanes utahensis
ttggtattccccgcgactctaaccagacccaaggtcaccggtaagttgagtctcatgtctgccgagttcttccgctctccgctgcacgaacgccacgtcgcgctgggcgcgaaactcgcgccgttcggcggctgggagatgccgctggagtacgcgggcggcggtgtcctcaaggagcacgccgcagtccgcgaggcggccggggtcttcgacgtgtcgcacctcggcaaggcccgcgtgctgggccccggtgccgccgagttcgtcaactcgtgcctgaccaacgacctgcaccggatcgcccccggccgggcgcagtacacgctctgctgcgacccctccggcggcgtcgtcgacgacctgatcgcctacctctacggtccggacgacgtcttcctgatcccgaacgcggcgaacaccgccgaggtggtccgccgcctggccgaggccgccccgcccggcgtcacggtcaccggtcagcaccgtgacttcgcgatcctcgcggttcagggcccggcctcggccgacgtcgtggcgaaactcgggctgcccgccggccacgagtacatgtcgttcaccggcgccaccctggccggcgcgccgctggtcgtctgccgcaccgggtacaccggcgagcacggctacgaactggtcgtcccgtgggacacggccttcacggtgtgggacgcgctgatcgccgccggggtccgcccgtgcgggctcggcgcccgcgacacgctgcgcaccgagatgggctacccgctgcacggtcaggagctctccctggacatcacaccggtccaggcccggaccggctgggcggtcggctggtccaaaccggccttctggggccgcgacgccctgctcgccgagaaggcggccggcccgcgtcgcaccctgcgcggcctggagctgaccggtcgcggcatcccgcgcggccacatgccggtcttcgccggtgacaccccgatcggcgagaccaccagcggcacgttctccccgacgaagaagatcgggatcgccctcgccctgatcgacaccgctccggacctgcccgacggcgccaccgtcgagatcgacatccgtggccgccggaccggggcgcgcctggtcaaacccccgttcgtgacgccttcggtccgctga

SEQ ID NO: 1435 - DNA, 306 bp, Actinoplanes utahensis
gtgtttcccaccagccgggagcaccgcccgcccggcggcccggccccgacgtcgtggagtgcccgagtgacccagcccaccctcagcctggtcgacagcgacccggccgaattgacggtcgatgccatcgtcatcggcctgcacagccagcccgaccaggacggcgccctgctcccggcgtccggcgcggagagcatcgccgcggcgttcgacggccggctgaccgcgacgctcgccctgctcggcgcgaccggcgcgccgggtgaggtgaccaagctggccaccctcggcacgctagctagctag

SEQ ID NO: 1436 - DNA, 1164 bp, Actinoplanes utahensis
gtgcccgacgacgccgacgccccggcggtgctgcgcgccaccctggagggtgcgctgctgggtggctaccggttcgccggctacaagaccaagccgcagaagggccaccgggagccggtcgccgagctgcaggtgcacgtgccggacgcggccgacgaggcggccaccgccgagctgacccgggccgcggtggtcggccgcgcggtccggctggcccgcgactgggtgaacatgccgccgaacgaactgcgcccggcgggcttcgccgaccgcatcgcggccgaggccaccaaggccgggctggacgtcgaggtgctcgacttcgaccagctcaaggccggtgggtacggcggcatcgtggcggtcggccagggttcggaggcgccgccacggctggtcaaactgacgtacgcgccggagggtgtcgccgagccgaagcgggtggcgctggtcggcaagggcatcaccttcgacaccggcggggtcagcatcaagccggcggccggcatgtgggagatgaagtcggacatggccggcgccgccgcggtggccgccgccatgctcgcggtcgcggcactcaagccgggcgtggcggtctccggctacctggcgatcgcggagaacatgccgtccgggtcggcgtaccgcccgggtgacgtgatcaccatgttcaacggcaagcgggtcgaggtgttcaacaccgacgccgagggccgcatggtgctcggcgacgcgatcgcccgggcctgcgcggacggcaccgactacgtgttcgaggcgtcgacgctgaccggcggccaggtgatctccctgggcaagcggatctccggcctgatgggctcggccgaggcgatcgcgctggtccaggcggccggtgacgcggtcggcgagccggcctggccgatgccgctgccggacgacgtgcgcaagggcatggagtcggagatcgccgacatctgccagaccaacgccaacctggaccgggccgggcacatgctgcagggcggcgtgttcctgcgcgagttcgtcgagccgggtgtggagtgggcgcacatcgacatcgccgggccgggttaccacgccggtgagcccaccggttactggaccaagggcggcaccggggtcccgatccgcaccctgctgcgggtcgtcgagacgctgtga

SEQ ID NO: 1437 - DNA, 327 bp, Actinoplanes utahensis
gtgggctggtttcggcgtcgtccccggtccaccgggcccggcggacgcccggtcgatcaggccgatctcgaccacctcacgcagttcgtccgctcccgccgtggcgtcgaggcgttcgtcgagccgcgcaccacagtgaccgagaccaccgtgttgcttgtcgcacacgacggcgaatggactcgtcggcgcatcgggtcaccggaggtcgcgcgccgtttcgcccttcggctctcgctgccgatctacgatgtccggctgctcggctatccgcagcgcatgcgcgatttcaacgcccggcgcaagcgtgccgcccagcccgattag

SEQ ID NO: 1438 - DNA, 1392 bp, Actinoplanes utahensis
gtgagccagccgaacggcggaaccttcgacatcgtcattctcggcgcgggcagcggcgggtacgcggccgcgctgcgcgccgccgagctcgacctctccgtagcgctgatcgacaaggccgaggtcggcggcacctgcctgcaccgcggctgcatccccaccaaggcgctgctgcacgccgcggagatcgccgaccagacccgggagagcgagcagttcggcgtcaaggccgacctggtcgggatcgacatggccggggtcaacgcgtacaaggacggcgtcgtcggccgcctctacaagggcctgcagggcctgctgggccacaacaagaacatcaccctggtgcagggcgccggccggctggtcggcaaggacaccgtcgaggtggacgggcagcgctacaccggccgcaacgtcatcctggccaccggctcctactcgcgcagcctgcccggcctggacgtcgacggcacccgggtgatcaccagcgagcacgcgctgaaactggaccgggtcccggcctcggcgatcgtgctgggcggcggcgtgatcggcgtcgagttcgccagcgtgtggaagtcgttcggcgccgacgtgaccatcatcgaggccctcccccgcctggtcgccgcggaggacgaggagatctcgaagaccgtcgagcgcgccttccgcaagcggaagatcaacttcaaggtcggcaagccgttcgagaaggtcgagaagaccgcggacggcgtcaaggtcaccatcgccggcggcgagaccctggaggccgaggttctgctggtcgcggtcggccgcggcccgaccacggcgaacctgggctacgaggagcagggcatcaccctggaccgcggcttcgtgatcaccaacgagcggctgcacaccggggtcggcaacatctacgccgtcggcgacatcgtgcccggcctgcagctcgcgcaccgcggcttccagcagggcatcttcgtggccgaggagatcgccggcaagaacccggcggtcatcgacgaggccggcatcccgcgggtcacctactccgacccggaggtcgcgtccgtcggcctgaccgaggccaaggccaaggagaagtacggcgcggacaaggtcacgtcgtacaactacaacctgggcggcaacggcaagagccagatcctcaagaccgcgggcttcgtcaagctggtccgggtcgaggacggcccggtcgtcggcgtccacatggtcggcgcccggatgggcgagctggtcggcgaagctcagctgatctacaactgggaggccttcccggaggaggtcgcccagctcgtacacgcccacccgacgcagaacgaggcgctgggcgaggccttcctcgcgctcgcgggcaagcccctgcacgcgcacagctga

SEQ ID NO: 1439 - DNA, 747 bp, Actinoplanes utahensis
atgccgacatcggtaaccatgccgcggctgggcgagagtgtcaccgagggcaccgtcacgcgctggctcaagcaggagggtgagcgggtcgaggtcgacgagccgctgctcgaggtgtccaccgacaaggtcgacaccgagatcccgtcgcccgccgcgggggtgctgacccggatcgtggtcggcgaggacgagaccgcggaggtcggcagcgagctggcggtcatcgccggggagggtgaggacgccggtgcggccgcccccgccccgcagcagcaggccgaggccgagccggagccggccgcgctgaccaccccgtcgaccgagaagccggtcgaggaggaggcgcccgcgccgcagaccgccgccgggtccgccgagggcaccgaggtgaagatgccggcgctcggcgagagcgtcaccgagggcaccgtcacccgctggctcaagcaggtcggcgagaccgtcgaggtggacgagccgctgctcgaggtctccaccgacaaggtggacaccgagatcccgtcgccggtggccggcaccctgctggagatccgcgttccggaggacgagaccgccgaggtcggcggggtgctcgcgatcgtcgggtcggcgtcgtccgcgcccgccgccgcgcccgctccccgcagcccgccccgcggcagccggaggccgagtcgaagccggagccgaagccggagccgaaggcggagccggtcggcgagtcctacgcgacgccggccctag

SEQ ID NO: 1440 - DNA, 669 bp, Actinoplanes utahensis
atggtggagtcgctgcaggtctcggcgcagctcaccacggtcgtcgaggtggacgtcaccaagatcgccacgctgcggaacaaggcgaaggccgacttccaggccaagcacggcgtcaagctgaccttcctgccgttcttcgccctggccacggtcgaggcgctgcagcagcacccggtggtcaactcgtcgatcgacgtcgaggcgggcacggtcacctaccacggtgccgagcacctgggcatcgcggtggacgcgccgaagggcctggtcgtcccggtgatcaaggacgccggcgacctgaacctggccggcctggccaagcggatcgccgacctggccgaccgcacccgcaacaacaagatcgggccggacgagatcggcggcggtaccttcacgctgaccaacaccggcagccggggcgcgctgttcgacaccccgatcatcaaccagccgcaggtcggcatcctcggcctcggcgccgtggtgaagcggccggtgatcgtgaacgacccgaacctcggcgagatcatcgcgccgcggtcgatggtctacctggcgctcagctacgaccaccggatcgtggacggcgcggacgccgcccgcttcctggtcacgctcaaggagcgtctggaggccggccacttcgagccggacctgggcctgtag

SEQ ID NO: 1441 - DNA, 924 bp, Actinoplanes utahensis
atgcggatcgtcatggccggcgcctccggctttctcggtgcccggctcgccgcccggttgcggcagagcggccacgacatcacccggctggtccggaaacccgtcccgggcgccgggccggaggtcgccgtctgggcgccgtcgcagggccggctcgacctgtcggtgctcgccggcgcggacgcggtggtcaacctggccggcgccaacatcggggcccgccggtggaccgcgcagtacaagaacgtgctgcgctccagccggctggacaccaccgacacgatcgcccggacgatcgccaagctgcccgccggtgaccgcccgcggaccctgctgcagtcctcggcggtcggctggtacggcgacaccggcgaccgcgaggtcaccgaggaggcgccggccggcaccacgttcctggccgacgtctgccgggtctgggaggccgccgcccatccggccgaggacgccggctcgcgggtggtgctgttgcgcaccgccccggtgctggaccggcagggatcgctgctgaaaccgctgctcccggcgttcaagctgggcgccggcgcgcggatcggcgggggccggcagtggatgtcgtggatcgcgctggccgactggctgggcgccgccgagttcctgctggagcgcgaggacgtggccggtccggtcaacctggtctccgccgagcagtgcaccaacctggagttcacccgggcgctcgcccgccggctgcaccgcccggcgctgctgaccgtgcccggcccggtgctcgacctggcgctcggcgagctggccggggaggcacagcgaagccagcgggcgattcccggcgttctgcgcggtgcgggattctcctggatgtacccggacatcgagtccgccttggccgccgcgctggatccggaaccggcgaaggccccctga

SEQ ID NO: 1442 - DNA, 1887 bp, Actinoplanes utahensis
atgtccgtgaccgcccccgccccagccgcgtccgccgatcctccctccgagcccgccgccgcatcgggccgcgaggcgcgcgaatggcctgttcacctggccttcgccgtcgtcgcgctgtccttcgcggtctacgtgacgtgcggcctctgggcggatccgtacacccatgtgctcgccgacaacgtcggcgaccaggccttcttcgaatggctgatggggtacgggtactacaccgtcacgcacggctcggaccccttcttcaccagcctgctgaacgcccccctcggggtgaacctggcggccaacacctcgatcacggtgtacacggtgctgatgacgccgctgacccacctggccgggccgcaggtcagcttcgtgaccgtgctgacgctgaacctggccggctccgccttcgcgtggtatctgttcctgcgccgctggctggtcggcagcgccggggcggccgccgtggccgggctgttctgcggcttcgccccggggttcatctcgcacgccaacggccatctgaactggaccgccggctgggtcgccccggtcgtcatctggcaggtgctgaaactgcgtgagccgggccgctggctacgcaacgggatcatcctcggcgtgctgatggcggtcggtttctcgatcgccgccgagggcctgttctacaccgcgctggcctgcgccgtgttcctggtgatgtggtcgctgagccggtcggtccgcaccgaggcgcgggacgccttcctgaccgtgttccgcgcgctctgcgtgaccgggctggtcgccggcgcgctgctggcctacccgctgtacatgcacttcgccgggccgcagacgttcaacggcaccggcttcaaccagcggtacttcgtcgaggacgccgcgtcctacctgtccttcccgaaccgctccgtcgccggctggctgggctggcacgccgacctggcgccgaaccggaccgaggagacgtcgttcttcggcgtgcccctggtcctgctgatcctggtctcgttcgtggtgctgtggcgccgggcggacgccggccggcgggccacactgcgcgcggtcggcgcggtcggcgtggtgttcttcgtcctctccctcgggccccggttcaacctgcagaagcacgagtacccggacttcccgctgccgtacgcggcgctggtgcacctgccgctgttcaactcggcgctgccgatccggttcgcactggtcgtggtcggggtcttcggcatcctgctggcgctgatcctggaccagctgatcaccaggaagatcccgtccggctcgctgctgcacaccgcactggcctcggccgcggtgatcggtctgctgccgatcgtcccgctgccggtgcggatccagttccggacaccggagccggcgttcatcgcgcagggtctctggaagaactacgtgcccgagggcgggacgctctccgccctgccgttcggggccaacgtcaccgcggacgcccagcgctggcaggcgtacacgatggctcgcggcgggcggcagttccggatcccggacggctacttcctcggcccgcagaccaccggcgacaccggccggaagcagccgggccggatcggcgcaccgccgatggccaccgactggctgttcctgcgcgccgcctggtacggctacatcaccacgctgaccaacggggaccgcgcccaggcccgcgccgacttcgagtactgggggctggacgcggtgttcctgccgtccaccatcaccggctcggaccaccagacgctgaaccggaccgcggtcgagagcaccgcccgggacctgctcggtgagcccgaggtggtgggtgacgtcctggtgtggcgcatccgtcgcggagtcgaccccgtcgaccggtag

SEQ ID NO: 1443 - DNA, 702 bp, Actinoplanes utahensis
gtggcgcatccgtcgcggagtcgaccccgtcgaccggtaggtacccgccggtacggggatacgctggccgtcgtgacaacctccgtactcaccgttctgcgccccggcctggtcgactaccgcgacgcgtgggacgagcagaagcgtctgcacgaggccgtggccgacggcgcccagccggacaccatcctgctgctggagcaccccagcgtcttcaccgccggtaaacgcaccgagccggcggaccggccgtgggacggcaccccggtggtcgacgtcgaccgcggcggcaagatcacctggcacggtccgggccagctggtcggctacccgatcctgcgcctgcccgacccggtcgacgtggtcgcctacgtgcgccgggtcgagcagctgctgatcgacgtgtgcgccgagttcggcgtcgccaccgaacgggtcgagggccgcagcggcgcctgggtgcgggccaccgacggcggcctcgaccgcaagatcgcgcagatcgggatccgggtggcgcgcggcgtcaccctgcacggcttcgccctcaactgtgactgcgacctggcgaatttcgagcggttcgtgccgtgcgggatccgggacgccggggtgacctcgctcagcgccgaactcggccggccggtgccggtcgccgaggtgatgccggtcgtcgagcggcacctggcgacgctcttctag

SEQ ID NO: 1444 - DNA, 1215 bp, Actinoplanes utahensis
gtgctgatcgacctcgatgccgcgccggccccggccccggttcgtcgcccgtccgggacccggtggtggaagctgctggccgcggccgccgtgctgctgccggtcggtgccgcggccgtgccggcgctcccgccgccgttcccgatgatcgcctcgaccggcggccaggcgacgctggacagtgtgtgcaccgaccgggcgctgtacgcggcgcaccgggcggccggcccgggcgcgggcgcggtgatcgtggcgcgcccgctggtggccggcggcccggactggcaggtccgggtcccgctggacggcggagaacttcggctgacggtggccggtccggtcctgatcgccgatgccgagggcaccgtgacggtgctcgacgtggcgaccggcagggtccgctggcgcccgccggacggcagcaccgtcgcgccgttcggcgaccgggcactggtcagctatttcgacagcgacaccggagaggcccggctgcggctggtggatctggcgtcgggccggacccggtggacgcggcccgggtacgcggccgctgccgcgctggatccggccggcttccggctgatcatgctgaacgacggcggccaggtggagatgcggtcgacagccgacgggcggctggccacgagccgggatctgaacggcgtgatcgtgccggaggagcagctgatcatcgacgggacgcggccgtaccagccgtcggtggccgtcgccggtgatcacgcgtacgtgctgggtccgtccgccgtggccgcgctgagcatcacggacgggagcctcacctggctcacctcggtgccgcggccgttcccggtgtccgcggtgagttgcggccacctgctctgcgtcaccggcagcggcggcaccaccgcgctcgatacggccaccggcgaggtgcgctggagcggcgcggagtgggcgtcgtacaccgctgacgatctcgccacgtcggcgggcggccgggtcgcccggctggatccggcgaccggccgggtcgtcaccgagctgggccgcggtgtggccaccggtggcctgatgctgcgcgcggtgaccggcggcacccgggtgaccgacctgcgcaccggccgcctgcacggtgagctggccggtgtgctcccgttcggctgcaccgtcgccgggccgtttctggcctgcccgacgacgggcagcgcccgcagcgtctggcgggtcggctag

SEQ ID NO: 1445 - DNA, 1248 bp, Actinoplanes utahensis
gtgcaacgcatcctctccaccgaactggccgcccacccgcacgagaaggtgctggtcgagggctgggtccaccggatccgccggctgaagtcggtcactttcctgatcgtccgggacgccgccgggctggcccaggtggtcgtcgacgaccccggtgacctgcgcgaggagaccgtcgtcgcgatcgtcgccgtggtcaccccgaacgagcaggcgccgggcggcgtcgaactcaccgctccggcgatccgggtgcactccgctgtggacgtaccgctgccgttcgatctgcaccggcctgcgctcaccgcgggcctgcccgcgcagctggaccacgccgcggtcgcgctgcggcacccggcgcgccgtaccgcgctccgggtggccgccgccgcgaccgccggtttccgcgcggcgctggaggcgcagcggttcgtcgagatccacacgccgaagatcgtcgagtcggccaccgagtccggcgcgaacgtcttccagctggactatttcggcaggcccgcgttcctggcgcagtcgccgcagttctacaagcagatgatggtcggcgtcctggaacgggtattcgaggtcggcccggtgttccgcgcggagaacagtgacaccgcccggcacctgacccagtacacgtcgctcgacgccgagatggggttcgtcgccgaccaccgggacgtgatggccgccctgacccgcacgctcggcgggatgctcggcgaggtgacggcccggaccggggtggtgaccccggaggtgccggcggagatcccggcggtgcacttcaccgaggcgttgcggatcgccggcgccccggccggcgagcccgacctggcgccggcgcacgagcgggcgctgggcgagtgggcgcggcgtgagcacgggtcggagttcgtctacgtgaccggctatccgatgcgtaaacggccgttctacacccatcccgacccggccgacacgacgtactccaacggctttgacctgctcttccgaggtttggagatcgtcacgggcggccagcggctgcatcggcacgccgactgtgtcgccgcgctgcgcgcggccggtgagccactcgcggcctatgcgggctatctggaggctttccggtacgggatgcccccgcacggtggctgggcgatcggcctggagcggctggtcgcgcggctgaccggggcggccaacgtgcgcgaggtggcggctttcccgcgcgacccgcaccgggtggctccctag

SEQ ID NO: 1446 - DNA, 924 bp, Actinoplanes utahensis
gtgactattgctcccgagggccgccgcatgctgcgcatcgaggcgcgcaacgccgagactcccatcgagcggaagccgccgtggatcaaagtcaaagcgaaaatgggccccgagtacacgcagatgcgtggcctcgtgcagaaagagggcctgcacacggtctgccaggaagccggctgccccaacatctacgaatgctgggaagaccgtgaggccaccttcctgatcggcggcgaccagtgcacccggcgctgcgacttctgccagatcgacaccggcaagccggccgagttcgacgccgacgagccgcgccgcgtcggtgagtccgtcgccaccatgggcctgcgctatgccaccgtcaccggcgtcgcccgcgacgacctgcccgacggcggtgcctggctctacgcggaaaccgtccgccagatccacgctctgcagcccggctgcggcgtcgagctgctcatccccgacttcaacgccgacccggcccagctggccgaggtgttcggcgcccagcccgaggtcctcgcgcacaacgtcgaaaccgtcccgcggatcttcaagcggatccgccccggcttccggtacgaacgctccctcgacgtgatcacccaggcccgcgcggcgaacctggtcaccaagagcaacctgatcctcggcatgggcgaggagcgggcggagatctcggccgccctccgcgacctgcacgccgcgggctgcgagctgatcaccatcacgcagtacctgcggccgaccccgcggcaccacccggtggagcgctgggtcaagccggaggagttcgtcgagctccgcgaggaggccgaggcgatcggcttcgccggggtgatgagcgggccgctggtccggtcctcctaccgggccggccgcctctaccgtcaggcgctcgacgcccgcggctga

SEQ ID NO: 1447 - DNA, 270 bp, Actinoplanes utahensis
atggacagcgcggtcgacatggcttatcgggtcgtcgaggcgttgttcgggccggactccgggattccctggtgggcttggcttgcgccgattgccattctgttcgccaggttgctctatccgatgatgttccccgaggcggcggcggccgaggcggagacggatcggcggctcgccgagttccggcgggaacgtgaggggcaggccagggacaggggcgcggagaagggcaaaggtaaggagaagaaaggcaagaagggcaagaagtga

SEQ ID NO: 1448 - DNA, 3789 bp, Actinoplanes utahensis
gtgaccggccggctggccgacgccgcggccctgtccggcacgatcggccggctggccgatgccgcggccccgtcccgcacgatcggtccggattttctgtcggatccgcgtggcatgctcgaccccatgatgacggcgagcgagatcctggtcggccgggatgccgatctggccgcgctgcgcgacacgttccggcgggtccgcggcggcgagccggccgccgtgctgctcggcggcgaggccggggtcggcaagacccggctggtcgaggagttcacccggagcctggccggcgagccggtccgggtgctcaccggccagtgcctggagctcggcgaggaggggctgcccttcgcgccgttcgcggccgccctgcgcgagctggtccgcgacgagggggtggcggtcctggaggggcgcgagtccggcctcgcccggctgctgcccgagctcggccccgcgccggagttcggtgacacccatcgcgggctgctcttcgagctcgtcgcggcgctgttcgcccggctcgccgtggagcgcccgctgctgctggtgctggaggatctgcactgggccgaccgctccacccgggacctgatcgccttcctggtccgttccgcccgcgcgccccggatgctgctgctggccacctaccgcaccgacgagctgcaccgcggccacccgctgcgcccgttcgtcgccgagctggagcgggtccgcggcgtgcaacgcctggagatccaccggctcgaccgggacggcaccgcggagctgctcacccacctgctcggcggcgagccgcggccgcagaccgtcgacgccgtcgaccggcgcgcccagggcgtgccgttcttcatcgagcagctcgccgccaccgccgacccggcctgcgccgacatcccggaaacccttcgtgacctgctgctctcccgggtcgaccagctgaccgaggcggcccagcggatgctgcgcgtcgccgcggtcggcggcacccggctcggccacgagctgatcacccgggtcgccggcgtcgacgaggtcaccctcgactcggcactgcgggtcgtggtcgccgcccgattgatcgtcttcgacccggagcggggctatgagttccgccacgccctggtccgcgaggcggtccacgacgacctgctgcccggcgagcacctccgcctgcacgcccgttacgccgaggcgatcgaggccgacccgcacctcgtcccgccgggccgggcccccgccgaaaccgcccaccactggcacgcggccggaaaccacccgcgggccctggtcagcgcgaaactcgcggccgacgaggccgggcggcagttcgcgtacgcggagcaggcccgcctgctcgaccgggtgctggagttgtgggagcaggtgcccgcggccggctcgttgctcggtgtctgccacctcgacctgctggaggagaccgcgctggtcgcgatcgactccggggagctgacccgggcgctgaaactgacccaggcggcgctcgccgagctggactccgaggccgagccgctgcgtgccgcccggctgctggtctgccgggcccggctgctgcgcaacatgggcaagagcgatgggttcgccgagaccaaggaggcgtatcggctgctcaccgccgtgccggtcacgtcggcggcgcctgccgtggcgtcagctcctgccgcaccggcggtgtccggtgcgtctgcggggtcttccgcggtcgtctccgcttccgctgcaccctccgcctcggctccgacttccgtttccgattcgacttccgtttccgatgcggcttccgcttcgctgtcggcctccgattcggcctcggcttcggcgtttgccgagccggggcgggcggagctgctcggcgaggtggcctatctgttcgccgggatggacggcgacgaggtgtcccggatctgggatcaggtccgggcgtcggtcgacgagctcggcgacaccaccgcccaggtgtatgcggagatcaccaagggccaggtctgcgccggccgggtgacggcgcaggagggtctgcccacactgctcggcgccctcgcccaggcccgccggctcgacgacgagcaggcgctgtgtcacggcctggtcaacgtttccgacgcgctgttcgagctgggccgctaccaggagtccgccgccgccgcggccgagggcgttccgcacgccgcacggtacggtgtggcccgcaccaccggggtccacctgctcgccaaccacgccgaggcgctgctcgccctgggccgctgggacgaggccgacgcccgcctggccgaggccgcccgccaggacccacccggcctgatggccctgccctggctccgcctgcgcgcccgtctccgcctggcccgcggccacgccggcgccggccccctgctcagccgcgccatcggcatgctcggcaagccctacgtgccggccgagaagaaactctggatgcacgagctgcgcgtcctcgccgccctccacgaacgggacgtgccggcagcggtggcggtggcccgggtcgccctgcaggacccggcactgctcgaccgcccgcgctacacctggcagctgctggccaccgcggcccgagcggtctccgcagcccgcgatgccaccccggcccacgaccctgccccggcccgcgatcctgcctccgcccgggattctgtctcggccccggattcttcctcggcccgggattccgctcgggtccgcaaatctgccctggcccgagatcctgccgtggcccgagatcctgccctggcccgagactccgccctggcccgcgactcttctcaggaccgcgacatcacttctgccggtgccgcctcctcacccgtcgcggggcgctccgcgccctctccgcgtgccgctgtctcatcggcggcctcgctggcggcggctctgcgggatgcgccttcttgggaaccgggatcgcgggatgcggccagtttgcggatgccgatccgggatgcgacctcgtcatgggcgttgtcacaggacgcggttccgatagaggccgtatcgccggatgtggcctcgttcggggcggtgtcgggggatgcggtttcgttcggggcggcgtcgggggatgcggtttcgttcggggcggcatcgcgggaggtggcttcggcccgggcggtgtcgcgaagtgtggcttcttcaggggacggggtgcgaaacggggcttccacggcgggggctccaggggacgatctttcggtggaggcggcgcggctggctgctcgaatctggtgggcggcggagcagttgccgcggcactatcccgccgagttggccggggcggcccaggtggcggcggagctggacgggggcgctgagcggtggggcgcggcagtcgcggcctggcgtgctgacgggcagccctacgaactggcgtgtgcgctgctgcgggccgcggaggcgaacgccgccgaccggaccgcggcggctacagcactcgccgaggtcaccgcgatcgccgacggcctgcgggtgacgccgctggtcgaggccgcggagacgctggcccggcggctcggggtccgcccggcggcgacagccgccggaacgctcgaggaggtgctcaccgcccgcgagcgggaagtgctccggctggtcgccgaggggcagagcaacggccagatcgcccagcgcctgttcatctcgccgaagacggcgagcgtccacgtctcccggatcatcgcgaaactcgcggtgaccaaccgcatcgaggccgccgccgtcgcccaccgcctcaacctgttggccgactga

SEQ ID NO: 1449 - DNA, 693 bp, Actinoplanes utahensis
atggcaaaaccccaggagaaggtgtccttcgtcgagcgcctgaagcagatcggccaggtgttcagtttcaccgcgaaacaggacaagtggttcgtcccgctcgtcctcgcggcggtgctgatcccgatcgcgctcaccgtggtcgccgtgctcctgggctggggtgtgctgttcatcccggtcggcatcctggtcaccgtgctggccgtgctgatcgtgctgaacctgcgctcgaacaccgcgatgatgaacgtggccgagggccagcccggcgcggccgcctcgctgatggagaacatgcgcggcgactggcgggtccgtccggcggccagctcgaccacccagttcgacatggtccacgtggtgatcggccggcccggtgtgatcctgctcgccgagggccacccgcagcgggtcaaggccctgctcggccaggagaagaagcgcctgtcgaaggtgatcggcaacgcaccgctctacgactacgtgatcggctccgaggagggccagctcccggtccgcaagctgcgcaccacgatgctgaagctgccccgcaacctgaccggcaaggacgtgaacgcgctggacacccgcctgtccgcgctgatggcccggccgcagatgcccaagggcgcgatcccgaagaacatgcggccgagcaagggcgcgttccggcagcagcgtccacgctaa

SEQ ID NO: 1450 - DNA, 1530 bp, Actinoplanes utahensis
atgcctaccgctgggccttaccgcctgcagcgccagctgtcgagctgcgaggtcggtgacgtctggtcgggcgtcgacgcgcaggggcggccggtgacggtcgcccagctcaatgagctcgcgtcggccgacgaccgctggcgcggcgctttcgccgcggcttccgaggcgctgggccagtccgacaccgatcggctgccgatcgacggctccgaccatctcggcgagcggccctgggtcgcctgcccggagggcgagggccagggcgacgcggcggagatcttcacggtgctgggccagaagctgcgtccggtcaccgccgggccgccggtggagacgccgccgccggcctccggcgacgcggtggtcgagcagcattccgattcggtacgtcgtgagcaggatccgccgacggcgcccttcccgccggtgccgagtccattcccggccgccgccggccaccccgtgtcggcgcagccgttcgccgcccaaccggtgtcggcgcagcccatgtcggcacagcccatgtcggcgcagccgtggccggccacgcccggtccggcccagccgatgtccgcccagcccgggccggagcgtcccatcccggcgttcccggtcgccacccagccggtgtccgcgcagcccgtttccgcccagccggtctcggcgcatccggtgtccgaccaccccgtgtccggccacccggtctcggctcagcccgtctccagccacccggtctccggccatccgacgtccggactgcccgccttcagtcacccgatctccgcggtgccggtgtccgggagcggccaggcgtaccagcaaatcggtcgcccgccgcgccccgaccgcctcctgttgctgatcgtcggcctggtgtgcctgcttctcggcggcgccgccggcgccgccgtggtctccctgcagcgcgatggcaagccgcgaccggcggcgagcgacgcgccggtcacctacaccgacgctcagctgctgctgcccgccacgccgccggtcgcgccggggctgaccccggagccggacggcgagtggccgaaaagctggccgaccttcggcagcaaggccacggtcaagcgggtgaccgatctcgacggtgtcggcttcgatttcaaggtgcccgacggctggacctgcgagctcgccgagaaggccgcggccgcggtgcactaccggtgcggcgcgttccaggggccgaccctgaccgccggcggcgatctctacgtgcgcacctgcgcggcggtctgtgacgacaaggcgcgtcaagccctgcggcagcgcgaggaggcctggggtctacggtggaccagcggcacctcgctgcgctcctgggcggagaccgacaccatcgacggcaagccgcagtacgggctggtctacgtcgggttctggcgcaccaccccggaggacgtgctgaaccgcgaggtcgtgctgcggatgaccgcgccgcccgccgccaagaaggacgtgaagagagtggccgacaacatccgcgaccgcacgtacacgcagtaa

SEQ ID NO: 1451 - DNA, 1659 bp, Actinoplanes utahensis
gtggccagcaccctcgcggtccccggcacctatccgacgatccgtgacgcgctcgaggtggcaccggacggcgcggtgatcaccatcggtcccgggacgtaccgggagcggatcgagctgaccgggcggcggctcaccctgcgcggctccggcgaggagggcacggtcgtcgtcgacgccgccgcgctggaggggccggccctggccgtgctcagtggcgaggtgaccgtcgaggggctggacctgacctcgggggactatccggcgatcgccgtcacggccgcgcgggtcgtcgtccggaaatgtcgcctccgttcgggttatgccgccggcctgcaggccaccgacatggccacggtggaggccagtgaggtccgcgtactgaagggccagaacgggctggtcttctcggacgccggcggcacggtcgagtcctgcgaggtccgcggggtcaacgacgacggcatcatcgtgcggctgggcgccgacccggtgatccgcaacaccacggtcgccgagtgcggctatcgcggggtgtacgtctatcagtccggccgtccggtgatcgagcgctgtgacatctccggcaccggcgacgccggcatcgtgatcgccaacagcagcgccccggcgatccgggagacctgggtgcaccagaccgccggctccgggatcgtggtcggcgccggctgctccgcggtggtcgagcagtgccgggtcgagggcaccgccgagccgaaggtcgcggtcgacccgcgcgcccaggccaccgtcaccctctccgagggcggtccggcgccgcgggccgggatcaccgaggccggcgccgggcaggacgccgccgaggtcgaccggctgctcggcgagctcgacgcgatgatcggcctggccggggtgaagaacgaggtccgcgccctgatcgacgagatccaggtgaacgagtggcggcgcagcgccgggctgtcggtcggcgcggccagccaccacctgatcttcaccggcgccccgggcaccggcaagacgacggtggcccgcatctacggtcagttgctcaaggcgctcggtgtgctgcccaacgggcggttccgcgaggtgtcccggcgcgacctggtcgggcagtacatcgggcacaccgcggagaagaccacctcggtgttcgaggaggcgatgggcggcgtgctgttcatcgacgaggcgtacaccctgtcccgggccggcggggccagcgccgacttcggccaggaggcgatcgacaccctggtcaagctgatggaggaccaccgtgaccaggtggccgtgatcgtcgccgggtacacccgggagatgctcgatttcctggacgcgaactccggtctggcgtcccgcttcgccaagacgctggagttcgagaactacgggccggacgagctggtgatgatcgccacccggatcgcgcagaacgacgactacacgttcgcgcccgggctcagcgaggcgctgcacgagcacttctcacagatcgagcgggaccggaacttcggtaacgcccgcgaggcccgcaagctgctggaggggatgcgcaaggcgcagtccggccggctgcggtcgctgggccggatgcccagccgggacgacctgaccacgctggtgctcgacgatctgctgacggcgatccgctga

SEQ ID NO: 1452 - DNA, 1122 bp, Actinoplanes utahensis
gtggtcgccgaggtggccgtgctggccaccatcgcggcggccctgcaggggccgatcccggcgctggtcaccggcgtcgccgggctgatcctgatcatcgtcttcttcgcccggcagcagggccgctggtggctggagcaccggcagatcgcccgccaccacgcccgccggcgggccgccgctccggagaccggggccgggccggtgctggccgcgctgcgcaccatcgcccccggcctcgccgtgcgggacatgaccgcgcaggacggcgcccgcgccggggtggccaaggacgaggccggctggttcagcgtggtggctctcaccccggccgcgccggtccaccacgacgccgcgccgatcccgctggacgcgctggtcagcgtcctcgccgcgaccgagcagccgggcgtggtgctggagctggtcacgcacaccgtgccggcgcccagccccgacgtgcacgcgtcctcgccggccgtctcgtcgtatcgccagctcgtcgagtcgctcagtccggagccggtcccggctcaccgggagtccacgatcagcgtccgggtcgacgcccgggtgctggccgaggcgctgcacgaccacaccgccgatctggagaccgccgccgccctggtcgccggcctcggccgcaaggtggccaccagcctgcgccggatcgggatcgcctgccgggtgctcgacgccgacgagctgctggccgcgctggcccgctcgtgcgacgtcgaggccggttcgctggccgagggcgcacaggtcgacgaggactggacacactggagctcggcccgcctgatccaccggacgtactgggtgaagacctggcccacctcggccggcgagatcggctccctgttcgcctgggcggccaccgccccggccgcgcagaccagcgtcgccctggtgctgaacgccgcggccgacggtgaggacgtcgccgtccgcgccttcatccggctggccacccggcccgacgccgacctcggcgccctcgaccgcgtcctgctggagggcgtcaaacgcgtcggcgccgagctgcaacccctggacggcgagcacggcccggccgcctacgccacggccccgacgggaggcggagcgggatga

SEQ ID NO: 1453 - DNA, 1509 bp, Actinoplanes utahensis
atgaccgacccgaaccgggacggctcctggcgtccctatcccccacagactccggaccagcccgccgccgacgccgatgcgccggacgccgcggggcgtgagcagcagttgccaccgccacccgcgatcttcccgccgggttcggtggcccgtgcgcaggtgcgtccgccgcagggtcagctgccgccaccgccggcgcacctcccgcaggcgccgacgggtccggggcagggccagtatcagcagggtccctactctccggggtcgtattcgccgggcggggcgcagcccggcttcggtccgcatccggcgggggcagcagccccgtccgggcagttcgcgcccggccaggcggcgccggcacccctcgcacccggccaagcggcgccggcaccactcgcacccggccagcccgcgccggcaccactcgcacccggccagcccgcgccggcatcactcgcacccggccagcccgcgccggcaccactcgcacccggccagcccgcgccggcatcactcgcacccggccagcccgcgccggcaccactcgcaccgggtcaagccgtgccggcacagggactgttcgcgccggggcaggcgtttccgacatccgggctgcagggaacgtccgggtcgcagggcctgcagcagggtgcgggtgatgcgagcgggcggcggctcgccgcgccgcagctgacgtcggcgcccctggccggcccacagggccggctgccggccgcggcgcaggcggcgcagacgtgggagaacgactctccgccggacgattccccggacgaggacgacgacgcccgtaccggcccctccgggaagacgtcaccgctgcacatcggctggcacgcgatctcccgtaagacgctgcgccgggtcaccgtggccccgtccgcgggcgccggcctggtgctcggccgcgaccggcagcacgccccggtccccctgcacctgttcgcccccgaaccggtccgcatcgccctggtcggcggcgtctgggccgcccagctcctgatcttccgagccttcgccctgggcgcccgggtcgtcgtcgtcaccaccgagccccgcgcctgggccggcttcggcgaacgcgccaccggtcagtacaaccggctcaccgtccacagcagcgaccagggcgtcgccctggccggcagcgcccagatgcccacgctggccgtctacgacctgggcatgtccggcccggccaccaccccaccgttgggcccgtggcgcacccagctgaccatcctgcgccagctggaccgccccggcctggccgccctccaggatgcccagctcaccctcctgcagcgcctgggcggtgacgaggccgccatggccgcctcagccctgaagttgcgcccgcacagcagccagttcctccagttcatggccgacgacatgctggccctgatcggtgcgggcaccgaccgctacctgttcctgtcccagaccccgaccgaacaacagttcgtcggcctcccccgccgctga

SEQ ID NO: 1454 - DNA, 1053 bp, Actinoplanes utahensis
gtgctccatgagcggcgttcccgccatcaccgcgtcgcggccgcactggccggccgctccgacggtgaactggcggcgtggctgcagaccgcatcgcccatgggcgtgggcgtgggtggcgacgcttcgagcatccacgtcgacggcgtgcccgtcttcgtgaagcggatcccgatcacccatcgggagctggctcatccctacagcacggcaaacctgttcgacctgccggcccggtggcagtacggcatgtaccgcctggccggtccgggtttcggagcgtggcgggagctggccgctaaccagatcgtcaccgagggggttctcgcgggcgaaacgccgtcgttcgcactgctgcaccactggcgggtgctgcccggccgcccgccgaccgcggcggagcacctcgacgtcgatgccgtcgtcgcccagttcggtggccaccgggccgttcgcgcacggtttgaggcgctggcgagcgccaccgcgagcctcgtgctgtttctcgagcatctccccgacgcactgcccggctggctgagcgacccggtggggagagccgcgacggtggaacggcaactgttcgagatggtggcgttcctgcgtagccacgaggtgctgcacctggacggacacttcggcaacatccgagccgacgaggaccggctctacctcgtcgacttcgggctcgccacctcaccgcgcttcgacctgtcgggcaccgagcgcgacttcgcggccgacaatgccggtcacgacgccgactacgcttccatgcggctggtgaactggctgatcaccgcgacgtgctcggtgccggccggcggcggtccggtcgcccgcaaccgcctggtacgccggtgcgcaaccggcgacattccacccgaggtgccggcgcccgtagcggagatcatcgccagacacgcccccgccgccgcccggatgaacgagttctgccggcgcctgttcgacggcgacctccgcgccgcatatcccggccatgcggatgcgatccggacacctccggatgacgcgacgccggtgacggcgtag

SEQ ID NO: 1455 - DNA, 3960 bp, Actinoplanes utahensis
gtgaccgtcaccatcgtcaagcgccccccgcgccggcccgcgccggtgatgccctccggcgaggtgctgctcgacccaccgccggagattccgccgcccggcggcaagggctggacgaggatgctgatggtcctgccgatgggcgccggcgcggccgggatggggctgatgatgagcgcccagcggggcggcccgctgacctacgtcgccggcgcgatgtacggagtgtccatcctcggcatgatcgcgatgatggccaccaacacctccggccccggcaagcgcgagatgatcgagtctcgccggcagtatctgcggcacctctcccagttgcgcgcccagctgcgcgccacgatccgccagcagcgcgaggcgtattactaccgcaatcccgacccggccacgctgtggacgttcgcggacagcggccggctctgggagcggcggcgcaacgacgccgacttcaccgtggtgcggatcgcggtcggcgcccaggaggtggcgacccgcctggttccgccgcagacccggccggtcgacgaactggagccgctgtgcgccatggcgctgcggaaattcgtcaacacgtactccgtcgtcccggaccttccggtctccgtcgccctgcgcgacttctcccacatctacctgcgcggcgccgaggaggcggtgctcggcttctgccgggcgctgaccgcccagctggtcaccttccacgcccccgacgacctgcgcatcggcgtctgcgtgccggaccaccagcggccccgttgggagtgggtgaaatggctgccgcacggccagcacccggacaagatcgacgcggccggctcggtccggctggtctcgcccagcgtgccggcgctcgaagcctcgctcgacgacgtgctggccagccggtcccggttcgagctgaccggcccgccgccgcccggcccgcacgtcgtcgtgatcatcgacggtggctcgacggccggctccgaccacctgatgaccgagggcggcgtggccggcgtcaccatcctcgacctgtccgggccgccgccccggctgctcgacgacagctcggtgatcctggagatcgccgcggacggcaccatcaccggcgtcaccatggacggctcgacccaggtgggccgggccgacacgctcgggctccccgagatcgaggtgctggcccgcgagctggccccgctgcgactgtccgccgccgcctccggtgaccagccggccatctcccaggacatggggctggccgagttgctcgaggtcgacgacccgtatcaactcgagctggccgacctctgggccaaccggcccaaccgggaccggctgcgggtgccgatcggcatcggcctggacggccggccgatcgagatcgacctcaaggagtccgcccaggacggcatgggcccgcacggcctgctgatcggcgccaccggctcgggcaagtcggagctgctgcgcaccctggtggtggcgctggcgctgacccacgacccggagatcctcaacttcgtgctggtcgactacaagggcggcgcgaccttcgcctcgctcgaccggctcccgcacaccgccgcgatgatcacgaacctgaaggacgagcagcccctggtcgaccggatgctcggcgccatccagggtgagctgacccgccggcaggagctgctgcgcaagaccggcaactacgcctcgcagcgcgactacgagcgggcccgggcggccggcgtgccgctggcgccgctgcccagtctggtgctgatcgtcgacgagttctccgagctgctcgccgaccggcccgactttatcgacatgttcgtccagatcggacgcgtcggccggtcgctcggcatccacctgctgctcgcctcgcagcggctggacgagggccggttgcgcggcctggagacccacctgtcgtaccggatcggtctgcgcaccttctcctccatggagagccgcgccgtcctcggtgtgccggacgcctacgagctgccgtcccacccgggccacggctatctgcgggccggcaccgacggcctgatccggctcaaggcggcctacgtgtccggggcggtccgccgcgagggcgccgtcgccgccggcggcacccgggccggcagcccgatccgcgagttcaccacctactacgcgatgcccctgcaggaggagcagccccgcgccgccgagccggccggccaggaggtcgaggagaaggttcagggtgacaccctgatggacgtgctggcccggcagatggaggggcgcggcaccccggcgcacgaggtgtggctgcccccgctggacaaggcgcccaccctcggccagatgctgccgccggtgatctcgatgccggaccgcggcctgcaggtcgacgcggccgagcggttcggcgcgctgcacgccctcaccggcatcatcgacaagccgttcgaccagcgccgggatccgatgtggctggacctgtccggcgcggccggcaacctgctcgtcgtcggcggcgcacaatccggcaaatccaatttcctgcgtacgctgatcaccagcctgtcgctcacccacaccccccgtgaggtgcagttctactgcctcgacttcggtggtggcccgctcaccgcgctcgctgacctgccgcacgtcggcggggtcgccggccgccgtgactcggaccgggtccggcgcaccatcgccgaggtgcacctgctgatgcgcggccgggaggacttcttcgcccagcgcaacgtcgagggcatggcggcgtaccggcgggtcaaagcccagggccggtacgcggaggacccgttcggcgacgtcttcctggtcatcgacggctggtccacgctgcgcaccgaattcgaggacctcgagcccaccgtcaacgagctggccaaccggggcctcggcttcggcatccacgtgatcggcgcgaccagccgctggatggacgtgcgcccgcagatccgcgacgtcttcggcacccgcatcgaactgcggctcggcgagcccggcgactcgctgatcaaccgccgggaggcggtcaacgtcccggacaagtcacccggccacggcctcaccccggacgggcaccacttcctcgccgccctgccccgcatcgaccgcgagcagcgcgccgacgacctcgccgaggccgtcgccgagatggtcaagcacgccaccgagcactggtccggcccacccgcgccgcgggtccggctgctgccggccgagcttgcgttcgaggcgctgcccgcggcccgcggcccggtcgtcccgatcggcatcgccgaatccgacctggaacccgtctggctcgacttcgacgccgaaccgcacgccctgctcttcggcgacatcgagagcggcaagagctcgttcctgcgcagcctcgccaagtcgatcgtggccggcaacagcccgtccgaggcccgcatcctcaccgtcgacctgcgccgcagcctgctcggcatcatcccggccgagaacaccatcggctacggcacctcccaccaggtcaccgccgacctgatcaaccaggtggtggtcgccatgcgggaacgcctccccggcccggacgtcacccccgagatgctcgccaaccgcagctggtggaagggcccccagctgtacgttctggtcgacgactacgacctggtcgccgccgccgcacagaatccattgctgccgctgctggaattcctcccgcaggcccgcgacatcggcctgcacctggtcatcacccgccgcatcggcggcgccgcccgcgccatgttcgacccggtgatcggccgcatccgcgaactcgcctcccccggcatcatgatgtccggcccgcgcgacgagggcccgctcttcggcacgatcaaacctcagttcctgcccccgggccgggcctggatgatcacccgcaagcacggcgcccggctggtccagctcgcctggacgccgccggcccactga

SEQ ID NO: 1456 - DNA, 1404 bp, Actinoplanes utahensis
gtgaccgcaccgggtgggccgagtctggcccgggtgacgatcgccgcgccgacccggcggatggatgtcgctctgcccgacaacatgctggtgggagagctgctaccgcacctgctgcggcacgccgagggcgcgttgggcgagccggccgagcggcacggcggctgggtgctgcgccgcgccaccggcgccgcgctggagccgcagcgcaacctggccgcccagggcgtgcgcgacggcgagctgctgcatctgaaaccggcccgggaggactggcccgagctggcctacgacgacgtggtcgaggtgatcgccagcggggcgcgccgggccgggcggtcctggggtgccgccgcgacccgccgggccggtctggcggtcttcgcggccgccctgctgatcggcctgttcgggctggccgccggcggcccggcccggccgaccgcggcgatcgtcgcgctggtcgtggcggtcgcgctggccgtggtcggcatcctgctgtcccgggcgttcgccgacgcgggcgcgggcgccgtggtcgccgcgagcggcctgccctacgcgttcctcggcggggcctggctgatcgccgactcgggcgcccgcttcctcggcgtcggcgcgccggccctgctgctcggctcggcggtgctgctggtgctcagcgtgctggggcacaccggggtggccgggttgccgcggctgttcgtgggcggcatcgcggtcgccctgaccggtctgctggccgcgctgctcaccctggccggggtgtccgcggccggtgccgccgcggtggcgctgaccgccgcgatcggcctgctccccggctatccggtgctggccagctggatcggccggctgccgttcccggagctgcccagccgggccgaggagatcctcaaggacaagccgatgccgcgccgggcggacgtgttcgccgcggtggtccgggccgacgaggtgctcaccggtttcctgctggcgaccgcgttcagcagcatcgtggcgatcgtctacctggcctggtcgcacccgggcacaccggcggtgctgctgatcgtggccgcggtcaccgcgctgctgctgcggtcccggctgctggcgacgccgcggcagcgcggcccgctgctggtggccggggtggccggactggccgtgctgggcgtcggcgcggtggtcaccggcgcggtcccgggcctgctggtgctggccggcgcggtgctggccggcgcggtggcgctgccggccgcggtggtctacagccagcggcagccgtcgccctatctgggccgggccgccgacctgctcgacgtgatcgcgatcatggcgctgatcccgctggcctgcgcggtgatgggcgtcttcgacgacatccgcggcctgctctcgtcgatcggcgggtga

SEQ ID NO: 1457 - DNA, 1359 bp, Actinoplanes utahensis
atggcctcgcgtcgcgatcagctccagtcgtaccagttcctgaaccagcgggtgatctccgcgttcgtgatgcgggagaccgatccggcccagtcgccgctgcggcggggtatcggcgcgctcttcggcggcctgatgatcgccgtcctgatcgcggccggtttcggcatctacggcatcctgaccaaggtcggcggcgaccagtggcgcaccgagggctcggtggtggtcgagaaggagtccggcgcgagcttcgtgttcctgcacgaccggctcaacccggcgctcaacttcacctccgccaagctggccgccggcaagccgaacccgcaggtctaccgggtcgccgcgaaggcgctgaccggggtgccgcgcggggtcaccatcggcattccgggcgcgccggcctcactgccggccgccgatcagcagtccggtctgccgtgggcgatgtgcctggtgccgggcgagaacccggcggccaccctgctggtcggcaccgccgggccggccggcgccgacctgggcgacaaggggctgctggtcaccgatggggcgggcaacgtccaactgatctcgcacgggtggaagcaccggatccaggacgcgcagaccaacctgccggcgctgttcggcgcggtcgacccgatgcgggtcagcaccgcctggctgaactctctcccggccggcgccgacatcgccgcgatcccggtgcagaaccggggcgtcccgtcgcgccgggtgaccggtctgaacaacggtcaggtgctcgccaccgaggtgggcgtcaacggcacccagttctacctggtgctggacaacggcgtgctgccgatcaccgccctgcagaaggcggtgctgaacgccgctttcccggccgagccgaagaatgtgccggtcaccgtggtcaccggcgccccgcagctcaagccggccggcaacgccgacgcgcaacccccggccgacccgcccaaactggccaccgtggcggccggcacgaccgcatgcgcggtcacccggtccgcggccaaggcgccgtcgatcgtggtgggcggctcaccggccgggctctccgcggcggtgccgaccaccggcgcggccggcgggcgggcgctggccgaccaggtcggcgtcccggccgggcatttcgcgctggtgcacgtgcccggttcgggcggctaccaggtgatcaccgacctgggggtgcggcacgcggtgccggacgcggacgcgctggcccggctcggttacaccgccgcgtcggccaccgaggtgccgaccgccctggtcaccagcatcccggccggcgtcacgctggacccggtcgccgccctgaaaccggtcaccggcaccgactga

SEQ ID NO: 1458 - DNA, 1221 bp, Actinoplanes utahensis
atggccctgctgcgggggctgccggccgtgttcctcctcctgatcgcggtcgtcgtcaccccggccgccgcgatggccgcggactgtgcccgtccggcccggctgaccggttcgacggcctggccgcgcaccatgctgtcgatcgactcggccacctcgttcagccggggcggcggagtcgtggtcgcggtgctctccaccggggtgcgggccggccagcggcaactcgccgggcgcgtcctggccggccgcgacgcggtgcgcaaccagggcgcggcggacaccgactgcaccgggatcggcacccaggtggccggcgtgatcgccgccgaccgggcggacggcagcccggtgctgggactggccggcaaggcgaccatcctgccggtccgggtcaccggcgacgacggcacggtgcaacccgccgccctgtctcgtgggatcagcttcgcggtccaggccggcgccgacgtgatcgtggtcgccgagccggcctatcaggacagtgcggcgctgcgcgacgcggtggccgcggcggtggccgcggacgtgccggtgatcgcggcggccggtgacctcggcgcggcacaggacgcgaacccgacgccgttcccggcgacctaccccggcgtgatcggggtcggcgcgatcgatcagaacggcgcgatcttcccgaaatcccagcatggaccgtacgtcgatctggtcgcccccggggtggcggtgcccacgctgcagggtggtgacggggcgtccgccgggttggtcgaggccgacgggacggcactcgcggccggctacgtgggcgccaccgcggcgctggtgcgcgcgcgtttcgggcggctgccggtggccgaggtgacccggcagctgaccgcgtcggccagccccacggtgaccggcgacgcgttcggggccggcgtggtgaacccgtccgcggccgtcaccggacgggtcagcgaccggcggccccgtgccctgcccgccctgagcccggcggcggccggccgcagcggggtggagaaccggcggcgggcggcggccttcaccggggcgaccatcgccggtgtcgcggtcctggcggtgctgatggtgaccgcggcgatccggcgcagccggcggcagcactggcgcccggcgctcgccccgccaccgccgtcctatgccgagccgatcgagccggggccaccggtcatgctgctggaccagccggaccgctga

SEQ ID NO: 1459 - DNA, 504 bp, Actinoplanes utahensis
gtgctaccggttgccaggactcgcgacgaagcccacctctacatggacctgcacggctgtcccgactgcggcagcgtcgacgtcacctgggccgaggcgctggtcgaccggtccggcgtgctggcccgccggtatcacggccggtgcgggggctgcggccgcgaccgggagttcgtcttcgctctgccggaccggccgacaccgccccgggccggggagtacgtgacgttcggcagcgagccgtcccagctgttcgacgccggcgagtgggtggacctcgccgacatgctcagcctggccgccgagatcgacgacgaccccggctccctgctgatcgcggtggcctgcctcgacgaggccctccggttcctgccggcggacgccgccgaggtgccggccgaggcgttctggagtgacgccggccgggcggcgcgggcccggtcgccggaacgcttccgccgcgccgacctgctcgcccgccgcgccgccctggcggcccgctga

SEQ ID NO: 1460 - DNA, 792 bp, Actinoplanes utahensis
atgaagaagcggatcatttcgtacgccgtcgccgcgttgctcaccgccgtggtcgtcgccgacctgctcagcggtggccggctggtccggctgccacagcgcgccgacgcggcccgggagcaggccgcgcagatcggcgcgcggctgcgggcggccggcacggcgaaggtgaccttcgaggcgtcgatgaatccgggcggatcctgggccggcaccagcacggtgcggttcggcgacaccccggtgtgggacacggcgtacacccgcgcgacggccggaagccgccgcatcccgctgcgaaggctgcatctccagcgccgggacttctactcctccccggcgctgaccacggccgacgcccggccctggatcccgccggacagaatcgggttcggccggctgtcctcgccgggcaacaacatcagcgacctcaccacctggctgccgttcctgaccggggcgggtgagcaggtcgcgccgcacgaatacgagttccgctgcgacgggacgtccgccgggtgcccgccgccgctgcattccgacctggacagctacttcaacgcggtcccggacggcccggtgatgcgggcccggctggacgacgagggccggctggtccgtctgcaggtgaccgcggtgctcgacaacatacgcggtgacgggtcgcgcggcatcctggtcccgagcgatgtcacggcgaccttcacactcgccgacttcggcacgccggtgcaggtggtggcaccggccgaggccgacatcacgacgacgttcgtcagtcttccggggtga

SEQ ID NO: 1461 - DNA, 840 bp, Actinoplanes utahensis
gtgaccgccccggcctgggagcccggcaacggggtcgaggagaccctgctgggtgccgcgatccaggacgaccggcagacgttcttccaggtggtcgcgtcctccgacctgtacctgccgcggatgagcggggacggcccgcagcgcttcctcaccatccacgcgctcggccaggtgatgctgccggtgttcacctcggtgcgggcgctcgccgcgcaggtcgggcacgccgtcgacggctacacggtgaccaacttcgccgagctcagccgcaagtggccggacccggactggcggctcgcgatcaacccgggtacgccgatcgacgcgtacctctcgatcgagaccctgatgcaggccgcgctcggcgacatccgggtgccgaccctgggtgagctggccgagtcggccgagcgggaggcgatcgccgacgccgaggcgcggcaccgccgtcgcgacccggccgagtatccggacgacgaccgggcggcgctgcgggcggcgttggaggtcggcgacgtgtacggctacctcgaccggctgctcgacgcgaacgtgctgatcccggtcagccgcccggccgagccggaggagatcctgggcgacgggttcccctggctgcccggctacgaccagatgatcgaggtgttcaccagcccggaggcattcgaccggcggcacccgcacgagccgccggagcgtgtcgaggtgtcgctggcgttcgccctggcgctgtggcccgaggggcacgggctctcggtcgacccggagagcgactccgcgttccagctgcccgaggaccaggtgctggccctgctcgccttcaccccggaagactga

SEQ ID NO: 1462 - DNA, 1035 bp, Actinoplanes utahensis
atgaccgtgctggtggcgcagacctacgccgaggcgtacctgtacctcgacctcaccccgtgcgagtgcggggagaccgccttcaccccgtccgtcgtcgccgaggcggactgcgtgcggtggttcggcgtctgcccgcgctgcggccgggagcggtcgttccgattccgtttcggcgaccgcccggacagcaccggcttcagccaccgcgaggctccgtccgagctgatcgacgccgggcagtggctgtgggtcgccgagcgatacctgtccggggtcccgcagagcattcccgggatccgggcgctgccgcgtgaccagcagaagaccgtgcaggcgctgctcgacgtggccgatgcggccctggacgaggcggcgaagttctggaccaccatggaggacgacgaggacctgcccgagtcggcgctgtggacggggtggagccggcaggcgcgggccgcggcaccggagcggttccggcgtcgctggctgagcgaccagcggtcccgctgggcgctgctggacggcgggattccgccgatgaccgacgaggagttcgccggggggcccgactccgactacctgaaggtggtccggctccgggccgaggtgcgggccatgtgggtggcccggcacggtctgagcgacctcaccgaccgccgggccaccccggcgcaacgcctcgagcttcagcgggccgagcgggccgccaccggactcgacgtggccaccggatactcgacgcatgcgacgcagtccgcgctggccgcgtacgactcgctggtcagcacgatccagcgcgagttcgcgaccgatccggggcagcgggacggccggctcgccgaggcggccgcggtgcgcgccgtgtggctcgccgagacgggcctcccggcgtggtcaccggacgacgacgtgtacgagttcccggccgatcggatgccgccggccggccaggcgtgggagatggtccgcgcggcccgggcggccgccggggtggatccggacctcggcgacatccgggagtggcggccgtga

SEQ ID NO: 1463 - DNA, 765 bp, Actinoplanes utahensis
atgccggttccacgcgcccgtagcgagcatgaggcgcacctgcacatggatctgcatccgtgcgtgtgcggtgagtcgcgcttcccccgcgagcccgagaagacgttgctgcccgatggcctcgccgaggtgcgcttcgccggtccgtgcgacaactgtggccggccccgggagttcgtctaccggatgtccaccgagccggagatcgaggagccgggctggccacggttcggcggtcccgagccctcggagctgatcgacgccgatcagtgggttgcggcagccgcccggtatgcggctccgcccgccgacccgatgcgcatgcgcaccgcgatggcctgcatcaacgaagcggagaaactcggcgccgagggactgtccccgctctgggagagctacaaccggtcctccggagtctgggagccgcgcccgtggccggggccgcccagctacgagaaggatccggccaccggctttcccaccgacaccggccggaccgcgctcagcggatacaaccggctgccgtaccagatccgcgcccgattccaggacgacccggccgagcgggaccgtcggctcgccgcggtggccgcggtgcggtccgcctggtgtgtccggcagggctacccggagtgggacgaggacgccgacgagtacgacatgccggccgatcggttgccgccggccgagcccgcctgggaactggtccgggccgcgcgggcggcggccgggcaggacccggcgaccggggagttcgtgcgatga

SEQ ID NO: 1464 - DNA, 360 bp, Actinoplanes utahensis
atgcgggaccccgacgacgaccgcgacccggcccggcacctgctgtcccgggtccgctaccggcggctgccggacggtacccagcagcgcgtcccgatcaccctggaccaggccgccgccgagttcggcgagctgatcgacgccggccggccggccgaggtgcgcctcgacccggacgagggccgcgacgaggtcgcggcgttctcccggcagcgggccaaggtgatcgcctcgctgctcgacgagctgtcccggcgggtgcgtccggggctggccgtcggcccgatccagagcgacggcaagctcgccgacctggccgccgagtccgccgcgcacctgcgcagcggcaccggttactga

SEQ ID NO: 1465 - DNA, 333 bp, Actinoplanes utahensis
atgaccccggacccggcccggcactggctgagctaccccgtccaccggggtgatccggagggcttccggccgaaaccgctcgatgagttcgccgccgacgcccgcccggccctggacgcgggcgacgccttcgaccaccgcaccacccgcggctcgcgggacatcgtgtcgatctccgtgcagcgtgccggggtgatcgccgctctgctggacgagttggcgctgcggctgcgcccgggcgtcgaggcggggccgatccaggccgacggcgagctcagcctgctggcccgcgagctggccgacgacatgtaccggtgggcgtcacccgagtga

SEQ ID NO: 1466 - DNA, 1005 bp, Actinoplanes utahensis
atgacccacccgttggcccggacccgccaggaagcgcacctgttcatcgacctcaccccgtgcgcctgcggggatcgccggctggccaccgccggcgagccggtcacgctgccggacggcaaccccggacggcggtacgcgggacgctgcccgacctgcgggcgcgaccgcgagttcgtgttcgcgatgcccgccgtaccggaggactccaccagcacccggcagatcgtgtacggctacggcacccgcccctcccggctcctcggcccggggcagtggctatgggccgcggagcagtatgccgaggccgtaccccgcgatccggaacatctcaccggcgaagcgcgggcgaccgcgcggacctggctgatggcggccgtggcggccgtgcgcgaagcggcgaagttcctgccggacggcgctgaccggctgccgccgggggacgtcccggccggccgggacccggacgacttcacccggcagcggttgatcgaccggcgactgggatatgagcggcggctgcgcgcccttccgggtgacccgccgcccccgcgcgacccggagcaggtccgccgccagctggcccgcaaccgcgcggtcgaggcctgggccgcccggcacggcctggccgatccggtgatcggcgccggcaccgcggagcagaaccgggagatcgaccgggagctgcgccgcatggacggtctggacccggagaccggcctggaccgggacagcgccgccgccgggttcgccgcgttccggcagttcatcgacgatctggagatcgcgctggcggccgacgtgccggcccgtgacctgcggatcggcaccgccctggcggcgtaccaggcgtggctggaccgtctgcggatcagcgacgggccatggcgcgacgccctctgggccggggacatctggcagacgccggacaccgatctgccgcccgccgcggcggtgtgggagatggtcgaggccgcccggtcggcggtccgctcactcgggtga

SEQ ID NO: 1467 - DNA, 489 bp, Actinoplanes utahensis
atgactgagctgccgcccgccgccgatcagccgtcgctggaggggctgttcagaacgctgcgggacaccgagtggtcctgggaccgggccgggtttccggccctggccgagcgcttcggatggaccgtcacctaccaggacgacaacggtgtgatcgccgacgtgccgtggccggctccgcgccgcccggtccagctggcctggagccgcggcgcggtggacgaggtgagtatcaccctggcttcggtagccggactgcccgaggcgccgccggacttcctgcccggggtgttcgacctggcggtccggaccggcacggcgatcctgggcgagccgggcgacggcaggccggccgaccacccgcaggtccggtggcccggcgagcgggccacgatcgtgctcgaccagctgcccgtcgcggtgttgctcacctgggcggacaacgagtggctggcgatcgccgactggtcggacgaggacgacggatga

SEQ ID NO: 1468 - DNA, 528 bp, Actinoplanes utahensis
atggcctggccgggggtgaccgtgccccggtcggtagtgaccgtgccccggtcggtagtgaccgtgcccgggtcggtagtgaccgggctgccgtggatcgtgctgctgtggatcgtgctgccgtggggaacgaccgtgcgccgatcggtggcgagcgggggccggcgggaggggatcgtgccgccgttggtggcgagcgcggggcgattggcggagaccgggcggcttccggacggcacggggcttctcgaggcgatgtggcggcgggcggggagacgagcagagggcgggatccctgggatggccattctggtcggcttccggaaggcgcgggaggacccgaccacggtggagtgccggtacgggcatccgagccgggaccgggcgctggtgatcgacaaggacacgccggcggggacgccgctggacggggcggcgacgccggcgttcgcggcggtcgcggcgaaggcggtccggacatcccggaccgtggggacgtggccggcggcggggacgtacgccgcatag

SEQ ID NO: 1469 - DNA, 1644 bp, Actinoplanes utahensis
atgctggactacttctcggcgttcgaggagtggctgcccggctgggccgactggctctcgcacctggtgatcggcgagatcccgctggcgcacgccaacaacgtgtacgacctcgccgaccagtgggagcggctcgccgacgagctgaaccggacgtaccaggacatcgtccgggccgccgacccgatcgtcgagaactggtccggcgacgcgtccgcctccgccttcgtcgagcagtggtacgcgtacctggacagcctccggcagaccgccgagggcgccggcgagatgcgccagggcgtgcagaacttcgggctcgaggtcgagctgatgaagttcgccgtcgcgatgaacctgttcatgctcgccgtgcagatctggatgatgatcgccggggccggcccgaccggcggcgccacgctcaccggcgccccaccggcgttctggggcttccgggcactgctgggcaaggccgcctccgccaccatcgggcggatcgccggcatcgtgatgaagttcgcgatcaagccgctggcgttcgtgttcggcaagctcccggcccgcgcgctgaccgccggcgtccggttcgccgtcccgctggtcacccggatcaccctcggccacatgatcccggccggcgtggtccgcggcctggtcgcccagggcgcccgcaacctggccgagaagatcgccggcaagtggctcaccgacatggcgatcaagggcgccaccaacctggccgcccgtggcatctccaagaccgtcgccaaccggctcgccgcccaggccctgcgcgacatggccaacaccgaggtccgcggtctgctcgcgcagcagagcgcccgcgcggtgcagaagcagctggtcaaagagatccagcagcaactgatgaagaactgggtgggcaggaaggtcgccgaggacgtcggcgagaacgcgcttaccaagctcgccgtcaaggaggccgcgacggtcggcctgggcaaggagttcgggcactacgtgggcagccgggtcgcgttcggcgccggcttcatgggcggcggcgacctggccggccagctcgtccagatgggcgagggcaaccgggacagcctggactggggccacgtcaaggacagcgccatccagggcggcgtcttcggcgccagcatgttcggcggcatcaccggccacgtcgccggcggcgcgctggccggcggtggcctggacatcatgagccagctcgaacagggcaccgggatcaaggacctgaactggaccgaagccgggcacggcgcggtgcagggtgccgaggccggggtgatcttcggcgggcagacccacctggagatgagcacgctcggcgccggcaaactgcagatcggcaaagacctgcacatcctgtcccatgaggacggcagcttctccgcggtctccttccgggacaacccgaagctcggcatccgggagcacctggtgctcaccgacaacggctacgccgcgtaccagggggccaaccacggcggtgacggcgcgctgcgggtggtgcccgccgaggtctccgcgcggcccgaggtggcccagcacatcgccgacaactggggtccggagccggccacggtccggaccgagtcgccgtcaccgggtgtcacggctagctag

SEQ ID NO: 1470 - DNA, 387 bp, Actinoplanes utahensis
atgggtaactacgtctcgatcaagtcgagcccgtccgaactcatcaacgtcgccgaccggctccgcgaccacgggatctcgctcaccgcgaacgtgcgcgccatcaagctcgacatcgtcgagcacgagaaccgcggggacaccttcccgtcggacaagttcaccgacggcttcgtgccgaagaactacaagaagccggttcccgggccggtgccgggacaggacatcccggccaacgaggcgctgatgcagggcgccgaggcggtcgccgcccggctccaggaggtcggcgagtacgtcggcaaggcgatggtgaactacgacgtgaccgacctggagaacgccggcgacatcgtgaaacacacggcgacggcgaagcgcgtctga

SEQ ID NO: 1471 - DNA, 402 bp, Actinoplanes utahensis
atggcggacgtaccgggacgacccgactggggcgtgctgcgcgacatgctctccgacctccgcaaggccacctccgacctgccgaacgtgcagcgcaggatgctccaggtgaccggcaccggctactcgccggacggcctgatcaaggcggtcgtcggcccgcgcggccacctcctcgagctcgacatcgacccccgggtgctccggcagcccaactcgaaggcactctccgcgagcatcgtgcagacggttcgcgcggccatcgaggatgccggccgcaagagcaccgcggtgatgaccgacagccttccggccgatctgcgccggatggcccccgacgacgtgcggagctatgtcggcagccacgacgccgacgtgctgatccgggcagaggatgactaa

SEQ ID NO: 1472 - DNA, 285 bp, Actinoplanes utahensis
atgagcatcacctacaacttcggccagatcaacgacgtcgcgacggccatcggcacctttgaggggcagatggaccatcagctgaccgagctgtacacggcgttcacgacgctgttcgcggctgactggcagggttccgcgggcgaggcctgcgaccaggcccggcagaagtggaaccagggcgccaacgagatcaaggccgcgctggccagcgtcggcgtgaagctcggcgcgtcggcggagcggatgcagcagatcgaccagcagatcgccgccggaatgtga

SEQ ID NO: 1473 - DNA, 342 bp, Actinoplanes utahensis
atgggacaggtccatgccacgcaggaacagctcaacaggatggcccagcgctgtgaggagaccggggagaacatctcccggggcatggcggggctgcgggagcggatcgaggggctcagcggtggcgggttccagggcagcgcgaacaacgcgctgcaggatgtgacgggccagctcaccgagggtctcgcgaagatcgtcaacgcgctcgacgaactggccggcaagatgagcagcgcttcgaagcagtacggcacgcacgacgaggacgccgcccacgacatccgggccgcggccgcgtcgaccggcgacggttccgtcgtcagcatcctgcgcggctga

SEQ ID NO: 1474 - DNA, 1074 bp, Actinoplanes utahensis
atgggcgacgacaatctgtatccggataccacgaagcagaacacgcatcagccctggctcgacgagcacaccccggtcgacgtcaacctcgacggcctccgggagtatgcgaagctgatgggcaagcagcagacccagctgcaggacgacctgggtcgcctgacccatctgtacgactcgccgttcaaggcgtgggacgggcacgtgctcggcgaggccgcgaacatccgccagcagctgaccaacaacgccggcgagctccaggcgtacatggggtatctggcgcaggccttctacaacatcggctcggccgcgcagacgatcgccgacatctactccgacggcgacgcgaccggtgccgcctcgctcaacgacgtgctgttcgccttcggcgacaagtcgatcccccggccgcacggcctgccccgcaacatcggccgcacctacctggacgcggtgaccgagcaggccaagtccgacccggtcgccatccccggggagaccagcccggagtggggcaacccgaccgtcacgaccctctcgccgtaccagtcgaaggaggtctcggtcggtcccggcgggcagcacatggagaaagtgatcaccagcgtcccgggcagtggggtgaccatcgagacggtcaccatcttcaacgccaaggggcagcagctctccaccaagagcacccgcaccaccacgtcgttcgacgcgtccacgcactcgatcgtcacctccaccgagagcagccaggacggccgggccaccggctcctcggtgaacaccaagacgtatgccggcacccggctggccgacgagaccacggtgaacaagggcgcgaacggtcaggagaccacgaccaccgagaccaagaccgccaccgacgggtccaaggtggagaccaccaccaagccggtcaaggacaagcacggccacatcgtcccggaccagcgcaccaccaccgacgaggtgcacaccgggacggccacgacgagcagcggcacgtccgccccgaccacgaagatctccacggcgtacgacccgatcgcccagcggatggcggccgaccatggctga

SEQ ID NO: 1475 - DNA, 1554 bp, Actinoplanes utahensis
atggctgacggcgactacttcggcgcgaaggccgacccgaattacggatacagcccgtacagcgggcaattgcactacggcaaccacagcatcgacttcgagttcactccggacgcgggtgagggaaatccgctcaccatcgagaccgttgaatggatgatcaacaattcgcatccggaggagatcgcggtcctcggtgatcattggcagaacatgatcacccggctgaaccagtacaagacctttctgcgcgacgagagcaagcagctggaggcggagagctggaagtcgccgaaggcgcgggagatgttcctgcagaagggccccggcgaggcactggcctacctggacgtctggatcgacgcggcgaccaccaacctcaccgccatccgcgccctggagaaggtcgccgccgactcgcgggccaagatcgcccagctgatgaacgagtaccgggccgccctgcacaacgcgcagcacgtcgacctgaagggccagctcagcgagtggttcgacaccagccgggcgctcaacaccacctggggcgacgccaagaagtaccagatccagcagcaggtcggggaggtcgagaagcacttcaacggccgggcgcaggaactcgccgcgctgaccgccaaggcgtactccgactggagcaagacgctgttcagcggcgtcggcccgccgtacaagccgatggacgccgtactcaaccagccgggccacccgccgctgctggccccgccgaacctgcccggtggtggcgcgccgcccccgccaccgccgttgccgccggccgtcccgccgcctccgccaccctcgggagcgaacccgaaaccgcccaccgcgccgggtggtgacctgccgcccgacccgtcgcagggcacccagggcaatccgccgccggctcccggcgcgctgccggcccctccgggtcaactgcccggcggcatgcccggcggcgtgcccggcggccttccgctgttccccggtggcctgagcaaccgcgggctcaccccgcccagcctccggccgggtctgggcgcgcagcgcccggcgctgccgcagtcgccgggcaccagcctgcccaacccggggcagctcacccgcaacgcgttcaaccggcccggtcagccccccggcctgggccagccgcccggccgcacgctgcgccgcggcggccagagcaccggcaaaccgggcagtctgccgccgggccgtcccggcgaccgccggcgcggcgagcaggaccgcgagcacggcacccggctgccgggcggcaccgaggaggccttcggtcacccgccgaacagcatgccgccggtgctgaagaatccgtcgaccgaccggcagcggcggcgcccgggcagcaccgaggagttgcgccccaccgcgcacaccagcggtgacgcctaccgcccggagggcaccgccccgccggtgctgaaccggccgatgcagccgggcatcccgccggcgcagccgtcccgcaggcggcagacgcccggacagcggcagaccaccggcccggcgtggggcgacttcttcggctag

SEQ ID NO: 1476 - DNA, 285 bp, Actinoplanes utahensis
gtgtccggcctggaggaggtgccggaggcgctgcgcagccgggccgccgcccgcgccgcggccgcacagcagggccgtcccggcacggtcgctccggagctcagcaagcgccgggtgaccggcgagccggctccggcgcagcgggacgaggacgaggacctgtccggtgtggtcaccgacgagcaggcgttcgaggtgcagaccccgggcggcggcgtggtgaccagccagcgtgaccagccggtctacgagccggagatcaagcgggtgctgggctcctcttga

SEQ ID NO: 1477 - DNA, 402 bp, Actinoplanes utahensis
gtggcagcttccgcgaacgacgtaccgcaggcgacggcccggccggaaccggccggcggcgggcggcggctgctcgctctgctcatcgactggcttctctgcctgctggtggccggcctgtatgccagcccgtaccggacgtcgtggccgccggtggtcctgctgatcctggtgaacaccgtgttcatcgggcttttcggacagacgcccgggatgcggctgacccggatcgcctgccgctcgctcatcgacggcggtgcgatcgggctgggccgcgggttgctccgggcggtgctgctcgcgctgctcgtcccggcgttgatcgccgacggcgacggtcgtgggctgcacgaccgcgccgccggctcgatggtggtcaagaggagcccagcacccgcttga

SEQ ID NO: 1478 - DNA, 1425 bp, Actinoplanes utahensis
gtgttcgccaatcccgaggaactcctgcgatacctcaaagacgaggacgtcaagttcgtcgacgtacgtttctgtgacctccccggcgtgatgcagcacttcaacatcccggtggagtcgttcgacgacagtgtggcaaccgacggtctcgccttcgacgggtcctcgatccgcggtttccaggccatccacgagtccgacatgatgctgctgccggacgtcgccaccgcgttcgtcgacccgttccggatccagaagacgctggccctgaacttcttcatccacgacccgttcacccgcgaggcctactcgcgtgacccgcggaacgtggccaagaaggccgaggcgtacctcgcgtcgagcggcatcgccgacaccgcctacttcggcgccgaggccgagttctacatcttcgactcgatccgccacgagacctccgcgcaccaggcgttctactacatcgactcgatcgagggcgcgtggaactccggccgtgaggaggagggcggcaaccgcggttacaagaccgcgttcaagggcggctacttcccggtctccccggtcgaccactacgccgacctgcgcgacgcgatggtccgccgcctggtcgacaccggcttcaccgtggagcgctcgcaccacgaggtcggcaccgccggccagggcgagatcaactacaagttttccacgctgctgcacgccggcgaccagatgcagctgttcaagtacatcatcaagaacaccgcctgggagcacggcaagacggcgaccttcatgccgaagccgctgttcggcgacaacggctccggcatgcacacccaccagagcctgtggctgggcggcgagccgctgttctacgacgagaccggttacgccggcctgtccgacatggcccgctggtacatcggcggcctgctgcaccacgcgccgtcgctgctggccttcaccaacccgacggtcaactcgtaccgccgcctggtccccggctacgaggccccggtcaacctggtctactcgcagcgcaaccgctccgcgtgcacccgcatcccggtcaccggcagcaacccgaaggccaagcgcgtcgagttccgcgtcccggacccgtcgtccaacccgtacctggcgttctccgcccagatgatggccggcctcgacggcatcaagaacaagatcgagcccccggccccgatcgacaaggacctctacgacctcccgccggaggagtggggcagcgtcaagcaggtccccggctccctcgacgccgtcctcaactccctcgaggccgaccacgagttcctcaccgccggcggcgtcttcaccgacgacctcatctccacctggatcgactacaagcgcaccaacgaaatcgacccggtccggctccgcccgaccccgcacgagttcgagatgtactacaacgtctga

SEQ ID NO: 1479 - DNA, 2316 bp, Actinoplanes utahensis
atggacatcgagaactctgcctcattcgaggtggctctgcaggccggtatacacctgatgctgggagccggcttcagcgtgctggcgaaggacaagcagggaaggtctcttcctgtcggcgggaagctcggcgacgaattgcgtcaagaattcggcgtggatcctggatgcaagctgaccctgccgcagctttacaccattctggcggcgaaggatcgggacgccgccgacgaatatctccggaatcgtttcacggtcggctggtttgatccgcgctacacctctgtggcgcgccttaacgtttcgatgatttttaccacaaatatcgacgacctgccatggaagatctatgaaggcagccagacgaaatatctcaatgacgtcgtgatgcgtgggccacagtttaaggatggatcggcggttgactatgcccctctccatggttccgtactcgacgatacgcgagcatttcgcttcacgagcatagaggtggccagcagcttctcgtcggatcctacgctctggcagacctttcgacgtcggctgtcggcgggcccgacactgttttggggatactctctgcaggacgcggcggctcttgaatccctgcagaccacgggtcagggcggaagagccgtagggaacaattggattacggtcaggccgtccgaccgagacgacccccttgtcgagtatcttcgcgctctacgttttcagatcatcttcgctgaaactgaagaaatgatcgaatatttcgatggtttggttccggcggcaccgtcggaaggcgcggatgacatcatcgactcgctgaggcaatatttggttccaaggcctagtagggtgcctcagcgccccgtagtggaattctattccggtgcggcgccggcatggagtgacatatttcgcccagacgttccgaaattggaacagtatcgagtggcggagaatgcgctgaacagcaaaaaggacgtaatcgtcactggaattccggcgagcgggaaaacgacgctcttgatgcaactcgcggcggcgaatgtaggtcctggcgttactttcatgccaggctccatgaccagagaggctgcggaccgacttcaacgggttctgcaggggaacgaagcgactgtggtactcgatcgcttctgtgacgacgtcgaggcatggaatctgctccgagcggcgccgaatattacgctcctcgccgctgatcgtgactataacatcgggaccgtgatccaccgtatcgatcggtctggtgtggaattcgtttccctgtctgaaatcagtgaactggatcagggcaccatccgagccgccatacctgcggccgtgcggaccccgaagatggttaggccgccggttaccgcgggcgaggtgagcatactggacttcaaccttgcgaatactacctcgaagagtctagaatcgcgccttgtagaggccatcaagcagttccaggaagatgatccggtctctgccgagatgcttatcttgatcgcatacgttcatgcatgcggaaccgtgttgtcaatggacatggcactcgcctattggcgtgataaatccgctcaatacagagacatattaacactcatcgaaaaagtcggaaagctcctcaatgagtatgagggcgacctggcggaagatgatgggcaggattactttgcggcgcggtccattgtggtggcagaggcggccctgaatgccgcaaggacgtccatcctgcgcaaggtgctgacaacctttcattcgaacctcgccactacccgaatctgccgtttcgacatctttcgcagacgtggatacagtcatcggatcattgggcgtgcgtttcagcggacgcaggacgcgatccaattctacgacctcctcctggataaggatgcaaatccataccttcttcagcagaaggcgctactgctcagcgaaaggagtctctacacggaatctttcgtggctattgatcaggcgctcgcgatgagccccaagaagaattggcgcatcgaagccacgcatgcagaacttctcttcgatgccaatataaatctggcagccgagagttcggacgctcgaaggcaggccgaccgtgctatggatatgctgcgtaggtgttacctctcggataggcggagatccttgcacgccttcagttacagccgccgcgcgctgaagtatttcggtcagttcggagacgaacaggcgagaacgtatctggagcaagccgaagagtggctgagggtggtgcaggtcaacgagccatacatgacatccaccaaatacctgctgggtgacgtgaggcgggagctttcctga

SEQ ID NO: 1480 - DNA, 3468 bp, Actinoplanes utahensis
gtggacatcggggtgctgggcccgctggagctgcgcgccgatgacggtgcgccggtgccgatcggtggcgtccgactgcggacgctgctgattcttctcgctcgtgacgcggggcgcagcgtctccacgggccggctggtcgacggtctgtggggtgcggcgccgccggccggcgcggggaacgcggtgcaggcgctggtgtcgcggttgcggcgggcggcgccggggttgcggatcgaggcgacggcgaccggctaccggctggtgctggatccggggcgggtggacgcgctgcgtttcctggcgtgcgccgaccgggatccgggggcggcactgcggatgtggcgcggggagctggaggttcccgacgtccatctggaggaggtccggctgcgcgcgcagaaggcctggctggcggccgagatggcgcaccgcgacgtggtcgccgagctggaggccctggtcgccgcgcacccgctggacgagccgctggccgcgctgctgatccgggctttgcgtcgggccgggagtccggggcgggcgctggacgcgttcgagcggatccgggtccggctccgtgagcagctgggcaccgacccgtccgccgagttgaccgcgctgcaccgggagttgctccgccaggagcggccgggcccgcgcgggaatctgccggccgagctgagcaccttcgtcggccgggagaccgacgtccggcgggtggtcgcgctgatcggcacgcatcggctggtcacgctgaccgggccgggcggcagcgggaagacgcggctgtcggtcgaggtgggcggccggctgccgggtgcgtcgtggctggtggagcttgcgccggtacgggacgccgcggagctgccgcaggccgtcctgaccgccctgggcctgcgggagcagccgggccgtgatccgctgacccggttgcgggacgcggtggccggccgggagctgctgctgatcgtggacaactgtgagcatctgatcgaggccgccgccgaggtcgccgcggcgctgctgcgggccgcgcccgggttgcggctactggcgacgagccgggagccgctcgggatcccgggcgagggcatccatccggtggagccgctgccgttgccgccggccgggtcggacgccaccaccgcggccggctttccgagtgtgcggctgctgctggaccgggcgaccgggttcgcgctgaccgacgggaacgtggcgagcgtggtgcggatctgccgggccctggacgggatgccgctggcgatcgagctggccgcggcccggctgcggacgctgccgccggcgatgctggcggaccggctgaccgaccggttccggctgctgaccggcggtaaccgggccgcgctgccgcgtcatcggacgctgcgggcggtggtcgactggagctgggagctgctgtccgagccggagcgccggctgtggcggcgggtggccgcgctgcccggcggcgccgacctggcgggcgtcgagcgggtttgcggtgccgacctggacgtggtcagcgcgctggtggacaagtcgctgctgatcctggagccggacgggcgctaccggatgttggagacgattcgggagtacggcctggagcggctcgccgaggccggcgagaccgagtcgtcgcgccggtccatcgccgatcatctgctggcgctggcccgggcggcggagccgcatctgcggcgggccgagcagctggtctggatggcccggctgcgggccgagcacgacaatctgcacgcctcgctgcgggccgcgctggcggccggcgaccgggccaccgcggtcgccctggtggcgaacctgggctggtactggtggctgtgcgggcaccggaccgagggttccacgctgtgcctggcggcgctggccctggacggcccggcggaccggcaggagctggccctggcgtacaccctggcggcgctcaacggggtcgagggcccgatggcgttcgccgaggtgaaggcatctttcaaccgggcgctggagctggccgacccgcatccgggcagccatccggggctgcggatgctggggctggtcgcggcgctgtacgggacccggcgggcggatgcggagcaggccgccgcgacgatcgtcgacgacccggatccgtggctgcgcgcggtcgcccggatgatcgtcgggcaggtgcggctgaatttcggggagccggccgaggtcgccgaggcggacctgcgggcgtcgctggccgggttccgggcggtcggcgaccgctggggtatcgggttcacgctgagcgcactggccgacctgaccgcagcacgcggcgacttcgcgcaggcggtcggctggcagcgggaggcggtcgagctgctgcgggaggtcgggatccgggaggacgtcccgcagatgggcgccaagctggcctatcagctgtggctgcacgggcagcgggagcaggcgtaccgggcgttggacgaggcccgggagtacgccgccgacctcggcattccggaggtgatggcgtcggtgcaccacgtgtccgcgacgctcgcccgcgaggagggccggctggacgaggcgcgcgagcaggtggaccggaccgtggcactgatcgccggttcgacgctggcgccgcagttccgggcgatgacgcacagcacccgggggctgatcgaggcgaccgccggccggctcgccgaggcgcgggccgagcacgagaccgcgctgcggatcgcggtgcgcacccgggattcgccgatgatcgcccaggtgctcgccgggtgggccgacctggcgctgcgcgaggcggatccggagcgggcggcgttcctgctgggtgccgctgacgcggtgcgggggtcggtcgaccgtaccgtcaatgcgggtgtgatcgtggcgggcgaagcccgcgccgcactgggcgacgcgggctatgcggcggcgttcggccgggccacggcggtcaccatggacaccgcgctggccgcggccggattagacccggcggcggaaggcctggacggagaggggggcgaagaccgcgaagagcgcggcggcccagatcagcgcaccggtgaccgggccggccaccgggccaccggtgagcaggccgcggccggcgtcggccaggagcgtggtcgggttcacccccgcgaagccgcgcagccagcccggcatgctgtcggtgcggacgaacgcgctgctcacgaacgtgatcgggaagatcagcacgaagccgaagatctgcacccgggccggttcgctgaccagcatcgcgagcagcacggacacccaggagacggacaccgcgaagccgagcagcagggcgaagaagccgagcaccggcagcgggccggtggtgatccggaaacccagcagcatgccgaaacccagcagcagcgcgagcgcccacgcctgtttgatcacgtcggccacgatccggccggccagcggcgagaaccgggagatcggcagtga

SEQ ID NO: 1481 - DNA, 942 bp, Actinoplanes utahensis
atgggacatgacaccaccaccgccgtctacgccgagggcctggtgaaacgctacggcgacaccaccgcgctggccggggtggacctcgcggtccgcaccggcaccgtgctggggctgctcggcccgaacggcgccggcaagaccaccgcggtccgggtactggccaccctggtccgcccggacgccgggcacgccacggtgggcggcttcgacgtggtccgccagggccaccaggtgcgccggctgatcggcctgaccggccagtacgcctcggtcgacgagcagctcaccggtttcgagaacctgctgatgatcggccgcctgctcgggctcacccggccggcggcccgggcccgggccgggcagctgctggaccgcttcgacctggccgacgcggccggccgggcggccgggaagtactccggtggcatgcgccgccgcctggacctggcggccagcctggtcggcgagccgcgcctgctctacctcgacgagccgaccaccgggctggacccgcacagccgcaacgaggtgtgggacatcgtccgggggctggtcgccgacggcaccacggtgctgctcaccacccagtatctggaggaggccgaccggctggccgacgagatcgtggtggtcggccacggccgggtgctcgccaccggcacgcccgagcagctcaaggcccggaccggggcacagaccgtgacggtgcgtccggccgacccggatgatctggagaaactgtccggcgaggtgggccgggtcgcggccgggccggtcgaggtgcgcggcgatgcggtggtcgcgccggtcagcggcccgggggcgctgaccgcgctggtccggagcctggacgacgccggcctcccggtgtccgagctggcgctgcgcggcccgagcctggacgaggtcttcctgagcctgaccggagccgccgcatga

SEQ ID NO: 1482 - DNA, 1173 bp, Actinoplanes utahensis
atgaagcgaatcgtgtccctggtcgggtcggcgttgctggcggtggttctgatattcaccgcggtgcaccgtaaccagttcttcgactccaaggtctactacggggcggtgaagtactggttccgcgacggcgggatggtctacgactggctgaagccgggcacgccgtacggcttcacctatccgccgttcgccggcctggtgatgtcgccgatgtcggtgctgccgttcgccgccgtggtggtgctcgcctcgatcggcacggtgctcaccaccgcgctgctggtctggtggctggccgggtcggtgctacgccgcaccggccacccgctgtggttcgtcttcgggctggcctgctgtgccgggctggctttcgaaccggtccgggagacgttcagtttcggtcaggtcaatctgctgctgctgaccgtggtgaccggcgacatgctgttcggggtcgcccgcggccgctggtggggtggcatcggcatcgggctggccaccgcgatcaagctgacgcccggagtcttcatcctgtatctgctggtgacccgccggtggaaagaggcgggcaccgcgatcggcgcggccgccggggcgtcggtgctggccggcgcgctgttcccggatcagtcccgggagttctggacgtccgcgctgtgggacaccaaccgggtgggttcgctgcagttcctctccaaccagtcggagcgcggcatgatcgcccgactgccgtacgaccagatcggctcgaagatctggctggtctgcgtcctgatcacgctggtctggtgggggctgcgggtggcccggaacccgggtgacgtggtcggcggcctggccctgaccggcgtgctgggctgcctggtcagcccggtcacctggatccaccactgcgtgtggctgatcccggcgctgatccgctgcctggagcgtggctggtcgggggtgggtcgcgggccggcctggctggccaccgccgcgtacgtgctgatgacctcgcatctggcctggctgtgggagaaccggccgtggccgccgatggcgatcctgggcagcaacctctacgtcctgttcagcctggctctgctgatctggacgccgatcggcgccggggtcccggccccggatccggctccggagaaggtgctgaccggcgctgacgggcgctga

SEQ ID NO: 1483 - DNA, 1395 bp, Actinoplanes utahensis
atgccgcgtccgcctctcatccgatatgcggggctcgcaggtagcaccctgttgtcaggtgccgcgcggctcggcggcgcgcaccgcccgtgggaaccgacggtgaccccgtggacgatcgtcaccgggcagaacggaatcctgctgccggtgttctggctgatcgggatcaccctgctgatcggcgcctggctggccgggcgacgggtggtcccgtccgcgcggtgggcgttcgtcacggccgggctgtgggcgttcccgctggtgctgttcctgccgctgggcagttacgacacctactcgtacgcctgccagggctggcagcacgcggccgggctcaacccgtacgccggcggggtcgatcttctgggttgcccgtggtccgacgccgtcgcgccgatctggcgcgccacccccgccccgtacggcccggtgttcctgaccctcgccgccatggcggcgcgggagggcggttcgctggccgggacggtggcgctgctccgcctgatcgccgtggccggggtcgcactgctgggtgcctgcctgccggtgctggcccgccgggccggtgtgccggccgctcgcgcggtctggctggtgctggcctgtccgttgctgctcatccacctggtgtccggcgcgcacaatgacgcggtgatggtcgcgctgctggtcgccggcctggcggtcgcctcgaccggccggggctggccggccggtgtgctgatcgggctcgcggtgggggtgaaggtcaccgcgatcgtcgtgctgcccttcctgatcttcctggtgccgaagccgcgctggcgggcggccggcgagttggccgggggcgcggccggcgcgctgctcgtcgcctcgctcggctccgggctgggcctgggctggatcggcgcgctcgtggacagcggcgtgtcggtgcagtggacgtcgccgccgaccgcggccgggatgaccctggagctgttcggcgtgccgcacggcgtcccggtcacccggatcctcggcatgctggccctggtcgccgtgctgatcgccctgttccggcggaccgcgcgaggcggcgatccgctgttgtacgccgggctggcgctggccgcgacggtgctgctcgccccggtcttccacccgtggtacgcgacctggccgctcgccgtgctggccgccacgctgccccgggacacccggtggctggccgtcccgtgcgcggtggccgccgccctctgcctgcccgacggatacaacctcgccctggccaccaaggctctgggtgctgtcgggatgactgtgctcgccggttctctagcgtggaaagtgctgcatgaagcgaatcgtgtccctggtcgggtcggcgttgctggcggtggttctgatattcaccgcggtgcaccgtaa

SEQ ID NO: 1484 - DNA, 246 bp, Actinoplanes utahensis
ttggcccgccaactagacgaggagtgcgtcgtggcgacgttccaggaccggttcgcgcgatggttccacgagaccttcgacgacatgtggttccgctcgctgatcggcccggcccagacgaagggcgccgtccagggctgcgacgccttcgcccgcgagggctggaaggcggacctggaacgccgcaagcaatacactcgcgaccagcgcgaactcaagcgggcccggcgtgcgggggcccgctga

SEQ ID NO: 1485 - DNA, 447 bp, Actinoplanes utahensis
gtgaccgacgacgcccccgtggatgatgatccgctggctctggaacgacaggtgtgcttcgcgctgtcggtggcggcacgcagcgtcgtggcgctctatcggccgctgctggagccgatgggcctgacgcatccgcaatatctggtgatgctcgcgctctggggggagtcgccgctgaccgtgcgccggctcagcgagctgctcgcgctcgatccgggcacgctgtcgccgctgctcaagcgtctggaagcgatcggttacctgcgccgtgagcgggaccgggcggacgagcgcagcctggcgatcacgctgaccgagcggggtgaggcgctgcgggccgaggcgttgcggatcccgccggccgtggtggcacggctcggcatgccgatcgacgacctgcaccggctgcacgcctcgctgacccgggtgatcgccgcggcggtgtga

SEQ ID NO: 1486 - DNA, 3012 bp, Actinoplanes utahensis
atgccgggatgccgaagaccctgccgctgctggggcagtgaggtgacccgccccacccggctggcgcggtacggtttcgccgactccggggccgatctgctcggcccgcgcggtctgcggctgtgggacgccgagggtccggccggcgccgacgcggccgagctgatccacgccctgtcccgggccgccgacccggatctggcgctgcgccagttccaccggctggtcgacgcggtgtcccgggccgccgagcgggccgccggggcccgcccgaccgggccgaccggtgagatcaccgcgaacgacgccacccgggaggtgttcggcgagctgttccgggatcacggtctgcgccgccggctggtggcggtgctcggtgcctcgtcgacgctcggcgatcacctggtcgccaacgagcaggagtggcgggcgctggccacgacgaagagcgggctgccgcccgatccggaggggcacctggagctggacgagccgaccgtgccggcgttgcgccgggcgtaccggatcgccctgctgcggatcgccgccgccgacctgaccggtggccgcggtctggagccgaccatggccgcgctgtcgacgctggccgacgagacgctgtccgcggcgtacgcgatcgcggtggccgcgctgccggccggcaccccggagccgcgtctggcggtggtggcgatgggcaagtgcggcggcaacgagctgaactacatctccgacgtcgacgtgatcttcgtggcggccggcgacgaggatctgccggccggcaccacggtcgcggcccggctgatggagatctgcggtcaggtcgcctggccggtggacgccgcgctgcgcccggagggcagccgtggcccgctggtccgcaccctcgccagccatcaggcctactaccgcaggtgggcgcggacctgggagttccaggccctgctcaaggcccgcccggcggccggcgacctggcgctggccggggagtggctggccgatctggcgccgctggtctggcatgccgcggagcggcccgaggcggtcgccgacgtgcgggacatgcgccgccggatcatcgacaacgtgccggcccgcgagctggaccgggagatcaagcggggcccgggcgggctgcgggacatcgagttcgcggtgcagttgctgcagctggtgcacggccgggtcgacgagtcgctgcggctgcccggcacgctgccggcgctgcgggccctggtctccgggggctatgtgggccggcaggacggtgagacgctgctgcgcggctaccgtttcctgcgggccgtcgagcaccggctgcagttgcagcacctgaagcgcacgcacaccgttccggacgatccggccgggctgcgctggctggccgcggcgctcggctacaccgcgctgcccggccaaggcgcggtggaggcgttccggtcggactggatcgggcacgccgcgaacgtccgccggctgcacgtcaagctgctctaccagccgctgctggaggcggtggcccgggtgccggccgacgcgctgcggatgaccccggagtcggcccgcaagcggctggagatcctcggtttcgccgacccggccggcgcgctgcgccacctggaggcgctgaccggcggcgtgacccgcacctcggcgatccagcgcaccctgctgccgatgctgctgcaggatttcgccgacgcgccggagccggaccggggcctgctcaactaccggcaggtgtcggacaagctgggcggcaccccgtggtatctgcggctgctgcgcgacggcggcccggtcgcccgccggctggcccgggtgatcggcctctcccggtatgccaccgatctgctcacccgcgacccggaggcgttgcggctgctggccgacgatgccgagctgcagccccggtcccgggagaagctgctcgacgggttcgccgccgcggcggaccggcacgccggggacccggtcaaggcgatcgccgcggtccgcgccctgcgccgccgtgagctgttccggctggcctgcgcggacatcctgtcccaggccggtgatctggccccggcccacccggtcgacgtgcacgagatcggcgcggcgctgtccgcggtcaccgacgccacgctgaacgccgccctgctgatcgcccggcgggcccgaccgggtccgcccgggatgcgtttcgcgatcatcgggatgggccggctgggcggctacgagatgagctatccgtcggacgccgacgtgctgttcgtcttcgacggcacggatgacggcgccgcggcgcacgcggtcgccgaggagacgcgccggctgctcaacgcccccgcccccgatccggcgctgggcgtcgacgccgatctgcgcccggagggccggcagggcccgctggtccgcagcctgcaggcctaccagcagtactacgaccgctggtcgaaggtgtgggaggcgcaggcgctgctgcgcgcccgcttcgtctgcggtgaccacgatctcggcgtggcgttcgaggcgctcgccgaccgcaagcggtacccggacggcggcttgagccgggaccaggtcgtcgagatccgccggatcaaggcccgggtcgagaccgagcggctgccccgcggcgccgacccgaacacgcacaccaagctgggccgcggcggcctggccgacgtcgagtgggcggtccagttgctgcagttgcggcacgcccacgaggtgccggatctgcgccgcaccgcgaccctggaggcgctggcggcagcccgggaggccggcctggtggaggcggccgacgccgccgcgatggccgacggctggacgctggccgcccaggtccgcaacgcgctcaccctggtccgcggccgcccgaccgatcagctgccgcagcacggcgtcgagctggccggcacggtgctgctgctcggcggcggtgacccgggcgagttcgtcgaccgctacctgcgcctcacccggcggtcccgggccgccatggaacgggtcttctcctga

SEQ ID NO: 1487 - DNA, 771 bp, Actinoplanes utahensis
gtgaggacagcgcttgtcatcgagaacgatccgaccgacgacctccggcgcctcggggagtggctcaccgaggccgggctggagctgaccgtgctgcgcccgcacgccggcgacgatctgcccgagaccctggacgacttcgccgccctgatcgtgctcggcggcgatcagagcgcctatccggatgcggccggcgccccgggcgccccctggttcccggcgttggaggggctgttccgcaaggcggtccgcaaccgggtgccgacgctcggcgtgtgcctcggcgggcagctgctggccagcgcgcacggcggtctggtggagcgcagtccggccggcccggagatcggtccggggctggtcggcaagcgcgacgcggccgacaccgacccgctgttccagtgggtgccgctgctgcccgacgtgatccagtggcaccgtgacgagatcaccgagctgccgctgagcgccaccctgctggccgcctccagccgttacccgcatcaggcgttccggatcggcgaccgggcctggggcctgcagttccacatcgagtgtgacgccgcgatgatggccgactgggtccggctgggcgccgccgacctggacgagctgggctacgacggggaggcggtggtgcacgcggtcgccggcatcctgcccgacgtcgaggaggtctggcagccgttcgcggcccggttcgccgcgctggccctgggtcagctgccggatgccgggatgccgaagaccctgccgctgctggggcagtga

SEQ ID NO: 1488 - DNA, 111 bp, Actinoplanes utahensis
gtgccgacttcgatccagccgatggtgttcatctcgttctccttcgttggcgtcgacagaactctcgcgggccggcccgacagcgtcctgtcggtgtttgccggcgagtaa

SEQ ID NO: 1489 - DNA, 1440 bp, Actinoplanes utahensis
gtgcgcccggtccaggcagtaaccgccggtgcggcccggctcggcgtagatcggggtgccggactgctgcagggcgccgatgtcacgctcgacggtgcggacgctcacctcgaagcgctgggcgagccagcgggcgctgcgtggccggggtgcgaccgcccgcaattcctcgacaagggcgtagagccggtcggtacggttcacgcccagcacgctagagcgggggtacgacaatctcccggtacggcgccggcaccccgcagtcaccgccgaccgcctaaggtctgcagcatgacgcaggagtcgcccgagccccgggtgtccacactcgagctgttcttcgatctcgtcttcgtcttcacggtgacccagctcgccgactcgctcgcccaccacccgacctggtccggcctggtcgacgtcctgttggtcctggtcgtcgtctggtggatgtattcggggtatgcgtggctcaccaacgcggtcgccccgaccaccaccacccggcgcaccctgctgctggccgggatggcggggttcctggtgatggcgctggccatcccggacgcgttcgggcacaacggctggctgttcggggtggcctacgtggtcgtcaacgtcacccattcggtgctgttcctgcaggccgggccggacgcgcggcgggtgatgcggactctcgggccgatgaacctgctggccgcgctgctcgtgctgaccggcggggtgctgcccgagccgtggcggcacctgtgctggctggccgccccggtggtgcaggtgctggcgagctactcgcacccgatcgggctgcaccacatcgcggccggccacttcgtcgagcgccacagcctcgtcatgatcatcgcgatcggcgagtcggtcatcgcgatcggcgtcggtgtcggcggccagggccatctcggcggcgacctgatcctggccgcggttctcggcctggccatcgcctactacctgtggtggacctatttcgccgacggcgaccgccgctccgagcacgtcctggccgcggtcgacgatcccgcccggcgcggccgcctggccctgaacgcctgggggtacgcgcacatcccgatgctcctcggcatcgtgatcaccgcggtcgggatcaagaagacactcggccacacgttcgaggcactgcactggccggaggccctgatgctgggcggcggcgtcgccgtctacctgctcggtcacgccgtcttcctgcgcctgctggcccagcccggcccgggctaccgcgtgatcgtggccacatgttgcctggccaccgtcccgctggggcacctcctggccgtcgcccagctggccgccgtcgcggtgatcctggcggccggcgccatcgccgaggacatcccccgcgtccgccgcgccggattgcaggccgccatcggcgacttcggccgcaccggctga

SEQ ID NO: 1490 - DNA, 426 bp, Actinoplanes utahensis
gtgctgcaggacctgctggaaggcgcggggcggagcatcgtcttcggcctgatcgggatcggcctgatggccgtcggttacgtgctgatcgacctgctcacgccgggcaagctgcgtgacctgatctggacccggcgcaacccgaacgcctccctgctcctggccgccaaccagctcggcatcgccgcgatcgtcttcaccgcgatcttcaccacctacgactccttcggccagggcctcgcctccacggtcctgttcggcctgatcggcatcgcgatcatgggcttggccttcctggtcctcgactggatgacccccggcagactcggcgaagtcatctgcaccgacgacttccacggcggcgccctggtcagcgccgcctcccacttcggcgccgccctcatcgtctgcgcctgcatcgcttga

SEQ ID NO: 1491 - DNA, 1353 bp, Actinoplanes utahensis
gtggaccgacagcaggagttcgtgcttcgcacgctcgaggagcgcgacatccgttttgtccgtctctggttcaccgatgtcctcggcacgctgaaaagcgtgtcggtggccccggccgagctggagtccgccttcgaagagggcatcggcatcgacggctccgccatcgagggcttcgcccgggtgttcgagtccgacatggtcgccatgcccgacccgaccaccttccaggtcttcccgttcgagggcggcggcagcggcgagagcgcccggatgttctgcgacatcctgctgcccgacggcaaccccgcctgggccgacccgcgccacgtgctgcgccgcgccctggcccgggcggccgagaagggcttcaccttctacacccaccccgaggtcgagttcttcctcatccaggaccaggacaacgacggctcggtgccgatcccggtcgacaccggcggctacttcgaccacaccacccacgcggtggcccgcgacttccgccgccaagcggtgctcgccctggaacggatcggcatctccgtcgagttcagccaccacgaggtcgcccccggccagcaggagatcgacctgcggtacgcggatgcgctgaccaccgcggacaacatcatgacgttccggcacgtggtcaaggaggtggcgctctcccagggggtgaaagccaccttcatgccgaagccgtacaccgaccagcccggctcggggatgcacacccacctgtcgctgttcgagggcgagcgcaacgcgttctacgacagcgaggacccgcagaagctgtccaagacggcgcgcgcgttcatcgccggcctgctggtgcacgcccgggagtacaccgcggtcaccaaccagtgggtcaactcgtacaagcggctgttcccgatgcagctgcccgaccggatcaccgagtcgccggcgttcgtcagctggggccacctcaaccggtccgccctggtccgggtgccggccttcggcaaacccaactcggcccgggtcgaggtccgctcgctcgactcggcgaccaacccgtacctggccttcgcggtcatgctcggggccggtctcaagggcatcgaagagggttacgagctgcccgccggcgccgaggacgacgtgtggtcgctgtccccggccgagcgcagggcggccggctacgaggcgctgccggagaacctgtccgaggcgatcgacgtgatggccgggtcggagctggtcgccgaggtgctcggcgagcacgtcttcgacttcttcctgcgcaacaagcgcgccgagtgggagcagttccggcgtgaggtgacgccctacgagcggcagcgctacctcggcgccctctga

SEQ ID NO: 1492 - DNA, 1782 bp, Actinoplanes utahensis
atgcccacgctgcgcatcgccctcgctcaggtgaattcgacggtcggcgacctggccggtaacgcggccgcggtccgccgctggtcacgggccgccgcggaggccggcgcgcacctggtggccttcccggagatgatgttgaccggctatccgatcgaggatctggtgttccgcaactcgttcgtcgaggcgtcccgacgggcgctgggcgagctggccgcggagctggccgccgacgggctgggcgagctggcggtggtggtgggttatgtggacgccgacgggccggcccggatcagctcggacgccacgccggggaccgggcgccgcgacgcgtccgcgctgctgcaccgcggcgaggtggtcgcgacctacttcaagcaccatctgccgaactacggcgtcttcgacgaggaccggtatttcgagcccggtgacacgctgaccgtggtgcgcctcaaccggatcgacatcgcgctcaccgtctgcgaggacatctggcaggccggcggcccgttcaccgcggcgcgccgggccggtgtggggctggtcgtcaccatcaacgcctcgccgtacgagttgaacaaggacgacgtccgcctcccgctggtgcagcggcgggcggccgaggcgggcgccaccgtcgcgtacgtcaatctggtcggcggtcaggacgagctggtcttcgacggtgactcgatgatcgtcggaccggacggcgagctgctggcgcgggccgggcagttcagcgaggaactgctcgtccacgacctcgatctgccggaggcggacgccgagccgaatccggagggttccaccgacgcggcgaagccccgggtggaaaccgaggtgagcgacaccatggcggtaagtcggacgacgatcaccggcgagccggccatgctccgcgaccgccggacggcccccgccaaggatcgcctcgaggactccgccgagatctggtccgctctcgtcctcggtctccgggattacgtcgacaagaacggcttccgctcggtgatcctcggtctctccggcggcatcgactccgccgtggtcgccgcgatcgccgtcgacgccctcggcccggaccgggtcaccggcgtctcgctgcccagcggctactcctccgagcactccaaggacgacgccgccgacctggccggccgcaccggcctgaaataccgcgtcgagccgatccagccgatggtcgacgccttcctggcgaacatgtcgctgtccggtgtcgccgtggagaatctgcaggcccgggtccgcggcgtgatcctgatggcactctccaactccgacggccacctcgtgctcaccaccggcaacaagagtgagctcgcggtcggctactccacgctctacggcgattcggtgggcggcttcaaccccctcaaggacgtaccgaagaccatggtgtggcaattggcccgctggcggaacacgcaggcggacgcaccgatcccggagaattcgatcagcaagccgccgagcgccgagctgcgcccggatcagaaggattcggattcactgcccgactacgaggtgcttgatccgatcatcaaggggtatgtcgaccacgacctcgggcgcgccgagctgatcgcggccgggaacgacccggccctggtcgaccgggtgctgcggatggtcgacctggccgagtacaaacgccgccaggccgccccgggcaccaagatctccgggaaggcgttcgggcgggaccgccggctgccgatcaccaacaggttccgggagggacaggtactttaa

SEQ ID NO: 1493 - DNA, 831 bp, Actinoplanes utahensis
atgtcggagatcccgaccctgtacggcggtcccgcaacccgccgggtccgcacccgtgacctgctcaacgccaaggtccgcggcgaccggtggccgatgctcacgtcgtacgacatgtacaccgcttcgatcttcgatcagtccggtgtgccggtgctgctcgtcggcgattccgcggcgaacaacgtgttcggatacgagaccaccgtcccgatcaccgtcgacgaactgttgccgctggtccgcgccgtggtgcgggccaccaggaccgcgctgatcgtcggtgacctgccgttcggcagctacgaggagtcacccacacaggcgctgcgcaccgccgtccggttcatgaaggagggcggctgccacgcggtgaagctggagggcggccgccggatggccccgcagatcgaggcgatcaccggtgccggcatcccggtgatggcgcacatcggcttcaccccgcagcgcgagcacgcgatcggcggctaccgcgtgcagggccgggagaacgagggcgccgaggtgatctcggacgcgcgggcggtcgccgacgcgggcgccttcgcggtcgtcctggagatggttccgggcgaggtcgccaagcaggtcaccaaggagttgtcgattcccacggtcgggatcggcgcgggcccggacaccgacgcccaggtgctggtctggcaggacatggccgggctgcggaccggcaaggcgccgcggttcgtcaaacgctacgccgacctggcgggcgcgctgaccgaggccacgcggcagttcgccgacgaggtccgctccggcgagttccccgctccggagcacaccttctga

SEQ ID NO: 1494 - DNA, 1425 bp, Actinoplanes utahensis
gtgccgatcaaaagggtgtgggcgccgcagatcgacttctcggttctccggcgggagctgaagctgccgggggagttcccggctgaggtgatcgccgaggcggagcgggtggccggggagatgccggagctcgccgaccggaccgatgtcccgttcgtgacgatcgacccggccgggtcgcaggatctcgaccaggcgatgttcctggagcgccgggagtcgggcggctaccgggtgcggtacgcgatcgcggacgtcgcctcgtacgcccggcccggtggggcgatcgaggcggagagctgggtgcgcgggcagaccgtctatctgccggacgggcggatcccgctgcacccgccggtgctcagcgagggcgcggtcagcctcttcccggacgtggaccgggccgccgtggtgtggacgatcgacctggacgcggacggggcgacgaccggggtggctctggaacgggcgcgggtgcgcagccgggccaagctggactatccgggcgtgcagcgggagcttgacggcggcagcccgtccgagcaggtgacgctgctcgccgagatcggcgcgcggttggcccgccgggccgccgaccggggagcggtcaatctgccgctgccggctcaggaggtggagcgcgacggcgacggctggcggctggtgctgcgcgcgccgctgccggtggaggagcacaacgcgcagatctcgctgctcaccgggatggccgcggcgcggatcatgctggacggcgggatcgggctgctgcggaccatgccggcgccgaaaccggaggcggtggccggtctgcgggtcgccgccgcgtccctcggggtgccctggccggacggggcgagcgtcggcgcggtggtggcgtcggtggatccgggcagcccgcggggcgcggcgtttctcgaccaggcggcggagctgctgcgcggtgccgggtacaccgccttcggcggggacgccgggccgccgccgtccgacgtcgggcacggcggggtgggcgcggcgtacgcgcacgtcacggcaccgctgcggaggcttgccgaccggtacgtgacggaggcgtgcctggccctgcacgggggccgcccggtgcccgggtgggtgcgggaggcgctgccccggctgccgaagcagatgtccgcgaccgaccgggtcgccggcgccgccgaccggggtgcgatcgacctggccgaggcggtgctgctgcagggccgggtcggggagacgttcgacgtggcggtcctggaccgggaggacgcctccgggaaacggccggccggcggcatggtggcgctcgacgagccggccgtgcgcgcccgctgcctcggcgacctgccgctgggctcacgcatccaggcgcggctcaccgaggccgacccgtcgacccgcacggtccgcttcgagaaggcgtga

SEQ ID NO: 1495 - DNA, 1239 bp, Actinoplanes utahensis
gtggcgaccggggccagggctgcgggcgcgacgaagactgcggcgaaggcgaccacaacgaagacggggaccaaggcaaccgccaccaaggcgactgcggcgaaggcgaccgccgctaaggcggctgcaactaaggcggcggggaccagggcaactccggccaaggcggcggggaccaaggcgacagccgccaaggcgaccgccgctaaagcgacagcgaccaaggcgacggcgaccaaggcgacgacgaccaaggcgacggcggccaaggcgacagcgaccaaggcgacagcgaccaaggcgacagcgaccaaggcgacagtggctaaggggactggggctaaggctgcggcgacgaaggggaccgcgaccagagcgaccgggggcagggccacggcggtcaagtcggctggtgcccgggcggctggtggtcgggcggcgggcaaggtggctgggcggaaggtgagcggggctcgggccggggccgcggcggaggctgtcgtcgcggaggcggcggcggtggaggctgcggcggcggatttcgcggcggtcaaggctgaagaggcgatggagtctgccaaccaggcggtcgcttcggtgatggcggccaagtcggcggcggcgaaggcggtcaaggtggccgcgagcaaccgggccgcggcggccaaggcggcacggaccagcaaggcagcggcggccaaggcggctcaggcggttgccgacgacgagccggcggcccggagcggtcggagccggacgacggcggccacgagcacgacgggccgggcgggaacgaaggcggcttccggtcgggcggcggccaagacagcggccggctccaagcggacggtgccggcggcttcggcacggacggagaccgcggtgagctcggccaggcgggcgccggccaagagcgcatcggtcaagagcgcatccgccaggaacgactcggccaagaacggaccggtcaagaccgcatcggccaagggcgcatcggccaagaatgcgccggccaagaatgcgccggccaagaaggcggccaacaagtcggtggctgccggggctgggcgggctaccgggaatgcggccaagggcaccaaggcgactcggacgtccggcacgaacggaagtgcgggcggcggtgcgaccggcggtggccggaacgccgcgaaggcggcttcggcgtcgcgggccagcgcggtgcgcaagccggcgggtgcggtgcgccgcagccggtag

SEQ ID NO: 1496 - DNA, 2595 bp, Actinoplanes utahensis
atgcccgctgccaaaaaggcaccgaccagacccgccacctccggcgcggcgacaaagacgattcccggtacggccaaacgcaccaccgccgcgggccaaccggaagccgcgaccggtcggaccggcgccggcaccccgcgcccgggtggaacccgcgccgcggccgcgagtgcccggccgtccaccggaaccgggcgatcggctcgtgcggtgaccggggcgggtacggcgaaggccggcgcggtgggacgtgccgcggcgaaggtggggagtggagtcgcggtggcggccaagaccaagagctcggcgagtgtgacggctcgggtgtccggtaagggggccgaggccaagcccgggagttcgcgggcggcgaaggctgctgtggcgaaaccggtcggggtgaaagcgggcgtggtgaaggcgggtgcggtgaagaccgtggccgccaagaccgcgtctgcgaagaccgcgtctgcgaaaacggcttcgacgaaggccgctgtggtgaaggcctcgccggccaaggtggcgtcaacgaaggtcgctgcggtgaaggttgcgcccgccaaggctgcttccacgaaggttgccgtgaccaaggctgcgcccgtgaagacggtggcggggaaggccggggctgcggccaaggcgactacttctgttcggagcgctgcggtcaagggcgctgcggggaagggcactccggccggggctgcggctgcgaagagtgccggcgccaagacggtcgcggctaagccggctgcgaaggcgacggcgggcaagagcgctcgtggggttgcggtggttccgacggctcggagtggggcgaaaagtgcggcggtaggccggacgggggctgccaaggcggctccggtgagcaaggcggcgggggcgaaggtgtccgggcgggatgcgacggccggcaagaaggtgccggcggcgcgggcggcgactacgccgaaatcctcggtgaagggcgctgcgccggcgaagcgggggacggctgcggtgcccgcggctcgggtggcgggtggctcggctcgggcggcgggtggatcggctcgggcggccaccaaacggggcgacaagccggtgaccaagccggtctcggcggccaaggcggtcgtggcgagcaagccggcggtcaagggggtcgcgggcagcaaggttgcggtcaacccggtcgcaggtggcaagacgacggtcaaggcggtcgcggcggctcggagtgcggggcggtccggagtggccaaaccggtcaccgggcgggttgcggacagcgcggtggcgaaggcggccgcgggccggaaggcggtgacgccttcgaaagctgcgaagtcggcggcggtgaaagtgccggccgcccggtccggtgctgcctcgacgggtggagtcaaggtcggcccggccaaggcgggtgcggctgaagccggcccggtgaaggtcggtgctgccaaggccaacacggtcaaggttggcgctgccaaggcgagcgcggccaagaccggcgcggccaaggttggtgcggcggggaccggcgcggccaagggcggtgcggtcaagagcggtgcggccaaggtgggtgtcggtaaggcgggtaaagacgctggggtggctacggcccggcgcgcgtcgggtgggcggcgagttgcggcggcgagcagcaatgtgccgaacaagacgcaggtgaccgtctcgaccgaggacgccgagagtaaagagtggcgacgggctggggatgaaacggagatttcgcccagtgagttgacggatcggccgttcctggggggatggttcgcgccgtcgcgggacgacaccgagcccgcccgcgactccgaccagtggggtgcggaccggcccgacctggaagcgctcgcggagccggacaaggtcgccggcgggaccggcgggaccggaaccacggatctggtgtcggcgcagatggaagcgttcgccaagagtgcccgggcgcgggggcagctgttcctctcgcctgaggacgaaggagcggtcgaggacggcggggtgatccggagtacgccggtgcggaaacggggtgccactgccgggccgcaggaggccgagcgggctggcgaaccgggcggtggtggtgccggatcggaggtggctgcggttcgggcggcgcaggccgagatggcggccacccgggcggcgcaggcggggaccctcgcggtgggccgggtcgggccggaccagcccgaaccgccggccactcaggtggcggtcggcggcgggaccgtgcccggcggaccggcggggaagcgggccggcggcaggctgatcgcggtgccggatgaccccggtgtggcgtacggcgggggctccgtggcggctggaccgttcgcggcggaacactccggggacgtgagccggacctcggtggagccgggggcggcggatgaggctacggcgagcgcggaagtggcgccgtcgcggatgacccggcgggaagcggcggcccggcgggcggcggcccgggctgcgatgagcgggtcagccggaacggcaggctccagcggcgcggtccgctccggcggagtgggcagcgccagttcaggcagtgcggcgggctag

SEQ ID NO: 1497 - DNA, 222 bp, Actinoplanes utahensis
ttgcagagtgatggaatgaacgacagtgggctcggcggggcgggctacttctggtgcctccgacaccaccgggtcgagaccggcgacgacgtgtgtcccgcccaattccggctcggtccgttcgccacggctgacgaagcgacgcgggccctcgaaacggtcgagaagcgcaatgccgagtgggacgccgaagacgcccgctggaccggggagaacagctag

SEQ ID NO: 1498 - DNA, 1026 bp, Actinoplanes utahensis
atgaggatcggcatcatcggcgcgacgggacaggtcggtggcgtcatgcgccgcatcctggccgaacgcgccttccctgtctccgagctccggctcttcgcctccgcccgttccgcgggccgcaccctgccgtggggcggcggtgaggtgaccgtcgaggacgcggccaccgccgactaccgcggcctggacatcgtgctcttctccgccggcaagggcgggtccaaggagtacgggccgcgcgtcgtcgacgccggcgccgtcgtcgtcgacaactcctccgcctggcggatggacccggacgttccgctcgtcgtcgccgaggtcaaccccgacgcggcgcggatccggcccaagggcatcatcgccaacccgaactgcaccacgatggccgtcatgccggtgatccggccgctgcacgacgaggccgggctggtctccttcgtcgccaccacctaccaggccgtcggcggctccgggctggccggtgtggccgagctcgacgagcaggtgaagaaggtcgccgaccgggccaccgaactcacccacgacggcagcgccgtcgaattccccgagaccagggtgttcccccggccgatcgcgttcaacgtgatcccgcaggccgggtcgttcgtcgacgacggcagcttcgagaccgacgaggagcagaagctccgcaacgagagccggaagatcctcggcctgcccgagctgctggtctccggtacgtgcgtgcgggtgccggtcttcaccggccactccatccaggtgaacgcgcggttcgcccgcccgctgtccccggcccgggcgcaggagctgctcgccaccgcccccggcgtcgagctgtccacggtgccgaccccgttgcaggccgccgggcgcgacccgtcgtacgtggggcgtttccgggtcgacccgaccgcggagaacggcctcgccttcttcgtctccaacgacaacctgcgcaagggcgcggcgctgaacgccgtgcagatcgccgaattggtcgccgccgagctgggctga

SEQ ID NO: 1499 - DNA, 798 bp, Actinoplanes utahensis
atgggcatggcgacgtacacccacgggcaccacgagtcggtcttgcgttcacaccgctggcgcaccgcagagaattcggcggcatacctgctgccgcatctttcctccggattcaccctgctggacgtcggttgcggccccggcaccatcaccgccgacctggccacccgggtgacccgggtcaccgcgctggagcgcaccgaggacgcgctgaacgcggcccgcgccgagatcacccggcgcggcctgccgaatgtcgacttcgcgctgggcgacgtgcacgccctcgactttcccgacgactcgttcgacgtcgtgcacgcccaccaggtgctgcagcacgtcaccgacccggtcgccgcgctgcgcgagatgcgccgggtgacccgacccggcggcctggtcgccgcccgggacagcgactacgccggtttcacctggttcccgctgctgcccgagctggacgagtggctcgccctctaccagcgggtcgcccgcggcaacggcggcgagccggacgccggccggcggatgctgtcctgggcccgcgcggccgggttcaccgacctcaccgccaccgcgtcggtgtggggtttcgccgacgacgccgaccggcagtggtggggcaccatgtgggcggaccggatcctgaagtcggagatggccaccacggccctggccaccggcgcggccaccgcggacgacctccagcgcctgtcggacgcctggcgccgctgggccgcgtcaccggacggcttcttcaccatcccgcacggcgagatcctctgccgcgcctga

SEQ ID NO: 1500 - DNA, 591 bp, Actinoplanes utahensis
gtgaactcgcgcatcgcggacatccagagccggatcctggccctgcagacgcagcaggcggccacgatcaccacgaaccggacgacggcgtccggaagcagtagcgccagcaccttcgccggtcacctgcagggcgcgatggtcgcccagggcgcggcgggggcgggccggacgtacaaactcaatgccaagggtattccggaggatctggccgcctacggcaacggcaggatcccgccggaggcgttggagcaggtcggcgacacccggcacaagctgtgggcgccggccgccgagaagctcacccagctgatcgccgacgccaagcgggacggcgtcaccatcgggatcaccgactcctatcgcccctacaccgagcaggtcgacctggcccggcgcaagggcctgtactcacagggcgggctcgccgccaagcccggcaccagcgagcacggctggggcatggcgaccgacctcgacctcaaccccgaggcgttgtcctggatgcgcaagaacggcggccgctacggcttcgtcgagaatgtctcgcgcgagtcctggcactgggccttccgtcccaacatggtctag

SEQ ID NO: 1501 - DNA, 1278 bp, Actinoplanes utahensis
atggccgacgagatccagtcagtccaccagttccgccggttcgccctgatcgtgtgtgcgatcggcgtcgtcatccagctcgggctcaccgcgtactacctgagcatgggccaccgcgcggcgccgcaccacctgccggtcggtctggtggccggtgccgagcagcgcgcccaggtgatcgggatgctggaggccggcggccggttccgggtcggcgacttcccgtcggcggccgcgctgaccgccgcgatcaagcggcgggaggtgtacggcggagcggatctgaccggcgacaccccgcacctctatgtcgcgggcgccgccggcccggccgccgccaccctgctgcgcggcacctacaccgcggtgctgcaacagcggaccgccgagcaggtcgccgcgctcgccaagaccaccgaccgggtcgggatcgccaccgtccgcacgctgatcaccccgccgccggtgaccgacgtggtgccgctgccgaaggacgacgtgaacggcgtctcgctcggcttcctcacccaggccctgtcgctgggcggcacgatcgcctcgatggggctcggccggctcatcccgcgcacccggcgcagctggcggcgcggcgtcgcccacctgtccacgctgatcgtgtacgcggtcggttcggccgccgcggtcctctggtcgatgagctggttcggggtcggcgtcgacgcgaaccgggccgagatgctcggcatcttctcgctgatctcgctggccgtgaccggttcgacggccggggcggtggcgctgatcggcccggccggcgcggcggtcggcgcgttctacttcacgatcgggacggtgatctccggtgccagcatcctgccggagttcctgccgtcgttcggccggcggctgggggagaacctgccgaccggggccggcgtgcaggcggtccgggagaacctctacttcccccaggcgcccatcgcggcacacctgtgggtgctcgccgcgtacgcgatcatcggctgcctgctggtgctggtgaccaacgtgctgccgaaccggagggacagcacgtccgaggtcgatctggacctcacggtccggctggagggctcggcggttgagtcattttcccggagcaactcagatttccccggtgacgccgaacctgtagagcgtgggaatcgagggagtgaactcgcgcatcgcggacatccagagccggatcctggccctgcagacgcagcaggcggccacgatcaccacgaaccggacgacggcgtccggaagcagtag

SEQ ID NO: 1502 - DNA, 888 bp, Actinoplanes utahensis
atgatcacgctcgcggatgtggaggccgccgaccggcggatcgacggccggatccggcgcaccccgctgctccaggccgggccggaccgctggttcaagctggagtacctgcagcacgccggatcgttcaagacccgcgggatgctgaacaagattctcggcagcgacgttccgccggccgggatcgtggcggcgtccggtggcaacgccggcctggcggcggcgtacgcggcccgcgagctcggggtgccggccgaggtgttcgtgccggtgaccgcccccgcggtgaaggtcgccaagctcggcaaactgggcgccaaggtggtgcaggtgggcaacgagtacgccgaggcgtacgcggcggcgcgggagcggaccggcgcactgttctgccacgcctacgacgacccggcgctcatcgccggaaacggcacgatagcccacgaaatatccgaagtctcggacacggtgctcgtggcggtcgggggtggcggcctgatcgccggcctgatcgccggaaacgtcggcaacatgcggatcgtggcggtggagccggcgacctcgtgcgcactccacgccgcgctggagaaggggcatcccgtcgacgtcccggtatccggcgtcgcggccgacgccctcggcgcccgccgggtcggcgacatcgccttcgacctggccaccaccgcgaaaatcgacgcgatcctggtcgacgacgacgccatcgtgcgcgcccgccgcgcactctgggacgactaccggatcgtcgtcgagcacggcaccgccgccgcctacgcggcgctcacctccggcgcgtaccgccccgcccccggcgagcgggtcaccaccctgctctgcggcgccaacaccgatccttccgatttgacctga

SEQ ID NO: 1503 - DNA, 1125 bp, Actinoplanes utahensis
gtgcgaaacgggggtgtcctcgatgggcggggaacacacaacagcaacggagtcggggagcgctcgatgactgtcgcgatcgggatcaacgggctcggacggatcggtcgcagtttgactcgtatcgtggcggcctcgccgaatccggggatctcgatcgccgcggtgaacgacatcgcgcccaccgagaagctggcgtacgggttgcggcgcgacagcctgcgcggctcgttcccgggcacggtcaccgcccgcggcgaccacctggtcgtcaacgatcacgcgatccggacgtaccaccaggaacgtccggaccggattccctgggccgaccagggggtggacgtggtgatcgaggcgaccgggcggttccgggccggcggcagcgcgcgcacccacatcacccacgggggcgcccgcaaggtggtgatcagcgcctcggccgacgacccggacgcgttcctgatcttcggggcgaaccacctgagctacaacccgggcgtgcacgacgtggtctcgccggcctcgtgcggggtgaacgcgctgaccgtgatggccaaggtgctgctcgaccggttcggcctgcacgcggtgaagacctcggtgatgctggccacccagggctggggtcgggtgcaggactcgctgatcggcgcctcgcgggacgatccgcggctgggccgggccaccggggagagcatcattccgcacaaccacgtggtcggcgacctggtccgggtggcgctgccggagatcggcgagatgcgctacagctactactgcgtgcccaccccgatcggctcgctcgccgaactcgccggggagaccgaccggccggtgagcgtcgaggaggtgaaccgggccatggcggaggcggcggccggtccactgcgcggcatcctggcgtacgacccggacccgaccgtgtcgatcgacgtgaagaacaatccggcgtcctgcctgttcgacccgtccggcacgcagaccacggccggcggcggggtgagcgtccgcggctggttcgacaacgagtggggcttctcccaccgattactggatctgacccggctgatcggcgagcgcctacccgtcccgtccagtcaggtgagctggagcgtcgtctag

SEQ ID NO: 1504 - DNA, 423 bp, Actinoplanes utahensis
atgtggaatgcgttgcggcatgctgggcacgtgcccgtactcctgtcctacgcccccgcggacgcacactgggcacaatggatcaccggatcgctgcaggccgccggccatgccgtgaccatgcatccggccggggtcgacttcgcgcatcggatgaccgtcgcgctatccggatcagatcgggtgctcatcctggtctccgcggagcatcccgcgtccgaatcggactgggcgcgggtcgccaccacagcgggatggacggtgctcgccctggacgcggttcccctgcccgcggcactcgatgccgcgaactgcaaaagcttgcatgacctggatgaagaagaggcgctggagatccttctgggggcggtgggcggaccacgggactctttttcgcgtacgccgcaatctcgccctgtttga

SEQ ID NO: 1505 - DNA, 765 bp, Actinoplanes utahensis
atggatctttcgcacatcttgctgctggtggtggccggggtcgcggccggtggggtgaacgcgatcgccgggggcgggtcgctgatcacctttccgagcctgatcgcggccgggttgccgtccgtggacgcgaacgtcaccaattcggtgtcggtctttccggggtacgtgtcgagcgtggccgggagccgggcggacctggccggccaggagcggcgggtgcggtcggtgctgccggccgcggtactcgggtcggtgggcgggtgtgcgctgctgctgtcgacgcccgggcgggtgttcgaggtgatcgtcccgttcctggtgctgggggcggcggcgacgctggctttccaggagcggctgcgcgggctggtcgggcatccgcgcggcatgccggcacggcgggcggcggtgatcttgcaggccgtcgtgttcgtgggggcggtgtacggcgggtacttcggggcggcgctcggggtcatgtacgtggcggcgctcgcgctggtgctggacgagccgttgaagcggatcaacgcgttgaagaacgtgctgtcggcgacggtggggctggtcaccgtgctggtgttcgcgttcttcgcggacgtgcactgggcggcggtggcgacgctggcgccggcgacggtggtcggcgggtatgccggggcgcggctggcccgacggcttccggcgacggtgctcaaatacctgatcgtcacgttcggcacgacgatcggcttgattctgctgtatcgggcgttccgctga

SEQ ID NO: 1506 - DNA, 666 bp, Actinoplanes utahensis
atgcctctgcatcaggatcgaccgggagatgacgtgagcgacgacccgtcgggacgctctgcggtcgcggtagaccacctgacgagtaagcctgtccggacgttcaagatcaagcgtcccatggccgggttcgtcccggtgatgatcgcggtggtggcggccggtcccctgcacgcccatgcgggagcaaggcccgaggccaacgctcctgcgatcgcaccgatcccgggcgaccccgggtggcagggcgtcgtcgtggccgacgtgcactgtggtgacgctgatccgtgccggcgagtccccaccgatccagcgctcgccgacaagtccgcgttctggggtccggacaatgacacccggcagttgatcagccaggtggaggctgccctcgcgaaggatctcgacaagcgcacggcctgcggcctcgacgacaaggcctgtgccgccaagccgccgtcaccggcaggagtccggcaggcgctcaccgccgccggcatctcgcatttcgaggtgcggacggggggactggaagcaggcgtccccgagggcaccgtcctcgtgggtatcccgcacggacctggctgcgtgatcgtcacggtgaccggctacacgcacgacatctacaagaacttcgcccagcctgacgggacctgtctgcacgcgtga

SEQ ID NO: 1507 - DNA, 873 bp, Actinoplanes utahensis
gtgcgccgcgtcccggtcggggcgcggcgcgctcgtcgactgattgcggaccttgcggtccgttgcgaaccttgcccctgttcgaccgactctccggtagcgtcgggcctgttctccgagggttcctcgtgtctgcagggggtcgcgttgccggcgcagatgacgctgacgcagcagttcgccaccgaatacgccaaaggcgcggtgccgggcatgctgcgcgcgatccggaccatcaaacgcgccaacaacgggatcctcgccggcgcgctcgccgccagctacctgcaccagggccactacctggtcagcctcgacgccggactgttcgcctggatcgtgccggccgtcttcgacctcgccatgctgtccatgctgacgatcagccagaccgccgggatggccgccgacgccaaacgcgccgccctcaaggtcctcgttctggtcgtcaccatctccgccgcggtcaacttcgcggcacccggcccactcggcctgcgcatcatcttctccctggtggtcggcctggtcgccggcgtcgaatgggtcgccgccaaaatccgccccgacttcgcggccatcgaggcccgcgaggtggaagcgaccgcggacgtgcgcccggcccgccgcctcgaccccgaagtcgcccggcggcgggccgccaaagcggccgtcacccgtcgggcgaatcaggcggcgaaggccgccgaggacgtcgcccggtcacgggcggccaaggccgccgaacgggctcgcgaacgcgccgcgaaggacgtcctggaacaggcggagctggcgggcttcttcgcggcgcagccctaccagcaggggtcgtatcccgaggtgacgcagcaggtccgggcccgacgctga

SEQ ID NO: 1508 - DNA, 1644 bp, Actinoplanes utahensis
atgagcgggcacgtcaccgagatcgtcatcttcacggtgctgttcctgctggtgagcgggatcggttttgtggcggcccgatggcgggcgccgcaggacatggctcatctcgacgagtgggggctgggcgggcgcagcttcggcgggtggatcacctggttcctggtgggtggcgacctctacaccgcgtacacgttcgtggcggtgcccgcgctgatcttcggggccggcgcggccgggttcttcgccgtgccgtacaccgtcgtcatctatcccctgttcttcctggtcctggtgcggctctggtcggtggcgcaccggcacgggttcgtgacgccggccgacttcgtccggcggcgctacgactcgccgacgctggcgctgctgatcgcgatcaccgggatcgtcgcgaccatgccgtacatcgccctgcagctggtcggcatcgagtcggtgctcaagacgatgggcgtgaccggggacagtgcggtggcccggcatctgccgatcatcatcgcgttcgcgatcctggcggcgtacacctaccagtccgggctgcgcgcgccggcgctgatcgcgttcgtcaaggacaccctcatctacctcgtgatcatcgtggcggtgctctacctgccgtacaaactcggtggctggggtgcgatcttcgatgccgcggacaggaagttccaggcgacgccggcgcccggcgacgggatcctgctgaacgccaacaaccaggtgcagtacttcacgctggcgctgggttcggcgctcgcgctgttcctctacccgcacagcatcaccggcgtgctggccagcaggaaccgtgacgtgatcaagcggaacatgtcggcgttgccggcgtacagcttcctgctcggcctgatcgcgctgctcggctacatggcgatcgccgccggggtgaagccgctgcccggggcgaaggccggcagcctggacagcaacaccgtggtgccgctgctgttcgacaccaaattcccgtcctggttcgccggggtggcgttcgccgcgatcgggatcggcgcgctggtcccggccgcgatcatgtcgatcgccgcggcgaacctgttcacccgcaacatctacaaggagtacctgaagcgggacgcgaccccggcgcaggaggcgaacgttgccaagatcacctcgctggtcgtcaagatcggggcggtggcgttcatcgtcttcctcgacccgcagttctccatcgacctgcagctgatcggcggcgtgatcattctgcagacggcgccgtcggtgatcctcggcctctacacccggtggctgcaccgcggcgcgctgatcgccggctgggccgccggcatgctgctcgccttctggatgctgtggcagatcccgaacgcggcgaccggccgcaagcacttcggcgggtcggcgttcgcgctctccgagttcggcctcgacaccaagaagacgatctacgtcgggttcgtggcggtgctggtcaacctggcggtggcggtcctggtgacattcgcgctgcgggccgcgaagaccccggaaggggtggacggcacggcacccggcgactacttcgccgacgagggcgatccgcgggtcgggcaggagccgaccccggtcgagacggtctcctccacctga

SEQ ID NO: 1509 - DNA, 222 bp, Actinoplanes utahensis
atggcggagctgaaatcttcaccacgtaccgatagcagtgtctggaactggttgcttctggtgccgatcgtggtgccgctgctgaccccgttgttcaatcacgactcgccccggttcgccgggttcccgctgttctactggctgcagttcgccttcatcctgctgggcgtggcgacgaccacgctggtctaccggatgacccggaagcggagccggccatga

SEQ ID NO: 1510 - DNA, 1287 bp, Actinoplanes utahensis
atgaacggtttcatccgccgcttcgtcgccgcggcggctgccgccacggtcgtgctgggcgcggcgcagacgcccgccgaggcgcaggcgagcaagggcttcgtcaaagtcggctacttcacccagtggggcatctacggccgcgactttcagctggccaaggtgcagaagtcgggcgccgcggcccggctcacccacctcaactacgcgttcggcccggtcaccgcggacggcgtctgcgcctccgccgacccgtgggccgactggcagacgccgttctccgacgccaccagtgtggacggtgtcggggacgtggccggccagccgatcgccggcaatctcaaccagctcgccgaattgaagaaggccaacccccggctgcgcgtgctgatctcgctcggcggctggagcggatcggcgtacttctccgacgccgccctgaccgacgcttcccggaggaagctcgtctcgtcctgcgtggatctgtggctcaagggcaacctgcccgaccacgccgcgggtgccgccgccggcatcttcgacggcgtcgacctggactgggagtggcccggctcggacggcaacaccggcaacgtggtccggcccgaggacaagcggaacttcacgctgctcgccgccgaattccgcgcccagctcgaccggctcggccggaccaaccacaagcactacgatctgaccgcgttcctgccggccgccccggcgaagatcggtgccggcttcgaggccgacaagatcttcaggtatctggacttcggcaccctgcagggctacgacttccacggcacctgggaatcgaggacgaaccagcagtcggcgctgcgggttccggccggcgcgccggacaatccggacttctcggtcgacaacgcgctccacgcctgggtcgccggtggcgccccgaagaaccggatcgcgctcggcctgccctactacagccagggctggaccggcgtcaccggcggcggcaccgggcggttccagccggccaccggcccggcggccggcaccttcggcgccggcaccgaggactacaaggtcgtcaagaccctgccggccaagggttacaccgtgcaccgcgacctgcgctccggcgacgcctggctgttcgacggcaccacctattggacgtacgacgacccggccgtcctgctgcagaagacgctgtacatccgcagccgcggcctggccggcgcgatgatgtggtccctcgacggcgacgacgacaacgccaccctcaccaagacgatctccctgggcctgttctga

SEQ ID NO: 1511 - DNA, 1101 bp, Actinoplanes utahensis
gtgagcgccggcctgcgggtcgtcgtcgaggccgacggcggctcgcggggcaaccccggcccggcgggctacggcgcggtggtcaaggatgcggccaccggcgaggttcttcttgagcggtacgccgccctgggcaccgccacgaacaacgtcgccgagtattccggactgatcgccggcctgcgcgccgccgccgagctgaacgccgcccgggtcgacatccggatggattccaagctggtcatcgagcagatgtccggccgctggcagatcaagaacccggggctgcgcccgctggccgcggaggcggcccagctggtcgccaggttccagacggtgagcttcgactggattccgcgggagcgcaaccgggaggcggacgcgctggcgaaccgggcgatggacgaggccgccggtaaggctgtcccggatgtgcccgccgccgcgccccagccgcgcagctgggccccgccggagctggacaacgccacccggctgatcctggtccggcacggcgccaccgcgatgaccgcgcagggccggtactcgggccggggcgacgtgccgctgaccgacgagggtgaggcgcaggcgatggccgcggccggccgggtcgccgggctgtcccgggacgtcgcggtggtgctgacctcgccgctggcccggtgcgggcggaccgccgagctgatcgccgccgaggtgggcggggtgccggtgaccgtgctggacgacctgatcgagtgcgacttcgggctgtgggagggcaagaccttcgccgaggtgcaggagggctggccggacgagatgaccgcctggctgtcgtcgaccagcgtggcaccgcccgggggcgagtcgttccaggcggtggcgaagcgggtccgtggcgcgctcgcgaagatccagcaggcgtacgagggtcaggtggtcgtggtcgtttcgcacgtgacgccgatcaagttgatcctgcgcgacgcgctcgccgccggggatgccttcctgcaccgcttgttcctggatgctgccggagtgtcgaccatggacatctggccggacggcaacatcgcggtccggtcggtcaacgagactgcccatcttcgataa

SEQ ID NO: 1512 - DNA, 735 bp, Actinoplanes utahensis
gtgaaggccgccccggaagcccagcgtcgcctgctcgacctgcaggccgtcgacaccgccctggcccagctcgcgcaccgccggaagaacctgcccgagatcgccgagatcgaggcggtggcccgggagatctccgcgctggaggacgagcgggtccgcgcccaggtcgcggtcgacgacctggaccgggacatcgcccggttcgagaaggacatcgaccaggtgcgccagcgcaaggcgaaggatcagcagcagctggacgcgggcggctcgctgaagcaggtcgagggcctgcagcacgagctggccacgctgaaccggcggcagtccgagctggaggacgccgagctggagctcatggagcagcgcgaggcggccaccgcggcgctcgccgacgtgcagggccggatcgccgctgccgggcagcggcgctccgacgcggaacgccggcgcgacgaggcgtacgccgacatcgccaaggagcaggagttcaaggccgcgtcccgggggccgctcgccggtgatcttccggccgacctggtcaccctgtacgacaagatccgcaccgagaccgggatgggtgccgcgctggtgtacgccgggcgctgcggggcgtgccggatcgagctgtacggtgccgacctcaaccgggtgaagtccgccccggccgacgaggtggtgcgctgcgaggagtgccgccggatcatggtgcgcaccgcggagtcgggtctgtga

SEQ ID NO: 1513 - DNA, 327 bp, Actinoplanes utahensis
gtgcgcgccgccggcgaccccgagcgggtgatccggacgatggccgtctgcggtggcgcgggcgactccttcctggccgacgcggcacgtgccggcgtcgacgcgtatctttgcgcggacctgcggcaccatccggccggcgagcatctcgcgaacgacggcccggccctgctcgacaccgcccactgggcgaccgagcgaccgtggctggacgacgtggcggcctggctgcgcgcgcagtttcccgtcgaagtggtggtgtccgacctggacaccgacccctggaccgttcattccgcctctgcgcacaaggagattcactcgtga

SEQ ID NO: 1514 - DNA, 345 bp, Actinoplanes utahensis
gtggtcgacgccctcgacgggcgttacccgcggagctgggcggagtcctgggaccgggtcggcccggtgctcggcgagtacgagcacgccgtcacccgcatcctgtgcgtcgtcgactgcgtgccggaaaccgtcgaccaggccctcgccgtcggcgccgatctgatcgtcgcccaccatccgctgctgctcaagccggtgtcgtcgctcgccccggacaccttcaaggggcggatcgcacaccggctgatccgtgccgaggtggccctctacaccgcgcacaccaacgccgacgtggccaaccccggcgtgtccgacgcgctggccgcccggctcggcctctag

SEQ ID NO: 1515 - DNA, 585 bp, Actinoplanes utahensis
atgacgggtaacccctcacccggtgtgctgtacgtcctcgtctgcggctcaccgatggcccgggacgtgggaatcctggtcgggctcgcgcagcgggacggctgggaggtctgcgtgatcaccaccccggacggccggaagttcgtcgacgttccggccctgcaggcgcagaccggacatccggtacgcaccttctacaagagtcccggcgacccggacgtgctgccgccggccgacgcgatgatcgtcgccccggccaccgtcaacacggtcaacaagtgggccgccgggatcaccgacacgctggtgctcggtctcctggtggagggctacgggtacggcgtgccgaccgccgtcgtgccgtacaccaacaaggtcatggccctgcaccccgcgctgcacgagagcctcgccaagctgcgcgactggggggtgcacgtcctctacggggaggacgtgtgccggctcggcggtccggggcagaccgaccggttccgcggccagttcccgtggcggcgtgccctgcaggcggtcagcggtccgatcaccgcggccagccgagtcgagcctggggcggtttcctag

SEQ ID NO: 1516 - DNA, 1275 bp, Actinoplanes utahensis
atggctcaccggcggagagtccgccgggtgagtgggggaggcaccgtggacgagctgccgatcggccgccgcgtcgcctactggcggggcaggcggaagatgtctcagcaggtcttcgcagaccggttgggcaagagcaagagttgggtcgacaaggtggagcgcggggtccgccgactcgacaagttctccgtggtgtatgacatcgcggacgtgctccaggtcgatgtccagctgctgctgggcaaggaggtggagcgcaagccggagacccaggcctgtatcgatcaggtcgaggtcgaggagattcgtgccgctctggagcgctatgaccagatgagcgcgttcttccaggccgtgccgcaatctccgcccctcgcggagatgcacaaagcggtcagccacgcctggctgacctatcagcacgcgaagtacggcgccctggcgcgcgcactgcccaagctgttgcgcgacgcgcaggcggcggacaccgcgcacgccaacagcgaccaggcgcccaaggcggcgcacctgctcgggcaggtctaccagatcgcctcgtcggcgctgcggaaagtgggcgagcacgagctctcctggctggccgcggaccggtcgatcgcggtctcccagcgggccggcgaccagctgctggccggcctggccagttaccgcgtgggcagcgcgctgctggcactcggccgggtccgcccatcgctggaggtcaacgtcaacatcgccaaccggctcgcctgcgggctggaacgcgccgacggcgaccagctctcggtgtacgggatgctgctgctcaacggggcgatggcggcctcccggatcggggacagcgccaccgtgcgcgacctgctggacggcgccgatcaggcgtcccggcagctgggtggcgacttcaaccactactggacgtcgttcggcccgaccaacgtgctgttgcaccggtgcgccaccgcggtggagctcggcgacggccggcaggcggtcgagacccacgagaaggcactggacatggccgggttcaacgcgctgctgccggagcggcgggcgcaccactacctggacatcgcccggggctacacacagatcggcgacgtggacaaggccggcgagatgctgctggagggcgaccgtctcgccccctcggagatccgctgccgcccgctcgcccacgaaatcctttccgacgtgctccggcgtacccggggcacgccgccggctccgatcgcggagctggccgaacagatgggagtcggcgtatga

SEQ ID NO: 1517 - DNA, 645 bp, Actinoplanes utahensis
atgcagtggagcagccgtcagccgttcgtcccaccgtcttttctcgatcgcctggaccgggtccggctgcgccgggccgcccagaccttcgccggccacggctgggcggtcgcacccggcgccgtcctcaccggaccgcggttcgactgcgggcggcccggctgcccgatcaccggatgccatccggccgtcgactcgctcgccgaggcggccaccaccgaccccggccgggtcgccgcatggtggcggcgccggccgcacaacgtgttgctcaccaccggggagagattcgacgtgctggaggtcccggcgctgctggggcggccggtcgcggaccgggccgccgggccggtcgcggtcaccgcgggcggacgctggatgttcctggtccggcccggttgcccgctgcgggcggaactcgacctgcgccaggacgtcgtccgccacgggcacggctcgtggatccccgccccgcccagccggatggtggaggggccggtgcgctgggtgatcccgcccagccaggtggattgggcgccgggcgatccgggacggatccaggagatgctcgccgcgagcgcggcacgaaccgggtgggctcatcgcgtaccgcggcaattgtcgaccttgcgccgcgcggcctag

SEQ ID NO: 1518 - DNA, 921 bp, Actinoplanes utahensis
atgaccgcggcgggcgggtccggccggtttcccctcggcggttcgggcccgcccggatgccggcacgacgggggaggcgcggtgaacacggagctctacatcggcgccgacgcggagaaggtcgtggtcgcggggcgcccggtgcgcacccggaccggacgggcccgctcacggcgtaccggatcgatggtcgaagccgtgccgtgcccgccttccgggcgcagccgcgaggttcgcgtgacgaacaccgcccgcctcgccctgcccctgctcttcgtcgccgcggtgctcgccgcggccggcctgacctggtggttgccggcggccgggggtaccgctctggtggtctggctctggcgccggcaggcccgcgccgcgcagccggtcgccttccgccggccgggcgagggcgaggggcgggtgctctggaccgagcccgagcgggcggctttcacccgtgccgtcgccgtcgcgcaccgggttcgccgcacctggcccgccctgggcgcgatgatcgacacccggctggccgaccggtcgctgacccgggcgctggacgagctggccaccctgctggcccgacggcaggagctgcgtcgggtccgggccggtctggccgccaccgaggacgccgacatcccggccgacagcccggcccggatcgctgccgacctgcagcgggagcgcgcggacgagctgtggcgggagaccggcgcggcggcgaaccggatcatccgggcgatcgacgccgcggcccgcaccggcgagagcttcatccgggagcagcaggtggcggccaccgcccggcacgccgagcggacgcttgcccgggtcggtggcgtcccggtcgccgagagtggcccggagctcgcggatcgcacggcagcggtgatcaccgcgtaccgggaactcggggtctga

SEQ ID NO: 1519 - DNA, 531 bp, Actinoplanes utahensis
gtggactcggtcgacctggtgttacgcaaatacgacggacggccgcaccgccgggtcaccggccgcctcctcggcgaggacgagcacggcacctggatcggcaccccgcgcggcacccgggtgagctacagctacggcctacgccggctctcctggacccgctccgactcggtccggctgatcccccgcgacacctggtggatggcgatgttctcggccgcacccagccgctccgagatctactgcgacgtgatcaccccggcccggcgcacccgcccgcacgaattcaccgtgatcgacctggacatcgacgtgatccggctgcgcccggacggccgggtggtgatcgacgacgaggacgagttcgccgcccaccggatccgcttcggctacccggcgcaggtcgtggccgaggccacggcggcggcggcgaccctgcaggcggcgctcagcggcggggccgagccgttcgcgacgcactaccgggagtggctcacccgggccgcggccctgccccggccactccgctga

SEQ ID NO: 1520 - DNA, 615 bp, Actinoplanes utahensis
atgaccgacacagcactccgggactccccgatcaccctcgaccgccgcctcctgctcggcgccacggattacgaggtgaccgtcttccccaccgacgaccagcgcctggagctctgcatagtgagcagcgacggcgacggccgggtcctgagcgagctcagcggcagcctcaccccggccgacctgcccaccctcaccgaggtcctcacctccaccctgtccggcctccgcgcgatgaccaccccaccaccggccaccccaccacccaccccacccgagcctcccgcccagcgcagccggcccgccaaccacggcgcccgctggaccaccgccgacgacgaccgcctccgcgcccgctaccgcgagggccccacccagtccgccctcgccagagagttcggccgcaccccgggcggcatccgctcccgcctcgaacacctgggcgagctcccacccggcgccccctggcgcccaccccgacccaccgcacccaccgatccactcgccaccaccgggatcagcaagcccacgccgccacaggcccagccacccccggccccccactccggcgagcccgaccctcgcctccccaccaggcctcccacagccgggtga

SEQ ID NO: 1521 - DNA, 465 bp, Actinoplanes utahensis
gtgccgatcgaggtgggcgcgccggcgccggatttcctgctcaaagaccagaacaaccaagaggtacgcctctccgccttccgcggccgcaaagcagtcctgctggtcttctaccccttggccttcacccgtcgctgccacggcgaactgaccgaaattcaggcccacctcgacgactacgtcaatgagcgggtccaggtcctcaccgtcagcgtcgactccgtctacagccacaaagtctgggccgaccgggaaggcttcgacttccccctgctcgccgacttctggccccacggcgaagtcgcccgccgatacggcgtcctcaacgaggagaccggcgtcgccaaccgaggcaccttcctgatcgaccccaccggaaccatccgcttcgccgaaatgaccacccccggcgaaacccgcgaccagcacgcctggcgaaccgccctcgccaccctcggtacctga

SEQ ID NO: 1522 - DNA, 432 bp, Actinoplanes utahensis
gtgagcgcgaccgcgggtcaggccgacggcgtacgcagcctggcggaccggttcggcttcgagccgaacatggtggtcatggagatgggctacgacgacgacgtcgacgaggagctccgtgacgccctgaccgaacgcgtcggtgatttggtcgacgaggacaccgacgaggtcgtcgacgcggtgctgttgtggtatcgcgacggcgacggtgacctgttcgagctgctcaccgacgcactcggccccctcgccgacaacggcgtggtgtggctgctgaccccgaaagccggccgcgacggccacgtcgagcccagcgagatcagcgagtcggcccccaccgccggcctgcagcagacctcgacgctgaacgccggcaaggactggaccggcgcccggctggtctccccgcggggcgccaagaagaagtag

SEQ ID NO: 1523 - DNA, 1404 bp, Actinoplanes utahensis
gtgcgccgcgaacgccgccccgccgtgctgcacctgggcacggtccgactgctgggccgcccgggggacccggaccccggccccgacctggaccgcgacccgctcgccgggaccgcccggctgctcgtcgaaaccggtctgctcaccgtcgacgaggtgatcacccggtacgacgagatcggctggcaggtccgcaaagccgccgaggaggtgctcggcgaaccgaaactcgccaccgtcggcgagatcgtcgcctcgctcgctccacgccgcccactgcgggtcgcgcacgccatcgccgacgccgccgaacgcgccctcggcccggccggcgcgaaccggtcccgcgtcttcggcggccggctgcccgaacaggccggcccgatgaccctcgcccaggcgatcaacgcgaccctcaccgacgccctcgccgcccggcccggcctgctcgtgttcggccccggcaccacccgcggcggccggcacggagtcaccgccggactccgcgaccgcggcggcgaccgggtcttcgacaccccgccggacaccaccagcgtggtcggtctcgccctcggcgccggcctggccggcctgctcccggtgcccgaactgcccggcctgggcagcctgcacagcggcgaggaccaggtgcgggtcgaggcggccaccatgtcgttcctgtcctccggcgcctaccgcaacccgctggtgctgcgcgtcccggccctcgccgacccgtacggcctgggcggcccgctggacaacgacaactccctggccgtgctccgcgacgtgcccggcctggtcgtcgccgtcccggcccgggcccaggacgccgccccgatgctgcgcacctgcctggccgccgccgacctggacggcagcgtctgcgtcttcctcgaacccgccgcgctgtatcagacgagggacctctatcagcaaggcgacaacgagtggctgtcgccctatccggggccggcccagtgggccgccgagcacgccccgatcggccgcgcccgcatctacaccctgggcacggcgcaggacctgaccatcgtcacgtacggtggcggggtgcggatgtccctgcgagtggcggcccggctggccgccgacgggtacggcacccgagtcgtcgatctacgctggctgagcccgctacccgtcgctgacctggtgcgcgagtcgctggccaccggccgggtgctgatcgtcgacgagacccgccgctccggcggcgtcggcgaaggagtgctcgccgccctggtcgacggctccttcgtcggatccgcccgccgggtggccgcggctgacgccccggttccactcggaccagccgcccagcacgtgctggtgggagaggatgccatcacacagggtgcccacgccctgctggcgcggtaa

SEQ ID NO: 1524 - DNA, 651 bp, Actinoplanes utahensis
atgatcgggttccggcgggtggcagcgctcgccccggtccgcgatgctgatttcgtgaccaccccgcaaagcctcgacgagcggttccgcgatgcggtctcggccctgcggcccccggagcacccccacgcccccggcgacccggtccgcgacggctccacgctgaccggcgcccgcgccctggaaatcttcgacgcccagctcaccagccgtcacctcgacctggccgcgcgctggctgcgcagcttcaacgagggcttccacaccgtcgcgtcgtccggccacgaggggaacgcggcggtcgccgccgcgctgcgcggcgacgatccggccctgccgcacgaccgggccgcggcgttctactgcatgcgggccgccgcgtcggcccccggcgaccggacccaccggctggaggacgccgcccgcgacatcctgcgcggcgtcgtcgcctcggtgcgcgacccgatcagcggcggccgcgacaaggtcttcggcaacgccgggctgcacctggtcccggtggtctcgacgccggcgggtcacctgccgcgcgcggtcggactggcgtacgggttgagccgctcgccggacccgcgctggccggccgacgcgatcgtggccgccaccttcggcgacgacggggctagctag

SEQ ID NO: 1525 - DNA, 405 bp, Actinoplanes utahensis
atgcgtagcgaagtgatcaccgtccggaccgggaacgccccggtggtcgtcgacatcaccgcccgggccgaggatttcgtccggccgcagggggacgggctgctgcacgtcttcgtgccgcacgcgacggccggcctggcgatcatcgagaccggcgcgggttccgacgacgacctgctgaccgcgatcgacgagctgctgccggccgaggacaggtggcggcaccggcacggctcccgcgggcacggccgtgaccatgtgctgccggcctggatcccgccgtacgccacgctgccggtggtcggcgggcggatcatgctcggcacctggcagtcgatctgcctggtggatccgaacggcgacaacccggagcgtcaggtgcgcttttccttcctggccgggtga

SEQ ID NO: 1526 - DNA, 2868 bp, Actinoplanes utahensis
atgtgtcgcgcatcgctgcgccgaccgttaggcgtgacgatgcccaccgttaagaggcaggatggagacctccgggcgatacgccaccttgatcgcaccggttccgacactcaaccaagaggattgcctgtggccacggagcgcaagcgcccggtgatcagcgatggcctgccgagccagcttccggacatcgacccttcggaaacgaacgaatggatcgagtccctcgacggagtcatcgacgagcggggcgccaaacgagcccggtacgtgatgttgcgcctgctggagcgcgctcgtgaacgacaggtgggcgttccgccactgacgtccaccgactacatcaacaccatcacgccggagcaggagccgtggttccccggtgacgagttcgtcgagcggcggatccgggcgtacgtccggtggaacgccgccatgctggtgcaccgcgcgcagcgtcccgagatcggcgtcggaggccacatctcgtcgtacgcgtccagtgccagcctgtacgaggtcggcatgaaccacttcttccgcggcaaggaccacccgggcggcggcgaccagatcttcttccagggccacgcctcccccggcatgtacgcccgggcgtatctggagggccggctcaccaccgatcagctcgacggcttccgccaggagctgagccacccgggcggcggcctcccgtcgtacccgcacccgcggctgatgccgaacttctgggagttcccgaccgtcagcatgggcctcggcccgatgaacgcgatctaccaggcgcggtacaaccgctacctgcacaaccgcggcatcaaggacaccagccagcagcacgtctgggcattcctcggcgacggcgagatggacgaggtcgagtcgctcggcgcgatcggcctggcggcccgcgaggagctggacaacctcaccttcgtggtcaactgcaacctgcagcggctcgacggcccggtgcgtggcaacggcaaggtcatccaggagctggagtccttcttccgcggcgccggctggaacgtgatcaaggtggtctggggccgtgagtgggacgcgctgctggccgcggacaccgacggcgcgctggtcaacctgatgaacgtgacgccggacggcgactaccagacgtacaagggcgagtccggggcgtacgtgcgcgagcacttcttcggccgcgacccgcgcacccgcaagctggtcgagcacatgaccgacgacgaggtgtggaacctcaagcgcggcggccacgactaccgcaagctgtacgcggcgtacaaggcggccaccgagcacaccggccagccgacggtgatcctcgccaagaccatcaagggctggacgctgggctcgcacttcgaggcccgcaacgccacccaccagatgaagaagctgacgctggaggacctgaagggcttccgcgaccggctctacctcgacatcagcgacaagcagctcgaggagaacccgtacctcccgccgtattaccaccccggcgagaagtccgacgagtaccagtacatgcagcagcgccgccgtgacctgggcgggtacgtcccgtcccggcgcaccagggccaagtcgctggcgatcccggactcgaaggcgttcagcgacatcaagcggggcagcggcaagcagaaggtggccaccacgatggccttcgtccgcctgctcaaggacctgatgaaggacaaggagttcggcgcccggtgggtgccgatcatcccggacgaggcgcggaccttcgggatggactcgctcttcccgaccaagaagatctactccccgcacggtcagacgtacacctcggtggaccgggagctgttcctgtcctacaaggaggcgacgaacggccagatcctgcacgaggggatcaacgaggccggatcgaccgcgagcttcatcgcggccggcacgtcgtacgccacgcacgacgagccgatgatcccgctgtacatcttctactcgatgttcggtttccagcgcaccgccgacgagctgtgggcggcggccgaccagatggcccgcggcttcctgctcggcgccaccgccggccggaccacgctcaacggtgagggtctgcagcacgaggacgggcactcgctgctgatcgcggccaccaacccggccgtcgtggcgtacgacccggcgttcgcgttcgagatcgcgcacatcgtcgagaacggcctgcaccggatgtacggggagaagcaggagaacatcttctactacctcaccatctacaacgagccggcgatccagccggccgagccggcgaacgtcgacgccgagggcatcctcaagggcatctaccggtacgccgagggcccgtcgacgaatggtccgaaggcgcagctgctcgcctccggcaccggcatgcgctgggcgctcaaggcgcaggagctgctcgcccaggactggggcgtgagcgccgacgtgtggtcggtcacctcgtggggcgagctgcgccgggacgccatcgcggccgaggagcacaacctgatgcacccgagcgaccagccccgcaagccctacatccagcagaagctggagggcaccgagggcccgtcggtcgcggtcagcgactggatgcgggcggtgcccgacctgatcgcccgctgggtgcccaacggctacacctcgctgggcaccgacgggttcgggatgagcgacacccggcatgcgctgcgccgccacttccacgtggacggcgagtcggtggccgtcgccacgctgcgcgagctcgcgctgcgcggcaaggtgccggcgcacgtgcccggtgaggccgccaagaagtacgcgatcgacgacgtgaacgcggcgccggtcggcgagaccggcggcgacagctga

SEQ ID NO: 1527 - DNA, 1413 bp, Actinoplanes utahensis
gtgactgttcgcgtacgtttcgcaccctcacccaccggcatgttccacgtcggcggcgcccgttcggcgctgcagaactggatctacgcccagcagcacggtggtgtcttcgtgctccggatcgaggacaccgacgcggcccgcaacaagccggagtggaccgagggcatcatctcggcgctcgactggatcggcatcgagcgcggcacgtatgaagggccctactaccagtcctcgtatgccgctgaccacaccgccgcggcgacccggctgtacggcgagggcaaggcgtactactgcgactgcaagcgcgaggacgtgatcgcccgcacgggcaacacgcacaccggctacgacggcttctgccgcgaccgcgcactgggccccggcgagggccgtgcgctgcgcttccgcaccccggacgagggtgagacggtggtcgtcgacctggtccgcggcaagcccaccttcgagaacaagctgatcgaggacttcgtcatcgcccggtccgacggctcggcggtgttcctgctggcgaacgtcgtcgacgacatgagcatggggatcacccacgtgttccgggccgaggagcatctgccgaacacgccgaagcagcagctgctgtgggaggcgctcgggcgcaccccgccggtgtggggtcacgttccggtgatcgtcaacgagaagcggcagaagctctccaagcgccgtgacaaggtcgccctggagtcgtaccgcgacgagggttacctggccgccgcgatgcgcaactacctgatgctgctcggctggtcgcccaccggggaccgggagatcgtcccgtggtcggtggtcgaggaggagtaccggatcgaggacgtcaaccacgccccggcgttcttcgacgtcaagaagctccgcgcgttcaacggggagtacatccgggccctcaccccgagcgagttcacccagtgctgcgcgccgtggctgaccggcaccgagacgatcccggccccgccgtggtcgccggagaagttcgacgccgaggtgttcaccacgatcgccccgctggcgcagacccggatcgcggtgctctccgagatcgtggagaacgtcgacttcctcttcctcgacgagccggtggccgacgaggcgtcctgggcgaaggcgatgaaggacggcgcggccgacatcctggacggcgccgccgaggccttcacggctctgcccgagtggaccgcggagtccctcaaggcggccctggagcgggtgggtgaggcccgcgggctgaagctcggcaagacccaggcgccggtccgggtggcggtcaccgggcgcaccgtcggcctgccgctgttcgagtcgatcgagttgctcggccgggagcgcacgctggcccggatcaccgccgcgcgggcgcgtctttccgcctga

SEQ ID NO: 1528 - DNA, 717 bp, Actinoplanes utahensis
atggtggttcgacaagcgatgaaacgggtggccgcgggcgccggtgggctggcgatcgcggccgcggtgacgctgggcgtgacgcctggtgtggcgttcgccacaccgcgggcacaggccggcaccgccacgacggtggtcaccgggtccagcagcaagccggcgccgcagccggactcgctgctgatcaccggcgatcaggtgccgtcggagggcatcaaggtcctgcagtcggaggacccgaagctgttccgcatgatgctcagtgaggtgagctggctctcctcggccacgcccaccgccaccgagccgcagaagggcaagctcggcccgaagtacacggtcaaggtcttcatcaaggaggacgcctccgagctgtacgatctgtacccgctggccaccggcggcccgcgggcgcaccgtccgaccggcgcgccgaacggcaagaaggcggacggctggttctacggccgacagtcgatgtccgagtcgctgcgcctgagcggggtcccgctcaaggcgaagccggacgtggtcaacggcggcatcggcggcggcatcggggagaacctgaactcctccgagctcgacccggtctccggcgccggccacctgttcggccagatgcgccggctgctcctgctcaacggggcggtgctgctggtgatcctcaccggcctggcggggatggccttcgtgatccgccgccgcatctga

SEQ ID NO: 1529 - DNA, 570 bp, Actinoplanes utahensis
gtggacgacaagcgacggctgatcctggaccaggctctcgccctggtggacgagcggggcctggccgccatgtcgatgcgggcggtggccgagcgggtgggcctcacctcgatggcgctctacccctacgtgggtggcaaggacgccctgctcgacggcctggtcgacctgctgcacctggagctgggcacgacgctcggcgacgacctcgcggaaatcggctggcaggcccggctgcgcgcgctgggccgggccgtccgctcgctcgcgcacgcccacccgagcgccttcccgctgctgctgaaccgttccgcggccggcgcctcggcctcgtggctcaccgcggccctgcgcgggctgctgcacgacgcgggcgttccggccgccgaggtgccccgcctggcccggatgatctgcgcgttcctgctcggctacaccaccggggaggtcaccggcgggctgcccacggtcaccccggaccccggggcgggggagttcgacgcggacctggaggacctggtggcgctcatcgaacgtgtcgctgatcaccatgccggcgaccggcgctga

SEQ ID NO: 1530 - DNA, 1209 bp, Actinoplanes utahensis
gtggccgagagccgaattgccgaacccgcgccggaagccccggcaaacccactccagcctgcgacgttacgccggatcgagcggcacgccggagcgctggccagctccgcggtggcccggatggaggaaacgctgccgtggttccgggcgctcccggccgatcagcggtcctgggtgatgctcgtcgcccaggccggcgtgcggtcactggtcgagtggctgcggtccggggccaccgtggcggccagcacccaggagatctccgacgaggtgttcgcggccgccccgcgcgcgctggcccgggcgatcacgctgacccagaccgtgcagctgatcaaggtgaccatcgacgtggccgaggccgaggtgcccggcttcgccgcgaagggcgagggcgacctgctgctgcaggcgatcctgcggttctcccgggagatcgcgttttccgcggcccgggtctacgcgcgggccgccgagtcgcgcggcgcctgggacgcccggctgcaggcgatgctggtcgacgcgctgctgcggggcgactcgtcggacgtgctggccagtcgggcggccgcgctcggctgggtcgactcgccgccggtcgcggtcgtggtcggccgctcccccggcggcgacatcaccgcggtgctgcacgcgctgtaccgggccgcccggcgcagccggctggaggtgatcggcggcctgcacggcgaccggctggtggcggtggtcggcggggcgaccgacccggtgctgaccgccgcctcgctgcggtccggcttcggcgacggcccgatcgtggccggccccggggtgccgacgctggaacaggccaccgagtccgcccgggccgcgctcgccggattccgtgccgcgccggcctggccgggcgcacccagcccggtcgcggccgacgccctgctgcccgagcgggccctcgccggcgacctggacgcgcggcgcaagctgcgcaacgacgtgtacggcccgctctcgcgggcgggcagcggcctgctggagacgctggacgcgttcttcgccgcgggcggggtgctggagagcgcggcccgggagctctacgtacacccgaacacggtccgctaccgcctgcgccgggtcgccgaggtcaccacgctctccccgctggacgggcgggacgcgttcgcgctgcggatggcgctgagcatcgggcggctggatcctgcgacatga

SEQ ID NO: 1531 - DNA, 930 bp, Actinoplanes utahensis
gtgctcgccgtactctcccccggccagggctcccagaagcccggcttcctggccccctggctcgacctccccggcgcccgggacagcctgaccacctggtcggcgctggccggcgtcgacctcgtccacctcggcaccgaagccggcgcggaggaaatcaaggacactgcccggacccagccactgctggtcgcggccgccctgctcgccaccgcccagttgccgctggagcaggtcgcggtggtggccggtcacagcgtcggcgagctcggcgcggccgccgcggccggcgtcctgaccccggccgacgccgtcacgctggccggcgtccgcggccgggagatggccgcggcctgcgcgctcgaaccgaccgggatgtccgcggtgctcggcggcgacccggacgaggtgctggccaccatcgagaaacacgggctgcacgcggccaaccgcaacggcgccggccaggtggtcgcggccggggcgcaggaggcgctggccgagttcgcggccgcgccgccggccaaggcccgggtgatcgcgctggccgtggccggggcgttccacacgccgtacatggcgcccgcggaaaccgcgctggccgaggtcgcgagcggcacagccgtcaccgacccggcccgtacgctgttgtcgaacctggacggcacggcggtggcgagcgggcgggagatgctcgaccgcctggtccgccagatcaccgccggcgtccgctgggatctgtgcatgcgcacgctcagggatctcggcgtcaccgcggtgctcgagctgcccccggccggcaccctcgccggtctggtcaagcgggagctgaagggcgacggcgcaccggagatcgtcaccctgaacacgccggacgacctgcccgccgcgcgcgatctgatcgcccggcacgccacgccccagcactga

SEQ ID NO: 1532 - DNA, 951 bp, Actinoplanes utahensis
atgaccgcgggttcccgcatcgtcgcgatgggccactaccagccctcgcgggtggtcaccaacgacgacctgaccaagaccctggacaccaacgacgagtggatccgggaccgggtcgggatcgccgaacgccgcatcgccgacaccgagacggtcgccgacatggccggcttcgccgccgagaaggcgctggccgcctccggtctgagcgccgccgacatcgacctggtcgtggtcgcgacctgctcgtcgatcgaccgctgcccgaacgtcgccacccgggtggcgaaccggctcggcatcgcggcccccgcggcgtacgacctgaacaccgcgtgctccggcttctcgtacgcgctgggctcggccgaccacgccatccgcgccggcgccgcccgcaacgcgatcgtgatcggcgcggagaagctctccgatgtcaccgactggtcggaccgcaagaccgcggtgctgttcggggacgcggccggcgcggccgtggtgaccggggtgccggacggcgaggagccgggcgtcggcccggtgctctggggctcggcaccggacaagggcgacgtactgcggatcgagggctggcggccgtacatcgagcaggagggccagatcgtcttccgctgggcgaccaccgcgctcgccccgttcgcgatcgaggcctgccggcgcgccggggtcgacccgtccgagctggccgcgttcgtgccgcaccaggcgaacacccggatcatcgacggcatcgtgaagcggctcggcctcagcgacaccgcgatcgtcgcgaaggacctggtcgagtccggcaacacctcggcggcgagcgtgccgctggccctgtccaagctgatcgagcgccgggagatcccgtccggggcgccggtgctgctgttcggcttcggcggtggcctcacctacgccgggcaggttgttcgctgcccgtaa

SEQ ID NO: 1533 - DNA, 243 bp, Actinoplanes utahensis
atggctactcgtgaagagatcacctccggcctcgccgagatcctcgaggaggtcgccggggtgaacccggacgacgtcgccgagggcaagtcgttcaccgatgatctggacgtcgactcgctgtcgatggtcgaggtcgtggtcgcggccgaggagaagttcggcgtgaagatcccggacaacgaggtgcagaacctgaagaccgtcggcgacgccgtcagctacatcgaggcgaacgcctga

SEQ ID NO: 1534 - DNA, 1227 bp, Actinoplanes utahensis
atgagcaccgtagacgtcgtcgtcaccgggctcggcgcgacgaccccgttgggcggggacgtcgcgtccacctgggacgccatgctcgccggccgctccggggtgggtccgctcacccaggagtgggccggtcagctcccggtccgcatcggcgcccagctggccgtcgacccgtccgaggtgatcgaacgggtccggatgcgccgcctggaccgcagtgaggccatcgcgatcatcgcggccaagcaggcctgggccgactccggcctggacggctccgggctcgacccggaacgtctcgcggtcagcttcggcagcggcatcggtggcgcggtcagcctgctcgaccaggacgacatcctggagcagtccggcccgcggcgggtcagcccgcacaccgtgccgatgctcatgcccaacggccccgcggcctacgtcggcctggagctcggcgcccgcgccggcgtccgggcgatggccagcgcctgcgccaccggcgccgaggcggtcgccctgggcctcgacctgatccgggccggccgcgccgacgtggtggtggccggcagcaccgaggcggtggtgcacccgctgccgatcgccgggttcgcctcgatgcgcgccatgtcgacgcgcaacgacgacccgcagcgggcctcccgcccgtgggacaagggccgggacggcttcgtcctgggcgagggcgccggcgcgctgatcctggagcgggccgaccacgcggtggcccggggcgcgcggatctacgcccggctggccggtgccgggatcacctcggacggctacgacatcgtccagcccgacccggagtgtgccggcggcatccgggcgatgtccatggcggtccgcgacgccggtctgaccggcgccgacatcgtgcacgtcaacgcccacgcgacctcgaccccggtcggcgacatgggcgagatcaagggcatcaaggcggccctcggcacgcacccggtgatcacctcgacgaagtcgatgaccgggcacctgctgggtgcggccggcgcactggagtcgatcgccaccatcctggcgatccgcgacagcgtggtccccccgacgatcaacctggacgacccggacgaccggctggacctcgacgtggccgcgcacaaggcccgcccgctcgacatcccggccgcgatgaacaactcgttcggtttcggcgggcacaacgtggcgctgatcttcacgcgtccctga

SEQ ID NO: 1535 - DNA, 1281 bp, Actinoplanes utahensis
gtggaccgcgatccggaatcgcggctgcgcgccctcttcgaccaccacaccctgcgtccgctggccgtgccggacgactccggcgtgctgccggcgcgcggcacggtcgacggcactcccgcgatcgccttcgccaccgaccccggccggatgggcggcgcgatcggcgtccacggaagccggcgcatcgtcgaggcgatcgacctcgcggtccgcgaacgggttccggtgatcggcgtctggcactccggcggggcgcggctcgacgagggcatggtggcgctggacgcggccggtcaggtcgtcgccgccacggtccgcgccgccggccggatcccgcggatctcgctgctgctgggcccggcactgggcagcaccgcctacgtgccggcactcaccgacgtcgtgatcgccggcccggaggccgacggctcgccggccggcaaccggctgaccggcggatcggctgtcgccggtgcggcggccttcggccgggtcgcgcacgtgatcagcgacgatgacgaggccgcggtgggcgccgctcgccggaccgtccggatgctgggtcacccgggccggctgtcgccggccgacgtcaaacccggcagcacgctggggcggtccctcgactcactgctgccggccgggattcgcgggtacgacgtacgcccgctgatccgtgccctgctcgacgagcccggcctggaactgcaggagacgtgggcgcccaacgtggtcaccgctctgggccggttcgccggacgcacgatcggcgtggtggcgaccaaccccgggcatctcgatggccggctggacgaggccgccgccgacaagaccgcccgcttcgtccggatgtgcgacgcccgggcgctgcccctgctcgtggtcgtcgacaccccggggcatctgcccggcccggaactggtgatcagcggagcgcggctactgcacgccttcgccggagccgtggtaccccgggtgacgctgctcacccggcgcgcgtacggcggcgcctatctcgccctgaactcccgcgctctgggcgccaccgcggtattcgcctggcctgacaccgagctggcggtgcacgacccggtcgaggccgtgccgatccggcatcaccggcggctggccgcgacggcgcccgaggagcgcggcgcgctgcaggagcggctggcacgcgagcaggccgagaccgccgccgcgacggtggacgcggtgatcacgccggcggagacgcggcggcggatcgccgaggcattcgccgcggcaccgctctga

SEQ ID NO: 1536 - DNA, 1743 bp, Actinoplanes utahensis
atggcggtcgtgagaaagttgtcttgtgtcgcttttgtcgctccgctgctcctgctcatcggggcctgcggagacgacgccaagccaccgccggccgccccgcccaccaccgatccggtcgggtcggtgctgagcgtcccgctctccgaatcggcgtccgcgccacccggcgatccggcggtccgggcggccgccacggtggcccggctcagcgacgaggacctggccgggcaggtgctgatgccgtacgcgtacggcggatcggcgaaccgggtcgacgccggcgcggtggccggcaaccggaaactggccggcgtcgacaccccggccgagatgatcgccaaataccggctcggcggcctgatcctggtctcgttcacccagcaggacccgaccggccgaaccaaccccacctcgaacgtggagaacccgcagcaggtccgggcgctcaccgacggcctgcaggtggccgcccggcagctgcccgccgcggccccgctgatgatcggcaccgaccaggagtacggggtggtcacccggatcaccgatggcgtcacggtgctcccgtcggcgctcgcggcgggcgccgccgggcagcccgcgctgaccgaggcggcctggcacgcggccggcgaggagctggccgcgatgggcgtcacggtggacttcgccccggtcgccgacaccctcggaccggccggcagcgcggtgatcggctcccgctccttcggcaccgacccggcggcgaacgccgcccaggtcgccgccgccgtccggggcctgcagggggccggcgtcgcggccgccctcaaacacttcccggggcacgggcacaccagcggggacagccacgaggagctgccggtgatccggcagagcctggccgcctggcaggcccaggacctgccgccgttccaggccggggtgcaggccggcgccggtgtggtgatgtccggccacctcgacctgcaggcggtcgacaagggggtgccggccaccttctcccacaagatcatgaccgatgtgctacgcggccggctccagttcaccggggtggcgatcaccgacgcgatgaacatggcgccggcccgcaagtgggcgcccggcgaggcggcggtgcgggccctcaacgccggcaacgacatgctgctcatgccgccggacatcggcgccgcccgggacggcatcctggccggcctgaggagcgggacgctcccgcggcagcggctgaccgaggcggtcacccggatcctcaccctcaagttccgcaccgcggccaccgccccacccgccctcgccgcgatcggcacgccggcgcaccagcaggcggtcgccgcgctggacgccgccgcggtcaccgtgctgcgcggccggtgctccgggccgctggtaaccgggccggtcacggtcaccgcgccggcctcgcgggagaccgcccgggtgaacctggtgcacgccctgcaggacgccggggtggtcgtgcaggcggccggcggggccgagatccggctggtggggtacggcgaccagccggtcgacctgtccccggacgccgcgctgacggtgatcaccgacctgccggggctgctcgcctacgccaagtcaccgacgctgctggcgacgtactcgtcgagccggctgtcgatggtggcgctggccgcggtgatcgccgggaagacgacggcaccgggtagatcgccgatcgcggtcgccggcctgccccgcagcgcctgcgggagatag

SEQ ID NO: 1537 - DNA, 492 bp, Actinoplanes utahensis
gtgccaacgtgtggcgtcgtatacgtccactcaaccccgctcgccgtgtgccagcacgtcgaatgggccatagcgcgcgtcctgaccgcgccggtcaatctccactggaccgtgcagccggtcgaccccagcatgcgccgagccgagtgcagctggacgggacgcgccggaactggcgccgagctggctgctgccctccggcagtggccgatgatccgttttgaggtgaccgaggaaccgagtccggggctggacggggagcgcttcatgcacgtccccggccgcgggctgttccacgggacgatgggcgcctcgggggacattcaggtcggcgaggaccggctgcgtgccatcatggcgtccgcccgggctccggaggcgctggcgcatgccctggagaaggcgctcggcagcgcctgggacgccgagctggagccgttccggtacgccggcgacggcgccccggtaacccttctcacccgggtcgggtag

SEQ ID NO: 1538 - DNA, 327 bp, Actinoplanes utahensis
gtggcgagcaacacctcaaagaccgcccgcgcatcagtccgcgccggccagggcaccggtggcgccctcagcgtgctcggtgagtacaaatacctcatcccgctcgccaacggccgcttcgcgtacgttcgcaacctgaccaacggcaagacctcgcacctcaagaccgactccgacgccttcgtcgaggagatccgcgtgctgagcgcggccggccacggcgccaagatccgcgccgagctgaacgccctgcacacctccagcccggccgacggctgggacgcgaccgagaagcggctggccgacgccggcgtcttcgagggctga

SEQ ID NO: 1539 - DNA, 603 bp, Actinoplanes utahensis
atgacagcgactcttcccgccccggtcactcccgccgccgctctggacgagctcctggccggcaacaagcgtttcgtctccggcacgccgctcgccggccacgacgtggcacaggccgtcgcgctcgccggcggacagcagccgcactcgatcgtgctcggctgcatcgactcgcgggtgcccctggaggcggtcttcgaccaggcgttcggctccatcctggtggcccggtccggcgcgcacgtgctggaccgctcggtggccggttcggtggagttcagcgtcggcgcgctcggtgcctcgctggtgctggtgctcggccacaccaactgcggcgcggtgcaggccaccctggacgcggagcgctccggggatcggccggccggcgacgtcggctatctggtcagcgagatcgccgcggcgaccgagggcatcgatctggccgccccggacgccgccggcctcgtgctgcgggcccacgtgcggcgcacggtggagcggctgcggacggccgacagcctggccccggcgatcgccgagggccgggtggacgtggtcggcggcgtctacgacctggcgaccggcacggtcatcatcctgtag

SEQ ID NO: 1540 - DNA, 990 bp, Actinoplanes utahensis
atgattactacccgtgggtacgacggggccgtgagacacgcggaggtgcccatgtccgagcggatcgaggttcggctcgccgacggtgtgcggctgcacgccgaggtctccgggccggagcgggccccggtgaccgtggtgctgctgcacggctggtgcctggaccggcgcacctggcggcaccaggtggacgcgctgagcggcctgggccggcgggcgccgcgggtgatcgcctacgacacccggggacacggccgctcctcggccacccatcgccggtccgccaccctggaccagctcggtgacgatctggccgaggtgctgcgccggctggcgccccgcgggccggtggtgctggccgggcactcgatgggcggcatgaccatcatggagttcgcccaccggcacccggcggagttcgccggccgggtggccgggctgctcctggtctccaccaccgccgaggggcacacccacacccggtacgggctgcccgggagcgtggccggggtgctgcgcgtcggcgagaccctcggcgccggcgtgctggcccgttccggcgcctggcgcccgcaccgggccgtgctgcccgccctcgccccggcgctgcgctggctgctcttcggtgaccggtgcgccgacgaggacctgggcctgaccctgcgcggggtgggccgggcgtcgctgtgctcgatcggcgggttccgcgcctcggtcggcgcccagcagcggctggacacgctccacgcgttcgccggcgtgccggccgcggtgctggtcggtgaccgggaccggctgaccccgccggcctgtgccgagtcgatcgcggcggcgctgccggcggccgagttcaccgtctgcccgggcgccgggcacatgctgcccctggaacgccccgaggaggtgtcggcggcgctgctgaaagtggtccgccgggccggccgggcgacccgccggaccgccgccggtcacctcggccgcgccgcttag

SEQ ID NO: 1541 - DNA, 2145 bp, Actinoplanes utahensis
atgaaagggagaacgaccgacttgagcgacgccaccgtcctgcaacttcagatcgcggtcgagcagcagcacgtggaccgggtctacgcccggctcgccgagctgcgccgggacgcgtcccgggccgaaaaggagggctatcagctcgccggggtcggcaccttcggcgccctggtcgagcgggacgcgatggtgttccatgcggcccgccgccggcacgcgctggacaccgagtacgaggggctggtcttcggccgtctcgaccagaaggacggcgccacccactacgtgggccggatgggcatccgcgacgaggactcgaagccgctggtcgtcgactggcgggcgccggccgcggcggccttctaccgggccaccccggccgagccgctgggcgtgatccggcgccggatgatccagtccagccgggagcgggtcaccggcatcgaggacgacctgctcgatccggagtcggcaccgcccgggatgaccgtggtcggggacggcgcgctgctggccagcctggccaaggcgaccgggcgcgggatgcgcgacatcgtcgcgaccatccagcgcgagcaggacgaggcgatccgctcccccgcctccggcgtgaccatcgtgaccggcggcccgggcacgggcaagaccgcggtcgccctgcaccgcgcggcgtacctgctgtactccgaccgcagccggttcgccggcggcggcatcctggtgatcggcccgtccggcgtcttcgtcgagtacatcgcgaccgtgctgccctcgctcggcgaggacaccgccacgctgcgctccctcggctcactggtgcccggctgggacgcgacccgggtcgactccggcccggtggccgcgatcaagggctcgctgcggatgcgccgggtgctcgaacgcgcctcgcacgacgcggtcccgggcggcccggccgagctccggctgctctaccgcggcacgctgctgcggctgggcgcggccgagctggatcagatccggcgccgggtgctgcagcgcggcgcgcggcgcaacgaggtccgcggtcagggtttcgaccgggtcttcgacgcgctctgggcgcaggcacgtgagcagcgggtgaccggcctgccggagaaacgcgagttcgaggcggaactggccgaccggaccgacttccgggagttcctcaaggcgtggtggccgcgattcaccccgatgcgggtgctgcggtggctggccgatcccgcgcggctccggtcgtacgccaacaatctgctctcccgcgaggagatcgcggtgttgcagggttccttcgacggcctggccgagttcggtccgaccatcgccgacgtcgcgctgctcgacgagctggacgaattgctgggccgcccccggcagccgcagaagaagacgaagaatccgttccacgtgcgcgacggcatccaggaggtgtccaccttcgccgaccggcaggccgccgcgcgcgcccagcaggtgcagcgcgaggaggactaccgcgactacgcgcacgtggtggtcgacgagtcgcaggacgtctcgccgatgcagtggcggatgatcggccgccgcgggcagtacgcgtcctggacgatcgtcggcgacccggcgcagaccgcctgggccggcgacccggacgaactggaccggtcccgggagaaggcgctcggctcgcgcaagcgcaacagctacgcactgaccaccaactaccgcaactcgtcggagatcttcgcggtcgccgccggggtgatccgggcgatcctgcccgacctgccgctgccttcggcggtccggtccaccggcgtcgacccggtcgacgtggtcaccgcgccggccggtctgcccggcgcggtccgcgagctggccgagaaacagctggccgacgtcgacggcacgatcggcgtgatcgccccggtgccgcgccgcgacgaggtcgccggctgggtcaccggcctgccggaacgcgtgcaggtggtgaccgcgttggaggccaagggcatggagtacgacgcggtcgtgctggtcgagccgggccagatcgcgatcgaccgggccggcgtgcgcaccctgtacgtcgccctgtcccgtgccacccagcggctcaccacggtcggcacggatcccgcctggcacccctga

SEQ ID NO: 1542 - DNA, 1092 bp, Actinoplanes utahensis
gtggcgggtgcgtctcgaggagctgctgcacgaccggcccgagttggcccgcgcggtcgtggaactcaccgcacgcgcccgggaagcctgaaacgccacttctgttctttttgcgatccgccacgccggatgcgcaaaaagatgagaatgcgaatcatgagtgacggccgggtcatggtcttcgcgccggccccacagctgacggtgaccatcgagcaacaccacgacgagccggaattgcatgtgcacccgggtggccagggcatctggcagacccggatgatcacgtcgctgggtgcccaggtgacgctctgcaccgcggccggcggcgaggtcggccgggtgctggccccgctgatggcggagctgcccggggtgaccatgcgactggtcggccgcgagcacggcaccgggtggtatgtgcacgaccgccgcagcggcagccgccaggagatcgccgagcgtcccggcgtgccgctctcccgccacgagctggacgagctctacaacctcaccctggccgagggcctgcgggccggcatcgcgatcctcagcggccccgcgcacccttcggtgatcaagcccgaggtgtacgggcggctcgccgccgacctgcggtccaacggctgccgggtgatcgccgacctgtgcggccggtacctggaggaggtgctcgccgccggcctcaacgtcgtcaagatcagccatgaggagctgatcaaggacgggctggccgccgacggctccacccgcgagctgatgaacgcgctcatgaagatcaacaccgacggggccgaggcggtgctggtctcccgcgccgacgagggtgccctggccctgatcgacgacgagatctacgcggtcaccctgccccggctgaccgcggccgagcaccgcggcgccggcgactcgatgaccgccggggtggccgccaccctggcctccggcggcacgctgaccgacgcggtccgcaccggcgccgccgccggcgccctcaacgtcacccggcacggcctcggcaccgggcacgtcgacgccgtccgggtcctcaccgaacgagtccggctgaccccgatcaagaaggcatcatga

SEQ ID NO: 1543 - DNA, 852 bp, Actinoplanes utahensis
atgacgcttcgccaaccgcgcatcctgatcaccaacgacgacggcatcgaggcgcccggcatccgctggctggcccgggccgtcgcgcacgccggatacgaggccgtggtcgccgccccgctcagcgagtcgagcggcagcagcgcgtcgatgaccgcggtggtccaggacggcaagatcgtctcggagccgcgcgagctggtcgggggcaagaacatcccggcgtacggggtggccgcctcaccggcctacatcgtcctgctcgcgctgcgggaagccttcggcccggcacccgaactggtgctctccggcatcaaccggggtgccaacgcgggcgccgcggtggtccactccggcaccgtcggagccaccctgaccgcgtcccacgccgggctgcgcgggctggccgtctccctcgacgtgctcaccccggcacaggccaccgcggccagcggcggcgccgcgatcgacgccatccacaaggccgacgaggagcagcaccactgggcgagcggggccgagctcgccgtccggatgctgcccgccctgctgcacaccccgcccggcacggtgttcaatctcaacgtgcccgacctgcacgtggacgggatccgcgggctgaaacaggcggcgctggcccggttcggccaggtgcagatgagcatcgccgaagccggggacggcttcgtgcgcacggcggtccaggccgccgaggaggagctggacgcgggcaccgacctggccgcgctggccgacaacttcgcggtggtgacaccgctgcgggcgccgcacgaggacaccacgatccggatcaacgtcgacgggatccgcatccagaccccggcgatctga

SEQ ID NO: 1544 - DNA, 351 bp, Actinoplanes utahensis
gtgacgctgtcgataacgacgtcgacgctggctgacggcgccgtcgaggtgtcgccgcgcggcgagatcgacgtcgagaacgcgtacgagatccgtgaggctgtcgcggcccagctggccgacggctcaccggcccgcatcgagctcaacatgcagcacgtgaccttcatcgactccgtgggcatcagcgcgctcgtggcggccttccagctcgccggggtcggcggggtcaaggtcgtcgtcacccatccgagccggttcgcgcaccggcagctgtgggtgaccgggctgctgggtctgttcggcaacccggccccgcacgaggacgatgcggcgctctccggcgcctga

SEQ ID NO: 1545 - DNA, 411 bp, Actinoplanes utahensis
atgttcgcgacgaggaagaaccgggcggaacggaccgcgggtcaggcctgggagtacctgtcggccgccgtggcgagcgccggcgagaccgccaaggaccaggccggtgaggctcgcaaggccgcccgccagggacggaaggcggcggccggcaaggctgccaaggtgaacaagcaggggcaccgggtcgccgacgaggcgaggtcgcgggccaccgccgcggccaacgcgctggccggccgcaagccgggtcgcccgtggggcctgctcgccgcgatcggcctgctgggcctggcggccggctgggccgcagccaccaccacccgggccgcgctggagcgtgaggcggagaacgagcagctggagctggccgagacggcggtcgtggtgacgcccaccgccgacaagtag

SEQ ID NO: 1546 - DNA, 411 bp, Actinoplanes utahensis
atggccgaaccgcagttcttcccggacgccgccgccctgcgcggctggttcgaggagcaccacgaggccgcgccggaggtcttcgtcggctactggcagaagggcgccggcgagtccggtgtcagccaccgagtccggtgtcagccaccccgagacgatcgagcaggccctcaccggcgcctactcatacgagcggaccgccccggtggtgttcgacgtcacccggacccgttgatccaggccacacccgccgccggggagtggttccgggcacagtcggcggcgtatggccgctccgccacgcgccgggtgctcggcgcccggcgcgccgacacccgggagcgccgcctcgcccagctcatcgaggatgccgcggccgggcgacgggtgcctccgctggcctcccgttga

SEQ ID NO: 1547 - DNA, 1401 bp, Actinoplanes utahensis
gtgctcagtgcgggacacatcctggacaaccgctaccggttggacgagcggatcgccaccggtggcatgggtgacgtgtggcgtggcaccgacaaggtgctgggccgggtcgtcgcggtgaaggtgctgcgcaccgcgatgctggacgacccggagttcgccgcccggttctacggcgaggcccggatgatggccgcgttccggcacccgggcgtggtcgaggtctacgactacgccgaggccggtgactccggcggttcggagaccgtggcctatctggtgatggcgttcgtcgagggcgagccgctgtccgtccgggtgaagcagggcccgatcccggtggccgagacgctgtcgatcgtggcgcaggcggccgacgcgctgcacgccgcccacgaggtcggcatcgtgcaccgcgacatcaaaccgggcaacctgatcgtgaaaccgaccggcgcggtcatcctgatcgacttcggcgtcgcccggtcgaacgcgatgaccagcatgaccgggctgaacgcgatcgtcggcacagccctctacatggcccccgagcaggtggcgaaaggcaacctcacgcccggcacggatgtctacgcgctgggcgccgtggcgtaccactgcatcgccggccgccccccgttcgacggtgacaacgcgctccaggtggccctgcgccacctggaggacgagcccgacccgctgcccgaccacgtgccgttcgaggtccgggagctgatcgcccgggcgatggccaagcagccggccgaccggttcgccacggccgccgagttcgccgaggcggcctacgccgcggtcggcaccccgcaggactggaaacggctgaccggcactgcgatgatcgcgccgcgcagcccgatcccggtgagcccgccgccggcggcgcccacctacgcgatgacccgcccgcgcatgtcgccggcgccgccgccgatgccggcccccgagccggtcgcctccggctggcacacccagcggggcctgatggtcgccgtgatcgcgctgttcgtgctggccggcgggctgggcgtggcgttcgcactgagcggcaacggggagaaggcggacgcgaacaccggcggtaagaaggatcagaagccgggcatcagccagaccgtcgagcagccgttcgaccaggtgaccaacggcccgtcggcggccgagccgacccacaagccgtcggcccggcacaccaaggcaccggtgtcgagcacgtcggtctccgccccggcctcgtcggcgccggccagcgccggcccgaccagcgccccgccgtcgtcgaaaccgccggtctcctccccgccgccggatgatccgaccacgacgacgcccaccgccacgaccaccaccaccggtccggcggccggctcgcagtag

SEQ ID NO: 1548 - DNA, 858 bp, Actinoplanes utahensis
atgttgagtatcggagacttcgccggcctgggccgggtgtcggtgcggatgctgcgccactacgacgccatcggtctgctgccacccgcccgcgtcgacccgcacagcggctaccgcttctacaccgcggagcagctgttgcggctcaaccggatcctcgccctcaaggacctcggcttcagcctgcagcaggtccagtcgatgatcgaggagaaggtcgacgtcggtgagctgcgcgggatgctgcggctgcggcgcgccgagctggccgcccaactggagcgggacaacgcccgcctggccctggtcgacgcgcgtctccggatggtcgagtcggagggtcacatggacaccacggacgtcatcctgaagcaggtcccggcgttgcgtgtggcggcgttgtccgccaccgcgctgggttacgaccacccctcgtcgatcagcgagaacctgtccccgctctaccctcgcctgctgcagctgatggagcaggcgggggtcgcgatgaccggctcaccgatcgcgtactaccggcccgcgccgaccggtcccgaggacgagacgatcacggtgcacgcggcgttcccgatcggcgacgccgaggtcggcgcggccggtttcgacgtggtgacgctgccgccggtccgggtggccgccgcggtgcaccggggcccgatggcggaagcgttccgcaccggtggacggatcgccgcgtggatcgaggacaacgggttccgcccggtcccgccgggttacgcgcgggaggtctatctgcactgcccgccggagctcgccgagtggctcaccgagatgcaggtgccgttggacggcaccggaaatgcaaccgagggcaactaa

SEQ ID NO: 1549 - DNA, 633 bp, Actinoplanes utahensis
atgaccatccagacgtcgcatcacgatcacctcgtttcgccgccgtgggcgaatgagaatgccgtggaggcggcggagaccgtcgagttcgtcgtgccaccgttcgggggcaccgttccgccgtacgggtccccggagaacaagcacggcgcgctactggtccggttcccgcacgcggtgctgggtgaggcccggccggaggcgccgtcctggcgcccggtggtggcctggacgttcctcctgagcgtgctgggcgtggtgtcggccatgcggcgcgcgggtcgggccagggcgtacgggcggccgcgtgccccgtactggatcgccttcctgctcaccgcggcggccggagcggcgttctggtcggtgctggtcgccgacgtggcggtgccggcctaccggcaccacgtggaggaccgggcgaccgccgcggtgcaggccaaggtgctcggcgacggccgggtggaggcggcggtcggcaccacggtcaagtccggcggttgtgtgccggacggcgaccgtggcgccgacagcctgcgggtctacgtctgctcgttccagttgaccgacgggcggtccgcctcgatgcggatcaccgcggacatccgcggcaactggacgttcagaaagtga

SEQ ID NO: 1550 - DNA, 1806 bp, Actinoplanes utahensis
atgacgcttcccaacggcgtatcgcgtcgtggtgtgctggccgtctccgcggccgccgccgcggcgccgctggcgctcaccggtccggcccaggcccacggcaaggggcacgacccgaagccgccgaaggccccggagacgttccacctcaccgtgctcggcacctccgacctgcacggcaacgtctacaactgggactactacaaggacgcggagtacgacgacgccgcgcacaacgacgtcggcatcgccaaggccgccgcgctgatcaacaagctgcgcgccgaggcggccggcgccaccctggtgctcgacgccggcgacaccatccagggcacgccgctggccacgtactacgccaagcaggagccgatcaccgagaccggtgagcggcacccgatggccaagtcgatgaacgtgctgcactacgacgccgtcacgctgggcaaccacgagttcaactacggcctgccgctgctgaacctgtggatccgtcagctgggcttcccggccctggccgccaacgcggtgagcgccaagaccggtcggccggcgttcaccccgtacatcatcaagaaggtctcgctcggcaagcacgcgcccacgctgcgggtcggcatcctgggtctgaccaacccgggcgtggcgatctgggacaagggcaacgtcgagggcaagctgaagttcctcggcatggtggagaccgccgcgaagtgggtgccgatcatccggcaccgcggcgccgacatcgtgatcgtggtggcgcacggcggcgacagcggtacctccagctacggcccggagctgccgaacgagaacccggtgcagctgatcgcccagcaggtgccggggatcgacgcgatcctgttcgggcatgcgcacctggagatcgcgcagcggttcgtcaccaacacggcgaccggcgcgcaggtgctcacctcggagccgtccaagtggggccagcggctcaccaggatggacttcgagctggtccgcgagcacggctgctggaagatcaccagcaaggcgtcggccacgctgaacaccaacacggtcgaggccgacccgaaggtgctggccgtggtgaagagccagcacgccaagacggtcgcgtacgtcaaccagatcgtcgccgcgtcgaccgcggagctgtccgccgccacctcgcggtacgaggacaccgcgatcctggactacatcaacaaggtgcagaccgacgaggtgaccaaggcgctggccggcacgtcgtacgccaatctgccggtgctctcgatcgccgcgccgttcagccggaccgcggtgttcccgaagggcgatgtcaagatcaaggacctcgcggggctctacatctacgacaacaccctggaagcggtcgtactgaccggcgccgaggtgaaggcgtacctggagtactccgccaagttcttcaagacgctcgccgtcggtgcgccggtcgacccggcgaccatcagcgacagcacgatcccggactacaactacgacatcctctccggggtcgactacgacatcgacatcagcaagccgatcggcagccggatcacccgactgcagatcgccggcgtcgacgtcgcggccgacgcccagttcgtggtcgcggtgaacaactaccgccggtcgggcggcggcaacttcccgggcatcgtgaagacccaggtctacaacgagcagaaggagatccgccagctgctgatcgactgggcgcaggccaagggcaagatcgacccggccgacttcttcgtgaagaactggcagctggtccgcgagggcgtgccggtcactttctga

SEQ ID NO: 1551 - DNA, 1644 bp, Actinoplanes utahensis
ttgaatctcgaatctctcctgcatgatcggctcgcgcccgcgctggcggcggtcgccggccacccggtcgatccggcggtgcgggcgtcgccgcacgccgacttccagtccggggcgccgctggcgctggcccgggaactgggccgggcgccgcgggacatcgccgccgacgtcgccgcccgggccgatctggacggggtcgcgcggatcgcggtctccgggcccggcttcctcaacctgaccgtttctgacagcctgctgaccgacgcgttgcagaccgttggcgcggatgcccggctgggggttccgccggccgcggcgccggtacgggtggtggtcgactactccgggccgaacgtggccaaggagatgcacgtcggccacctgcggtcgaccatcatcggtgacgccctggcccggatgctgcagtggctggggcacgacgtggtgcgggtcaatcacctcggcgactggggcaccccgttcgggatgctggtcgagcacctggtcgaccggggcggtgcggccgatcattcgatcggtgacctgaccgctttctatcagtcggcccgggttaagttcgacaccgatgacgacttccggacgcgggcccggcggcgggtggtggcgctgcagaccggcgatccgctctcccgggacctgtggcggaccctggtggcgcagtccgagcggtacttcctggacgtctatgcccggctggggatcacgctcggtccggacgacttcgccggcgagagccggtatcagggcgatctcgacgacgtcgtggccgagctggaggtcaagggcctgctggcggagagcgacggcgcgctctgcgcgttcccggcgggcttcaccgggcgcgacggcgacccgctgccgctgatcgtgcgcaaggccgacggagggtacggctacgccgccaccgacctggccgcgatccggtaccgggccgggaagctgggcgcgcggcggatgctctacgtggtgggcgcgccgcagcggacccacttcgagatggtcttcgcggtggcgacggcggccggctggctgccggccggggtgaccgccgagcacatcgggttcggctcgatcctgggaccggacggcaagatgctcaagacccgggtcggtgacacggtgaagctcgccgccctgctcgacgaggcggagagccgggcgtccacgccggccgtcgggatcggcgcgatcaaatacgccgacctgtccggggaccggcgcggcgactacgtcctcgacttcgaccggatgctcgcgatcaccgggaacaccggtccgtacttgcagatggcgtacgcccgggtgtgttcgatcttccggaagacgaccggcacgccggggccggtggcggtgaccgagccggccgagcgggccctcgcgatggcgttgctcggcttcgcccccgccgtcaccgccgccgccgagcaggccgaacctcatcggctcgcggtctatctgcacgatctggccgcggcattctcggtcttctacgagcgctgcccggtcctgcgggcgcccgacgggctgcgggccggccggctcggtctggccgacctgaccgcgcggacgctgcgcaccggattgttcctgctgggcatcgagacgccggaagagatttga

SEQ ID NO: 1552 - DNA, 675 bp, Actinoplanes utahensis
atgcaggagagattcgagattcaaggtcaacacccgatttcttcgtacggacgaagcgggtcgaccggcgagcctctgcgcaaccggcgggatcgacccgccggaggtaggcacaagtcagcggcggccgtggagacggcggcgtcgcgagctgacggtgctgaacatgccgcgactataacccgccgcggccgccttggccgaccgggtagtgttccggcgatgagcgggacgaccggctgggaccaggacgccgccggcgtgctgcggctgccctccggccggctggtccgcggccgtggcctgcgccgggcgatgcccaccggccatcccccgcagttcggcgtctacctgctcggctccccgcctcccgagttcggctggaccacccgctggatccgctggcccgacttctggctgcccagcgaccggtccgaggcccgcgccacgctgcgggaggcgctggaccgggctgccggcgaacgcgtcgaggtcgcctgcttcggcggcgtcggccgcaccggcaccgcgctggcctgcctcgccgtcctcgacggcgtgccggccaccgaggccgtcgcctacgtccgcgcccactaccaccaccaggccgtcgagaccccctggcagcgccgcttcgtcgcccgcttcgccacggtcgcaccccggccctag

SEQ ID NO: 1553 - DNA, 408 bp, Actinoplanes utahensis
atgaccaccggtggcctgcaggcctggctggtaccggtcttcgtgaccgcggccatcgtcctgatcgtcctgatcgacgccggcgtctcctggtacacccaccgtgacaaaccgcccgccgagccggtgtccccgcccaccgccgaccgccggctgcagaccgtcggcctcggcctgctggtcctgctggcgatcgccgtcgtcgtgatggccggcctcggcccgaaccgcgccgatcagttcgccagcgtcatcgccgccctgctcggcgccgtctcggcggtcctcgccttcttctcctaccgcgacaatctggagttcctgcgagcgaaccgggaccgggaggcggccgcgaccggcacccccgacccggccccgccacagccggacggctcgtcgccggactga

SEQ ID NO: 1554 - DNA, 1239 bp, Actinoplanes utahensis
atgcctcgcacaccgggtacgccgcgatggcgtacatcgagtaatttgaatcacatgacggacctgtactcgcggcggtcgttcatcgccggggtgctcaccgccgggatgctctccaccgccgccggctacctgttcacccgccgcgtcccggtgaccctcaccctggtcaccggcaccgacgacaccggcgggcgcaccctgctgatcaagctgtggaacacgttccatccggacgtgaccgtcgaggtggtcccggtcggcaactccacacaggaccagtacgagaagttcgtcagcaccaaggcggacatctacaacctcgacatcatccacatcccgcggttctccggtagcggccggatcacgccgatcgacgcgccggacggcatcaccctgctgccgccggtgcgccgtacctgcgagatcgagggctcgacccggctctgggcggtcccgttcaacaccgacgtgggcatgctctaccgccggatcgccgcgaagggcgcccgggacctggaacccggtctggacgcggtgatcgccggcacccggctgttcaccggccagctcagcaccgagggcacgttcaccgacgaggcgttcgtggtcaacgtgctggagcaggccctcgcccaggatccgacgatcctcgacgaccggggcacggtctcgttcaacctgggccagtggcagaaggcgctcgccccgctcgccgccgcgatctacagccggcgggtcgtggtcacggccggcgagacgcagaccaacgaggcgttccagcggcagggcctgcggtacatgcggaactggccggtctacttcccggcgatcgaccgcgccgaacgggagaagcccggcaccgcggcgatccgcctcggcgcgctgccgatcggcatcctgggtggccaggccctcgcggtcgccgaggacacccgccaccgggccgaggccgaagcggtgatccagttcctgaccggcatgcccgcgcagaagttgctggccacctacggtttcgcgcccacctcggtggaggcgtacaacgacccggaactggccgccacggtcccgcacctggggaaggtccgctcagcggtggaacgggcccacccgcgcccgatgagcgccggttacgcggccttctccggcatcgtccgccagcacgtctacaactacctctacaaccggatccagctcggcgagaacttcgtccagagcatgcaggaggccctgcgatga

SEQ ID NO: 1555 - DNA, 1245 bp, Actinoplanes utahensis
ttgtcggactattactttttcctcagctacgcgcgcggcgacgactgggaatcagtcaagcagttcttcaacgatctgtccgccgaggtccgctcctacgcggggctgccgaccagccggaacgtcggttttctcgacgtggagatgcaggtcggcgaggcgtgggcgcggaccctggtcaccgcgctcggcaactgccgctcgttcgtcgccctgatcacgccgcgctacctgcagagcgagccgtgcggccgggagtggacggtcttcaccgagcggctgaccctgctcgaactcgacgtcccggtgctcgacccgccgccgctgatcccgctgctctggctgccgccaccaaaactgccgccggccatcgcggcgcggcagtacctcaaccaccggctgcccgaggcgtacgcggcgctcgggttgcgccagatcatccggctgcagcggtaccgggacgactacatcgagatggtcgcccgcctggcccagcagatcgtggcggcctacgacgtggacccggcgctgccgaagaatccggccacggtgccgttcgaggagatccccagcgccttccacaccgccgggatgacgccgccggccaccggcgggccggcccaccaggtggagttcgtgatcgccgcgccgtcccgggccgacctgagcgaccaccaccatccggacctgccgggcgtggcccgggacccgcgcttctacggcgaggcgccggagagctgggcgccgtaccggccggccctggagtcgtcgctcgccgaccgggcccgcagcgtggcgttgaaccaccggttccaggccctggtcaccgatctggacaagctgcgccggctcggccgggacgacgacgcggtccggctcgtggtgctgctggtcgacctgtgggtgaccggcctggcccggcatcgcgaggccctggcccggttcgccgccggcggccgggacaccaccgcggcggccgtgctggtgccggccggtcaggacgacgagcagaccctgacccacctgcatcagctgaaggcgacgctgagccgggtgttcggccggcggatgaacacccggatggacccgcccgagttccgcagcgagatccccagcccggcggtgttcgacgccgagctcggcggcatcctggagcgctcccgcaaccggatgttccgcaccgacccggtccaccgccgcccgcccggcccgtccgggcagcggccgattctgcgcggtccgtga

SEQ ID NO: 1556 - DNA, 3930 bp, Actinoplanes utahensis
atgaccagctcgtcccacggccgggagcccggtcaaatcgtgacgttctactccttcaaggggggcaccggccggaccatggcggtggccaacgtggcgtggatcctggccgccaacgggttgcgggtgctcgccgtcgactgggatctggagtcgcccgggctgcaccactacttccgtcccttcctggccgacaagaagctgcggcactcccgcggcgtgatcgacatgatccgtgacttcgcggccgcggcggtcgatcccaccgccgatcccgccgagccggagtggtaccgccgctacgccgacgtggagcgcgaggcggtctcgctgacctggcgtttcccgggtgccggccggatcgacatgctgccggccgggcagcagaacccggcctactccggcacggtgagcaccttcgactgggcggcgttctacgaccggctgggcggtgaggccttcctgcacgcgctgcgcgagaacatggcgcagatgtacgactacgtgctgatcgacagccggaccgggctgagcgactcggccggcatgtgcacggtcaacctgccggacacggtggtcaactgcttcaccctcaacgagcagagcatcgacggcgcggccgcggtcgccgagtcgatcgtccggctcagcacccgtcgcccggtgcggatcctgccggtcccgatgcgggtcgaggacgccgagctgttcaagctggagaccggccgggaccacgcccgccagcgcttcgagccgtacctgcggctcgacccggacgcggccacctcctactggggcgacgtcgaaatcccctacaaacccttcttcgcgtacgaggagatcctggccaccttcggcgaacgtgcccggcaggaacactccctgctctcctcgttcgaacggctcacctcgatcatcaccgccggtgcggtgaccgaactgcccccgatggaggaacgggaacgccggcgctggctggccggcttcgaacgacagaagccctcgatcaacccgaacaccgtgatcagctacgtctcggtcgaccgcacctgggccgactggatcgccggcgagctggagcagatcggccagtcggtcacgctgcaggaggtggagctgaccgacccggccgccggaccgggccacgacccgcgcccggccgcccggctgctggtcctgctctcccacgactacctgctcaccccgcagtccgcggcgctctggcagcaggccgccgaccgggacctggccgctggcgacctggtccggatccggatcgacaacagccggctgccggtctcgttcgccaggccccaggtccgcgaggtggacctgttcggcctgaccgaggagcaggcccggccggccctgctcggcgcgttcgaccagccgcacctggagccgggcgccgccggtgtccgggccggagcgcagtccggatcccggttcccggcggacactccgccggtctggaacccgccgcagcgcaacccaaccttcaccggacgcacccggctgctggaggaactgcgggaccgcctgccgatcagtgtcaccgcgaccgcgccgcaggccctctacggtctgggcggcgccgggaagacgcagatcgcgctggagttcgtgcaccggttcgcggccaactacgacatcgtctggtggattccggccgaacagcccgccctggtccgcgcctcgctggcggagctcgccgaggcgctggacctgcccaccgcgtcctccacggccgaggcggtcgacgccgtcctggacgcgctgcgccgcggcgagccgtaccggcgctggctgctcgtgctcgacaacgccgaccagccggaggagatccggcgctacctgcccgccgggcccgggcacatcctgatcaccacccgcaacgtggcctggggccggtacgtcagcgccaccgaggtgccggtcttcagccgggtggagagcgtcggcctgatccgccgcctggtgccggcgatgtccgaggcggacgccgagatgatcgccgccaaactgggcgacctgccgctggtcatcgagcaggcggccgcctggctggcggcgaccggaatgccggccggcgcctactccgcactgctcgacaccgagctcccccggatgctgcgggagaacccgccaccggggtacgagcacaccccggccggcacctggcgcctgtcgctggaacgcatccgggccgacctgcccgccgcggcccgcctgctggaggtctgcgcgttcttcgcccccgagccgatcccgatgcgcctgctgtacagcgggcggttcatcgagctcctgcagccgctcgacccgaccctgcaggacccgctgctgatcggccgcctggtccaggagatcgggcggtacgcgctggcccgcttcgacgccggccggaacaccatcgcgatgcaccgcctggtgcagaccttcatccgctccgagatgtctccggaggaccgcgagcagaccggccgggacgtacaccggatcctggcggcgaccaacccgaaggagccggacgacccggagacctggcccgactaccgcctcatccgcccgcacatggaggcgaccggggtgctcagctcaccggtggccccggtccggcaactggtcatcgacatggtccggtacctgtggcggatcggcgacctgcaggaaagccaggaactgggcgaacgtgcgctggccgcctggcgtgcggccggcggcgaggacgatctgacgacgctctggctgcgcctgcacctggccaatccgatccgctcccaggcccggctcgccgaggccctggcgatcgatgaggacgtccaccggtcgctgctgagcacggtgggaccggagcatccgtacctcgtgatgagtctcagcggacgggccgccgacctcaagggcctcggccgctacccggaatcgctcgccctcgaccgggaggcgctcgcgctggccacccggactctgggcgagaacgcggcgcgcaccatcttcgcgatgaacaacctgggcctgtcgctgcggttcaacggcgacttccgggagtcggcgaagatggcggagcggtcgtacgtgctggcccgccagctcggcgagagccgcccgtacaccctggcgatggccgccaatctcggccgcagctatcgggacctgggacagttcgccgaggcccagcgggtgctgacccgggtgctgatcaagtcgaccgaggtgcacggcgcgggccacgcgcagaccctggcgatcgtccggatcctcgccgtgaccctgcgcaagctcggcgacctggatcaggccgaggcactcacccgggacgtccggccgaaactggagcggcggctgggacgcagccacccggagaccctggcctgcctcaacgacctggccaacctgcagtccgcgctcggcgacgaccggaccgcactgctgaccgcggagaccgcgctgcgacactacgagtcgcggctcggcgtcgaccatccgtcgacactggcctgccggaacaacgtggcgatcttccagcgccggctcggcgaccacgccggcgcgcgggagatcagcgaacgggtgatcgcccggttccgcgccctgctcggcccggatcatccgtacacgctggcctgcctggtcaaccggggcaacgaactgttcgacggcggcgacctggacggcgcccgggacaacgatcaggacgtctgcgaccgcctgaccgaggcgctcggcgaggagcacccggacaccatcgccgcgcgcagcaacctggccatcacgctggcggcgcgcggcgaccaggagacggcccgcgagctcacccgtcgggtgctcgctcagtccgtgcgggtgctgggtgccgagcacccgaacaccacggcgatccgcgagggccggcgactgaactgcgacatcgacccaccgcagatgtga

SEQ ID NO: 1557 - DNA, 1164 bp, Actinoplanes utahensis
atggtggccgcggggccggtccggccattccggcaagttcttctgaaactacacagccggtgcaatttagcgtgcgactactgttatgtgtatgagcacgccgatcagtcctggcgcacccgtccccgggtgatgtcccccgaggtgatcgccgccgcggcggcccgggtggccgagcatgcgcgcgcctgggggatcgactcgctggcggtggtcctgcacggcggtgagccgctgctggccggcgccgcggcgatcgggacggtcaccggggcgatccgggaggcgctgggcagcaccgccgcggcccggttcaccgtgcagaccaacgggatcctgctcgacgagccgatgctggaggcgctgctgcgacacgacgtccgggtcggggtgagcgtcgacggcggccgggcggctcacgaccggcatcggcggtacgcgcatggtgcgggcagtcacgacgacgtcgtggccggcctggaccggctccgcggcgagcggtaccggcatctctaccgtggcctgctgtgcacgatcgacgtccgcaacgacccggtcgaggtgtacgaggcgctgctggcgctcggcccgccgaccatggatctgctgctgccgcacggcaactggacgagcccgccgccgttccgggtgcccggtgacccggccacgccgtacggcgactggctcgtggccgtcttcgaccggtggtactccgcagcgccggagaccgacatccggctgttcagctcgatcatcacgttgctgctgggcggcgcgagcggctacgaggcgaccgggctggacccggtggactacgtgacgatcgagaccgacggtgcgatcgagcagtccgacgcgctgaagaccaccgccgaccgggcggccgcgaccgggctgaacgtcttcgaccacacgctcgacgaggcgctcgcgcatcccggcgtgcgggcccggcagagcgggctggcgagcctggccgagacgtgccggcgctgcccggcggtcgcggtctgcggcggcgggcactatgcgcaccggttccgggcgcccgccgacttcgccaacccgaccgtctactgcgcggaccagcgccggctgatcgaccacatccgggatcgggttttcgccgacctgcgccgcgcattgcccgccgaggtcggctag

SEQ ID NO: 1558 - DNA, 171 bp, Actinoplanes utahensis
gtggcaatgaagccggctgtgcagcctgacgacgacccgtacgtcatcacgaacagcacgcgcaaactggtcgatcggtcgaaggtcgacagtcgggttctgctggccctcctggatcgggccgacgacccggaaccgacaacgacgtacttcaccaacttcgtcagttga

SEQ ID NO: 1559 - DNA, 3996 bp, Actinoplanes utahensis
atggcggacgtacgttcccgcgggaaaccgtgcggtccggcgcaacgtgcacacgaactggcggtgatcatggagttctcgggccggcacggacagatcatcacgttctactcgttcaagggcggcgtcggccggaccatgtcgctggccaacgtcgcctggatcctggccagcaccggacgccgcgtgctcaccgtggactgggatctggagtcgcccggcctgcaccggtactactcgcccttcctgcccgaccgcgatctgcgccagtcacccggggtgatcgacgcggtcgtccggttcgaggagcgggccggcgaggcgcaggcgaacggggaggagctcgggcccggggagatccgccggctggcccggatccaggagtacgcgacctccctggagcggtacgaattcccgcgcggcggctcgatcgacttcgtcccgtccggccggcagacccccgagtactcgcacgtggtcagcaacttcgactgggagacgttctacacccggctcaacggcgagcggttcctcttcgacctggccgacgacatgcgcgccaactacgacgtggtgctgatcgacagccgcaccgggttgagcgacaacgccggcatctgcaccgtgaccctgcccgacacggtggtcaactgcttcgcctacaacaaccagagcatcgagggcgccgtcgcggtggcgaacacgatccgccggctgcgccccgacgacatccggatctttccggtcccgagccgggtcgaggacggcgaggcggccaagctgaaccgccgccgggcgctggcccagcaacagttccgcgagttcgtggcggcgctcgggcacgccgaccccggcaagtactggggtcaggtggaacaaccttacaaacccttctacgcgtacgaggagaccctcgccaccttcggcgaccggccgtatcaggagaacgacctgctcgccgcgtacgaacggctggccggcgagctcgtcggcgagcgctgcaagctggacgagatctccgaggcgatccggctcggctggctggcggagttcgagcagcgcggcacgatcaacccggggccggcgctgatctgctacaccccgcgggaccggatctgggccgagtggatcgcctatcagctgcgcctggccggccagcgcagcgtgctgcaggacgtcaacgccgcggtggacgcgaccgaggtgttggcccgctcggactgcgcgatcgtcctgctctcccaggagtcggtccgggtgccccagctggagacctggtggcggctgaccgtccggcgcgacatcccggggcacggccggttcctcgtcccggtccgggtggacggcttccgcccgcccgagccgttcgccgaccgggagccggtcgacatgttcaacgtgccggaacgcgcggcgcgggactcgctgctggcccggctcgacctgcgggacaccgggtccgggcacatcggcggcctcgccggcgggcccaccccccggttcccgttcgagccggcccgggtctggcgcgcgccggcccgcaacccgggcttcaccggccgggacgccaccctggaggcgttgcgcgagcagctcaacgccagcaacgcgcagaccggcccggtggtgctgcagggcatcggcggcgtcggcaagacgcagatcgccgtcgagtacgtgcaccggttcaacgccgactacgacatcgtgtggtggatctccgccgaccagccggcgctggtcgtcaccgccctggccgacctggcccgggagctcggcctgccgatcgccggctccggccgggccgacgaggaggtggccgccgtgctggaggcgctgcgggtgggcaacccgtcggcgaactggatcgtcatcttcgacaacaccgaggacccggagcagatccggcggttcctgccgaccgggtcgggcgacgtggtggtcaccacgcccgggcaggagtggtcgcgcaccgcctggacgctggacatcaacgtcttcgaccgctcggagagccgggccctgctgacccggcgggtggccggtctctccgacgcgcaggccgacgagatcgccgccaagctgggtgacctgccgctcgccgtggaacaggcagccacctggctggccaccaccggcatgtccgccgaacggtacctcgcgctgctcgacgagcagctgccgcgcatcctcaacgagccgccgccgcccggttaccggcacccggccgccgagacctggcggctgtcccaggggcgtctgcagcaggcgaacccggccgccgcgttcctggtggagctgctggccgtgatggcgcccgagccgatccccaccacgctgctggacagcccgggcatggccgacgcgctggcgagatacgacccgatcttccgtgaccaactgatgcgcaactcgttggtgcgggaagtgagccggttcgggttggcccgggtggattcggcggttcacgcgcttcgcatgcaccgcctggtgcagagtgtgattatcagcgacctcgccgttgaagagcagaggcgcaggcgggagcagatacacgtgatcctggcgaaggctcagcgcggcgaacctgacgaccaggccagctggccgacgtaccagggcatcctgacccacctggagccttccggcgcgctcgactccgacgacgccgaggtgcaccagctcgccgtcgacatggtgcggtatctgcggtaccgcggtgacctggccggtggccgccggctcgccgagcgggccatcgggatctggcaggaccggctcggcgccgaccacctctccctgctgcggatgcgcagcgaactcggcaacatcctggaggcgcacggcgagtaccgcgcggcgttggacatccagcaggacaccgcggaccggatgatcgcccagcgcggccacacgtacccgcatgcgctgatcgcgctcagtggcgtggccgcggcgtacgtcgggctcgggcagtaccagcaggcggtcgacctcgccgagcaggtgctgctgcactggcagaccacggtcggcgacagccaccgccggaccgtcatcgcgcgcaacaactacgcgttcttcctgatgctcgccggcgacttcgcccggtcccgggagatcagcgagcaggccgtggtggcctccgaggacgtgctcggcccgtccgcccggtggaccctgctgatccgccgcaacctgggccggtgcctgcgggccgacggtgacctgggccggtccgagaacgtgctgcgggaaaccctggccgggtgtcagaacgcgctcgacgaggccgacgagtacaccctgctgacccgcaaggagctcgccgtcacgctgcgccgcctcggtcacctggccgaggcccgggagctggccgagcgggccgtggcggggttcggcgcgacggtcggcgccgagcatccgcacacgctcgcctgccggctggaggtggcgaacatcagggcggcccagtccgagcacgccgaggcgcgggccgaggcggccgaggtgctggccggctactcccggatccggggggagagccacccggccacgctgaccgtcgccaacaccttcggggtcctggaatgcctggacggcgaggtggcggacgcccgcacccggctggagcagacgttcaccgcgttggaggccaccctgcccgagtcccatccgtacgtctggatcggccggatgaacctggcgagcgccctgttccaggccggtgaggtgcaggccgctcgggaagcggacacggtcagcctggcccggttgcgcgagcgactgcacagccggagtcatccggcgatcctgaccgccggcgtcaacctggtggcgagccggctggccgccggtgaccggaccggcggtgaggcacagcgcgaggaggtgctccggatcgccggggagctgttcgacgagaaacacccgctgatggtggcgctgcgctccggcgggcgggccttcttcgacctggagccgctgagcacctga

SEQ ID NO: 1560 - DNA, 1173 bp, Actinoplanes utahensis
atgctgtatttctttctgagctacgcgtctgacgaggacgacatcttcgtccgccggctctaccgcgatctgtccgccgagatcgcccgccggatcggcgcggagcctcagcaggtcatcggatatctggacgacagcggcaacggcagatggccggccgacgcccggtccgcgctcggcacctgccagaccttcatcgccctgtgctcgtcgcgctacctggccagcgaccgctgcgggcggtactggggcaccttcgtcgaccggatccgcaaggacgactcggcggccgcctccggcgcgctgatcccggtgctgtggtcggccgacggcgtttccggcgacgtcttccacgagccggggctcgacgtccagccccatcggacgccgcacggcgacgacctgcgggtgatgatgcgcctgcgctcgcaccgcgccgggtacgccgcgttcgtggcctcgctcgcgcaccgggtggtcgagacggcgcacgcgcaccggttgcccgacggcccggccggcgtcgacctggacgccgcggtgaacccgttcgacgagcgccgccaccggccgggcgccggcccgccgtcgaccaaggtgtacgtggtggtcgcggccggcacccgcgagcagatgcgggcggtccgcgacgacctgcgcttctacggccggcgccgggaggactggtcgccctatcagccgatgaccccgcagtcgctggcggcccgggcctgcggggtggtctccgatcgccgcctgcagtccgaggtggtaccgatcgagtcggtgcccgagcggctgcgcaaggggctgcagcgcgacatcctggtgcttctcgtcgacgcctgggccacccgggtggaggatctgcaccgggcgctgcgggagatcggcgagcgggacgacgaggcggtggcggtgctcgtcccggccagcccgggcgacggggagacctcggcccggcgcggcgagctccgcggcgaggtgctgcgcagcttccccggccgggcgtcctggcacgactcgctgttccgggtcggcgtcgactcacccgacgagttcgacgccgacctggcgacggcgatcgccgcggcgcagcgccgggcgtaccggcgcgagcggccgggcgggtcacgccccgggccgcgccggccggtactggaggggccgtga

SEQ ID NO: 1561 - DNA, 1179 bp, Actinoplanes utahensis
gtgagccgacccgcgggcttcgcaccagcgccggtgcgccaggtcctgctcaagattcacagccggtgcaacctggcgtgtgactactgctacgtctatcagcatgtggaccagagctggcgggaccgcccgcgggtgatgtcgcgggccgacatcgacctggcggtggcccggatcgccgagcacgccggcaagcacgacctgccctatctcgccgtcatcctgcacggcggtgagccgctgctggccgggcccgacgtgatcgactacatcgtccgggcggtgcgcggcgcgatcaccagccacaccaaggtcgcgttcggggtgcagaccaacgggctgctgctcgacgacgcgtatctggagctgttcgccacccaccggatccgggtcggggtgagcctggacggcccggcgacggccaacgaccggcaccgccgcttcccgaacggccggggcagtcacgccggggtggccagggccctgcgccggctcaacgaggcgcggcaccgccccctgttcggcggcatcctgtgcacggtggacgtgacgaacgatccgctcgacgtctaccaccacctgctcgcgttcgacccgccggagctggacttcctgcttccgcacgggaactgggaccgcccgccgccggagcgcggcccggatccgggccgcaccccgtacgccgactggctgattccgatcttcgaccggtggtacgagtcgccggccccgcagacccgggtccggctgttcgagtcgctggtctcgctgctgctcggcgggccgggcgggatcgaggggctcggtctcggccgggtcgacctggtcaccgtcgagaccgacggcaccctggagcagggcgacgcgctgaagacggccgcgccgggcgcgccggccaccggcctgcacgtgcgctggcactccttcgacgattacctggagcatccgggggcgcgggcccgacagtccggtgtggacgggctgagcgccacctgccggcggtgcccgctggtggaggtgtgcggcggcgggctgtacgcccatcgatacagctcgctgaccgggttcgacaacccgtcggtgtactgcgccgatctcgccacgctgatccggcacgcggccgatcggctggccaccgatctcccgccggccgccggaggcccgggtgtccggagttga

SEQ ID NO: 1562 - DNA, 180 bp, Actinoplanes utahensis
atggcacgtgagagtgagacttcgatcgccctgctacgttcggccgcgccggatcaggcgcgactggccctgctgctgcggcggcgcccggcgttgcggcactcgctggacgagtcgcggcacgcgggcgtcttcgggaacttcatcgggggccactgctccgatgaggcgccccggtag

SEQ ID NO: 1563 - DNA, 834 bp, Actinoplanes utahensis
atggacttcgcggatcgtggctcgctggccgaggacctgcgcgggctggggctgcgcgcgggcgagagcgtgctcctgcactcctcgctgaggtcggtgggctgggtctgcggcggcgcggtcaccgtcgtgcaggccttcctcgacgtgctgggtcccgccggcacgctcgtgacgccggcgttcgccagcgagaaccgcgacccggcgcgctgggccggtccggagatcccggcggcctggtggccgcggatcagggaaaccatgcctgcgtacgacgcgcagcgcacgccgtgccgggcgctcggcatcgtggccgagaccctgcgctgctggccgggcgccgtgcgcagcccgcacccgcagacctcgttcgcggcggtcggcgcccgggccgcggccctgatgcgccggcacgacctggtcagcgaactgggggaggagtcgccgctggccgcgctggaggcggccggtgcccgggtggtgctgctcggtgtcggcttcgaccgctgcacggcgttccacctggcggagtaccgcctgccctggcgcaccccacgggacaacgcctgcgtgatgagcaccccggccggccgcgcctgggtgccgtatcgcggcgtgctgctcgacgccggcgacttcgcggccctgggtgccgacttcgagcggaccggcgcggtgaccaccggtccggccggtgccgcggtggcccggctgttcccgctgccggccgcggtggccttcgcccgggactggctggccgcgcaccgcgtgccgccggccggaccgccggagccgggcgactctgtacgtagtcggcgacactgtacgtag

SEQ ID NO: 1564 - DNA, 1257 bp, Actinoplanes utahensis
atgtgtgctgcctgcggccagaccgcgcatgtgcccgacacaccccgccggttcgccgcgctgcgcaacccggactgccggccgtacctgttcggcgccgcgctggcgatgatggcggacaacatcgagcacgtcatcacctactgggtgctgtgggagaagttccactcgtcggcgctggccggcttccaggtgatcagccactgggtgccgttcctgttcctgtcggtctggttcggctcgctcgccgaccggtacgactgccgccgggtgatccaggtcgcgcagacgttgttcatgctggtctcggcggcctggggggtgctcttcctgaccggcacgctgcaggtctggcacgcctgcgtgctgctggtgctgcacggggtggccggcgccctgtggggtccgggcgaacagctgatgctgcacgacttcgtcggcgacgacgaactgcccagcgcggtgcggctgaacgccaccttccgcagcctcggggtgctgttcgggccggcggtcggctcggcgctgctgctggggctcggcccgacctgggggatcttcgccaacatcgcgttctacctgccgctcaccctgttcctgttccgcacccggttcaccgggcacagccgggacggcggggtgccggccggccggaaacgggtcgggatcatggactcggtgcgggtgctgcgtcacgtgcgggccgaccgcaccctggtcagcatgatcatcctgggcgggctgggttcgttcttcgtcggcgcgtccctgcagtccgcgatgccgctgttcgcgcaggacctgggcagcggcagcgccggcacggcgtacggcgtcctgctcttcgccaacggcgccggcggcgtgctgggcggcctcgtgctggagacgaccggatggatccggcccaccgtgttcgccgcggttctcagcaccggcctgtacgggctgttcaccttctgcttcgcgatcaccccgaactacccgctggcggtcgtcctgctcgtggccggcggggtggcgaacctggcgtcgatgtcggtcgggcagaccgtcgtgcagctgatggcgccgcccgccgaccgcggccgggtgatcggcgtgtacggcatgtccgccaacggcctgcggttcggcagcggcatcacggtcgggctgttcggcgcggtggtcggcatccactggtcgctggggctcagtgcggcgaccctgtgcgtgggcacgctgatcgcggctagttacgcgcggcgaacgtga

SEQ ID NO: 1565 - DNA, 873 bp, Actinoplanes utahensis
gtgaacgggggacacgtgcagcgccgctggcatctggttgttctggcagtgctcggggttttggcgcttgcctgtgaggggggtgccggctccgatcccgcgccgaagcccaccgccaccaggaagccccggcccggcggcggcccggcgtcgatggccgcgctcggtgactcgatcaccgccggggtcggcagctgtgtcacctacctggcctgttcgcacaattcctggtcgaccggggacaacgacggtgtggacagccactaccggcggatcctggcgaagaatccggggatcaagggcaacgagcacaatttcgccgagccgggcgccgaggcggatgcgctggtcacgcaggcgcggcgggcggtcgacgcgaaggcgcagtacgtcacgatcctgatcggggcgaacgacgcctgcgccgggtcggtggcggacatgacaccggtcgccacgttccgcaacgaggtggaccgggggctggccgagctgaagaagggtctgccgagggcggatctgctgatggtcagcatcccggatctgtaccggctgtggcaggtcggccgcaacgacgacgacgcggtccgggtctggcggaccgggggcgtctgcccgtcgatgctggccgatccgacctcgacggcgtccgccgacgagcggcggcgccgggcggtgcgggatcggatcgacgcgtacgacgaggtgctgcaccgctcgtgcgccgggtacggcagccgctgccgatgggacggcggccgggtgcacggtctgcggttcagcctggacctggtgaacaggttcgactatttccacccgaacctgaaggggcagaacgaactggccgacgtcacgttcgccgcgcgtaactag

SEQ ID NO: 1566 - DNA, 1338 bp, Actinoplanes utahensis
gtggatctcgatgagatgaccaccgagcttggccggctcaaaccgcgacgaccgtcagcgcatcttgcgattactctcatttgggccgcccagcgcgccgaccgggatgagcctaggcagagtcggtggtctgacgctcggtcgactctccaagacgccgtcgccaaggtgagcggccacgccgcggctgatcaggccgcgtccccagtcgttgccttgcggggctcgccactgtggtccatggatgtcgatgccggcgctccgcccctggccaaccgcgatgctgccggctggctcgaccgagctgatccgctagtcgggctatctccggcggcttactcaacgctgcgtggtggcggctttgaggagttcgcgctcgccgcggtgggcaagcttgacaccggcacggcccattccgtgctcagctatttcaacgtcgaacgactgccgttccagggattcggcgacgtccccggcattgatgtgggcgccaccttcaaggaccgcgccgacctcttcgcccatcgggtgcaccgggagctccaagccggtatcgccggttccgccagcagaggcgcggagtccatcgtcctctccggtggatacaccgaccgcgacttcggcgacgtcatcatttacaccggtcatggcggccgggacccgagaaccaaaaggcagattgccgaccaagatccgaaggcccgagggaatgccgcgctgatcgtcagtcacctcaccaacgctcccgtgcgggtcattcgtggtgctcaccgcggcagcccacacgcgccggccgtcggtctccggtatgacggcctcttcctggtcgaaagcttttggcaagagccggacgacaacggattccgcctctgccgataccggctggttggctttcgcccctccgccgtcgtcgcgacggctgaaacccacaccacaccgtcgacgcccctgccgtccggatcgacgaatcccggtcgcagggcgacgacatcggaacggatcatccgcaatgtagcgctcgccaacgccaccaaagcactgcacaaccacacctgccaggtgtgcgatacccgcctgctgattcagggccgggggtatgcggagggtgcgcacatccgaccgctgggcgaaccccataacggcaacgacacgcccgacaacatgctgtgcctttgccctaactgccacgtcctattcgacaacggagccatcaccatcgacgccgacctgaccatccggtcggaccagccacaccgcgggatattacgccgcgctgagggacacgacatcaaccccgcgttcttggcctaccaccgggagatctaccccggcaactag

SEQ ID NO: 1567 - DNA, 816 bp, Actinoplanes utahensis
gtgtggaaggacggcacgatcgcacggcggacaaccctgccggctaccgacgccgagatcgtcgacatgacccgggacggcaccggcgtcgccaccggctatctgcagaaccatcaggcttccttcgggtacgccgacggccgcttcacccggttgcgcggcagcggcgtgggagcgatcgcgatcaacgaggccggggtgatcgtcggagggaggggcgggtctcccgggggagtgccggttcgctgggcgtcggcgtccgcggcgccggtccggctgccactgccggccggggcgaccgagggctcggcgagcaacatcgccgaggacggcaccatcctcggctcggtcggcagggccgggaagtcggccaccgcgtatctctggtttcccggcggcaccggccgctacctgccactgtccaccgtcgacggcggccgcagggcgacctccttcgcgccctcagcgatcagcaacggctgggtgaccggcaacgcggtcgtcgagaccgagcagtcgacggcctccaccccgatgcggtaccggatcaccaccggtgagttccaaaggctgccggccgatctctggagcgccgagaagatcgccgcggacggctgggtggccgccgagggactggacctgtcggtaacgggggatgccggccggcgctcatcggcgccggccggcgtcggcggtgatcgcccggatctcggccaggccggtggcgccggcggtggccgccgtgacggtaagccgcacgctgcgcaccctcttcgccgggaaccgcacggtcagcggggcgccgccggccggtag

SEQ ID NO: 1568 - DNA, 123 bp, Actinoplanes utahensis
gtgaccgctccggcctcggcggccaccaccccgcagcagctcggcggcctcgacatcggcgcctactgccgttcgatcggctacaccgcgccggcgggtagcgggcggggtgtttcgctttag

SEQ ID NO: 1569 - DNA, 1329 bp, Actinoplanes utahensis
atgaccgatctttcggagtacaccggccggatggccgcgatcgaccggtcgcaggcggtgatcgagttcggggtggacggcaacgtcctgaccgcgaacgcgaacttcctggccgccaccggctacacactcgccgagatcaccggacggcatcaccggatcttctgcgatccgcagtacgccgggtcggacgcgtacgcggccttctggcagcggctcgctgcgggcgagttcgaggccggcgagtaccggaggttcggccgggacgggcgggagttgtggctgcaggccacctacaacccgattctggacgagcagggccgggcgtacaaggtggtcaagttcgccatcgacgtcaccgcggccaagctgcgcaacaccgagttcgccgcgaaggtggacgcgctgaaccggtcgaacgcggtgatcgagttcgacctggacgggacggtgctgcaggcgaacgagaacttcctgcggaccatggggtacacgctgcgggagatcgtcgggagtcaccacagccggttctgcaccgaggactaccggcgttccgacgagtaccgggacttctggctgcggctgggcaagggcgagttcatcagcgggcgcttcgagcgggtcggcaactacgggcgccaggtctggatccgggcgacgtacaacccgatcatggacgtggacggcaagccgatccgggtggtcaagtacgcgtccgacatcaccgcccaggtggagcgggaacagcggatcgacgcgctgatcgccgggacggccgaggtgaccacgtcggtgcagagtctgtccgagtcgatcgcggagatcgccggcacctcgcagaccgcggccgagctggcggcgcggacacagaccgcggcgaccggtggcgcgcaggcgctgcaggcgtcgatggaggcgatcggcctgatcgagaagtcgtcgaaggcgatcgccgacgaggtgcgggtgatgagcgagatcgccaaccagacgaacctgctggcgttcaacgcctcgatcgaggcggcccgggccggcgaacacggcatcggcttcgcggtggtcgccgacgaggtgcgcaagctggccgagcggtccttcgaggcggcccagcacgtcgggcggctggtcgaggaggcggcggaacgggtgcacgagggttcccgggtgtcggccgaggcgggcgcggcgttccagcacatcgtggacagcgtggagcggacccacgaggcgatcggcagcatctccggctcgacccgggtgcagcaggccgccgcgcaggaggtcgaccgtctcgtctcccggctggtcgccgaacatgcccgctga

SEQ ID NO: 1570 - DNA, 1332 bp, Actinoplanes utahensis
atgcccgctgaccggatcacctacggcgccgcccggctcggcccgctcaccctggcgttgccgctgaccgccctgcacgaggcggtcgcctgcccgccggcgctggatccggcgccgttcccgggcggcggcgtggccggttcgctgaacctgcgcggcctggtgctgccggtactcgatctgcgcccgcacctcggggtcggcgatgccgccccggacgagcaggtggtcctggtcgtcgccgacggcgagcaccggttcgggctgctggccgacggtgtgctgggcatgctgcgccccgagccgggtgcggtgcggccggtgacgaccggcgccgggccgtccctggtgtcgcacctgttcaccgaacccgccggggcggggccggtcgcggtgctggacaccgcggcggtgcgccgacttccggggctgcccgcggtgcaggtgcgggacacgcagaccgcggccaccgccggtggggcgacacggaccgtcgtcgtggtccgctgcggcgagctgaccctgggtgtggacacctccctggtgcacacgatcacgccgggtacggcggccggcagattcctgtcgtacgacggccgtaagctgcccgtgctcgacccgctcccgctgttcggcacggaccgccccggcccggccaccgtgaccgcgcacctggtgctgcgggtcgccggcggccacgtcgccctgccggtcaccgcgctcgtcgggctgcaccggctggccgaggccgacgtgctcgccgtgcccgccgtcgtcctcccccgccccggcctgatcgccggcctggtcgagactccggcggccggccggttcctggtgctcgatccggccgccgtcgacgccgatccggatctgggcgcactggcggcggccagccggctgggcgcccgcccggagtcccgggcggtggccgcgcgggccggcgggtcattcctgacctacgccgccggcggcgacttcgccaccccgctcgaccagatcaccgagatcatcccgatgcccgccggagtcggcggcgacggcccggtgctcggcatgatccagcaccggcgggccgccatcccgctggtctgcctggccggtctgctgggccggcggccggagccggtcaacccgtgcgtgctcgtcgcccaggtcgacggtgtcccggtcggcttccggatcgaccggctcggctcgatcgacacggcggagtgggcgggccgggccggcggtgcgggccgggtgatccgggcggtggccgccgcccggatgatcagcgagctggatctccacgagaccggccgccgggtcttgtgtggacggccctga

SEQ ID NO: 1571 - DNA, 1269 bp, Actinoplanes utahensis
atggcgtaccgtcaattgcccgccctgaccgcgaccgtgaccctgactctgaccttgaccagcgccttcgtgccgtcggcggcgcaggccgcgccccgcggcccgaacgccgtggtgacctggaacctcaacgcgcagaacgagatctacgaggtggcgaagcagtcgccggccaccgcggcgcgcagcttcgcgatggtgcagggcgccgtctacgacgccgtgaacgcggtgtccggcgtgcccttcgagccgtacctgaccgcgccgcgcgcgcaccgcggctatgcggtcgacgccgccgtggccgcggccgcctccggggtgctcacctcgctcttcccggatcaggccgacactgttcaggcgcagtacgacgcggcactggccgcgatcccggacggctgggccgagaacggcggcgtccgggtcggccggcaggccgccgacgcgatgatcaaggcgcgggccggggacggcgccttcgacacctcggacagttaccacgtcggcaccgcgcccggccagtggcggccgaccccgccgaccaacgtccaggacggcgcctggttcgccgacctgaagccgttcgtgctgccggacgccgcgatgttccgcaccgccggtccgcccgcgctgaccggggccacctatgccaaggacctgaacgaggtcaaggcgatcggcggggtgaccagcacggtccgcaccgccgaccagacgcggtcggcgatctggtggcacgaccgccggctcaccgagtgggacatgaaacgccagctcgcgatcacccggcacctgagcccgttgcagaccgcgcggatgttcgcgatggtcgacatcaccaacgtggacgcgctgatcgcctgctacaacgagaagaagtactggaacttctggcgcccgatcaccgcggtccgcgaggcggacaacgacggcaacccggacaccaccggcgatccgagttggacgccgctgctggtcaccccgccgttcccggactacacctccgggcacacctgctcgttctccgcgatcaccctgacctggcagcgcttcttcggccgcgacgacctgccgatcagcgcgtacagcgcggactccggcaccacccgcgccttcccgagcttctcgtcggcgctggccgaggtgatcgaggcgcggatctggggcggcgtgcacttccgcagcgccgacgaacagggggtgcggatcggcacgagcaccgcgcgctacgtgctggcccgcgagttccgaccgcgccgctga

SEQ ID NO: 1572 - DNA, 588 bp, Actinoplanes utahensis
atgttgaccgtgtcgatcctcgcggggtgttccagggtcgacgtcccggacatcaacagtccgctgtcgtcacccggtgtgaccctaccgccgtcgctgttcccgtcggtggattcgcgacgatcggtgcctccggccactcatcactggaaaaccgatggtctcgcctgtccctcagtgaccaggccggcggccgtcgcggccggaatcgccggagtgggaaaggtggtcgacgccgatcacctcagcgccctcggcgacaccatcagctgccagtggggaccagccgacggtactgccccgtcggcgatcatgaacctgaccacgaccactcagcaggcagcggccgacagggtttgggcgatcggcgacagcacgctgaagcagccgctcaacggggtaggtgagcaggcgttcatgtcggaggacgtcggcttcgacgagacgcgaatcgccgtacggtccggcaatgccaccgtccgcatccagctgctcgcgaagcggaacgacgccgggagccggaaggcgttgcggggggcggcggcggacatcgcgaacgacctgctcacctgtctggtgccggcgtga

SEQ ID NO: 1573 - DNA, 828 bp, Actinoplanes utahensis
atgactgaaccggatggatcgttcgccccggcgctcctcggcaccttccaggacgcggtcgacctgctggagaaacaggtcagtggcattcgcaccgcctgggacgagttcactcgcacggccgaggagtttctcgcggcgattcgcgcgaaactccaggacgatcactggtggaacaggatcgcggaatggttcaccgacgacatcgccgacacgctcgaggcgatcgaggccggaatcgagtcggctcgggtgaaactcgatgacatcctcggcaggatggatgcagcgctcagcggcacaccaccgattctttcgctgttccggtccggcatcgactggtccaccacgatcaatacacgactcagcgcgatccagccggacgtcgagcagtccggcagcatcgacgtgtggcacggcccggcgcacgacacctaccggactcgggagaccgagcagggagaggctgtcgggcttgcgtccgcgcaggtgaaaagcctcagcgtgtggcttgccgacgtggcggaagcgaacacacacttcgtcaccgaactggtggatcaggccacaaccatcgtggaggagttggtcacggtgaccttggacatcggcactgccatcggagcggaggacccgctcagtgctcaggaggccgtcaacaatctggacgagatgatggggaagtacgccgccgccatcatcgactttctcaccagcctggccaatcgattcaccgaggtgatccgtctggtcaccgaggtcgcggccgagcacagcgacaacagcgcgtttccgggaggcaactggccgaaggcggtggacctgtga

SEQ ID NO: 1574 - DNA, 804 bp, Actinoplanes utahensis
gtggcatgtagtcaaggtcttcgatttctaaactttcttgtccaggttctccggggacacggcctgaacctggtcgccgacggcggcgtactccctgatgcgcacatcgatgcgcgttgtgcgacgcccgaatccctcgcccgtgaggtggcggcaaccatgagccagtccgacgactaccggctgcgtgacgcccgcaggttcgttcagaacctggaggacgcgctggcccgcaccccgcacggccggcccgtcccgggcctggccgcgatcgagggcaccgacccgaccggcacggtccactgccgggtcgggctccgcggcgatcttcgggtggcgatcgtcgacggctggtggcattccgtcggtcccgaccgcatcgcggacgcggttctggaggcgtaccgcttcgcgtgcgagaaggccggcttcgctcggctggtcctgcgccaccacggacgcgccgggcgagcgaagtccccgccggtggatcctggccggcgatgctcctatccgagcgggcacgcggaccaccaggatctggccgaactccggcgacgcctcgaacaggcgtcgatcggcctcgaccgggccgcccggttgtcggaactgctcagcggacgcacgtcccgggaggtcaccggaccgcgccgcctgttcaccgtggtgatgcgaggtgccgtcatccaaggcgcccgggtcgctgtccacggtttgcgtcgcgccgatggcgccgtgctcgccgccgacgcccaggacgcgctgctcacctcgcgactcggcatcacacctggggagaggtaa

SEQ ID NO: 1575 - DNA, 2475 bp, Actinoplanes utahensis
gtgaagaaacagatcctcaccctggcggccgcggccgtcgcccttctgacagtgaccgcgacgacggcgacacccgccgcggtggccgccggcgaacccacctggcatgccggcatcccgccgctggccactccgtggaccggccaggtcggcccggacaacgccctgcccgactacccccgcccgcagctgacccgggcccggtggcagagcctgaacggcgtctggcagttcgccggcgcgaccgtggggcaggccgtgccgaccgggcagaatctcggcgagcgcgtgctggtgccctacccgatcgagtcggcgctctccgggatccagcggcacgaggaccggatgtggtatcgacggacgttcaccgtcccggacggctgggacgtgggcggcgggaatcggctgaagctgaatttcggcgcggtcgactacgacgccaaggtcttcgtcaacggcaggcaggtcgccacgcaccggggcggctacgacaagttcgacgtggacgtcaccgacgcgctgaccgggtccggtgagcaggagctgatcgtctgggccgaggatctcaccgacgccaccgggcagccgatcggcaagcagcgccgcaccggcgatcacggcatcttctaccagggcagttccggcatctggcagacggtgtggatggagccggtgcccaccgacagcatcaccgggctgcgcttcacgcccgaccccgaggccggcgtgctgcgtctcaccgtggacgtcgcgggacgccagaatctacaggtcaaggccgtggcgcgaggcagcggcgcggtggccggaaagatccagggcggttccggtacggagttggccctcccggtcaccgcggcgcacctgtggtcgcccgacgacccgtacctctatgacctggatgtctccctgatcgacggcaggacgaccgtggaccgggtcggctcctacgtcgggatgcgggcggtcggcaccgcgaagggtgcggacgggcggctgcggatcacgctgaacaaccggatcctgttcaccatggccaacctcgaccagggtttctggccggacggcctgtacaccgccccgaccgacgcggcgctgaagtgggatctcaagaaggacaaggagatgggcttcaacgcggtccgcaagcacatcaaagtggagccggatcgctggtactactgggcggacaagctgggcctgatggtgtggcaggacatgccggccgcgaacaccgggccgatcccgccggagtggcgcgggcagttcgaggccgagctgcacgagatggtccgcgagcatcagagctggacgtcgatcgtcgcctggatcccgttcaacgagggctggggcgagtgggaccgggcggccaccggccggatcgccgacgacgtcaaggcccaggacccgtcccggctggtgaacgcgcacagcggggtgaactgctgcaactcgcacggcgactccggccgcggcgacgtgatcgactaccaccagtacctgggtccggcctcgccgcggccgaccgcggaccgggtggcgatcgacggcgagcacggcggtttcgggctgaaggtgtccaaccacatgtggttcggcgacggcaacgcctaccagatgaccccggacaaggccacgctgaccgcccgctacgtgcagaaccagcaggacgtgctgacctcggcgcagcggtgcgggatcagcgcggcgatctacacccagctctccgatgtggagggggagctcaacggcttcttcacctacgaccgccgggtcaccaagatggatctcgcccaggtcaaggcgatcaaccagaagatcatcgcgggagcggacggcaccacggccggcatcccgcagccggatccgggcaccccggggctgtccgggatcgcgttctggccgctcgacgggtcgtacggcgatctgacgccggtcaacgctccggccttcgccgacggccacaccggccagggcgtcgcgttcaacggcggcaaacagtacctggacgccggccgcccggtgctgaacaccgcctcggactactcggtcgccgcctgggtcaggctcgacaaggcggacggcgcgttccagaccgtgatcagccaggacggccccgccaacagcgacttcttcctgcagtactccggcgccgaccaacgcttcgcgatgagtttcgccggggtgcgcgcgctggctcccatcagacccgaggccggccgctggtaccacctgaccggcgtgcgggacacggtcaaaggccaattgcggttgtacgtcgacggcgagctcgccgggacggccgacgcgtgcctgccgcagggggccccgaccggcaacaccgtgatcggccgcggcaagttcggcggcaacccggtcgactacctggacggcacggccgaccaggtgcacctgtacgaccgggcgctgtccgccgacgagatcaggcagttgtacgcctccggccggtaa

SEQ ID NO: 1576 - DNA, 693 bp, Actinoplanes utahensis
atggttttccggctgccggtccgggcagaatcgcggcggagccagcggaagggcaccccaccgatgacgaccccgtatctcgtcccctgtctggtgacgttgcggtctgagttcaaccggctgtcgccgagacgcgacaaggacagcgacggctggatcggcgacgccgcgcacagctcgcgggtctccgaccacaacccggaccgcgccggccgggtcctcgcgctcgacatcgactcgaccggaccgtggccacagccgttcggtgacctggtcgagacgctgcgcggcgactcccggctggaatacatcatctggaaccggcggatcgcctcgcgggcccggggctggacctggcgggcctacgccggcagcgccgatccgcacaccggccacgcgcacttcagcgcgcggcacgaccacgccggcaacaactcgaccgcaccatggccgctggaggacgtcgtgacgcccgatgacatcgagaagatcgccaacgcggtctacctgaagctcaaaccgcagctggaccaggcggtgtcggcctgggacgacacgttcggccgcggagacgccgccaccacggccgggctgatcctggtcgagacccggaacaacacccgggccctgctgtcccggctgcccgaggagaacgggagcggcaccgggacgccggcggccggcgcggtgtga

SEQ ID NO: 1577 - DNA, 1494 bp, Actinoplanes utahensis
gtgcaggttgacgacacatcgacgggagcgtttattgttagccaccttttcaatcccggcccgacccccatcccggcaagggagatccccgccatgcccctgaaacgcacccctctgctcgccgtcggcaccgccgcgctcgtcgccggcaccctcggcgtactcggcatcaccgatgcttcggcggccagcgccggcacgctggcgagcgcactgaacggcaaatgtctggacgtgaccgacggctccaccgccaacggcaccctgccccagctctgggactgcgtcgccggcagcgccaaccagctctggaccctcgccgacaacggctcggtgcagggcaggggcaagtgcctcgacgtcgcgaacaacgccaccaccgacggcgccgcggtccacctgtgggactgcttcgactcggtgaccagccagaagtggacactgaacgcggccggcgacctggtcaacaaggcgtccggcaagtgcctggacgtcagggacaggaacaccgcgaacggcgccaagctgcagctctggacgtgcaccggcacgtcgaaccagaaatggaccttcggtggcggcagcgttcccaccaccccgccggcgaccggcgggccgggagcgaaagccgtcgcgccgtactactacaccggctggggcaacccgccgagcctgagcgcggtcaccgcggccaccggcgtcaggtggttcaccatggcgttcatgctgaacagcggcacctgcgacccgaagtgggacggctcccgcccgctcaccggcggccaggaccagaccgcgatcaccacgatccgcgccgacgggggcgatgtgatcgtgtcgttcggcggcgccagcggaccgtggctggagcactactgcggcagcgcgtcggcgctggccgcggcctaccagaaggtgatcgacgcgtacggcctgaaagcgatcgacatcgacatcgagggcaccccgtacgacagcgccaccgaccagcagaagacggtcgacgccctgaagacgatcaaggccaacaacccgggcatcaccacctacatcacgctgggcagcggcaccggcggcccggacgactcgctgatcaagcgcgccgccgcggccggcctggtcgtcgacggctggggcatcatgaccttcgactggggcaacaccggcggcaaccagggccagctgaccatccaggcggccgacgggctgaagaacaagctgaagagtgcgtacgggtggtcggacgccgaggcgtaccaccatgtcggcatctcgtcgatgaacggcatcaccgacgagcacgccacggtgaccctggccgacatgcagacgatcacggcgtacgcccagcagcacaccatcgcccgcctgacgttctggtccctgaaccgggaccgccagtgccccggcgcctaccccaacgacgacacgtgcagcggcgtcgcgcagtccgcctaccagttcaccaagatcatcggcgcctaccgcggctag

SEQ ID NO: 1578 - DNA, 462 bp, Actinoplanes utahensis
atgggtgttctgttcgactatttccgggcgcccgaggtggaggaggtgcggcggaagctcgacgagaacgagggttactcgccggtcccggagttcttcgacggggtgatgctgaagaccatcgaccccggcgtgatcctggcgcagatgatcgcgatggcggcggaccgggagtggagcgccgacctggtcagcgaacgtctcatctggccgatgagcgccgaccgcgacctcgagtatcaagggccctgggtgacgggcatcggtgatccggcgcgggacgcgctggccggcatcgaggccggccgggcgccggaactggccgagcggtgggccggcatcgaggagttcttcggtgacgtcgacacggagtacctggccgaagtgatcatcgagctgggggagctcgccgcgcgggcccgggcgcacggcgagtccctctactgctggtccagcctctag

SEQ ID NO: 1579 - DNA, 615 bp, Actinoplanes utahensis
atgatggctcgggtcgatcggagagacgtcatgagttacgagcacctgccacccgctgaggggaatctggagaccttcggcctggccactcgccgggtgatccggttcagcgtgggttacctgctggtctcggccctgacgacggtgctggtcctggccggggtggcggccctgcgcagcggcgccgccgacccgctctccgtgggcacccaggcgaccttcgcgatcaccaacctgatcctcggctcggcgacgctgatctgcctcatcggcctgctgatctccacgatcgtctgggcggtgagcgccgaccgggtggcacccggcggtcccggcgcccccggttacggcggcctgaccctcgccgtcctgctgatcgcgctgagcgaactgctgaccgcgccggccctgctgctgggtgctctccagctggccgcctgggccgcgctgctcgccggcgtgctgatcacccgcacccggctccgccgccacaccggcgacgtcagcctgggcggccgtcgcaaaccggtcgtgaccagcgacgactgggacgcctcccggtgggacccggaggtcgcgcacgacatcgagcggcgcggccgccccaccggctga

SEQ ID NO: 1580 - DNA, 1338 bp, Actinoplanes utahensis
gtggaggacgacacgcacgcgagtatcgctccgtcggtgcggcggctcaggcagcgcgcgatcggcgaccggctgcgggagagtctgctcttcctgccgatgctgctgctggccgccggcatcctcgccgagaccgcggcgcgggagatcgaccggagccgggagccggcggggctggggctgttcgccatgagctcggacgcggcggtcactctgctgtccaccatcgcgggcgccaccatcaccaccgccggagtggtgttctccctgctcgtggtgtcgctgcagctggccagtggtcagttctcgccgcgggtgctgcgcaccttctggcgggatcggatcggtcaggtgctgatcggtctgctgctggcgacgttcgccttctgtgtgctcgcgctggggcacatcgacagccaggaccaggcgccgcgactgaccatgaccctggcggtcgggctctccctggcctcggtgctggccatcgtcgtcttcctcaaccggatcacccggcagcagtacgtgggccggatcatggaacgaatccagcacgaggccatcgaactgatcgatgatctgccgtacgggtcccggatgggcatccaggtcggtgcgccgatcgccgccccgcgggccggtgaacccggcgacgccctggcggtcaggtccccggctgacggctgggtgcagcagatcagccacccggcgatcctggccgcggtgccgccgggcagcacggtccgcctggagacccgggtcggcgcgtacctgatccgcgacgagccgctggtgcggatctggccacgcccggcgaaggcgcaagcgcaccggatcgcccagctcatcgccgaagcggtcgtcatcggcgccacccggaccatgcagcaggacatcgacttcgcgctgcgccagctcaacgacatcggattgcgcgcgttgtcgccggcggtcaacgacccgaccaccgcggtcgagtcgatcctgcgggtgtcgtccgtcatgcgtccgctcctgcaggctgacctgccggcccaggcgcaccgggacgaccggggccggagcctgctgacgccgtgggacctggaccatgccgagtacgttcggcacgcgtacggccagatccgcctcttcgccggtggtcatccccaggtggccttgaccctgatccgggtgctgcgcatgctgcgagacgtcgtcgccgcccgcgaggaccgtgccgcgacgctcgtcgagatcgaccgtcagctggacgcggtcatcgacgacgctcgccgcgcgggtctgccggattcggagctggcgccgattcgtgagtctgcccggcgacgccaggagtga

SEQ ID NO: 1581 - DNA, 363 bp, Actinoplanes utahensis
gtgcggatcggcgacctggcagaacggacgcgcgtgagtgtgcgggccctgaggtattacgaggagcagggactgctggcctcgacgcgcagcggcagcgggcagcgcctctatgcggacgcggcggtcaaccgcgtacgcctgattcagcagttgtacggtgcgggcctgtccagcaggacgatcgcggagttgctgccgtgtgtcgacgccaaggtgagcacgcccgagtcgcgggcgcgcctggtggcggagcgggaccggatcaacgcgcagatcgccgagctgaccctcgcccgggaccggctcgaggacatcatcgaggtgacgtcgggtccgaacccggcgtgcgactaccgctag

SEQ ID NO: 1582 - DNA, 711 bp, Actinoplanes utahensis
atgcagatcaacggcacaaaagccctggtgaccggcgccaaccgcggactcggcaaggcgttcgccgaggccctcctcgcccgcggcgcgaccaccgtctacgccaccgcgcgccgcccggacagcatcgacatccccggcgtcgtcccactccaactggacgtcaccgacccggcgtccatcgccgccgcggcggccggagtcggcgacctcgacattctgatcaacaacgccggcatctccaccgacgcgccgctgctcggcccttccacggacaacatccgccgtgagttcgacaccaacttctggggcaccctcaacgtcacccgagccttcgccccccggttggccggcggcgcgatcctcaccgtcatctcggcgctgagctggtacgcgttcgccccgtccagcaacggctacgcggcctcgaaggcggcggagtggtcgctcaccaacggcatccggctggagctggccggccagaagacccaggtgaccgcgctggccctggcgatcgccgacaccgacatgatggccgggtacgacatcccgaagctcccgccgcacgaggtgatcgccaaggcgctggacggcctggaggcgggcgcgctcgaggtcatcgccgacactccgaccgccaacgtcaaggcgtccctgtcccgcgatcccgccctgttctacgccgacatccccggcgccctcttcggctga

SEQ ID NO: 1583 - DNA, 258 bp, Actinoplanes utahensis
atgggtgtgcgtcgatcaaaccaccgcgggcgacgcggcacccgcccggccgaccaggacgtccggcaccgcatcggtgttcagatcagtgaggtggcccccgatcgggtcgccgtcgccgtcctggacgcatgccagtcggactgccgaggagagttcgcctactccggcgcgacgtattacctggtgccggtgcggctccacaagccgctgggcgcccgtctcgtggacgacaccaacggccttccggtgttctga

SEQ ID NO: 1584 - DNA, 294 bp, Actinoplanes utahensis
ttgccgcaggctggcgttcatcgacgaacagaccccttcgaggatttccgcgccggcgacttcgatgtacaggcggcgagcgctgctccgacggcgatgaacggtgcggcgggttggccgatgatgatcgtcgtgaatccgatggcgctgacgataccgtccttggccaccgtgatgaagctcggccgcccggctcggggccgttcggtttggcggttgtcgataccgtcgtcggccatggacgggcttctcctgatggcgatcccgctcgccgcggtgctgctgtgggggtga

SEQ ID NO: 1585 - DNA, 402 bp, Actinoplanes utahensis
atggcgataacgctgggaatccacgcgctggccgacgtcgctctggtgtggctgggatcgctggtgtggaacgcgtaccggcagggcaccctcgccgccaccgaagcggcatccgtctccatcctcgcggtcagcgccggcgtcggagccgtcatcaccgtcgtcttgcagatcgggctgctgcggggaaccaacggccgccacctcgtgcaggccgccatggccctcaacctggcaaggctgctgggcctgctgctcgctctcatgatcaccgcggcacggctcggcatcaccgcccttgccggaatgatggagacgttcgccgccgtgatcgcggtggcagaggccctcggcgcgctctacgtgacgaccgtagtgagccgccgtaccagtgatgggtga

SEQ ID NO: 1586 - DNA, 111 bp, Actinoplanes utahensis
gtgatgggtgaacggattgccgtcgcggcaggcctgctctgcctggtgatgatcgccctcgtcaccgtggtgacggtggcccagcggcgcggcgcccgccgagagccatga

SEQ ID NO: 1587 - DNA, 258 bp, Actinoplanes utahensis
gtgacttcagcgatcagtgccagcgaggctcgcaagtccctctttccgctcatcgaacgagtcaacctggaccacactccgatcgaaatcgtctccaagcgcggcaacgccgtcctggtgagcaaggaggactgggactcgatcatggaaaccaactacctgcttcgatcccccgccaacgccaagcgcctcactgagagcgtcgagcaatggcgagcgggacgagccacggagcgcgagttcggccccgaggagtga

SEQ ID NO: 1588 - DNA, 306 bp, Actinoplanes utahensis
atggcgagcgggacgagccacggagcgcgagttcggccccgaggagtgaaactcagctggaccgaccacgcctgggacgactacctgtaccggcagactcaggaccgcagaaccctcaaacgcatcaacgccctgatcgccgacatcaaacgtgatcccgacggtcagggcatcggcaaaccggagatcctccgaaacaacctcgcgggactccggtcccggcgcatcgacgacgaacaccgcatggtgtacgccgtcgagaccaacgagatcaccatcatctcctgccgataccatcacgaatag

SEQ ID NO: 1589 - DNA, 738 bp, Actinoplanes utahensis
atgtcgatggttgatgccgcgctgctacgacgggctggtgacctcaagggcgagctggtggcgttctctcaacagccccgctacgaccgggctatgtcgagttttctggccgagtacggcaacggcttggaaagcgccgatgaacagcggtggatgctgctctgggacggtttcaccctggagcaccggctggcggacggccagacggtggtggagcagttcgtcgaggcccggccggacctgccggaggtcgaacgggagatggtgctcgggctcgacggctactacacgtactgccgtgactcggttctcgggccggacccgaaggtcagcccctctatggtgtcgatgtcgttgccgccggatctgaccggtgcggagacggttgcgctgatttacgacgagacggacggactcggcttctacgccgagttcggcctcgtggaggaagcgttcgtgaaccccgacgtgctgcgacgtcgccggtggcgcgagcggacgctgtcctatctcgaggacgacagcgtggagccgatggtcctgcgtcggctggctgctcggcatccggagaaggcgagtgtcgtgttccgtcggctgctgaaacgaccacgcttcgactgggtccgggacggtgaggcgttgatgcgcgagttcaagccgctctatttccatcggctgccgcgcccgcgggtgagcccgctcagcgagcgcttggcagaattcgccagacgccgctga

SEQ ID NO: 1590 - DNA, 1230 bp, Actinoplanes utahensis
atgcccaagagtcgtggtcgtcctgcgggacggggtaagccgaggcgtccgcagcgcccggttagtgagttgcggttgtcggaccggttgatgcgtgacgctatgtcgatcgtgtctgaggacagtgtgcttaaggtcgagcggtgggccagtgggtggctcggtgcggcgtggtcggcggcggggctcggtgagcgtgacccggagaaggtgttgtacctggaggtggtggggcgggcgtcgacccggccgtcgctgtacgggctggccgcggtggcggcgctgcgtcgtgtcgccgccccgggcgagtggccgatgctggacgacaccctggagatcttgtcggagagccagccggtgccggactggttcgcgatccccggcttcgagccggttcgggcgtggcgggcggtggatgtctgggacagcgagcacgtgctgttcgtcgagttcgccgggcagacgccgcacacggtgatggcacagatctccctacccggcggtgtgctggtcgacaagctcgcggtgctgcagcccggggctgcggaggcctgggaccggctgcgtgagcccggtgaggtgccgatgccggccgtcgagtgcccggtggaggttgcgctggcggagctggccgatgcgttgcggaccacggacatgacctggccccgtcacgatgacgaggagttcctcgacttgcgggcgctggcctggtcgcgatgccggtcgtatctgccggatttccgtgactggcagccgatgagcgatgaggaacggcaacgactgctggacgggttcgcgccggccgatgacacggtcgccaggtcgctggcggacctgttcctggactacggcgacggctacatgaccagcggcccattgtgctggagcccgggacaggtcggcttgtttctggccgattggctgccgcgcaaggcggcgctggacgccgagcagcgtgcggcgctgccggacgtgttgcggcgctgggtccggtacgccctggaacgccgtgcggtcgacctggagtggatcggtcccgtggtggaggcggtcgacacgttccttccctcgttcgaggaggcgttcgacgacacggcggcgtgggggccggccaagcagatcgccgcggagttgacggcgcgtggtgtcgacttcaccgactcggaagccgtcgaggacgcgatgcggggcctcaacgccgagcgcctcgctcgatatctgatcgactga

SEQ ID NO: 1591 - DNA, 2154 bp, Actinoplanes utahensis
gtgcccgctggaggatctgcgatcggtcgtgccttacgtgagcgtgagcatgcggcagagctcatgcgtcggtaccggcgagcccaggcggtcgcagctcgatacgcggcggcggccataggggagcagcaagtagcggccgccctgatcgtgttgactggagctggctggactctactggtggaccgacgttggcccggcagtgcagtagccaatgtcgacatgattctggtggggcctggcggcgtcttcgtcattgacgtcaagaactggagaagcccgccgacggccctcgacggccggctccacgccggctcggacgatcgtcaccaagagatcatcaaactccgtgcgatcacgagcagggtgcacgacgagctagcagtcctcgacatggcgccggccgtggtggcttctgtcatggtgttcgcgaaccaatccgtcgaacagcgtgtcggtacggttttcctccgcggcgtcaaggagatcgcgccgtggttggcggccctgccgcgccgcctcaccacaccgcaggtcggccgagtggccgttcacctcgctggcaagtttcccgcgtacgacatacccgacatcgttgagcggccggttcaggtcgaccgcagtgaccccccgcaaaaggcaccgtcgctcttcgacgtggatgcgatcgctcgcgcggagcaacagtccgtgctggcccgcccgatcgaaagttggatgacgtatctgcatcccgaccagctcgccatcgtcagacgccggtggaacggtccggctcggatcagcggcgcggctggtacgggcaagaccgtcgtaggtctacaccgggccgtctggcttgcccagcgtacggtaggcaaaatcctctatgtcacattcgtgaagaaccttccccgggtccaggcgcagctcctggcgcgcctttccccggcggtcgtcgacagggtcgagttttgcagcctgcacggttgggcgaggtcgctgcttgaccagcgtggagtgcacctacgagtggatctggcggcgaccggcaattgcttctcccgcgcatggctgcatgtcgggaggagcagcgttctggcggagctcgaacctaacccgatgtactggcaggacgagatcacctacgtcatcaaggggcgaggcttcactgagctggggcagtaccttacggctacccggcccgggcgccggactgcgctgcgacgcgttcaccgcgaggccgcctggcagctctacctggagtacgaacgtctgcgtgccgagcggggagtgcacgacttcaccgatgtgctcaccgaggccatcgccgtcttgcgtgacccagccgctcggccgcggtacgccgccgtcatcgctgacgaggtacaggatttgactctcgtcggagtgagcctgctgcatcagctcgtcggtgatgcgccgaacggcctgctgctcatcggtgatggccagcaagccgtctaccctggcggctttcgtctcagcgacgccggcatcgacatccgtggcggacgtgccgaagtcctgaaggtcaactaccgaaatgccgcggacattcttacggcggcgctacagacccttgatgggcagcccttcgacgacatagacgggacagttgtcaccaccggccctgccgtggagaccacctaccacgacggtcgagtgatccgcgtcgacgcggccactgctgacgagcacgaccaagccttcctcgccgccgtgagggagctggccggagattcatccgacgatacgcggcttggggacgcggcagtgctctgcgcccggaagaaggacgtcatccactaccagcgcctgctgacccgcgccggcatcccgaacagcaacctcgaggactacgacgggcaggccaccggcgagttgaaggtgggaacctttctccggtccaagggactcgagttcaagcacgtcttcctgccgcatcacgaccgcgaggtaaggaaagcgcagacgagcagcctcaccgagaccgaccgcctggcgctggtgaagcgacagctcttcgtcggcatgacccgcgcacgtgacatgctgtggatcggcgctgtcccggatgcgaagctgccgcgacccagaaccgggcacgattcggcggctgtaccgggctctcctccgctcggctcgcggtga

SEQ ID NO: 1592 - DNA, 174 bp, Actinoplanes utahensis
atgagcgacttcaacccggagaacttcgccgaattcaccactcaggacggcccggaatccccgggcgtcggggaagacaatctgcccgccatcgctgaccttcagccgccggacatggtctccgacccccgataccaaatcgttttgttgccacagacgctggtggagcgatag

SEQ ID NO: 1593 - DNA, 1263 bp, Actinoplanes utahensis
atgtcgcagccggtcgaggtggacgtcgtcatcgtcggcggcgggctcgccgggctgtccgccgcccgccgactcgaccgcgccggcgtcgaatggctgctcatcgaaggatccgaccggctcggcgggcgggtcgccaccgaaaacgtcgacggctggcggatggaccgcggatttcaggtcctcaacaccgcgtacccccggctctccgccctcgtcgacatcgacgccctggaaatgcggtacttcaccgccggcgtcctggtccggcgtggtggcaccctgcaccgcctcgaaaacccgctccgcgaaccgctggccaccccgcagaccctgctgtccggcgtcggctctctcaccgaccggctcaaattcgccgccctcgccacccgatgcgccaccacgcccgccgccaagctgctcgaagcgccggagaccaccacccaggagatgctccgcaaagccggcctctcccaccgcatcatcgaagaggtgctgcggccgttcttctccggcgtcttcgccgaccggtccctcgacacgtccagccacgtcaccgcgatggtgctgcgctccttcacccgcggccggatcggggtgccggccgccggcatggccgcgctgcccgccgccgtcgccggtcccctgcccttcccgcaactgctgatcggcgcccgcaccctcagcatcggccccggtctggtcgtcaccgaaggcggcgaaatccgctgccgcgccgtgatcgtcgccaccgacccgctcagcgccgccgacctgctcccgcagctgccccggcccgacatgcacgggctgaccaccttctacttcggcgcgtccctggcacccatcgacgaaccgatcctgctcctcgacggcgagcgccgggagatcgtcgccaacaccgtcgtgatcagcaacgccgccccggaatacgcccccggcggccacagcctgatcgccgcctccgtcgtcggcgtctccgccccctccagcgcctccgaggctgtcatccgcgtcgaactggcccgcatgtacggcacctccaccgacgactgggacctcctcaacgtgatcagcatcccgaacgcactccccgccgcccgggtgccccagaacaccctccgcaagtcggtagccctcggtgacggcctgttcgtcgccggcgaccaccgtgacagcccatccatccaaggtgcgatggccggcggctggcgcaccgccggccaagtcctggcgtcactcggcgtgcaggtcggggtctag

SEQ ID NO: 1594 - DNA, 324 bp, Actinoplanes utahensis
atgcgcggaaagctgatgttcctcaccggtctcgcggcgggcttcgtcctgggcagccgggccggccgcgagaagtacgaggagatccgggcgaacgcccagaaggtctgggagcacccgacggtccaggaggccgccggtgtggcgcaggcccaggcgaacaagctctacaccgagggcaaggacaagctgcagtcgtccaagctcggtgagaagctcggcgccaccagccagagcagcacgtccggcaccacgagcacggacgagctgctcgccccgtcggactcgctctccggcaccaaggggtcgggcagcacgtactga

SEQ ID NO: 1595 - DNA, 1038 bp, Actinoplanes utahensis
atgcggcttcgacatccttccggccggaccgtgcacctcatcgccggggtcgacctgaccggcgcgcgaacggcggccgacgccttcgccatgatcgatgcggtcgccgcccgcctgcgatccggccggaccgccgatcctcgactcgccgttgccggtgtgaccgacaatgccgaccgggctgccgtcggctggaccggtcgggctgccggcctgaccgagaatgccgatctgtcccggacggatgccgtcatcggcggcgatgctgatcccgcgcaccaccggctcgggatcgcgctgcgcctgccctacccgcttgccgccgccctcgtcgacgacgggcgcgcccgcacccggctgcgtgccgacctcgatgcccgcgggctcgacgtcgtcacggtgaacggcgggcccgaggccgaggtcggcggcctgcccccgctgcccgactggagcgagaccgcccggctgcagcacaccctggacctggcccggatcctggtcgacctgctgcccgccgacgaggtgcgcggcgcggtcggcacctgcggcctggcccaccgggacggctgggacgaggcccgcgagatggcggtgagccggcacctgcggcggctctccggccgtctcgccgacctggcctggcgggtcgggcgggcggtgcgggtcggtttcgagccgggccccggctgggtgctcgacaccccggaggagacggtggccgggctggcccgggtcgacaaggaccggctcggcatctgcctggacctggcccgggcggcccgggagtggcccgacccggcggccggcgtcgatcggctcaccgacgccggcctgtcggtgatcaccgtccggatcaccgatccgcgggccgcgtggcagccgatcctgcgccacctgctcgcggcggacaccgcacgcacggagtatgtcgaggtggagggatccggcgcggcggccgcggatctgacgtacaccatgggggaactgaccgccctcggtctggtgccggagcacgagccctgccccacgtcctga

SEQ ID NO: 1596 - DNA, 1320 bp, Actinoplanes utahensis
atgagactccagaatcgcccgcacgggcgccacgatcccgaagacgacaagcagtccggcagcgtggccgccgtgcccgccgcctccggcagccacggacggccggaccccggagacggggaaggctcagccgtccagcggaccgacggttcgggcgccgaccacgcgaccgcggccggatctgcggacgcgtcggacgccggccggaccggggccgagcacgcggccgcttcggatgccggccgcggcgacgacgccggccaggcacggcggcgtggggccgaggacttcgacctggcggcggcgagcacgaccgacgtgggtcgtacgcccgacccgaaagacctgtcggcgccgggtccggatgccggcccggaccgtccgtcgcagctgcacgcccgggggatcttcgccgcggtgcggcggaccttcaagcagttctccgaggacaacgtgtccgactgggcggccgcgctgacctactacggcgtcctgtccatcttcccgggcgcgctggtgatcgtctcgctgctggggttgctcggcgacgccggccagcggaccgtcaccgacgcggtcacccagatcaccccgaactcgcagctgcgcgacctggtcaacacggtgctcgaccaggtgcagggcaccggcaacgccgggctggccgcgatcctcggtctggtcgccgcgttctggtcggcgtccggctacatcgccgcgttcatgcgggcgtcgaacgcgatctacgacgtgccggagggccggccgatctggaagaccctgccgatccgggtcggtgtcaccgcgatcgtcggcaccatgctgatcgcctccgccgccatcgtcgtgttcaccggcgacctggcccgcatcgtcggcgagaagctgcacctcggcggggtcgccgtgaccacctggaacatcgccaaatggccggtgctggtgatcctggtcagcctgatgttcgccatcctctactgggcttcgccgaacgccaagaccggcggtttccgctggatcagcccgggcggcatcttcgccgtcctgctgtgggtggccgcgtccgccggcttcgcgatctacctggcgaacttcgccaactacaacaagacgtacggcaccctgggcggcgtcgtcgccttcctggtctggctctggatctccaacatggcgatcatgctcggcgccgaactggacgccgaactcgaacgcggccgcgccatcgccgccggccaccccgccgacgaggagccgttcctggagttgcgcgacacccgcgccctgaagaagggctccgaacacggcctgagccagggctga

SEQ ID NO: 1597 - DNA, 810 bp, Actinoplanes utahensis
atgctgacgatgctgctgccgcggctcgtgtcgttcgagggcagcgccggccggtcggtgcgggtcaccgagcgcaacgtcaacgcgctgaaatcggcgtactgggtggtgatggccggcggcctgctggagccgctgctctacctgttctccatcggcgtcggggtcggcgcgctgatcggcgacatcgccctgcccgacggccggctggtcagctatccggcgttcgtcgccccggccatgctggcctcctcggcgatgagcggtgcgctgtccgagaccaccttcaacttcttcggcaagatgaaatacatgcggctgtacgacgggattctcgccaccccgatccggcccttcgagatcgccatcggcgagctgatctgggcgatggcccgcggcaccctgtactccctggccttcctgatcatcatggtcgcgatggacctgaccaccccgctgcgcgccctggccgccttccccgccgcgatcctggtcggcttcgcgttcggcgccctcggcatgtccgtcgccaccctgatccgcagctggcaggacttcgacctgatcgccgccggccagttcgccctgttcctgttctccggcaccttcgtccccgccggctcctacccgccggtcctccgctggctcgtcgaaatctccccgctgtcccgcgccgtcgacctgatccgcgggatcacgctcggctcggccgggtggctcgcactcgtcgacatcctctacctgctcaccctcctcaccatcggcctcagcatctccgggcgccgcatgtccaccctcctctgcaagtag

SEQ ID NO: 1598 - DNA, 759 bp, Actinoplanes utahensis
atgaccgccgcgggttacgtgctcgaataccacctggtcaactatcggcggacctggcgctccagcgccctgtccacgctggtgctgccgctgctcacgatgctcggcttcggcctgggcgtcggcggctacgtgaaagccggcgtcgacggcttcgcctacatcgactggatcgtgcccggactgatcgcctccaccgccgtgcagaccgccctgggcgaggccagctggccggtgctgagcgccctgacctggatgaaggtgtatttcgcccaggccgcctcaccgctgcgggtcggcgacatcgtcggcggccacctcgccttcatgatcttccgggtgctcctcagcgtcaccgcgttcctgctcatcgcggccgccttcggcacgctgcacacggtcgccgcgctggccgtgctgccgctgtccgcactgatcggcttcgcgatcgcggcccccgtgatggcgtacacggccagcatccgcagtgacagctacctggccatcctgttccgcttcgccgtgctgccgatgtcgctgttctccggggtgttcttcccgatcgggtcgctgccgccgctgctgcgctgggtggcctacgcactgcccctgtggcacggcgtcgacctgacccgcgccgccaccctcgggctcaaccccggctgggccggtctgtggcacgccctgtacctgctgacctggtgcgtggccggctggtttctggcccgctggcgtttccgcagccggttggtgatgtga

SEQ ID NO: 1599 - DNA, 924 bp, Actinoplanes utahensis
gtgactgctctcatccacgcccgcggattgatcaagagattcggtgacttcaccgcggtcgacggcatcgacgtcgacgtgcagcgcggtgaggcgttcggcttcctcgggccgaacggcgccggcaagagctccaccatgcggatgatcggctgcgtctcgccacccaccgacggcatcctggagatcctcggcatggacccgcggcgcgacggcccggccatccgcgcccggctcggcgtctgcccccagctcgacaacctcgacgtcgagctcaccgtccgggagaatctgaccacctacgcccgcttcttcggcatcccgcgcgccaccgcccgccgccgcgccgacgagctgctcgacttcgtccagctcaccgagcgggccggcagcaaggtggagccgctctccggcggcatgaaacgccggctcaccatcgcccgtgccctggtcaacgagcccgatctggtcctgctcgacgagcccaccaccggcctcgacccgcaggcccggcacctggtctgggagcggctgttccggctcaagcagcagggcgtcacgctggtcctcaccacccactacatggacgaggccgagcagctctgcgaccgcctggtggtgatggacggcggccggatcgtcgccgagggctcaccccgcgcgctgatcgagcagcactccacccgcgaggtggtcgagctccggttcgccaccgacgaccagggggcctacgccggcaaactggccgggatcgccgaccggatcgaggtgctgcccgaccgggtgctgctctacgtcgccgacggtgacgaggcactggccgaggtgggccgccgctcgctgagcccggcctcggccctggtccgccgctccagcctggaggacgtgttcctccagctcaccggccgcaccctggtggactga

SEQ ID NO: 1600 - DNA, 516 bp, Actinoplanes utahensis
ttgttccgacgccggcccgcgctgccggccgagtcccggcccccgctcgaggccgaggagcgggtgctcgcctggtccgccggcgagcagggcgtggtcgtggccaccaaccggggcctctggctgccgggtggtgccgaccggctgggctggcacgagatccacaaggccgcctggtccggccgcgagctgcggatcaccccggccgaggtggccgaggaacgcgacgggtacaccgtgctggtggacggtccggtgatcaccgtcctgctgttggcgccgggcgagctgcccgaccaggtgcgctcccgggtcacccggtcggtcgcctacaccacccaccacgagctgtcgcacggcgcggtccgggtggtcggccgccgggtcagcgggcgggacgggctgagctgggcggtgcgctacgactccgggacacccgtcgaccgggaatcggtgatcgccgagaccgccgagctggtgggcgcggcgcagaattctgtcgcaccccctccgtag

SEQ ID NO: 1601 - DNA, 1854 bp, Actinoplanes utahensis
atgtatgccgtggccggcagggtgaaggacgaggacatcgcgctggtccgcgaccgcacctcgatcgccgacgtgatcggcgagaccgtgacgctgcgctcggcgggcggcggcaatctcaagggcctgtgcccgttccacgacgagaagtcgccgtcgttcaacgtctccccggcccggggggtgtatttctgcttcgggtgcgggcagggcggcgacgcgatcaagttcctgatggacgccgagcacctgtcgttcatcgagtcggtggagcggctggccggcaaggccggcatccagctgcgctacgacaccgacggcgccgcgccggccggcccccgtccgcagaccgggcagcggcagcggctgatcgccgcgcacgcctcggccgtcgacttctaccgcgaccagctcggctcggccggcgcccgcaaggcccgcgagttcctcgccgagcgcggcttcggccgggacaccgcggagcgatacggctgcggcttcgcccccgactcgtgggacgcgctcagcaaacacctgctgatgcgcggcttcaccaccgacgagctgatcacggcgggcctggccaagacggcccggtccggctcgctgatcgaccggttccgccgccggctgctctggccgatccgcgacctgaccggtgacacgatcggcttcggcgcgcggaaactcttcgacgacgacgacggcccgaaatacctgaacacccccgagaccccgatctacaagaaatcccacgtgctgtacgggatcgaccacgccaaacgggagatcgccaagcgcggccgggcggtgatcgtcgagggctacaccgacgtgatggcctgccacgaggccggcgagccgaccgcggtggccacctgcggcaccgcgttcggcgtcgaccacatcggggtgctgcgccgcctgctgatggacagcgacagcttcaccggcgagatcatctacaccttcgacggggacgcggccgggcagaaggcggcgctgcgcgccttcgaggaggaccagcgtttcgtcgggcgcaccttcatcgcggtcagcccggacaacatggacccgtgcgagctgcggctggcccgcggtgacctggcggtccgcgacatgatcgccggccgggagccgctggtcgacttcgcgctgcggcacaccatcggccgcttcgacctggacacggtcgagggccgggtggaggcgatgcgccgcgccgccccgctggtcgccaagatcaaggaccgggagaaaaggccggagtacgcgcggaaactggccggcgatctcggcatggacctggagccggtgcagcgggcggtcaaccacgcgctccgcggtgaacaggttcaaccggtcccgcagcaggccacccacgcaccgcaacgcctcgtcgaacgcgacgcgctcaagctcgccctgcaggagccggtgctggccggcccgatgttcgacgcggtcggcccggagaactacaacgacccggtcctgcgggcggtccgcgaggcgatcgccgcggccggcggcaccagctccgcggtcagcggcgtggtctggatcgagaaggtccgcgacgcctgcgccgacatcggcagccaggccgccgccggccagctggccgtcgagccgctgctgctcgacggggcgcccgacccgcactacgtccaggtgctgctggccaagctgcaactgccccgggtgatccaggtgatccgcgacctgaaatcccggctgcagcggctcaacccggtcacccacaaggatcaatatctggcccaggccggcgaactcttctccctggaacagcagaaacgcgctctgagcgaacaagcggcaggtgacctgtga

SEQ ID NO: 1602 - DNA, 2910 bp, Actinoplanes utahensis
gtgggtctgcctggccgatccggagggcaacgagttctgcgtgctgagcgccccccgtggggccgttcagtagcggaattcgtcgatcagggcgcggatctccccggccgcgccgctgaccagctccgcggagtggcgggtggtgttcgccccctccgcggtgtgcgcgctggacgtgctgatgtgcgacaccgtgccgctgatctcggacgccgccgcggacaccgccccgacgttgcgggccagctgatcggtggtcgacgactgctgctcgacggcggccgcgatggtccgctgcccgtcgtcgatccgggtgatcaccgaggcgatcgcctcgatcgcctcggcggtcccggtggtcatctcctggatcgccaggatcttcgcggtgatgtccgcggtcgcctgcgcggtctcctgggccaggtccttgacctcggtggcgaccaccgcgaagcccttgccggcgtgcccggcccgggccgcctcgatgctggcgttcagcgccagcaggttggtctgctcggcgatgttcgtgatcatctgcacgatcgcgcccacctcccggctcgcctcgctgagccgggccaccgcgtgcgcggtccggttggcgctggtggtcgcctcgttcgtggtggccgccgcggacagcgcctgcttggcgatctcccggatcgaggcggacagctgctcggtggcggccatcatcgccgacaccgagccggagacgttgccggccgagccgtccgcgctgcgcgcctgcgccgaggtctcctccgccgaccggtccagggtgccggccagcttctgcagctcggtgctggcctgggtcagcacccccacccggccggcggtcgccgacacggtctcctgcagggcgccggccgcctcgttcagcgccaccgccatcgcacccagctcgtcccggttgaccaccggggcccgcacggtcaggtcccggcgggccagcgcacgcagcgcgtccagcatcccgcgcagcggccggcggaccgcccgcacggtcagcacgcacgccgtcgcggtgatcagggcggccagcagcgcggcgatcacgatgaaccggttgctcgacctcgacgactcggcgccgcgggccgcggcggccttgacctcggcgtacatccgggtgtcgagatcgccgagcttctcctcgaggtcggagtagaccttgaggaagtcggacaggccggcggccgcggcggggtggtcggtctcggcggtcgccaccatgcgcttcgcggcctcggtgtacgccaccacggacggccggatcgccacatagtcggccttgagggcggccggggcggctttcgtggcatcgtcgtacatctgcagcatggtggcgccgtggtcggccacctcgtcgaccgcgaacgtctcccgcatgctcgcggtcgtcgcgtacatcgccgacatcacgtcggcccgcagcgcgtcgtgctgcatgtcggcgttccactgatcgctcatcgcctcactgaccgtggcgatctcctcgttcgccgccgtctggtcggaggcgttgcgcaccgcgaacgcggtcaccaggccgaccgagagcagtccggcggcacccatgatcacgagacgggcgacgatcgtgacgccgcggcgccgggaaacggactccacggcatccccatcggcatcctggacatccggcttaggctggggatcatgaccgctgccgacgcccagcgctgggccgctgagcccgccaaggacagcggctacgggcgcaccccgtatcaacgggaccgggcccgggtgctgcactcggccggcttccgccggctggcggccaagacgcaggtgcacaccgccggggtcgacgacttcctgcgtacgcggttgacccactccctggaggtcgcgcagatctcccgggagatgggcgcgcggctgggctgcgatcccgacgtggtggacgtcgccggcctggcccacgacatcggtcacccgccgttcggccacaacggcgaggccgcgctggacgtggccgcgagcgcgtgcggcggcttcgagggcaacgcgcagaccctgcgggtgctcacccggctggaggccaaggtgcccggcgccggcctcaacctgacccgggccaccctggacgcctgctcgaaatacccgtggttccgccgccccggcacccgcaagttcggcgtgtacgccgacgacgagccggtcttcacctggctgcgcgacggccgcgacgacgaccgccgctgcctggaggcccaggtgatggactgggccgacgacgtggcctactcggtgcacgacgtcgaggacggggtgcacggcggctacctcgacctcggcccgctgctgcgcgacccggccgagcgcgccgaactctgcgcggacgtggccgccacctactccgacgagacggccgaccagctcggcgagtcgctggagcacctgctggccgatccggcggtggccgcggtcgagggctacgactcctcgtacgccgcgcaggtcaccctgaaacggatgaccagcgtgctcaccggccggttcgtctcctccgcggtcggcgccacgcacagccagtacggcaccgacccgatgcgccgctacgacgccgacctggtcgtcccgcgcactgtgcgcaaccagtgcgcgctgctcaagggcatggccttccggtacgtgatgcggatgcgctcagccgagcggtggtacgagcagcagcgcaccatcgtggtcgagctggtggaggcgctcggccgggccccggaccgcctcgacccgctgttccgcccgctgcacgcggccgccggctcggacgccgaggcgctgcgggtgatcgtcgaccaggtggcgtcgctcaccgatcacgcggccgtggcctggcaccgcgacctgaccggcacgcgctga

SEQ ID NO: 1603 - DNA, 369 bp, Actinoplanes utahensis
atgcccagtcactgggagcaggtcgtggtggacgcggcggatccgggccggctggggcgctggtgggccgaggcgctcggctatgtgatcgtcgacgagcacgcggacggcgcttacctggagatccggcgcggtgccgacgagttgccggcgctcttcttcctccgctgcgaccagccccgcaggggcaagaaccggctgcatctcgacctgcgcccggacgaccaggagtccgaggtggaacgtctggtcaacatgggcgcccggccggtcgacatcggtcagggcgacgtgccgtgggtctgcctggccgatccggagggcaacgagttctgcgtgctgagcgccccccgtggggccgttcagtag

SEQ ID NO: 1604 - DNA, 381 bp, Actinoplanes utahensis
gtgcccggcgtcgatcactgtctgcaggaggccatgacgattcctggcgcggtcggggccagcatcgtcgactacaccacgggctttccggtcgccacgaccggagccgcacccaacgcggatcacgaggcagcggccgccggcaccgcggaggtcgtccaggccgcgaacagccgatcgctgttcgtctcggcaatcccgcacgacctgctcgaagacctgatcatcacgaccgccgggggctaccacctcctgcggatcgtccagaccgatttcgacagtcggctggtgctctacgtctggctggaccgggtgcgcggcaacctcgccgtcgcgcgccgccagatgcaacgcctgaccgacgaactcgtctccgactga

SEQ ID NO: 1605 - DNA, 987 bp, Actinoplanes utahensis
gtgtccgccacgaagaccgccgcaccggctgatctgctgtcgcaggtcgccggcgagcggcagaccggcgcgctggtgatgggtggccatcccggcggcgcggtctacgtcttcgagggccgggtcatctacgccgagtcgccggccgcgcccggggtcggcgagctgctcacctcgtccggccggctggccgggcggacctggcagaacgcgctcgacctgggaacctccaccgcccgggtgggccggctgctggtcgagcagggccacctcacccagggcgagctggagctgtgcgtgctcggggcgacctacgacgcggcgtacttcgccctggccgcaccgtccggcccggtcgagtttctgcccgcggccacccactggctgggcccggtggtgcacatcgacgcggccgcggtgctgcgcgaggtgggccggcgggtgaagctgctcgacgacatccatccgagtgcgcggatcgacaccgcgccggtcagcccggtgacccggccaccccgggagcgggtgacgatcaccgcggcccagtgggagctgctgatccacgcggacggccagcgcacccccgcggacctggccctgctcctcggccgcgccgggtacgcgaccatccaggagctgcggcggctcgcggctctgggactcatcgaggttcccctggaggtacgtgcggagagccccgagttcgtccgcctcccccagcatcgggccgaggtggcgccggtggcccgccccgcgccgccaccggcgccgcccccaccggtggtgccggtgatcagcagccagccgccgccggcaccaccgcccggggagggcaacaccggagcgaaccggctgccccggctggcccgccgcaaacccggggcgaagctgccgaaggaactcgccgtcgagaatccgccggtgcaccagggcaccgacgaagtcctgctcaaacgcatacgcacagcactgagggcactgcggtga

SEQ ID NO: 1606 - DNA, 498 bp, Actinoplanes utahensis
atgacggtggacccggcggtactcgacgagctcggccgcctgcgcagcagggtgcccgagctgtccggcagcgtgctcgccaccgccgacgggctggtcgtcgcgcatgattcgcacgggatcgaaccggacaccctggccgccctggccgcggcacacctggcgctggcgcgccggttcgcccacgcggtcaaccacggcgagctgcgggagtcggtcgtcgagtgcgacggcggctatatcacctcgtacaccgcgggccccaacgcgctgctcaccgtggtcacctccggcgacgcgaacctcgccatggtgcacctggaggcgcgacggtgcgtacgccggatcgtcaagctcctggctctggactcggcgcagcagaaacatctgcgtccggagattccgcagcagaccggaccgtcgtcgatcccgctggcccggcggaccccgatggccaccctgtcgaacgcgtcgcgccgccgcacggcggccggctga

SEQ ID NO: 1607 - DNA, 372 bp, Actinoplanes utahensis
atggctgacatggacaccgcactgaaggaagttatggagatcgacggctgcatcggcgtcgctctcgtcgaccacaccagcggcatggccctgggcaccctcggcggcggcaaggacctcgacctgacggtcgccgcggccggcaacaccgacgtggtgcgcgccaagctgcgggcgatggagatgctcaacctgaccgagaagatcgaggacatcctgatcaccctggacacgcagtaccacatgatccggccgctcacgagccgacagggcaagggcctgttcctgtacgtggcgctgcgccgggaccggtcgaacctggccatggcccggcatcagctgcgacgcatcgagaacgacctcgacgtctga

SEQ ID NO: 1608 - DNA, 1080 bp, Actinoplanes utahensis
atgccggccagggagatcgtcgaacgcgtccgggccggagaactcgatcatgagacggccctcgatatgctgaccggggcgcccgcggcggagaccgacgcggcactcgcggaagcgctgggcgccgagttcgaccggctgttccgcaccggttggcagccgatcgagctgcaccggacgatcgcgcggcgcggtgatccgatccagggccgcctggtggccgaggcggcggccgccttcctggtcggcaaggcaccggtcgacgaggcctggcgggcccaggtcgtacagctccagcggggtgcgggccggaagaaggacgaccggatcgcggtgctcgacgcctcgctcgggctgctcgacgagctgcgccggctgccgggcatcgagatcctcatcccgccgcccggcaccccggccaccaccgtgcatcagcacgccgaccggcggctgctcgaccgggtccgggccctgctggccaaggcggaggcgaccgacttcccggccgaggccgagtcgtacagcgcgaaggcccaggagctgatcacccggtaccggatcgaggaggtcaccgcccccgcggtcgacgtggtgccgttcgcccgccggatcggcgtcgaccacccgtacgagaacgagaaggccagcctgctcgacgcggtctcgcggaccaacggctgccgcacggtctggtcgccggagctcggattcagcacgatcttcggcttcgacaccgacatcgacggggtcgagctgctctacacctcgctgctggtgcaggcgaaccgggcgatgacccgggacgaaccggccaagggcaaggcccgggtcaaggcgttccgtcgctcgttcctggtcgcctacgccatccggatcggcgaacggctgcgcgaggtcaccgagcagcagttcgccgggcacggcgacctgctgcccgtgctgcgcaaccgggacgtgcaggtccgcgccgcgatggagaaggtcttcccccggacggtccggacccgcggcagccgggtcgacagcctggagggctgggagtccggccgggccgccgccgacgaggcgaagctgcgctga

SEQ ID NO: 1609 - DNA, 1119 bp, Actinoplanes utahensis
atgctcggcaatcacgccgtcaatccgcctgtcgtgctcgctccgatggcggggatcaccaacgtggcgttccggcggctgtgccgcgagcagggtggcggcgtctacgtctgcgagatgatcacgacgcgggcgctggtggagcggatccccaagacgctgaagatgatcgcgttcgccgaggatgagggttttcgcagcctgcagctctacggcgtggacccggatgtgaccgccgcggcggtccggatggtcggtgagcgcaatctcgccgatcacgtggatctgaatttcggctgcccggtgccgaaggtgacccggcggggcggcggttcggccctgccgtggcggcgcaagctgttcgggcggatcgtgcggcaggcggtcgaggcggcgagcgagttcgggatcccgctgaccatcaagatgcgcaagggcatcgacgaggaccacctgacgtatgtcgaggccggcctgaccgcgcaggacgccggggtggccgcggtcgccctgcacgcccgcaccgccgagcagcgctattccggccaggccgactgggatgcgatcgccacgctcaagcaggccctggacgtgccggtgctgggcaacggtgacatctgggagggttcggacgcgctgcggatggtcgcgcacaccggcgtcgacggcgtggtggtgggccggggctgtctgggccgcccgtggctgttcgccgacctggaggccgcgttcacccggggtgcgaactatcagccggtgctgcccacgctcggcgaggtcgcgaagatcatgtcccggcacgcgcagctgctggtcgaggctctggaggatgagcggcacggttgcgccgacttccgcaagcatgtcgcgtggtatctcaagggtttcccggtcggcggtgacctgcgccgcagcctcgcgatgatctcttcgctcaccgagctggacgacctgctgggcaggctcgacccggcgatcccgttcccggtggagtcactggggcagccccgcggccgggtcaacgccccgggcaaggtgtccctgccgtacggctggctggagtcccgggacgacgacaccgtgccggagggcgcggagacggacgagtccggcggctga

SEQ ID NO: 1610 - DNA, 471 bp, Actinoplanes utahensis
atggggccgcgacggctggtggtcgtcttcgagtcgccggtggcggaggcgctgcagcggttcgcggtcgatctggggtttcattcggtgctggtggagccggatccgacccggctgggcggcacaccccggccgcacggcgaccgggtggtgggtgacctggcggcggccgagccggacgagcacaccgacgtggtgctgagcgatcaccaccggccggagatcgggccgctgctccaggagatcctggccgggccgagccggtggatcgggatcgtcggcaacccgcggcacgagggcccgcacaccgcggccctgcgggatctgggggtgccggaggcggagatcgcccgggtgcaccggccgatcgggctgaacatcggcagccgcaccgggccggagatcgcgctcgcgatcctggccggcctgatcgccgaccgcaacggccgccccggtggcttcagcttctga

SEQ ID NO: 1611 - DNA, 1245 bp, Actinoplanes utahensis
atgccgaaggtttcacgaaggcgacggctgctggcggtggtggccgcgatgctggtcggcgcggtgacgatgggtgccgggcccggccgcgccgaggcggcggcggccttcgcgcccatcgacccggcgccgttcatgcttgacccgtcggacagcttccagcgctatgggagcctggtcagccggatcgaggcgagcggcaaggtgaccgcgacgccccagctgggatcggcgctcgacggcccgcaggacttcaagcccacttgggggctgtgccaccccaccgccgggatccccgccggcctcggcgccaccggcttctgctgggacccccgggacgacggctggggcctcacctggaccccgcagggcatctccggttcctgggacgcccagcccgacgggctgtgggagggccggaaaatcgcgctggccagctggcacggcccgaacaacgggttcgcccggctcaccttcgtcgactacacgaacaccgccgcactcaagttccgcgacgtgctgctcgtggtgccctacagcagcaacggggtggacaacttccgggtcctgagcgcgcacgcggacggtgtcgtctggtacggcaacaccctcctcgtggccaatggcggccggatgcacgtgttcagcctgaagcacctgtgggcgatggaccgctcggaggaggagaccgggttcggcgccgacgggtccaaggcgcccagcgcacgctggcaccggtacgcgctcccggagatcggcgagtactacccggagtccacgccgaccggcacctacgtcggctgcacctcggccaccggcgtccggccgtgcctcaacgcgatcagtctcgaccggcgcggcggcaaccccgactcgatcgtctcggcggagtacctggacgcgaacgcggccggcggccgggcgttccggtggccgttgagcccgacatccgggctggtggtgagcgccgacggcaaggtgcacgccgaggcggcgtacacctcaccggtctggcggatgcagggcatcgccagcgacggcgtcaactggtacatcgccgggaactgtgcgtcaggtgcgtcgaacagcggctgcatccacaaggccgtcccgggtcaggcgccgcaccagcaggccgaggtcggcggtgtggagaacctctcgtaccagccgggcacgagtccccgcctgtggggcctgaccgaggggaagaatccgatcaccttcaccatcaaggtgccgtga

SEQ ID NO: 1612 - DNA, 1380 bp, Actinoplanes utahensis
atgcctgccgaccgcatcgattccgttgtcagccttgccaagcgccggggcttcgtcttcccctccagcgagatctacggagggacccgctccgcctgggactacggtccgctcggcgtcgagctgaaggagaacgtccgccggcagtggtggcggaccatggtccagcagcgcgacgacatcgtcggcctggactcggccgtcatcctgagcaaggacgtgtgggcggcctccggtcacctcgacgctttcgtcgacccgctgaccgagtgccagtcctgccacaagcggttccgggccgaccacctcgaggaggcgtacgaggccaagcacggctcgctgcccgcctcgctgtccgagctgaactgccccaactgcggcaacaagggcaccttcaccgagccgaagatgttcaacggcctgatgaagacctacctcggcccgaccgagagcaccgagggcctgcactacctgcgcccggagaccgcccagggcatcttcgtcaactacgccaacgtggcgaccgcggcccgcaagaagccgccgttcggcatcgcgcaggtcggcaagagcttccgcaacgagatcacgccgggcaacttcatcttccggacccgcgagttcgagcagatggagatggagttcttcgtcgcccccggcgacgacgagcagtggcacgagtactggctgcaggagcgctggaactggtaccgcgggctgggcctgtcggagagcaacctgcgcttctacgagcaccccagggagaagctctcgcactactcgaagcggaccgtcgacatcgagtatcgcttccagttcggcggcaccgagttcgccgagctcgagggcatcgccaaccgcaccgacttcgacctgaccacgcactccaagcactccggcgtcgacctgtcctacttcgaccaggagaagcaggaacgctggacgccgtacgtgatcgagccggccgccggcctcacccgtgcggtgctggccttcctgctcgaggcatacgacgaggacgaggccccgaacaccaagggcggcgtcgacaagcgcaccgtcatgcgcttcgacccgcgcctggccccggtcaaggtcgcggtgctgccgctgtcccgcaacccggagctgtcgcccaaggccaagggcctcgccgccgacctgcgcaagcgctggatcgtcgagttcgacgactcgcaggccatcggccggcggtaccgtcgccaggacgagatcggcaccccgttctgcgtcaccgtcgacttcgacacgctgaccgacgacgcggtcaccgtgcgcgaccgggacaccatgaagcaggagcgggtctcgctcagccagatcgaggactacctgatcaagcgcctgccgggttgctga

SEQ ID NO: 1613 - DNA, 528 bp, Actinoplanes utahensis
atgacctacggtcagccgtatccggcgcttcccgagacgcccaccttcgtcgcgccgcccccgccgcccggcccgggcgtgcacccgccgttcccggcgccgccggtcgagggccgcgggcgtcggatcgggctcggcttcggcatcggcggtggcatcgtggcgctggtctgcgctggcgggctggccgcggtggtcggcctcggcctcgcgatgaccagcgcgttcaccgagcaggcgcacgtcgtggtcggtaaatacctggacgcggtcaaggccggcgactacaccaaggcgtatgcgcagctctgccccgaggcccgggcgcgggagtcgatcaccgagtatcgcgcccgcgtcacgcaggacgagcggatcgactcgtactccatcggtgatcttgatctggtcaccggtgaggtgccggtcgacctcacctatgccgacggcggcaccgaccacgtcgaggctcagctcgggcagaacagcagcacgggcgcgttcgaggtgtgctccgtcggggagtag

SEQ ID NO: 1614 - DNA, 699 bp, Actinoplanes utahensis
gtgagcaggcggcgcatcatggcaccaactgtggtcgataatgacaatgattgtcaaaagcgcatgggtcagagggccttgccgagcaccgcgacgatcagcagggtgagcagcaccacccggacgagccgggtgatcggcggctggaccggccaggtggtgaaggtcagcgtggccagcccggccgccagcaccgccagcagcagcgcgcccaccacgcccggcaggaacaggccggccagcagcagggccagcgcggcgaagaacgccgaggtgggattcaccctcgccagccggcgaagaaaatggtccggcgtcgtcacagcggctccctcgcggcgtgcgtaccctcgtcacatgctggtgctcaaccgattcctggtcccgccggacacgcaggacgacttccgggagcaggcgcacgccgcgctcgcggccctcgccggatgccccggatacctgtccggccggctcgcccgcgccctggaggacaccgccgcctggaccctggtgaccgagtgggagtcggtcggagcctaccgccgcgcgctgggcaacttcgatgtgaaggtgcacgccaccccgctgctcgcgcgctcgctcgacgagccgtccgcgttcgagacgctggccgccgccgggccgggggagccggtgaccgagaccgccagtgaccgggcggccgagtcgtggcgctga

SEQ ID NO: 1615 - DNA, 852 bp, Actinoplanes utahensis
atgcgccgcctgctcaccccgctgctcctgctggccgtgctggccggctgcggcgcgcgggccgcggcggacggccggatgccgatcgtggccgccttctacccgctgcagttcgtcagcgagcggatcggcggcgacctggtccgggtggtcaacctgaccaagccgggcgccgagccgcacgacgtcgagctgagcccgcgccaggtggcccagatcgtggacgcgaaggtggcggtgcacgtggccggcttccagcccgcggtcgacgaggcgatagaacagaacgcggcgattgcggggtacgacgtgtccgccgccgccgcgcccgaacatcacgacccgcacgtctggctcgacccggtccggctcgccgcgatcgccgaccggctcgccgtccggttcgggcaggccgacccgccgcacgcggccacctacacggcgaacgccgccgccctgcaccggcagctcgacgacctggacgccgagttccgcacccggctggcctcctgtccgcggcgggagctggtgaccagccacaccgcgttccactacctggccgagcggtatcacctgacccagatcgggatcaccggggtggacccggaggccgagccgtcgccacgccggctggccgaggtcgccgccgacgcccgggcgcacggcaccaccacgatcttcttcgagaccctggtcagcccgaaggtcgccgacaccatcgcgcgtgaggtcggtgcgaagaccgcggtgctcgacccgctggaaggcctgatcgacccgtccgcggactacttctcggtgatgcgggccaacctggcctcgctcaccacggcattggggtgcccgtcatga

SEQ ID NO: 1616 - DNA, 99 bp, Actinoplanes utahensis
gtgcccgtcatgaccggcggcaccgggcggcaccgccgcaacctgaccatcggcgccgcaggcgagggccacgagggcatgacaaggagggcccagtga

SEQ ID NO: 1617 - DNA, 783 bp, Actinoplanes utahensis
gtgagtgtgatcgcggttcggcacgtggcggccggttatgacgggcgggagatcctgcgggacgtggacctgagcgtcgcggccggcgacgtggtcgcggtgctcggcgccaacggctccggcaagtccaccctgatccggacgatcctcggcctggtcccggtgcgccgcggggagatcgacctgttcggcaccgcgcagcgccggttccgcgactgggcgcggatcggctacgtgccgcagcgcctcggcgccggcagcggcgtgccggccaccgtcggcgaggtggtcgcctccggccggctggcccggcgcgggctgttccggctgcccggggccgccgaccgggaggcggtgcggcaggcgctgaccgcggtcggcctgctggaccggatcggcgacccggtcagcaccctctccggtgggcagcagcagcgcaccctgatcgcccgggccctggccggccggcccgacctgctggtcctcgacgagccgacggccggggtggacgcggccagccaggaggcgttcgccggggcgctcaccgagttcgccgcgaacggcggcaccatcctgctggtcctgcacgagttgggcccgctgcggccgctgatcggccgggccgtggtggtgcacgagggccggatcgcgcacgagggggtgccgccggagccggccgggcatcacgccgagccgggccacgaccatgtgcacccgcatgccgacgaggcgaaggccggcatctgcgaatgggcgccgacggacgggatgaaggcgtactga

SEQ ID NO: 1618 - DNA, 861 bp, Actinoplanes utahensis
atggacctcttgacctatcccttcatgctgcgcgcgctggccggtgcgctgatcatcggtctggccgcgccggcgctcggcgtctacctggtgcagcgacggctgtcactgatcggtgacgggatcgggcacgtggcgctgaccggggtcggcgtcggcctgctcacccaccggtcgccggtgctgaccgcggtgctggtctcggtgatcggcgcggtcgccgtggagctggtccgcgaacgcggccgcacctccggtgacctggcgctggccctgctgttctacggcgggatcgcgggcggcgtggtgctggtcgggctctccgacgacgccagcaacgccagcctgatgcagtacctgttcgggtcgctgatcaccacctcgccgcaggacatcgtggtgatcgccggcctgggtgcggcggtgctgatcgccatgctggtgttccggccggcgctgttcgcgctctgcaacgacgaggagtatgcccgggtcagtggactgccggtgcgtacgctcaacctgctcctcgcggtgacgaccgcggtgaccgtcacgatcgccatgcgcaccgtcggtctgctcctggtctccgccctgatggtggtgccggtggcggccgcgcagcagctgacccgcgggttccggtccacgatggcggtggccatgctgatcggggtcggcgcggccggcgccggggtggtgctgtccggccagatcgacaccgcgccgggcgccaccacggtgctgctggccctggccgcgttcctggtgaccgccgcggccggcgcgctgtggcaccgccggcgacgcccggcgcctgcccacgccgaaccgccggacgtggtgctgcatggctga

SEQ ID NO: 1619 - DNA, 306 bp, Actinoplanes utahensis
atggctgagcagggcgccggccacgggtcgtacgaggcggccggcgcgctgctgcgggcgctgtccgccccgatccggatcgccatcgtggtgcgcctgggcggtggcgcatgctgcgtgcacgatctggtcgccgagctcggcgccgcacagccgctgatctcgcaacacttgcgggtgttgcgcggcgccggcgtggtgcggggtgtccggcgcggccgggagatcgcatactccctggtggacgaccacgtcgcgcacatcgtcgccgacgccgtgagccacgcaagggagaatcgatggtga

SEQ ID NO: 1620 - DNA, 405 bp, Actinoplanes utahensis
atggtgagcccggacagtgctcagcgcaacaccaagcagcgcagcgcggtgagcgccgtgctcgccgagaccgagggattccacagtgcgcaggacctgcacgcgatgctgcgcgaccggggtgaacgggtcgggctgaccacggtgtaccggacgctgcagggcctggccgacgccggcgaggtggacgtgatgcgcccgcccggcggcgagcacctgtaccgccgctgcagccaggggcatcaccaccacctggtgtgccgatcctgcgggcggaccgtcgaggtgctcggcccggcggtcgagtcgtgggccgagaagatggccggcgagcacgggttcgtcgacgtgtcacacaccatggagatcttcgggacctgcccggagtgcgcgcaccggggctga

SEQ ID NO: 1621 - DNA, 612 bp, Actinoplanes utahensis
gtgaagctctacgccgaccgcatgcccatcgccgtccgccagctcgtcaccgacatcctcgtggtgatctgggtctacctctggatccgggccgctctctgggttcacgacctggtgcagcaactggccgtccccggccagaagctggagagcgccggcggcggcatcgccgacaacctggccgacgcgggcggcaaggtgggccgggtgccgatcgtcggcgatcagctgaccaaaccgttcgccggggccgcgaacgccgcccggtcgatcgccgaggccggccagcagcagcaggacctggtcggcaagctggcgctgatcctgccgctgatggcggtcgcggtgccgctggccgtgatcctgttcctctggctgccgaggcggctgcgctgggtccggcgggccaccacggcgagcgcggtccgcgacctgccggccgggcgggacctgctggcgctgcgagcgctcgcctcccggccgctgagcgagctggcccggctcggcccggacatcgcgcagagctggcgggccggggacgcggcggccgtcgacgcgctcgccgacctggaactcaggcgcctcggtctgcgtcgagcaggccgctcgtag

SEQ ID NO: 1622 - DNA, 552 bp, Actinoplanes utahensis
atggccgccactccgtcgaaggaaacgcagaagcagcggtgggaccggaatttcgccgacctgctgcaggagctgcgggtggcgcagaccggcgtgcagatcctgttcgcgttcctgctgaccctgccgttctccagcggcttcccgaaggcgaccgagttccagcgggacacctacgtggtggcgttgatcagtgcggcgttcgccaccgcgctgatcatctcgccggtcgcgttccaccgggcgctgttccgccagggccgcaaaccggagctggtccggtatgcgcaccggatggccagcgccggcctggcctgcatgctggtctcgatggtcagcagcgtgctgctggtcaccgactacgtgctgcacgcccgctgggcggtggtgctgacggtgctcagcgccggctggttcctcaccttctgggcgatcctgccggtcacccacaagcgctgggccaccgacgacgacaaggacggcttcgtcctcgacgacgccccggccgactcggctacgagcggcctgctcgacgcagaccgaggcgcctga

SEQ ID NO: 1623 - DNA, 816 bp, Actinoplanes utahensis
atggaggtcaaggcccgggggctgacgttcgaggtggccgtgggcggtcccgaggacggtcggccggttctgctgctgcacggctttccgcaggatcaccgggagttcgaccctctgctgccccgcctgcacgaggccggcctgcggacgtacgcgatggaccagcgcggctactcgcccggcgcccgcccgtccggcgtccccgcctaccggatcggcgagccggtcgccgacgtcctcggcgtcctggacgcgctcggcctggagtcggtgcacctggtcggccacgattggggcgcccaggtcggctggctggtcgccggccggcacccggaccgggtgcgcaccctgaccgcgatctccgtgccgcacccccgggcgctgctgctggccctgcgggtccggccgtcccagcaggcccggctcgcctacttccaggtcttccgcagcgccgtggcggagaagctgctgctcggcggcggcgccctggtgatgcgccggatgctgggcgcgatcgggccgcgtgccgacctgtacgtcaaggcgatgcgcgagccgggccggctgaccaccgcgctccactggtaccgcgccttccgctcctcggacgtcgccgacctcggcgagatcaccgttccgaccacgtacgtctggagcgaccgggacggggtggtcggcctgaccgccgcgctgcgcaccgccgactgggtgccggccgactaccagttggtcgcgatgcgcggggtcagccactgggtgcccgaacaggcgccccgcgaactcggcgacgcgatcctggcacgcatcggcgtttga

SEQ ID NO: 1624 - DNA, 1731 bp, Actinoplanes utahensis
gtggggcgccaccgtgatcatccagggtgcggcccagggcctcggcgccgagctggccttcgccctgttccgctaccgggtcttcaccctgcccgccgggctgctctccggcgccctggccggcctggtcgccgcggtcttcgactggtacgtctggacctacgactacgacctgtggagctaccggatcccgtacgcgctgatcaccgtcgtcagcgccaccgtgatcgccggcgccggcgcctggctgctggtccgcgcgctcgcgccgaccggcgtcctggaccggttcgcggccggccgccagcgggcattgatctaatcgcggtgagcgaggttcagctccgcgggttcggctggcggcacgcgggccgccgggcctgggcggtgcgcggcctcgacctgcacatccggcacggcgagcgggtgctgctgctgggcccttcgggggccggcaagagcaccctgctcgccgcgctggccggcctgctgcccgaggattccggggaggccgcgggcggcatcgagatcgacgggctggaaccgcccaaggcccgcgaccgggtcggcatcctcttccaggacccgcagacccagctggtgatggcccgctccggcgacgacgtggcgttcggcctggagaaccgcggtgtgccggccggcgagatctggccgcgggtcaccgaaaccctggaccgggtcggattccggtatccgctggaccgctccaccgccgcgctctccggcggcgaggcgcaacggctggccctcgccggggtcctcgcgctgcgccccggcctgctgctgctcgacgaaccgaccgccaacctggacccggccggagccgcgctgatccgcgacgcgatcgcccaggcggtcggcccggacaccacgctgatcatcgtcgagcaccgggtcgccgacgcgttgccgctggtggaccgggtcgtggtgatcgaggcgggcggtggggtgcgggccgacggcacgcctgaggcgatcttcgccgcctacggcgacgagctggccgagcagggcgtctgggtgccggggcacgccgtcgagtcgcggatcgccccggtcaccgttccctccgatctggtacgtgcggaacagaccggcgtgccgggacgcctgcccgccgtgaggctgaccgcgggcgccggcgaagtgctcgcggtgaccgggccgaacggcgccggcaaatccaccctcgcgctgctcctcggcgggctgctcgccccgggaaccgggcgggtcagcgcgttcggtgaccggaaaccgccgcaccggtggcgggccagaaccctcacccagcggatcggctcggtcttccagaacccggagcaccagttcgtcaccacccgggtcgccgacgaactgtcactcggaccccggcggctgggccgcggcgccgccgagatccgggccaccgtcgacgagttgctgcaccggctgcggttggagcggctggccgaggcgaacccgtacaccctctccggcggggaggctcggcggctgagcgtggcgaccgcactggccaccgcaccccggctgctggtgctcgacgagccgaccttcgggcaggaccggcggacgtggaccgagttggtgacgttgctgggcgagctgcgcgacgaggggcacggcgtggtggcggtcacgcacgacgaggaattcgtccgtaccatcgccgatcggaccgtcaccatcggcggaccgcgaccgtga

SEQ ID NO: 1625 - DNA, 921 bp, Actinoplanes utahensis
gtggaccgagttggtgacgttgctgggcgagctgcgcgacgaggggcacggcgtggtggcggtcacgcacgacgaggaattcgtccgtaccatcgccgatcggaccgtcaccatcggcggaccgcgaccgtgaacctcctcctcgagccgatcgccgacccgggcgcgccgctggcgcgccgcaacccggtggccaagctcggcgccgcgctgctgttcgccctgccgatgatcgcgacgctggacccggtgaccccggccgtcgcgctcggcgtcgaactgatcgcactgccgttcttcggggtgcgggcgcgggtgctcgcccggcggatctggccgctgctgctgaccgcgttcagcaccctggtcgcgatggtgctgttcgccgccgaccgcggtggtgagctgctgttctcggtggggcgggtggacgtgaccaccggcgtgttggcgagcgcgaccggtctgatcctgcggatcttcgcggtggccctgcccgggatcgcggtgttcaccaccaccgacccgaccgacctggccgacgcgctggtgcagaacgcgaaagcgccggcccggttcgcgatcggggcgctcgccgcgttccggctgctgccgctgctcgggcaggagtggcggatgctgaccctggcccgacgggcgcgcggagtggaaaccgggaagaacccggtggcgttcgcgtcgacggcgttcgcgttgctggtgggagcgctgcgacgcggcgtgcggctggcggtggcgatggacgcgcgcggattcgactccggggtgccgcggacgtacgcccggacccagcgcttcaccgcggccgacgcggtgctgctggtgacggccgtggtgctgtccgccctgatcctggcagtgagcgtggtctccggagtgttccggccgatcatcggttga

SEQ ID NO: 1626 - DNA, 504 bp, Actinoplanes utahensis
atgcgccgggcggtcgtcccgcgcggaacagcgactcccgcaattgacttgccggccccgccacgacgcgatgatcatggatgggtgagtcagtatttcgaggtcggcgacctggtcctgtggaatccgtcgaacggggtggcgaggctctacgcgcgcaccggtgaggcggtggcaccgctggtggaactgccgaccggcatcggtccgatgatcgcggacgagtatgagatcgacctcgacgtcttcgtggccttcgtggacgcgttgaccggctactacctcggggcccagcatccgattctccgctcgctgatggagggcttcctcgccacgtcgatcgtcatggtccagcgggccgggcgggagctgccggcgctccgcgagcagcagcggccgcactggtggaacgtctcggtgaccacacgcggggtcgccccgaccgccgaccgcgacgagctgctcgacctggtcgccgagcacgcgatgagcatggcccggtag

SEQ ID NO: 1627 - DNA, 918 bp, Actinoplanes utahensis
atgactcgtgcccgactgccgcagctgttggccgacgcccgtagcggggtgttgctgttcagcatcacgccgccgaagcgcagcacccccgaggagcggatcaaggagatcgccgaggtcaccctggagcggctcggccggctcgacctggacgggctgatcctctacgacatcgacgacgagtccgaccggaacccggtcgagcggccgttcccgttcctggcgtcgcacgaccccgcgcagtattacgagacgcacctgggcgcctggaagcagccggtgatcatctaccgctgcgtggggaagtacgccgaggaggagctgcgcgactggatgcgcggggtcgatccggagcaggtgctcggtgtcttcgtcggcgcgtcgtcgggcggcaaggcggtccgcaccgggttgcgccgggcgcaggagttgcgggccgaggtccggccggagctgccgctgggtgcggtggtgatcggggaacggccggaggagcaccggcggatgctgaccaagcaggatcggggagcgagcttcttcatctcccaggtcgtctatcacgtcaacgagaccaagaacctgatctccgactacttctacgagtgccgggcccgggacataccgccacggaccatgattttcacgctgtcgctgtgcgggtcgctgaagacgctggagttcctgcgctggctcggcgtcgacgttccccgctggctggagaactcgctgcggcacaccgccgacccgctcgccgagtcgtacaagcactgcctcgacatcgcccgtgacctgcgggacttctgcgagcacctgggcgtcccgtacggcttcaacatcgagagcgtctccatccgcagggaggagatcgaagccaccacccgcctggccgccgacatcgccaccctcctcggccgctga

SEQ ID NO: 1628 - DNA, 297 bp, Actinoplanes utahensis
atgctggtcgccttctctgtcacgccgatcggggtcggggactccgtcggggatgccgtcgccgaggcggtgcgggtggttcgggcctcggggctgccgaaccggaccgatgccatgttcaccacgatcgagggtgagtgggacgaggtgatggcggtggtcaagcaggcggtggaggcggtggccgcggtcgccccgcgggtgagtctgtcgttgaaggcggatgtgcggcccggggtgaccggggcgctgaccgccaaggtggaccacatcgaacgggtgctgggcgagtcatga

SEQ ID NO: 1629 - DNA, 675 bp, Actinoplanes utahensis
atgaggcgtctggtgatgtgggacgtcgactacacgctgctgcgcggcggcggggtggcggcccgggcgtggaaggccgcgttcaccgaggtgaccggggtggcctggcgggatacgccgatcttcggtgggcgcaccgacctggacatctgcggcggggtcttcgaggcgcacggggtgaccgactgcaccccggaacgcttcttcgcgcggtacgtggagatcgtcgacacggtccggcacgagttcgccgaacagggtgcgctgatgccgggagtgcgggagatcctcgcccacctcgcggaacggcccgatgtggtgcagaccctggtgaccggcaacgtgcccgaggtggcggcggcgaaggtggcggcgttcggcctgtccggttcgttcgacgccgaggtgggcggttacggcacggacgacagtgtgcgggccaccctggtccgccgcagcctggaacgcgcgcgggcgaaatacggcgagccgttccggccggtcgtgatcggcgacaccgtgaacgacgtgacggcggcgctggccaacgacgcggtcgcgatcgcggtcgccaccggcgccaccccggcggccgacctcgccgccgccggcgcccacgtggtcctgcccgacctgaccgacctggaaaccgccgtcaaggcaatgaccgactga

SEQ ID NO: 1630 - DNA, 516 bp, Actinoplanes utahensis
atgaggcacctgtggatcgcccggcacgccttcgccaacgaggacgagaccggactgaccggcgacggcgagcagcaggccgccctgctcgggaaacgcctcgccgacgtgccgctgacggccgtccaccacagtccgctggcccgggcggtgcagaccgccacgatcgtcgcggcgcatctgccgcccgaggtgccgctgcaccccgccgacgaactcgacgaccagtttccgaccccggcgaactcggccggcatgatcgcccgcttcaccggggccgcgccggtggagacgcacgagttggtgatcacccacgcgttccaggtggcctggttcgtgcgggacgcgctggaggcaccggaagaccgctggcggggcctgaactcgtgcaacgccgggctgaccctgatccgctatttcccgggccagaagccgcgagtgatcatgttcaacgacgtgagccatctgccggcgtcgttgcagtggacaggtttcccgcccgaactccgcccgtga

SEQ ID NO: 1631 - DNA, 783 bp, Actinoplanes utahensis
gtgagcccgcgtccgcccaccccgcacatctccggcgcccggccgccccagctgccgtccgcggcgatcccccggcacgtggcgatcgtgatggacggcaacggccgctgggccaaggagcgcggcctgtcccgcaccaagggccacgagcagggcgagcactccctcttcgacgccatcgagggcgccatcgagctgggcatcccctacctctcggcctacgcgttctccaccgagaactggaagcgctcgcccgaggaggtgcgcttcctgatgggcttcaaccgtgacgtcatccgccgccgccgcgaccagctggtcgacctcggcgtccgggtggtctggtccggccggtccggccggctgtggaaaagcgtgatcgccgagctgcagaccgccgaggagatgagccggcacaacaagacgctcaccctgcagttctgcgtcaactacggcggccaggcggagatcgccgacgccgccgcggcgatcgcccgggacgtcgcggccggcaaactcagagccgacaaggtcaccgagaagaccatcgcgaaatacctgtaccaccccgaggtccccgaggtcgacctgttcctgcgcccctccggcgagcagcgcacgtcgaacttcctgctctggcagtcggcgtacgccgagatggtctacctggacacgctctggcccgacttcgaccgccgccacctctggtatgcgtgcgagctctacgcccagcgcgaccggcgcttcggcggcgccctgcccaacccggtcagcccgtcatga

SEQ ID NO: 1632 - DNA, 777 bp, Actinoplanes utahensis
gtgcccgctggatatcgacgccacctctaccgcgacgacgcggtggtcctgcgtgtgcagaaactcggcgagagcgaccgaatcgtcaccctgctcacccgccggcacggccggctgcgcgcggtcgcccgcggcgtgcgccgcaccacctcccgcttcggcgcccggctcgagccgttcgggcacatcgacctgcagctcgccgggtcgcccgagggggtgggcagcgcgctgcactcggtcagccaggtcgaggcgctgtcgctgttcggcaagagcttcctcgccgactatccgcgctacaccgccgccagcgccatctgcgagaccgccgagcggctcaccccggtcgagcgggagccggcgctgcgcctgttccagctcaccctgggcgcgctcaaggcgctcgcggccggcgagcacgccggcagcctggtgttggacgcctacctgctgcgcgccatggccttcgccggctgggcgcccgcgctcaccgagtgcgccgtctgcggcgacccgggccggcacgccgcgttcgcggtcccggccggcggcgcggtctgccccgactgccggccacccggtgccgcccaccccagccccgacacgatcggcctgatggccgcgctcaccagcggcgactggccggtcgccgacgcgtccgcgccgtcggtgcgccgggagtgcagcggcctggtcgccgcccacctgcaatggcacatggagcgctcgttacgctcgttgccgcttgtcgaccgacgggagttgaaaccgtga

SEQ ID NO: 1633 - DNA, 765 bp, Actinoplanes utahensis
atgacccgcagagttgcccttctcctcgccgccgcctcggtcgccgccctggccggctgcgacggcgtggtgggcgccaagatgaccttcgacgacaccgagaagacgaaggtcaccgacatcgtgctgagcggtggcagcggcgatgtgacggtgaccaccggggcggtcggcgagacgcacatcaagcgcatcgtgcgcggcggcaacggctccggcccgtcgtatcagctctccgggaccaccctgaccctgcccaccgactgtggcttcaactgctcggtgtcgtacgaggtggacgcgccggccggggtggcggtgcacggcagcatgcggtccggcagcacgtcgctgaccggggtcggggccgtcgacctcaagctcacctcgggggacgtggtgatcgatcacgccaccgcgccggtcaaggtcaaggccacctcgggcagcgtgacggtgaccggcgcgcccgcggtgaccctggaggccacctcgggtgacctggcggcccgggagatcgccgggccgatcgacgcccgggtcacctccggcgacgtggatctggagttgtcccggccggcctcggtgaccgccgtggtgaccagcggcgacctgatgctgcgtgtgccggtgggcagttaccagctcaaggagcacgccaccaccggcgacgagcacatcgaggggatcaccgacgatccccggtcgccgaacgtgctggatctacgcgcgcgcagcggcgatctcaccgtcggcaccctctag

SEQ ID NO: 1634 - DNA, 1053 bp, Actinoplanes utahensis
ttggccatgcgcaaccggtacctggacctgctccgcgcgatcgccaccgtccgggtggtcgtctatcacctcaccggctgggccgcgctgaccatcgtcttcccggcgatgtcggtgatgttcgcgctggccgggtcgctgatggcggcctccctggaccgcttcggggtgtgggcggtggagcggcggctgcgccggctgctgccctccctctgggtgctgaccctgctgatcgcggtgccggccatgctgatcagcggtaccccgttcgacgtacatctgctgctctggggttttccgctggtcgacccggaggccaccggctggtggatggcctcgctcagccacgcctggtatctgcgggacttcctctggttcgtgctgctctcgccgctggccctgccggtcttccggcggatcccgctgatcgcggtcctgctgccgtacgccggtctgctggtcctggagctcaccggcgcccgggtcgtcaacgtggtgcacgacctggccctgtacggcggggcgtggctgctcggtttcgcccatcacgacgggcacctggcccggatcccgcgcaagcggctgatcgcgctggcggccgcgctcgccgtgcccgggatggcgtgggtgctcacccactccgggccgcgcggcctcgacctgaacgacatcccgatcggcaacgcgctctggtcggcggccttcgtgctggtcgcgatgggctgctcgccgagggtcggcgagcaccgggtgctgaccgtgctcaacgcgcgggcgctgagcatctacctctggcacatcccgatcctgctcggggtcaccgagttcggcgaacggcacgggctgccggtccgcggggcgtacgggatcggctggcggctgatcgtcgtgacgctgctcatcgccgtggccctggccctggtcggctgggtggaggacgtggccgccggacgccggccggcgctgctgcccggccggccggtgccggtcccggtgtcgccggccccggccctagagggtgccgacggtgagatcgccgctgcgcgcgcgtag

SEQ ID NO: 1635 - DNA, 876 bp, Actinoplanes utahensis
gtgtatcgggcgggtttcgcctgtttcgtcgggcggccgaatgcgggcaagtcgacgctgaccaatgcgatcgtggggcagaagatcgcgatcacctcgagcaagccgcagaccacccggcacgtgatccggggcatcctgcaccgcccggacgcccagctggtgctggtcgacacgccgggtctgcaccggccccgcacgctgctcggcgagcggctcaacgacctggtccgcgagacgtggagcgaggtcgacgtgatcggggtgtgtttcccggcggacgagccggtcgggcgcggtgaccggttcatctcggcggaggtcggcgagctcaaggccaaggtgatcgcggtggtcaccaaggtggacctggtcgatccgcagaccctggcacagcggctgctcgcggtcgccgagctgtacgacttcgcggagatcgtgccggtcagcgcggtgtccgggcaccaggtggagacgctgaccgacgtgatggtgcgttacctgccggagtccccgcagttgtacccggacgacgtgctgaccgacgagccggagcaggtcctgatcgccgagctgatccgcgaggcggcgctggagggggttcgcgacgagctgccccactcgatcgccgtgctggtcgaggagatgcaggtggagggcaggaccacgaagatctatgcggatctgtacgtggaacgggacagccagaagtcgatcgtgatcgggacgcgcggcgagcggctcaagacggtcgggacgcgggcgcgcggcgagatcgagcagcttctgggcaggaaggtgtacctcgatctgcacgtgcgggtcgccaaggagtggcagcgcgatccgaagcagctccggaagttgggcttctga

SEQ ID NO: 1636 - DNA, 123 bp, Actinoplanes utahensis
atggccgacgagaacgagcggcggctgaccgcgggggagcgcaacgagctgcggcgccaggagcgccgggcggctcgcaaggcggccgacggccagggccaggtccagggcagaggccactag

SEQ ID NO: 1637 - DNA, 381 bp, Actinoplanes utahensis
atgcctgagcagagctttgccgccgtccctgtgcccggggcggacggttccgcgctgagcgccgaggacgccaagctggtcaccctggcccgcagttcgcgcgcccgggccggtgcggccgagggcgccgcggtgcgtgaccaggacggacgcacctacgcggccgcctcggtggcgctgcccagcctgtcgctgaccgcgttgcagctggcggtggcccaggccgcggcgtccggcgccacgaagatcgaggcggcggcggtggtgaccgaggcgtcgacgctggacggcgccgggcacgccgcggtgcgtgacctggccgccgacgcgccggtgcacgtggccggcccgtccgggacgctgctcggcacggtctcctga

SEQ ID NO: 1638 - DNA, 1572 bp, Actinoplanes utahensis
gtgagccggccctgctcggcgacatcgtgctggccccggaggtggccgccaagcaggcggtcgccgccgggcacaccgccgccgacgagctgcatctgctcaccgtgcacggcgcgctgcacctgctcgggtacgaccacgccgagccggaggaggagcgggagatgttcgccctgcagaacaagctcctgcagagctggcgcgccggtcgtaaagccggctgacgtgaattccgcctcgaccctgcccgaactgcaactgatcatcatcgcggtcgggctggtcctgctggccggtctcgcctcgatgaccgacgcggcgctggccacggtctccgcggcccggtcgtccgagctggcccgggagggtcagcgcggggccggcgcgctgaccgcggtcgcctccgacgtggtccgctacgtcaacctgctgctgctgatccggctgctctgcgagctgtcggccaccaccctggtggcgctggtggcggtggacaactgggggatcggctggtccgcggcgctggtcacggccggggcgatgaccctggtcagcttcgtggtggtgggtgtcgcgccgcgcacggtgggccgccagcacgcgtacgccgtgggccgggccgccgcgccgctggtccgctggctgggccgggtgctgaatccgctcgcctcgctgctgatcctgatcggcaatgcggtcaccccgggccgcggtttcccggagggcccgttcggcagccaggtggagctgcgcgagctggtcgacctggccgagcagcgcggcgtggtggaacacggcgagcgcgagatgatccattcggtgttcgcgctgggcgacacgatcgcccgtgaggtgatggtgccgcgcaccgagatggtgtggatcgaggcgccgaagacgttgcagcaggcgctctacctgttcctgcggtccgggttctcccggatcccggtgatcggcgagagcgtcgacgacgtgctgggcgtgctctatctcaaggatgtgatccgccgcacgcagaacggcgatccggcggcggccgcgcaggcggtggccgacgcgatgcgcgcggcgaccttcgtgcccgagtcgaagccggtcgacgacctgctgtcggagatgcaggcggcccgcaaccacctggtcatcgtggtcgacgagtacggtggcacggccggtctggtgacgatcgaggacatcctggaggagatcgtcggcgagatcaccgacgagtacgacgtggagcgcccgccgatcgagcatctggacgacggcgcggtccgggtcgcggcccggctgccgatcgaggatctgggcgacgtgttcggcgtggagctgcccaccgacgaggtggagacggtcggcggcctgctcgcgcagacgctgggccgggtgccgatcccgggcgcccaggccgacgtcggcggcctgcacctgatcgccgagggcaccgccggccggcggaaccggatcgactcggtgctggtgcgccgggtcccgccggtcacgccgaccgatgacaacgacgagaacgtaaccgagaacgaggaaagacttcccgctgatgcctga

SEQ ID NO: 1639 - DNA, 1077 bp, Actinoplanes utahensis
atgaccggtacgccgaacccttccagcacgggctcgtccagcccggtgcgggcgcagaccaagatctcggtgtccgacccgaagatcatggtgaacctgctcggcgccaaggacgagatcctccgcctgatcgagcgcacgctcagcagcgatgtgcacgtccgcggaaacgagatcaccatcaccggcgagccggcggacaacgccaccgccgagcgactcttctccgagctcatcgagctcatcgagaagggtgagacgctcagcgtcgacgccgtccgccgcaccctgcggatcctcgaggacaccacctccgagcgacccgccgaggtgctcacgctgaacatcctgtcccggcggggccgcaccatccggcccaagacgctgggacagaaacactacgtcgacgccatcgacgagaacacgatcgtcttcggcatcggccccgccggtaccggtaagacgtatctggcgatggccaaggccgtgcaggcgctgcaggccaagcagatcagccggatcatcctgacccggccggcggtcgaggccggcgagcggctgggcttcctgcccggcacgctcaccgagaagatcgacccctatctgcgcccgctctacgacgccctgcacgacatgctggacccggagtcgatcccgcggctgatggccgccggcaccatcgaggtcgccccgctggcctacatgcggggccgcaccctcaacgacgcgttcatcatcctggacgaggcgcagaacacgacgcccgagcagatgaagatgttcctgacgcggctcgggttcggggccaagatcgtggtgaccggtgatgtcacccaggtcgacctgccgggtggcacgaccagcggcctcaaggtcgtccgggagatcctgcggaacgtcgaggacgtgcacttcgccgagctgtccagctcggatgtggtgcggcaccggctggtcgcggagatcgtggacgcctatgcgcggttcgacgccgagcaggagcagcagcaggcagccaattccgttcatgccgttcccgggcgggccgccaacggccgcgccccgcggcggcgctga

SEQ ID NO: 1640 - DNA, 1365 bp, Actinoplanes utahensis
gtgaccggccaccacccgcggtacgagcgggcggtccgccgggcgcaggccgacggacggatcccggcgctcagcgtcgccctggtccgtgccgaccgcgacccctgggtgtgcaccgtcggcgagtccgggacaccgggccggccgctcggcccggacagccggttccggatcggctcggtcaccaagacgttcaccgcggtgctggtcatgcaggcccgcgacgacggcctgctcgacctggaccagccggtcagccgctacctcgacgtcccggcgcacggcgacgccaccatccgccggctgctctcgcacaccgccggataccagcgtgagccgcacggcgacgtgtgggacaccctgatcagcccggacgccgcccggatgctcgccgaactggaccgggtcgagcgggtgctgcccaacgcccgccgctaccactactccaacctcggcctcgccgtgctcggccagctcgtcgccaagctgcgcggcggcacctgggcggagatcctcgccgagcgcgtcctggccccgctcggcctgacccgcaccaccgtcgaccggccggccgaggcggtcgtcggctacctggtcgacgcgtactccgacgcggcccgcccggagccggccatcgacctgggcggggtcgccccggccgcccagctctggagcaccgccaccgacatggcgcggtgggccgccttcctggccgacccgcacgacgaccgggtgctcgcggcggccaccgtcgaggagatgcgctggccggtcaccaccaccgacgaggcgctctgggcgcagggcttcgggctcggcctgatcctcgccccagagggccggcgggtgacacatgtcggtcacgacggggcgatgcccggcttcctggccggcgtctacggccggcgcggcggcgagggcaacccgggtggcctcggctgcgcggtgctcggctcctcgggcaccgccgggcagaccatcgatctggcccacgagctgctgcggctcgcggtcgagaccgatccggcggagatccggccctggcggatggccgcgccggcgcccgccgcgtaccgctcgatcctgggccgctggtggagcgagggctccgacttcgtcttcgggtggcacgacgggcggctgcaggcccggctcgccgaggcgcccgcggaccggccgccggcgatcttccagccgctgccggatcggccggacgtgttgcgcacggtctccgggcgggaggccggcgagctgctccggttgacccgggacgactccggcgcggtggtccggatgcactgggccacctaccggttcacccgcgaccagcagaccttcgacggcggcctggcatccgacgggtga

SEQ ID NO: 1641 - DNA, 2556 bp, Actinoplanes utahensis
gtgggtcggcgcctgcgggttgatgtcccggaaggcgaccgtggtctcggtgcggtgcacgacggtcgcggggatctcgccggcgacgatgcggcagaacaggcaggagttgtccacccgtcggatcttatgcggccaccaggtcggcttgaatgggtcccggaataccccacccctgcccgggagcgctctcacatgaccgacgttgatcacctgctcgaccggctgaccctggacgagaaggtgtccctgctgaccggacaggacttctggtcactgcccgcgatgccgcgcatcggcctgcgctcggtggtgatgtccgacggtccggtcggcgtccggggcaccggctgggcgccggagaacccgtcgatcgccctgcccagccccaccgcgctggccgcctcctgggatccggagctggccgtcgaggccggccggctgctcggtcaggaggcccgcgccaagggggtgcacgtggtgctcggcccgaccgtcaacctgcaccgtaccccgctgggcggccggcacttcgagtgctactcggaggatccgctgctcaccggcgagatcgcggccggattcgtgcgcggggtgcaggagcacggcgtcggcaccacggtgaagcatctggtcggcaacgacttcgagaccgagcggatgaccgtcgacgtgcggatcccggaacgggcgctgcgcgagctgtacctggccccgttcgagcgggtggtcgaggccggcgggtggggcgtgatgagcgcgtacaacggggtcaacggcgcgtcgatggcgcagaacggccggctgcaggacgaggtcctcaaacgcgagtggggtttcgacggggtggtcgtctccgactggcgggccgcccgggacacggtcggcgccgcgctcggcggcctcgacatcgccatgccggcgatggacaacccctgggggccgcggctcgcggcggcggtccggtccgggcaggtgccggtcgaggtcgtcgatgacaaggtacgtcgtctcctccggctcgccgcgcgcgtcggcgccctgggtgcgccaccggtggtgacggccgcggcggtggacggcggcgaggtggcccaccgggtggccgcccgctccttcgtgctgacccgcaaccggggcgtgctgccgctgcccccggagcggaccggcgggatcgcggtgatcggcgcgctcgcccaggacgcccgggtgctcggcggcggcagcgcccaggtcgccccgccgcacgtgatctcgccgctggacgggatccgccgggtgttcggcgacgtcgcctacgcggtcggcgccgacccgcgcccgttcctgccggccgcgcagggccccggctggtcggcgttcaccatcgacctgggggcgtaccgcttcgaggtgcccaccgccgcggtccgctggctcggcgacccacccggcgggctcgccgtgccggacgtcacgacgctcgaactgaccaccacgtacaccccggaaatcggcggtgagcacgtcttcgcggtctccggcttcggcacgttccagctgaccgtcggcggtcaggagctctaccggggatcgctgcacccgcccggcaccggccgcgccgacctgctcctgcacccgcgcgaacagcgctttccggtgcgcctagccgccggcgaaccggtccggctgaccctgcggcaaagcttcgcaccagggacggcgcactcggccggcaccaccctcgggcaccgcccgcccggcccggacgcggacggcctgatcgccgaagcggtcgatctggcccgccactgcgacgtggcggtcgtcgtggtcggcaccaccgagcaggtcgaatcggaaggcttcgaccgcacctcgctggccctgcccggccggcaggacgaactggtcgcccgggtcgcggcggccaacccgtccacggtcgtggtggtcaacgccggcgcgccggtgctgctgccctgggccgacgaggtggccgcggtgctgctcacctggttccccgggcaggaggcgggcgccgcgctcgcggcggtgctgagcggcgccgaggaacccggcgggcgactgccgaccacctggccgcggcacgagacggactgcccggtgctgacggtgcagccccgggacggggtggtgacgtacgacgaagggatcttcatcggctatcgcgggtggcgggccgcaccgttgtacgccttcggatccgggtccggatacacgacctgggagtactccgggctgacggcgaccgcgaccgaggtggcggtgacagtgaccaacagcgggcagcgggccgggcgggaggtcgtgcagatctacctgtccgcgcgggacgacggggcggtcgaacggccggagcggtggctggccgggttcgcgtcggtcacggccgacgccggggagcgggtcacggtgcggattccgctgccggagcgggccttccaggtctggacggacgggtggcggacgctgcccgggcgttacacggtcatcgcggcgcacgctctggacgatccccggctgaccgccgagatcgagaaaccgcaggcttga

SEQ ID NO: 1642 - DNA, 1440 bp, Actinoplanes utahensis
atgaaccaccgcaccccgctgttgcgtctggccgtgccgaactatgtggccctgctctccggcgtcctcaccgggatcgtggacgtcgcctgggtggcccggctcggcccgtccccggtcgcagcggtcgccgtcgccaccggcgtggagaacgcgctgctcgggatcgtcctgctgatcagcggcggagtcacggtccgcctcgccgccgccctgggcgccggtgacacgcacaccggccgcgaccgccccggcggcgcgactgccggcggcgcgactgccggcggcgaggccggggcgctcgcggtgatccgcgccgggtggcggctctacctggtgatcacaccggtcgtggtgctggccgggacggctctgcgcggcacgctcgccggcgccttcctcgccgatccgggcgcggcccggctggccggggcctacctggccgtcctgttccccggggtggcgatcttctacgcccagcaggtggtcgacgcgatcttcgcggggcgcggtgacacccgcaccccgatgcgcctcgcgctgaccgcgaacgcgctgatcctggtgctggatccgctgctgatctacggcgcgggcctgggggtcaccggcgccgcgctggccaccgcggccgggcgggcggtggccctgaccgggggcctggtccggctccaccggggacgtcccggcggccggctgcgcccggatgccgccctgccggtccgggcggtggcgcggaccggggcgccgatcgccggggatttcctggtgcggatggccggggcgctggtgctgctcgcggtggtgggccggcacggcgtcgcggccgtcgcggcgtacggcatcggcctgaaggtcctgtatttcgcgaccatgggtttctacgcgatccggaacgcggcgacgatccacacgccgcgcaccctgagcgcccggcccgggcaacgcgccgccatcgggcggcaggtgctcacgctggccctggtcgccggcatcggggcgagtgcgctgttcgccgggttcgctccgctgatcatgcggctgttcaccgcggaccgggcggtggccgccgccggggtgctgttcctgcgctgcgtcggcggctacctggtgccgatcgccgcggtgatcggcctggccggcttcctgatggcggccggccgcggcgcccgcctgttcgccgtcaccgtcgccggcaccgcccttcagacgctgctcgccctgtggctcccggcccggctcggtctgcccggcgtctggctcgcgatggccctggccgccgtgttccagctgctcctggtcctggcctccgcgaacctccgcgaccaccccgccgcggcggccgaaggcggcgggccggtcgggacggaggcggtcaagcctgcggtttctcgatctcggcggtcagccggggatcgtccagagcgtgcgccgcgatga

SEQ ID NO: 1643 - DNA, 525 bp, Actinoplanes utahensis
atgctggcgctcgcgatcctcggcttcctgcacgacgagcccctgcacggctacgagctcaaggaccggatcaggtccctcaccggtcacgtccgcgcggtcagcgacggcgcgctctacccggcgatcaaccgcttgaccgccgccggcctgctggaacgccgtaccgagccgggcacgtcagcagccccgcgccagatgttgtcgctgaccggggccggccgcgccgagctgctgtcccggctgcggtccccgtccgaggtcgagatcaccgaccggaaccgctacttcacgatcctcgcgttcctgcgccatctgccggatccggccgatcaggccgaggtcctgcgtcgccgcctggcgttcctggcggcccccgccacgttcttctcccagggcggcacccgcctgcgcgccgccgatgtcagcgacccgttccgccgggggatgttcgagatagcccgagccacctcgcaagccgaacgcgcctggctcgaacgcaccctcgccaccctgacgccctga

SEQ ID NO: 1644 - DNA, 771 bp, Actinoplanes utahensis
gtggtgcggggcggggcgggcggtagcgttcggggggtgtctgcgccgctgtttctggtcgagaacctgccgtccgggtcgttcttcacgctggacggggcggaggggcatcatgccgcgaccgtgcagcggctccgggccggggagacgctgattctcgccgacgggcggggtgggacggcgttcgccgaggtggtcgccgtgggcaagggcagtgtcgacgtcgccgtgggggagcgggggcaggagccggccgcggcgccgcggctgaccgtggcgcagggcatcgccaagggggatcgcggcgaactggccgtgcaggcgatgaccgaggtcggcgtcgacgagatcctgccgtgggcggcgtcccggtcggtcgcgcagtggcgcggcgatcgggggcacagggcccgggacaagtgggcgtcgaccgcccgggaagcggccaagcaggcccggcgctcctggctgccgctggtgggtggggacccggactgctcgacgaagcagatcggcgcccgcatcggggaggcgtccgcggcgttcgtgctgcacgaggaagccaccgagcggctcagcaccgtcggcctgcccgatgcgggggacatcgtgctggtggtcggcccggaaggtgggatcagcgacgccgaggtgaccgcattccgggacgccggggcacttccggtccgcctcggcagcaccgtcctgcgcacctcgaccgcgggcgtcgccgccctcgccgtcctcgccacccggctgggccgctggtag

SEQ ID NO: 1645 - DNA, 1278 bp, Actinoplanes utahensis
gtgggctcggcgtgctggggccgacccggatggactaccccggcaccatcgctactgttcgtgcagtggcacgctacgttggcgacctgttggcacagaattgacggatccgcgcagacattgaggactccaaaccccgtggccaaggactactacggaattctcggcgtgagccgggaagccaccgacgacgagatcaagcgcgcctaccgcaaactggctcggcaataccatccggacgtcaaccccgatccggaggcacacgagaagttcaaggacatcaacgcggcctacgaggtcctgtccgacgaccagaagcggcagatcgtcgatctcggcggtgacccgctcgcacccggcggcggcatgcccggcggcggacccggcggcgccggcccgttcgtcggcttccaggacatcatggacgcgttcttcggcaccgcggccggcggcggcagccgcggcccgcgcccgcggacccgtcccggcgccgacgcgatcctccgcctcgaactcgacctggtcgagaccgccttcggcgtcgaggccccgatcaccgtcgacaccgcggtgctctgcacccagtgctccggcgccggcaccgcccccggcacccacctggccacctgcgaggtgtgcggcggccgcggtgaggtccagtcggtccagcgcaccttcctcggccaggtcgtctcgtcccgcccctgccagaactgctccggtcacggcacggtcatcccgaccccgtgcccgacctgcgcgggcgacggccgcatccgcacccgccgctcgctcaccgtcaagatcccggccggtgtcgaggacggcatgcggatccgcctggcccagcagggcgaggtcggccccggcggtggcacggccggcgacctctacgtcgagatccacgagcggccgcacgacgtctactcccgcaagggcgacgacctgcactgccgcgtcaccctcccgatgaccgccgcggcgctcggcacccggatgaccatcaagaccctcgacggcgaagagaacatcgaggtcaaagcgggcacccagccggccagcacgctgcggatccgcggcaagggcgtgccacatctgcgcggccaggggcggggcgacctcttcgtccatctggacgtcaagacgccgaccaagctgaccgccgaccaggagcggatgctgcgcgacttcgccaagacgcgcggcgaggacatcgccgagctgagcaagcaggggggcttcttcagccggatgagggatgccttcaacggccattag

SEQ ID NO: 1646 - DNA, 1023 bp, Actinoplanes utahensis
atgagtctggatgaccgcaagctcgaggtgttgcgggcaatcgtcgaggactacgtcaagactcgcgagccggtcggcagcaaagcgctggtcgagcggcatcagctgggcgtctcgtcggccacggtgcgcaacgacatggccgtgctggaggaggagggctacatccggcagccgcacaccagtgccggccgggtccccaccgacgccggctaccggctgttcgtcgaccgcctcacccggatcaagccgctcagcccggccgagcgccgcgcgatcgagcgcttcatggtcggtgccgtcgacctcgacgatgtggtgcaccgcaccgtccggctgctcgccacgctgacccgccaggtcgcggtcgtgcagtatccgagcctgtcccgctcctcggtgcggcacctggagctggtgccgatctccaccacccggctgatgctcgtcatgatcaccgacaccggccgggtcgagcagcgcctcgtcgagatgcccgccccggttccggaaggcgacgtgtgggacctgcgccgccgggtcaacgagaaactcgccggtcagcgcctcgccgacaccccgcccctggtgcagaaactcgtcgaggagtgcgctccggagcgccgcggtgacatggcctgcctggccaccgtgctgctggagactctggtcgaccggagtgaggagcgcctcgcactcgccgggacggccaacctgacccgcggcggtgtgctggactttcagggcacgctgcgccccgttctcgaagcgctggaggaggaggtcatcctgctcaagctgatcggggatctggagcccagcaccacccgggtccggatcggcgacgagaacgagatcgacaacctccggtcggcgtccgtggtcagcaccggttacggaccgggtgccacgatcgttggtgggctcggcgtgctggggccgacccggatggactaccccggcaccatcgctactgttcgtgcagtggcacgctacgttggcgacctgttggcacagaattga

SEQ ID NO: 1647 - DNA, 384 bp, Actinoplanes utahensis
atggcggaaccgaaacagtacggccgacagccgcgacccggctacagcctggagcggaactgggtgatgacggcacacgtcggcggtgccgcgggtgccctcctgggcggcgtggcgggctgggtggcgccgctgctcgccctgctcaaccagggtggccggagtccgacggtgcgggccgcggcggtccaggcgctgaacttccagatcctctggacgatcgtcgcgctggtcggctgggcgacccggtggctcgcggtgggcaccgtcatcgtgccggtcgcggcggccgtggcggtcatcttcggcctgatcgccggcacccgggccctgggtggcgagccgtacgactacccggccaccgcgcggttcatcagggaatga

SEQ ID NO: 1648 - DNA, 1203 bp, Actinoplanes utahensis
atggccggcgcactccccgatggcgaacccgtacccgacgacgggtcgctccccgacgacgccacgcgcgacgtgggcggacggggtttcgccgtctacgtccacgtgccgttctgtgccagccggtgcggatactgcgacttcaacacgtacaccgccagcgagctgggcggcggagccagccgcgacgagtacgccggcaccgtgctgcgcgagctggagctggccgcccgggtgatccggccggcccgggtcgacacggtgttcgtcggcggcgggaccccgaccctgctcagtccggcggacctgggccggatcctggaaggcgtcgaccggacgtgggggctggcggccggtgccgaggtgaccaccgaggcgaaccccgagtcggtggacccggccgggctgcgggcgctgcgggcggccggcttcacccggatctcgctgggcatgcagtcgtcggccgagcacgtgctgcgggtcctcgaccgccggcacaccgcgggccgcgccccggccgccgccgaggaggcccgccgcgccgggttcgagcacgtcaacctggacctgatctacgggaccccgggggagacgccggaggacttcgaccgctcgctgcgcaccgtgatcgacgccggggtggaccacgtcagcgcgtacgccctgatcgtcgaggacggcacccggatggccgggcggatgcgccgcggcgagctgccctacccctcggacgacgtggccgccgaccgctacctggccgccgagcaggcgctcaccgccgccggcttcgggtggtacgaggtgtccaactgggcgcgcccgggcggcaactgccggcacaacgagctgtactggaccggggccgactggtgggggctggggccgggggcgcacagccacgtcggcggggtccgctggtggaacgtcaagcacccgtcggcgtacgccgggcgtttgcaggagggtctttccccggggcacggccgcgaggtgctgaccgccgaggatcggcacgtcgaggatgtgatgctgcgcgtccgcctgcgggagggcatcacgctggcgaaggtcgacgcgaaggccgcgaaacaggcgctggacgacggcctgctcgatccggaggcctacgccgcgggccggttggtgctcaccctgaacgggcggctgctggccgatgcggtgatccgggacgtcattccctga

SEQ ID NO: 1649 - DNA, 777 bp, Actinoplanes utahensis
atggaattggtccgtaccgtcaccgacgccggggtgaccaccctcaccctggacagtcccgccaaccgcaacgcgctgtcccgcgccctgatcacccagctgctggccgcgctcggcgccgcggccgccgcgccgggcacccgggtggtggtgctctcgcacaccggcccggtcttctgctccggcgccgacctcaaggagaccgccgccacccggcccggtgaacgtctgccggtcgagctgatggccgacctgctggccgcgctctgggagttccccaagccggtggtcgcccggatcgccggaccggcccgggccggcgggctgggcctgatcggcgcggccgacatcgcggtctgcgcggaatcggccacgttcgccttcaccgaggtgcgactcggggtgatcccggcggtgatcagcgccaccgtgctgccccggctgtcggcccgggcggcggctgagctctatctcaccggtgacgtcttcgacgggcgccgggccgccgagatcggcctggtcagcgcggcggttccggccgaggcgctggacgacgcggtggccggctactgcgcctcgctgatccgcggcgggccgctcgccctggccggcaccaaacagctgctgcgccgggcgcggtcggagtccatccgggccgaactggctgatctcagtgaccgttcggccggatacttcacctctccggagggccgcgagggggtcgccgcacgtcaggaacgacgggagccgaactgggtcccgacacagcaggaatga

SEQ ID NO: 1650 - DNA, 849 bp, Actinoplanes utahensis
gtgaaagcggtcatcggagtggtcggcgcactcgtcctcatcgccgtggtcagcgtggtcatcgtcctgcaccaggcgcccggggtgatcaaactgccgcgactcgggccggagtgcacggtcagcgccgacggtgaggtcactctcgactcggtgcagatggccaacgcggccaccatcgccgcggtcggcgtccgcaagcagatgcccgagcaggcggtggtggtcgccctcgccaccgccctgcaggagtccaagctggaaaatctcgacgagggcgaccgcgactcggtcggcctgttccagcagcggcccagccagggctggggcaccatcgagcagatcaaggatccccggtacgcggccggcaggttctacaccgccctgaagaaggtgaagggctacgagcagatgcgggtcaccgacgcggcgcagaaggtgcagcgctcggcctacccgaacgcgtacgagaagtgggccgacgagtcccgggtgctgacccgcgcgctgctcggccgggccaccggcgcggtggcctgcacggtgcccggcaccccggtgctgcgcggcgcggccgcggcggccgccctgatggccggcctcaaactcgactggggccggacgctggacgccgccagcgaggaggcagccggcctgaccctgtcggtcagcaacccgaaatccggctggcgatacgcgcactggctggtctcgcacgcctccgcgaccggactcgaacgggtacgtttcggtgacctggagtggcacgccccggacggaaagtggcagcaagtaaccacggccgcggcccgtgacgacggccgggtcgtcgccgaagtcttcaactga

SEQ ID NO: 1651 - DNA, 1674 bp, Actinoplanes utahensis
gtgttctggggagcgctcgaatggatcctgctcggagcgggtggcgtcggcgcgatcatccacggggtgcgccgtcatcgaccggcgcggaaggccccctggtggctgctcgccggctcggtcgccgtgctcgcggcgggtgatgtctgttactcgtatcgacagatgggcacggccgacatcttctacctggtgatgttcggcctgaccgccctctgcctgctgcagttcacccgcggcggcgcgctgctcggcgaccgggcccggctgatcgacctgctcgcgctggcctgctcgaccctgctggtggcctgggtcttcatgatcggcgtggacggccggctggacaccgtctcggcccccgacgtgatcggcgacctgctgctgaccggggtcgccggccggctggtcggcgccgaccggcgcaacgccgcggcctggctgctgctcgccggcgcggccgggatgctcgccggcgacatcggctatccgctggcccgcggcccgctcaccgagtcggcgtacgtggtgctctacctctgctggggcctggccgcgctgcacccgtcgatggtccggctgaccgagccggccccgccccggcacagcccgtggcgattccggtggtcggtgctgctcaccctgtccgcctgcaccccgccggccgtgctgctgatcgaggcgctgcacggggaggtgaaggacggcctggtgatcgcgatcaccggggcgctcaccctgctgctcacgatcacccgactggccgactcgatccggcagaacagccaggcgctcagccgggaacacgcgctgcgcaccgcgaccgcggccctggtcgcggccgccgaccggccggccgtcgacgccgcggtgcgggccgcggtgatccagctgctgcccccggccgcgatacgccgggtctcgctcgccgacgaactcggccccaccgagctgccgatcggcggcgccgaaccggccaccggcccatccggccgcgccgaaccgaccgccggccccgcggaccgcggctggtggctgccggccgccgaccccgacgaccggaccctggtctgcccgctgcggctggaacctctcgacgtggcccggcccagcggcggcgcgctggtcctcaccggccggcgggaggacctcatcgccggccgcgacgcgctggaagtgctggccgggcaggccgcgctggccctggaccggatcaccctggtcgaggcggtcggccgccgggacagtgacctctacctgcgcgcggtgatccgcaacaccgccgacctgatggcggtgatcgacgccgaccagcggatccggtacgcgagcccggcgctgcgccacctgctcgggcaggacgagctgcccccgctggccaccctggacgagctgatccacccgtgcgaccgggcccgggtgcgcggcgagctgcggtcgcagggcgacggcacgatccactgcgcgttgcagcgcgacgaccagagtcaggtgctggtcgagctgacctaccgggatctgcgcgacgaccggctggtccaggggctggtgctgaccctgcgggacatcaccggcaatcacgacccggtcgaacgccatccgtacgccgagcccgggggcgacctcccggcctgggtcaatcgccgatccgcacggcaacgtttccgttattga

SEQ ID NO: 1652 - DNA, 276 bp, Actinoplanes utahensis
atgaccgtcaccggcatcatcaccgcccttatcgtcggtctgatcatcggtgctctgggtcgcctggtcgtacccggcaagcagaacatcccgatctggctgaccatggtcatcggtgtggtcgcggcgctgctgggcaccgtgctggcccgggccttcggtgtcgccgacaccaagggcttcgactggatcgagttcttcttccaggtcgtgctggccgcggtcggtgtcgccctcaccgtgggtatcaccggtcgccgtggcctgacccgataa

SEQ ID NO: 1653 - DNA, 1878 bp, Actinoplanes utahensis
gtgcctggaccgctcgaccccggcgtgaacgtgatcggatcgaccgatcccagccgcatccgcaacttctgcatcatcgcccacatcgaccacgggaagtcgacgctggccgaccggatgctgcagatcaccggggtggtcgacccacgtcagatgcgcgcccagtacctggaccggatggacatcgagcgcgaacgcggcatcaccatcaagtcgcaggccgtgcggatgccctggacggtccgggccggggacaagcagggcgagaccgccgtcctcaacatgatcgacactccgggtcacgtggacttcacctacgaggtctcgcgcagcctggccgcctgtgagggcgccgttctgctggtcgacgccgcgcaggggatcgaggcgcagaccctcgccaacctgtatctggcgatggagaacgacctgcacatcatcccggtgctcaacaagatcgacctgccggccgcgcagccggagaagtatgccgaggagctggcgaagctgatcggcgtggagcccggcgacgtgttgcgcgtctccggcaagaccggagtgggcgtggaccatctgctggacgagatcgtccggcagttccaggccccggtcggtgacgcgaccgcgccggcccgcgcgatgatcttcgactcggtctacgacgtctatcgcggcgtggtgacctacgtccgggtgatcgacgggcggatcgaggcccgcgaccggatcaagatgatgtccaccggcgccgtgcacgagctgctcgagatcggcgtggtctcgccggagatggagaaggccggcgccctcggggtcggcgaggtgggttacctgatcaccggtgtgaaggatgtccgccagtcccgggtcggcgacacggtgaccggcaacaaccggccggccaaggacgctctgggcggctacaaggacccgaagccgatggtctactcgggtctctacccgatcgacggctccgactacccggcgctgcgtgacgcactcgacaagctcaagctcaacgacgccgcgctcacctacgagccggagacgtcggccgcgctcggcttcgggttccgggtcggctacctgggcctgctgcacctggagatcatcggggagcgcctggagcgcgagttcggcctggatctgatctccaccgcgccgaacgtggtctaccaggtggtcaccgaggacgcgaaggagcagacggtcaccaacccgagcgagttcccggccggcaagatcgccgagatccacgagccggtggtgcgcgccacggtcctggtgcccaacgagtacgtcggggccgtcatggagctctgccagagccgtcgtggcgccctgctcggcatggagtacctgtcctccgaacgtgtggagctgcggtacaccctgccgctcgccgagatcatcttcgacttcttcgaccagttgaagagcaagaccaagggctacgcctcgctcgactacgagccgtccggtgagcaggtggccgacctggtcaaggtcgacatcctgttgcacggtgagccggtcgacgcgttcagcgccatcgtgcacaaggacaaggcgtacagctacggcacgacgatcgcggccaagctgcagaaactcatcccgcgccagcagttcgaggtgccgatccaggcggccatcggctcccggatcatcgcccgcgagacgatccgggcgatccgcaaggacgtgctcgcgaagtgctacggcggtgacatcagccgtaagcgcaagctgctggagaagcagaaggaaggcaagaagcggatgaagatggtgggccgggtcgaggtgccgcaggaggccttcatcgccgccctttccaccaccgaggcggctgatccaaaagggaccaaaaaatag

SEQ ID NO: 1654 - DNA, 279 bp, Actinoplanes utahensis
gtggaggcggtggccgcggcgctgcggcgggatcgcgagcacgacggtgcggatccgcgggcggcgatcgtcgtggccgggctgcggaatccgtgtgcgcagatcgaccggttccggagcgggctgctcaagcaggtcctcggccgggacgacgccgggaacgtggtccgccgggccggggtgatggccgtggtgctgcgtggtggggtgatccggcccggggatccggttgtggccgagcctccgccgggagtcaccggcccgctcgaacgggtgtga

SEQ ID NO: 1655 - DNA, 372 bp, Actinoplanes utahensis
gtgattagccagactcagggcatgagtggtgattcagcgacagttgccgcggtcagccggaacgatgcctacacgttcacgaagccgaaccgggacgagatcgtcctggtcgagggctggggcgtggagggggacatccacgccggggtcaacgtgcggcatcggagccgggtggcggccgatccgagccagccgaacctgcgccaggtccacctgatccaggccgagctgttcgacgaggtggcggggaagggtttcgacgtgccggccggcggcatcggcgagaacgtgacgacccgcgggatcgacctgctcgccctgccgcgcggcacgatcctgcgcttcggcccggcgccggcgggcgcgccctag

SEQ ID NO: 1656 - DNA, 534 bp, Actinoplanes utahensis
atgcgaaccgacgatttctgggcggtcatcgaccgcgcgaccaccgatcggccggcgtcccccgccgtggtggccgagcgtgccgtcgccgagctggccacgcacgatccggaggagatcgtcgcctgggggcgtcacctcgacaaggtgatggccgcctccggcacggaggatctctgggccgcggcctatctgatcaacagcggggccgacgaggccgggttcgacgcgttccggggctggctgatcgcccacgggcgcaaggcggtcgccgccgccgtgcagcgtcccgacgtgctggccaacgtcgaggtgatcaaggccgccgcggattccggcgcggtcttcgaggccgaggaggtgctcggcatcgcggcccgggcctatgagcaggccaccggggagccgttgccggccgaggagcggccccggatccgtcccgcggtcgacgacctgtgggacttcgacaacgaggacgagatgcgccgccgtctgccgaagctgtcggcgctgttcctggagccaccggactga

SEQ ID NO: 1657 - DNA, 1032 bp, Actinoplanes utahensis
atgcggccgatcactctgcccgacgttccgtacagcgctaccgccgtacgcccgcaatggcatgaactgccggagaccgtgcgggaagcgatcaccgagcgcctcggctcgccgatcgtcgccgcgcgcagcgcaggcggcggtttcacccgtgccttcgccgccgtgctcgacaccgaggccgggaccggcgctttcgtcaaggcagcgccgttgagcgagcccacttcgcagtggtacgcccgggaggccgccgtcacgtccgccctcccgccggaggtcaccgcggcccgcccgatcgcgatgctgaccgtttctgactggttcgtgctgtgcctggaggcggtcgacggccggatcccggagctgccctggacccggccggacctggacgccgcactgcgcacctggtcggccgcggcgaccgctttggcctacccgtccccggccctgctcgccgtcggcctgccccgcctgccggacattctgcgcgacgagatgtcctggtggtcgctgatcgcgaaacgccgggagccgatgccggagccggcccgcgacaccatcgcgccggcccgcctagcggacctcgccaggctcgaacgcgccctgcccgacctggccgcgggcgaccacctgctgcacggcgacctgcgcctggacaacgtgctgatcgaccgggacggccgggcctggctctgcgactggacctggccgtgcctcggcgcaccctggttcgacacggtgacgttgctggtcagcgcctacgccagcggcgcggacacggatgcggtgctgcgcgcctggggcgccccggacgacggggtggacggggcgctggccgccctcgccggatactggctggtccgggccggcggcgggccgagcagcgcctccccgcacagccgccagcaccagcggttcagtggccgggccgcgctcgcctggctcgccgaacgccgcggctggtccgccaccccgcccagcactccggggcggcccgccccggagaagcgcggctggcttcgccgctga

SEQ ID NO: 1658 - DNA, 267 bp, Actinoplanes utahensis
gtggcgaacatcaagtcccagatcaagcgcaaccggcagaacgagaaggcccgtctgcgcaacaagtcggtcaagtcttcgctgaagaccgtgatccgcaagctccacgaggcgagcgacgcgggcaacgtcgagacggcgaccactctgctgcgtgacgcctcgcgtcagctcgacaaggctgtcagcaagggcgtcatccacaagaaccaggcggccaaccgcaagtcggccatcgccaagaagatcgcctcgctgtccgcctga

SEQ ID NO: 1659 - DNA, 981 bp, Actinoplanes utahensis
atgacccgtaccgtccgttcccggcggaccggggcggcgcaccagccgctctacgcccggatgctgggtctgcgccacctcagccccggcggcctgctctgcttcgtgttcctcgaaggcgcgatcgcgctcggtgtactgctcgcgctggccgaactggtcagctggtggggtgtgctggtgctgccgatggtggtggcggcgatggtcaagttcaacgatgtggtggccggctggttgtccccgcccgcatcggccgccgagccggtggcggcgcgggccgcggttcagcgtgcggaacgccacacccatcggccgcagaccgccgggcatgcgccggaatggccgccggtccgggtccggaccccggtggcgccgccgccggtggacgcccggccgaccggggtggtctggtttccgccggagaacgggtacgggcgtcggcctgtcggagctccgcccgccgggccgggcgtcaactccgggggcggcccgggctccgctccgtggaacggtccgggtggcggttcgggctccgctccgtggaacggtccgggtggcggttcgggtcccgggtcttggaacggtccggacggtggttcggatgccgggaggtggaacgggccgagcgctgacccgggggctggttcctcgtccgggcgcaatgcctcgtccgcgggtgctccgcacgccggtcggcatgggccggccggcccgttcgcgccgcgcggccagggtggtccgggagaaccggttctggcgccggggtcggggcggcccggggcggtcggttccgcgatctcggacgggggtgcggcgggatacggagccggagtcccggacgggcgcttcgcggagggcggacacggccggcacggaggcccggcggtcaacaccgcgccggtgcggcgcgcgcggaccgacgatgtcggcgtccgtcagcagatggcccggcagtcagcggtacgccggtacgaatag

SEQ ID NO: 1660 - DNA, 984 bp, Actinoplanes utahensis
atgtccgacgtgaacgccgcgccaccaccctcgttgctgctcgtccaaggcgatgaggagctactcgccgcccgtgccgtcgccgcggcggtggcggaggcgcgcgtcgccgagccgggcgcggacgtccgggagtatgaggccggccagctcagccccggtgagatcgccgagatgctgagcccctcgctgttcggcgggcgccgcgtgctggtcctgcgcaacggtcaggacgcgcggaaggagctggccgccgcgctgctggcctatgcgaagaatccggatcccgacgtcaccctgatcgtgacgcatcccggcgcggccaaaggcaaggcgttcgccgacgggctgcagaaagccggcgccaccgtcgtgccggcgatgaagctgaaaaacgaccgggaacggatcgcgttcgtccgcgacgagttccgccgggccggcggccggtgcgacgaggctgccgcgtcggccctgctggcctcggtcggcaacgatctgcgggagatcgccgcggcctgctcgcagctgctcgccgacaccgacggcaaggtcaccgaggcggtcgtcgcgcggtactacaaaggccgggccgaggtcagcgggttcacggtggccgacgcggcgatgatcggcgatctgcccggcgccctcgaagcgctgcgctgggcgctgcacgtcggggtcgacccggtgcccatcgcggacgcgctggccgacggcgtccgcaccgtggcccgggtcgcctcagccggcaaaggcaacccctaccagctggccagcacgctcggcatgccggcgtggaagattcagcgggcccaggaacgcagccgcggctggaccccggacggcctggtcgacgcgatgcgcgccgccgccgactgcaacgcggccgtcaagggcggcgccgaggaccgcggctacgcactggaacaggcgatcttcgcggtggccgccgcccgccggggcgaggccgtccgatga

SEQ ID NO: 1661 - DNA, 2667 bp, Actinoplanes utahensis
atgacagcgccaccggccgacggctcgccgcccaccccggacggcccgttgccgcgatccggaagcccgcagtcccgctccggcggttcgctgccgcccttcagcgggacgcgtccgtcccccggcagcgcccacccgccctccggccgtccgcggcctgcggtccatccgtcgcggtctcccggtcgtctgtcgccgcactcggctgatggagccgggtccgccggggcggcggtgccggctggtggcgccgcgtcgaccggtggaaaggcggtcggaggccggcgtgggcggggtgtgccggatctgcggctgggtgggttcatggcgggggtctggctggcggcgctgggggcgttgcatctgccggcgcggggtgggttgctcgtcggcggggtggcgctgctggtggccgggacctgcgcgctggccggggcgatctggtggacggaggcgggagggcgggcaccggggagggggagagcggagatcggccctgcgctcggttggatcgtgatcgccctcgcgctgggcgccggctgcggggccgtggcgaccgcggcccggctcagtgtgcgggaggcgcgcccgctggccggcctgatcgcgtccggcgagccggtcgaggtgcgggcggtggtccgggacgacccgcgggcgttgcgtggggcggcgggaccaccgacgtatctgctggccgtcgatctggaaacggtccgtgtcgtcgggagcgggatgacgatgcggctgtccgcgcgggcgctggtgctgggcagcgatccggggtggcggggcctgctgcccgggcaggaggtgaccgcggccgggaaactgctgccgccccggcccggtgatctgcgggcggcggtcgtcgcggtgcgccgagcaccgcgcctgatcggtgagccgtcgtgggcgcagcgggccgcgggcgtgctccgggccgggctgcagcgggcctgcgcgccgcttccggccgactccggcggtctgctgcccggcctggtcgtcggtgacaccagccggctcgacccggggctcgaaaccgacttccagacagccggcatgacgcacctcaccgccgtctccggtgccaatgtcgcgatgatcctgggggtggtgcttttcgcggtacgccgtacccgggcgggaccggtgctctgcgcagccgtgtgcggggtggcgctggccggcttcgtgattctggcgcggccgtcgccgagtgtggtgcgtgccgccgcgatgggcgcgatcgggctgctcgggctcgcctccggccggccccgggtggcggtgcccgcgctggccgcggcggtcgcggtgctgctgctggccgatccggagctcgccgcggatcccgggttcacgctgtccgtgctggccaccggaggtctgctgctgctcgcgccggcctggcgggaggcgctgcgggcccggggctggccggccggcgccgccgaagccctggccgtcccggcggccgcccaggtggcctgcggtccggtgatcgccgggctgtccgggacggtcagcctggtcgcggtgccggcgaacctgatggtggtgcccgccatcgccccggccacgctgctcggggtggccgcggcgctgctgtcgccggtgtggccggccggcgccgggttcgccgcctggctcgcgcactggccggccgagtggctggtgctggtcgcccggaccggggcgcgggtgccggccggcgcactgccctggccggccggggtgccgggggcgttgctgctggccgggctcacggtggcgttcctgatcgcggcgcggcgggccgtggtccggaggctggccgccgtggtcgcggcgtgcgcggtgctcggcgcgttgccggtccgcctgctcgcccccggctggccgccaccgcactggctggtcgtggcctgttcggtcgggcagggcgacgccgtggtgctgccggccggcacgggccgggcggtggtggtcgacgccgggcccgacccggatccggtcgaccgctgcctgcgccggctgggggtccggcaggtggcgctcttcgtggtcagtcactatcacgcggatcacgtcggcggggtggacggggtgttccgcgggcgggcggtggcagcggtggtggcgccggactggccggagccggcgggtgggcggcggcaggtcgcggaggcggcgcgggcgggcggaacgccggtgctgacggtcggacccggttgggcgtacgaggtgggcggcgtgcggctggtcgcgctcgggccggtggagccgttgcgcgggacgaactccgatccgaacaacaactcgctggtgctgcgggcgaccctgggcggccggaccgtgctgctccccggggacgccgagaccgaggagcagaacgacctggtggcgcgggtgggcgcggccggactgcgggcggacgtgctcaaggtggcgcatcacgggagtgcgctgcagtcaccggagctgctgacggcggtcgatccggcggtggcgctggtgtcggtgggggtgggcaacgactacgggcacccgaatctgtcgctgctggcgcggctggcccgggacggggcgcgggtgatgcgtacggacgaatcgggggaccttgcggtggtcacgcaggttggtgggcttgcggtcacggcgcgtggggtgaacgacaggtag

SEQ ID NO: 1662 - DNA, 882 bp, Actinoplanes utahensis
gtgggagcgccctcctcgtcggtgccgcccttcatgtcagctccgcctgccgaggcgccgttcgacgaacggtattcgtggactgccgaggagcctccggtcgccgccgagccggggctgcccggcgccggggcgttcggggcggacgagagcggcccgcggcgctggctgaacgccttcgaccccggccggccgggagtgcgcgcgctcttcgcggtggcggtgatggtcctgctgatcgcgggattcctcgcctggcgggcgcggccacgggtggacccggtcggagccggctcgggcgggccggggacgggcgttgcgggcaccaccggttccggcaggtccagcggctccggggtcagcggttccggatccggaggtgccaggcccgattccggtgccggttccggcgctgcggtcggtcctggcggcatgaccggcgcggcggcggaagtggtcgtggcggtcggcggcaaggtgcgcagaccgggtctggtccggctggcgcccggttcccgggtggctgacgccctggccgcggccggcggcgcggagcccggggtcgacgtggcagccctcaacctcgcccgcaaggtcaccgacggcgaactgatcatggtgggggtgagtccgccacccggcgcggcggcgaccgcgggcaccggcccggccgcctccggaacggccggcgggctgatcaacctgaacacggccactctcgccgacctggacaccctgcccggggtcggcccggtgctggcccagcggatcctggacgcacggacggcccagggcggcttccgcgcggtcagcgacctgcgcaaggtggacgggatcggggatgcccgctacgaccagctcaaagagctggtgacggtatga

SEQ ID NO: 1663 - DNA, 777 bp, Actinoplanes utahensis
gtgaccaggaacgaggcgatcagcctgctgcgcgccgcgggttgtgtcttcgccgaggaggaggccgcggtcctgttcgaggccgccccggatgacgcgacgcgccgcgcgctggtcggccgccgctgcggcggggagccgttggagcaggtcgtcggctacgccgatttctgcggcgtccgcgtccatctccgcccgggcgtcttcgtcccccgggtccgtagcgaactgttggtccgcaccgccgcgtcggaggcaacgaccagggccggcgatgaccacccaggcccgctggtggtcgacctctgctgcggctccggcgccctcgggctggcgctccgcaccgtcgtaccgcgcatagacctgcacgccgccgacctggaccccgtcgccgtcgcctgcgcccggcacaacctggggcagaacgtccatcagggcgaccttttcaccgctctgcccgcccggctccgcggccggatcgagatcctgatcgccaacgtcccctacgtcgccaccccccacctcccgtttctccccgccgaggcccgcgaccacgagccccgcaccgcgctggacggcggcgacgacggtctcgccgtcttccgtgccgtcgtcgccggcgcccgttcctggctggccccgggcggcctgctgctttccgagatcaccgaggcgcagaccgccccggcggccgccgtcgtcgccgggtacggattgacgcccgacgtcatcaccgacgatgatctcgacgcccgtgtgatcaccgcgagacgatag

SEQ ID NO: 1664 - DNA, 1035 bp, Actinoplanes utahensis
gtggggctcttccgcagggtcgcccgcgcccggctggccagaagggtcatccggcggctgcggcgtgccggtgtccggggcgcgcgctatcaccgggccggtttcgaggtgcggttcaccctgccgggcgagccggagccgacgattctgccgctggccgctctggccggccgcaagcggcgcgaggtgcgcgaccacgtggcgggcatcctgcgtaccgccgatctcccgttacggtgggcggacgccgcgccgctgctgcggccggttcttcgcggcggcgcgccgggcgcgccgttgcaccgcccggcgttgcccttcctgtccgagttcgtcgtggtcgatcatccggacaccatgacgtacgtctccccggcccaactggcggcgtgggaggtgaccgccgaggccgtcttcgccaccgcccgggcgaaccttccgggcgcgtcgctgcacggcgccccgtccggccgcccggtcgtggtccggttcgtcgacgacggcaatgcctactggacgtcgcatctgctgctgcccggctggctgtcccggctcagcggccaggtcggcggggttccggtggcgttcgccccggagcgcggcaccctcctggtcaccgcggacggcaccgagctgctgccggccctgttcgcgcaggcggaggagatcttcgcgaggtcgtcacggtcgctgaccccgatggcctatgtcagcgatccggatggctgcacggtcccgtatccggcgccgccggggcacccgttgcacgcggtggtggcgcgcgccgagcggatcctggcggtcgaggagtattcccggcaggcggccgggctgcccggcgccgcggagatcgagctggccggtgagcggacccgggcgttgtggccacggaacaccccggtgctgctgccgacggccgacgaggtgcgactcggcgaccgggtggtgccctgggcggacctggcgttgaccccggtggagggtctgagcccggcgcgctggcgtgccgagggctggccggagggggcgggctag

SEQ ID NO: 1665 - DNA, 849 bp, Actinoplanes utahensis
atgaccatcgcggtcgtcaccgactccacggcctatctgcccgccgagctgaacgggcggtacgacctcaccatcgtgccgctcaccgtcgtgatcaacggctgggacggcctggaagggctggagatctccccggccgaggtggcccgggccctcggtggccggcgcagctcggtcagcacctcccggcccgccccgtcccagttcgccgaggtctaccgggagctcctggccggtggcgccgacggcgtcgtctcggtgcacctgtccgccaaactttccggcacctatgaggccgcccagctcgccgcggccgaggtcggctcccgggtcatggtggtggacagcgggaccgcggcgatggggctcggcttcccggcgctcgccgcgaccacggccgccgcccaggggcacgacctggagacggtccaccggatcacggtcgagcacgcggcccgggtcagcaccctgttctacgtcgacaccctggaattcctgcggcgcggcggccggatcggggcggcctccgcgctgctcggcaccgcgctgtcggtcaaaccgatcctgcatgtcgtcgacggggcggtcgtcgtacgggacaaggtccgcaccgcggggcgggcactgagccggctcgtcgacctcgcggtggaggcggccgggccgggcgaggcggacatcgcggtgcaccacctgcaaacccccgaacgcgcgtcggcgctggtggacgcgatcaccatgcggctgggcgaccggctgcgggactgctacctgaccgaggtgggcgcggtggtggcggcacacaccgggccgggactggccggtgtggtggtgcaccgccgggactag

SEQ ID NO: 1666 - DNA, 414 bp, Actinoplanes utahensis
gtggcaactcctggcgtacaacgtgggcgtgcgctagcggaaccgtccgcggtccggagacgtcccatcggcatgatccgacgaaacctcctgccggcgacgctgctgctggcgatcgccggttgcgcacagccggcgcagaccgggcagccgggtgccggcacgccgtcctccccggcgccggtccccgggaacaccgcggcggggaccacgatcagcgggacggtcgccgtgggcaccgagcccggctgcctgctcctgcagaaccacctgctgatcatcagcgacccggagcagcgcaagcagctcaccgaggggagcagggtgcgggtgaccggggtgccccagcccgggctgatgaccacctgccagcagggggagccgttcgcggtctcctcggtcacgccgggctga

SEQ ID NO: 1667 - DNA, 678 bp, Actinoplanes utahensis
gtggaaggactgcccgaccattccgttcgtcgaccgggacatggtcgacgcgggcgcggccggcaccgacaccccgtgacccgcctgatcgtctggcggcacggcaacaccgactggaacgcggagcgccgcgtgcagggacaggccgacgtgccgctcaacgacctcggccgccggcaggccgccgaggccgcggcggtcctggccgagcggcagccggcggcgatcgtcgccagcgacctgacccgggcggcgtcgacggcggcggccctgtccgcggtcaccggactgagcgtcagccacgacgagcggctgcgggagcggttcttcggcgagtggcaggggctgaccaccgccgaggtggcgtcgcggcggccggcggagttcgcacgctggaaagccggggcggacgtcgtcggtggcggtgtggagaccctcgacgacctgggcaagcgggtcagcgacgcgctgcatgacgcggccgcgctcgcccccggtgagacggtcgtggtggccacccacggggcggccgcccggcagggcgtcggtcagctgctcggctggccgcgcgaacaggtgcggacgctgcgcggcctgcacaactgtcactggttcgagctgacccacgaggaggggccggggtggcaactcctggcgtacaacgtgggcgtgcgctag

SEQ ID NO: 1668 - DNA, 405 bp, Actinoplanes utahensis
ttgcccgtcaccgaacgcgccctggaactggcgatgacggccgctcaggccgccgccgacaagaaggcgcaggacatctccgtcatcgatgtcgccgaccagctctacatcaccgacgccttcgtgatcgcctcggcggccaacgagcgccaggtgatcgcgatcgtcgacgccatcgaggaagcgctggtcaacctgccggagaaggcgaagcccgcccggcgcgagggcgagcgccagggccgctgggtgctgctggactacgtcgacatcgtggtccacgtgcagcacgccgaggagcgcgagttctacgccctggacaagctgtggaaggactgcccgaccattccgttcgtcgaccgggacatggtcgacgcgggcgcggccggcaccgacaccccgtga

SEQ ID NO: 1669 - DNA, 606 bp, Actinoplanes utahensis
atgtcagcacggcggatcgggatcatgggtggcacgttcgaccccatccatcacggccacctggtcgcggcgagcgaggtgcaggcccgcttcgagcttgacgaggtgacgttcgtcccgaccgggcagccgtacgagaagggccgggtctcgcccgccgaggaccgctacctgatgaccgtgatcgccaccgcgtccaacccgcgtttccacgtgagccgggccgacatggaccgggacgggcccacctacaccgtcgacacgctgcgcgacatgcgggccgtctacggccagtcggccgagctgtacttcatcaccggcgccgacgcgctggcccggatcatgtcgtggcgcgacgcgctgaccatgctgggtctcgcgcacttcatcggggtgacccggcccggcttcgagctgagcgcggcgaacctgccggccgaccgcgtgacactggtcgaggtccccgcgatggccatctcgtccagcgactgccgccagcgggtcgcgtccggctcgccggtctggtacctggtgccggacggtgtcgttcagtacatcaacaagcggggcctctatctggactcggggaatgtcggacccgcgtga

SEQ ID NO: 1670 - DNA, 1503 bp, Actinoplanes utahensis
gtggaatggtccgctgaattgtccagcggcctgctacaggccgcaccggacgcgatcctggtcttcgacggcctgcggatcgccctggtcaacgaccgggccgggcaactctacggctggcccaccaccgagctggtcggccagtccctggaggtgctgctcaccgaggagtcacgggcgctggtgcgccggcggcaacaggtgatcgacacctcgccgcccggctcgatcggcaccgtgaccaccaccgcccggcgccgggacggcaccgaattcccggtcgagtcgtccaccaccatcgtcgagacgccgcagggccggctcgccgtcgccgtggtccgcgacctcaccgagcggatccgggtggaccaggagaaggcgcggctgcgggccgaggcacacgcccaccgcagccagcgcctggaaagcctgggccagctggccggcgggatcgcgcacgacttcaacaacatgctcggcgtgatcctcaactacgccaacttcgtgatcgaggaggccgagtccccgcaacccgacctcaaggcgatcgccgccgacgcccagcaggtggtccgggccggcacccgcggcaccgacctgacccaccagttgctcgccttcgcccggcgcgaggtggtccggccgcagccgctcgacctcaacacggtgctgaccgaggtcgaggatctgctgcgccgcaccctgggcgagcacgtcacgctgatcgtccggcccggccccgatctgccgtcgatcaccttcgaccccgggcagatcgagcagatcctggtcaacctggcggtcaacgcccgggacgcgatgccgtccggcggcaacctggtgatcgacacgcaccgcctcggcgaccgggtccggctgcgggtctgcgactccggccgcgggatgaccccggacgtgctcgaccgcgccttcgacccgttcttcaccaccaaacccaagggtgaggccagcggactgggcctggccaccgtgtacggcgtggtcgcccaggccggcggcgaggtcagcctgaccagcgagcccggcctgggcaccacggtcaccgtgctgctgccggccggcgaggagaacgctccggccgcggagaccgccgaaccggccgtcacccgtggcaacggcgagacggtgctggtcgccgacgacgaggacgggctgcgcgacgtcgccggccggatcctcaccgcggccggctaccgggtgctcaccgcggactgcggccggcaggcactggacctggccgccgagcacaccggcgagatcgacctgctgctcagcgacgtggtgatgcccgggatgctgggcaaggagctggccgagcggctgaccgacgcgcggccctcgacccgggtgctgtacatgtccgggtacgcgcagccggtgctcgcctcacagggcaccctggacccgggcgtcgagctgctggagaagccgttcacctcgaacgacctgctcgccgccgtccgcaaacggctggacggctga

SEQ ID NO: 1671 - DNA, 2505 bp, Actinoplanes utahensis
atgattgtcgtcatgccgaccctgacccgcgccgaggccgccgaccgggcgtccctcgtcgacgtcgagagctaccacgtcgacctggacctcaccggggacggtgagaccttccgcgccgtcaccgtcgtccgtttccgggcccgcgccggcgccgccaccttcctggagttcgagccggtcgcgatcgcgtcgatcacgctgaacggggccccggtgccgatcgccgcggccggcggcgggcggctcgcgctgaccggcctggccgaggagaacgtgctggtcaccgacgccaccatgggctattcgaacagcggcgagggactgcaccggtacaccgatccggcggacggctcggtctacctctaccagcacctgttcatcaacaacggcggccgggtgctgccctgcttcgaccagcccgacctgaaggcgtcgttccgggtcagcgtcaccgccccggccgcctggacggtggccaccaacgggcggctggtcagccgggacggcggtcgctgggagttcgcgtcgaccgagcggatcgccacctacctcgcctcgctgatcgccggtccctggcacgcgcgcaccgacgagcacgacggcatcccgctggcgctgtacgtgcgggccaccctcgccgatcagctcgacgcgcaggccccggagatcttcgaggtcaccaagcggtgcctcgaccggtatcacgagatgttcgagatccgctatccgttcgggcactaccagcaggccttcgcgccggagttcaacttcggcgcgatggagtacccggggctggtggtgttccgcgacgagtacatcccgcgctccgcgatgaccgagtccgagcgggagtaccgggccagcgtgatcgcccacgagatggcccaccagtggttcggcgacctggtcaccatggcctggtgggacgacctgtggctgaacgagtcgttcgccgagtacctgggctcccgggtggcggccgaggcgacccggttcaccggcacctggaccaccttcgccatgcaccgcaaggcctggggcctgcgcgccgaccagcggccctcgacccatccggtggcaccgtccgaggtgaccgacaccgatcaggcgctgatgaacttcgacggcatctcgtacgccaagggtgcctcggtgctcaagcagctggtcgcgtggctcggcgacgaggcgttcctggccgggctgaacgcgcacttcgaggcgcaccggttcggcaacgccacactcgccgacctgctcggcgcgttgagcaagggcagcggccgggacctgtccggctgggccgagctgtggctgcgccgggcccaggtgaacacgctgcgcgtcgaggtgacccgggacggcgccgcctaccgcgaggtcgcggtgctgcagaccgcgccggacgacttcccgacgctgcgtccgcaccggatcgggatcggcctctacgaccacgcgccggacggcaccgtgacccgccgcgagctgatcgaggtggagctggaggccaccgggcgcaccgtgctgcccgcgctggccggggtgcgcgccgccgacctgctgctgctcaacgacggcgacctggcgtacgcgaagatccggttggacgacgcctcggcggccgccgtcccgctgctgctgccgctgatcaccgactcgctcgcgcgcgcggtgatctgggccggcacgctggacgccgtggtcgacggcgaacgcccggtcgccgagctggtcacgctggtgctggccgcgctgccggtggagaccgagacggtgatcgtcgaggacgtgctgcgcgccacccggggcctggtcgaccgctacgccaccgcggagacccgcccggccgcgtgcgagatgatcgcccaggccgccgaccgcctgctcgccgggtccgcgccgggcagctcccgccagctggtggcggcccgcgggctgatcggcgccggcatcgacaccgctcggctgcgcggctggctgaccggcgccggcgtgccggccggcctggtcgtcgacgccgacctgcgctggctgatcgtctaccggctcgccgtgctcggtgcggccgggccggacgtgatcgaggccgagctggccgccgaccggaccgtcggcggcgagcagtgggcggcccggtgccgggccgcgctgcccgaccccgccgccaagcgggcggcctggagcgccgtggtcggcgacgccggcctgtccaaccggatggccgagctcaccgcgctcggcttctggcagcccgagcagcgcgagctgctggagccgtacgtcgagcgatacttcaccgacatgccggagatgatgcggatccgctccgggatggcggccgagaaggcggcgatcgcggcgtacccggcggtgatggtcgccgagcggacccggcggctggccgccgggctgctggcccggccggacctgcacccgctgctgcgccgggtggtgcaggaccacgacgacgacatgcgacgcgccctgcaggcctgctga

SEQ ID NO: 1672 - DNA, 990 bp, Actinoplanes utahensis
atgacgaccaccgtgaccgccgcgcccgcctcgacccgccgcctcagcggttttcaaccgaccggccacctgcacctgggcaacctgctgggcgcgctgcgcccgctgatcgcggcgcagggcgccgcggagtcgatcgccctcatcgccgatctccacgcgatgaccgtcgaccacgaccccggggaggtacgtcgtttcacgctggagcaggtgagcgtcctgctcgccgcgggtgtcgacccggaacgcaccccgatcgtgctgcagtcgcaggtgcgcgagcacactgagctgcactatctgctggaatgtgcggccgcgtacggcgaggcggcccggatgatccagttccgggagaagtcggcggccggcggcccggtccggctcagcctgctcacctatccggtgctgatggccgccgacatcctgctctacgacgtcacgcaggtgccggtgggcgaggatcagaaccagcacctggagctggcccgcacgctcgccaccaggttcaacagccgctacggcgcgaccttcacggtgcccgagggggtgcgtccggacgccacggcccgggtgatggacctggccgagccgactacgaagatgggcaagaccaccggaaccggacggatcggactgctggactcccccgacgtgatccgccggaccatcgcgcgggccgccaccgacacgctcggcgtggtccgccgggaccgcgaggcgcagcccggggtgaccaacctgatcgacatcctggccgggatcaccggcgcgcggccgtccgacgccacctcctacgccgccctgaaacgcgaggtcaccgaggcggtgatcgccctgctcgcgccgttgcaggcgcggcaccgagagcttcaggcacatcccgatttcgtacgaggggtgctcacggccggcgccgagcgggtgcggccgatcgccgccgccacggtcagccgggcacgccaagcaatcggactattggactaa

SEQ ID NO: 1673 - DNA, 450 bp, Actinoplanes utahensis
gtgctgatcgaatcgcgtcccgccctggaccccgaactcgccgccctcgtcactgctcagcagcgcgaactggccgggtccgccaccggcgcgggcaagatgttcgagccgcacgacgacgtggcgtatctgatcggcgtggtcaacagccgtgcggtcgcgtgtgccgcctggcgcgccctggaggacggcgtcgccgagctgatgcggatgtacgtccgcccggctcaccgcggtcgcggactggcccgggagatgatcgtggcggtcgaggaggagacgctcgcggccggccgcccggtgatccgtctggagaccggtgttcacctgccggccgcgatcgccctctaccagtcctccggttaccggcagatccccgccttcgggcactatgccggcaacccggggagcgtgtgtttcgagaagaagctgcctgccttagtccaatag

SEQ ID NO: 1674 - DNA, 1497 bp, Actinoplanes utahensis
gtgaccacgttcgtcgaccgggtcgtgctgcatctgcaggcgggtgacggcgggcacggctgtgtctccgtgctccgggagaaattcaagccgctgggcggtccggacggtggcaacggcgggcacggtggcagcatccggctggtcgtcgacccgcagcagcacaccctgctggacttccacttccacccgcacgtcaaggcgagcaacggcggcggtggcgccggggcgaaccgggacggggcgaacggcaaggatctcgtgctcaaggtgccggacggcacggtcgtgcagaccgccgacggcgaggtgctggccgacctggtcggtgcgggcaccgagttcgaggtggcccgcggcggccgcggcggccggggcaaccgggcgctggccaacacccggcgcaaggtgccgggcttcgccgagttgggcgagccgggcgaccagctggacgtggtgctggagctcaagagcgtcgccgacgtcggtctggtcggcttcccgtcggccggcaagtcgtcgctgatcgcggtgctctccgcggccaagccgaagatcgccgactacccgttcaccaccctggtgccgaacctgggcgtggtgcaggccggcgaggagaccttcgtcatcgccgacgtgcccggcctgatcccgggcgcggccaccggcaagggcctgggcatgcagttcctgcggcacatcgagcgcacctcggtgctggtgcacgtgctcgactcggcgaccccggagatcgagcgggacccgctggccgacctggacgcgatcgaggccgagctggccgcctacggcgggctggaggaccggccgcgcctggtggtgctcaacaagatcgacattccggacggccgggacctggccgacatcacccggcccgacctggaggctcgcggctaccaggtgtacgaggtgagcgcggtgacccgggagggcctgcgggagctcacctacgccctggccaaggcggtcgccgagttccgggccgcgaagccggtggtcgaggccacccggctggtgctgcgcccgcgggcggtcgacgacaccggcttcaccgtcgagcgcgacgacgacggcgtgtacgtggtgcgcggcgcccaggtggagcgctggatcaagcagaccaacttcgacaacgacgaggcggtcggttacctggccgaccggctggagcggctcggcgtcgaggacaagctcggcaagctcggcgcccaggccggtgacccggtccggatcggcgcccgcgagttcgactggcagcccaatgccggcgagttcgtctccggcccgcgcggcaccgacgcccggctggaggagcaggacgtgcgcccgtcggccgcgcagcgcctggcggcccgcaaggcccgccggatccgcaacgaggacgaggtgctgcacatggcctccgacgggacggtcaccgcggtggccaatccgcaggtgccggtgctgatcaccgacgaggacgacaccgacgaatag

SEQ ID NO: 1675 - DNA, 258 bp, Actinoplanes utahensis
atggctcacaaaaagggtgcatccagctcgcgtaacggccgtgactccgccgcccagcgcctcggcgtcaagcgtttcggtggccagctcgtcaaggccggcgaaatcctgatccgtcagcgtggcaccaagttccacccgggcgacctggtcggccggggcggcgacgacacgctgttcgcgctcgccgcgggcaatgtgctgttcggtaccgcgcgtggccgcaagaccgtcagcatcgtgccggtcgcggagtag

SEQ ID NO: 1676 - DNA, 315 bp, Actinoplanes utahensis
atgtacgcgatcgtcaagaccggcggcaagcagtacaaggttgccgagggcgacgtgatcgaggtcgagaagctcgtgggagagcccggcgacgctctgacgctcgccgccgtcctcctcgtcgacggtgacaacctggtgaccgacgcggccaagcttgccaacgttacggtgtccggcgagatcgccgagcacaccaagggtccgaagatccggatccacaagttcaagaacaagaccggctaccacaagcgccagggtcaccgccagccgctgacccgcgtcaaggtgaccggcatcaagagcgggaagtag

SEQ ID NO: 1677 - DNA, 183 bp, Actinoplanes utahensis
gtggacagcttctcgtacgccctgcgggacatggcgaagctcacctccgacccgaaggtcaagaaggcgctggacgcgatgggccggcaggtgaccgctctgaagggtgacgtcgccaagatcgacgacaagaagctcgccgacctgcacgccgaactcgacgcggcctgcggcaggggctaa

SEQ ID NO: 1678 - DNA, 1878 bp, Actinoplanes utahensis
gtggccgccgcggccgagcagccggtgctggacgagatcgacgagagtgacgagtccgctgacgacgccgaggacggtgtcgaggacgacggggacgacgacgaggccggtggccgccgtcgtcgccgccggggccgtcgtggccgcggccggggcaagggcccgtccgacgaggccgacgacgccgacctggacgccgaggagtccgagggcgaggccgaggccgcgcacgacgaggaggccgaggacgaggagtccgaggacggcgagggcggggtcacccgacgtcgccggcgtcgtcggcgcaagggttcgagcggggacggcgagaccggtggcatcgaggacggtgtgcacaccgtggtgcgggtccgtgagccgcgccgttccgacgaggtgcagggcgtctccggctcgacccggctggaggccaagcgtcagcgccgccgggacggccgcgagcagcgccgtacccgtccgccgatcctgagcgagtcggagttcctggcccgccgcgaggcggtggaccgggtgatggtcgtccggcagaagccggaccgcatccagatcgccgtgctcgaggacggcgtcctggtcgagcactacgtcgcccgggccacctcgggcaccatggtcggcaacgtgtacctcggcaaggtgcagaacgtgctgcccagcatggaggcggcgttcgtcgacgtcggccggggccgcaacgcggtgctgtacgccggcgaggtgaactgggacgccaccgggctggagggtcgggcccgctcgatcgagcaggcgctgcgctccggtgactcggtgctggttcaggtcaccaaggatccgatcggtcacaagggcgcccggctgaccagccacatcgcgctctccggccggcacctggtctacgtgcccaacggcaacgcctccgggatcagccgcaagttgccggacaacgagcgcaagcggctccgggacatcctgaagaagctggtgccggacggcgcgggcgtgatcgtgcggaccgcggccgagggcgccagcgaggacgagttggcccgcgacgtcaagcggctgcaggcgcagtgggaggacatccaggcgcgggccgccgagggcaacgccccgcgcgccctctccgaggagcccgacctggtcatccgggtggtccgggacctgttcaacgaggacttccgcgagctcatcgtgcagggcgagcaggcgtacgccgaggtggagaactacctccactcggtctcgccggacctggtcgagcggctgcaccggcacgtcggcgtgggtgacgtgttcgccgagaaccggatcgacgagcagatcctcaagggcctggaccgcaaggtgttcctgccctccggcggccacctggtgatcgaccgcaccgaggcgatgaccgtggtcgacgtcaacaccggcaagtacaccggtgcgggcggcaacctggaggagacggtcacccgcaacaacctggaggcggccgaggagatcgtgcgtcagctgcggctgcgcgacctcggtggcatcgtggtgatcgacttcatcgacatggtgctggagagcaaccgcgagctggtgctgcgccggctgaccgagtgcctgggccgggaccggaccaagcaccaggttaccgagatcacctcgctgggcctggtgcagatgacccgcaagcggatcggcgccgggctgctggaggcgttcagcgagacctgtgaccactgcaagggccggggcgtgatcatccatcacgagccggtgcccgagaggcggtccaacggcggtggcgccgcgccggccgcgacccaggtgaaggcggtggccgcggcggcccggaccgaggctccgccggcacagccggcgctagctagctag

SEQ ID NO: 1679 - DNA, 666 bp, Actinoplanes utahensis
atgctcgataacgagcccccagtcaccttgggagaacagggcggtgaacgggacggggcagcgactcctcccgtagacgccgccaccggcaccaccccggcccgccggacgcgtgcaccgcgtcgcaaggcggccgcgcctggagctgaggaggtcgcggagactgccgcggccgccccggccgaggtggtggagccgactcccgcaccggtgaaaaaggccacacggagccgccgcaaggtggccgagcctgccccggaggcggctccggccgctgcggcggaggaggcggcggcggaggccgtggccgagaccgccgagaagccggctccggtgaagaaggccacgcgcagccgccgcaaggtcgccgcgcccccggccgagcagctggagatcccgccggccgccgagccgtcgcccgctcccgtggcgccggtggcgccgccggagagccccgaggtgccgatcgtcgggatcctcccgctcgacgacgacttcctggagcccgccgaagaggagcccgccgaagagcagcccgcggaagagcaggccgccgcggaggcggagcccgccgggcagcgcccggcccgggcccgcaaggccccgctgccgccgccggtgctgttcatgccgccggaggcgaccgaggtcgcgccggctagctag

SEQ ID NO: 1680 - DNA, 756 bp, Actinoplanes utahensis
gtgggcggtcaggccccggtcgtgcagcggatccgcctgcggtatgccaaacgcggaccgctgcgcttcacctcacaccgggacttcgcccgggccttcgagcgtgccctgcgccgggccggcgtgccgatcgccttctcgcagggcttcaccccacacccgaagatctcgtacgcgagcgcggcgcccaccggcgtcggcagcgaggcggagtacctggagatcggcctgcagtccgaggtcgatccggagcagctgcggctggccctggacgcggcgctctcgcccggcctggacgtgctggaggcggtccgggccggcgagggcagcctggccgaccggatcgacgcgtcgcagtggcgcctggagctgttcgaggtggatccggcggccgcccgggacgccgtggaggccttcctttcggccggtgaagtgctggtcgagcgcatgacgaagcagggccggcgcacgttcgacgcgcgcgccgcggtgaccaggtgcatggtggtagcagagccggacctaccttccggggccggtggagtaccgtgtgcgataatcgaccttgtcgtacggcaggtaacgcccgccgtgcggcccgatgacgtcctctccggcctgcgcgtggtggccggcctggagccgccggttccccctcgggtaacccggctggcccagggcacactcaccgcgcagggggagatcgtcgatccgttggaggcggatcgcgagggcgtcggcatcggcggacactga

SEQ ID NO: 1681 - DNA, 1944 bp, Actinoplanes utahensis
atgagcgtgagttccgtcttcccgcagcttgagcagctgctgccccgggtcagcaaaccgatccagtacgtgggcggcgagctcggtgccgttgtcaaggactgggacgccaccgtcgtccggtgggcgctgatgtatccggacgcctacgaggtcggcctgcccaaccagggcgtgcagatcctctacgaggtgctcaacgagcagccggacgtgctggccgagcggacctacgcggtctggcccgacctcgaggcgctgatgaaggagcacggcgtcccgcagttcaccgtcgacgcgcaccgcccggtgaaggcgttcgacatgttcggcgtctcgttcgccaccgagctgggatacaccaacctgctcagcgccctggagctggccggcatcccgctcagcagcgccgaccgcaccgaggacgacccggtggtgctggccggcgggcacgccgcgttcaacccggagccgatcgccgacttcatcgacgccgccgtgctcggcgacggcgaggaggcggtcctggagatcaccgggatcatccgggagtggaaggccgagggccgcccgggtggccgggacgagctgctgctgcgtctggcccgcacggagagcatctacgtgccgcgcttctacgatgtcgactatctgcccgacggccgcatccagcgcgtcgtgccgaaccggccggacgtcccgttccgggtcgccaagcgcacgacgatggacctggacgcctggccgtacccgaagaagccgctggtcccgctggccgagacggtccacgaacggtacgcggtggagatcttccgagggtgcacccggggctgccggttctgccaggccggcatgatcacccgcccggtgcgggagcggtcgatcaccacggtcgcccagatggtcaaggaggggctggagttctccggctacagcgaggtgggcctgctctcgctctccagcgccgaccacaccgagatcggtgacatgtgctccggcctggccgagcagtacaaggacacgaacgtgtcgctgtcgctgccgtccacccgggtcgacgcgttcaacatcgatctggcccaggagctgtcccgtaacgggcggcgcaccgggctcaccttcgcgcccgagggcggctcggagcggatccgcaaggtcatcaacaagatggtgaccaaggaggacctgatccggaccgtcgtcacggcgtattcgaacggctggcggcaggtcaagctgtacttcatgtgcggcctgccgaccgagaccgacgaggacgtcctggagatcgccggcatggcgcacgaggtgatccgggccggccgcgaggccgccggcaccaaggacatccgctgcaccgtgtcgatcggcgggttcgtgcccaagccgcacaccccgttccagtgggcgagcatggaacggccggaggtcatcgacgcccggctcaagatgctcaagcaggcgatcaacagtgaccgctcgctgggccgggcgatcggcttccgctaccacgacggcgagccgtcgctgatcgagggcctgctgtcgcgcggcgaccgccgggtcggccaggtcatccgccgggtctgggagaagggcggccggttcgacggctggtccgagcacttctcgtacgcccgctgggtcgaggcctgcgccgaggtgcttcccgacctcggcgtcgacctggactggtacaccacccgcgagcgcgaggagaccgaggtcctgccctgggaccacctggactccggcctcgacaaggactggctctggcaggactggcaggactcggtcagcgagttcgagcaggacgactgccgctggacgccgtgcttcgactgcggcgtctgcccggcgatggacaccgagatccagatcggtccgaccggtaagaagcttcttcccctgaccccggtgaacggcctgcgggtccccgtttag

SEQ ID NO: 1682 - DNA, 345 bp, Actinoplanes utahensis
atgaccgaccagtgggtgagtttctccaagcgcggggtggccgagaccgtccacctccggggtgagatcgatctggccaacgcgcacgacatcggccgggcggtggtggcccgcaccaccctggccgaggccgtgctgatcgacctgaccgcggtctcgttcctggacagcgccggggtgcgactgctcgacctgatcgtcggcgacctcgacgagcggggcaaacccatccgcctggtggtcggcgagcgcggcgcggcccggatgacgctgcagctctgcgcgttccgcaacgacctgttcgcgatcgatctggaccatgccgctgacgaattgggtggctga

SEQ ID NO: 1683 - DNA, 2499 bp, Actinoplanes utahensis
gtgagtgaatctggtgggccggacgtgacacaggagttacgactgccctgggacgacgatcccgaggacctgtacgaacatgcaccctgcggctatctgacgacactcccggacggcaccgtggtccgggtcaacgagacgttcctgagctggaccgggtacacgcgggccgagctgatcggtcaccggcggttccgtgacctgctcgctccgggttgccggatctaccacgagacccactacgctccgctgctcaccatgcagagcgaggtgcacgagatcgccctcgacgtgctgtgcgcggacggctcgcgggtgcccgtgctggtcaactcggtgctcgaacgcggggtgggcggggcaccccgggtgatccgcaccatggtgttcaacgcgaccgagcggcgcagctacgagaccgagctgctgctcgcccgggacgtggcggagagctcggagcagcggatcaaggcgctgcagcggatagtggccgacctggccgccgcgccgaccgaggcggaggtggccgaggcggtggtccgcgcgccggagggcgccttccaggccaccagcagcagcatctacctggtcgaccaggaccgcgaccagctggtcgcggtggcctccaccgacccgaccaccggcaactggaacgacatgccgcgctcgtcccagcgggcggtggccgaggtggcccgccgcggcgacctgcacgtggtgcacaccctggccgaggcggccgagcacttcccggacctggccgagtcgatggtccgctccggccgcagcaccgtggtgctgctgccgctgaccaccggtccggccgaggaccacgccggggtgaccgtgctgggcctgctggcgttcagcttcgccgaggagcgccggctgtccgacggcgagctgcgggtgatccggctgctcggtcagcaggccgggcaggcgctggaccgggcccggctctacgacgacgcccggcgccgcgaggagcgggccgacttcctggccgtcaccacccgggcgctggacgaggagcaccggctcatgcagcgcagccgccgcctcgtcgagcgggtggtgccggcgatcgccgactgggccaccgtgcggctgcacgtcgggccggtcgggctgcgcgaggacgccggcggcccggcgccggacgaggcccggctgggcgcgcggatcctggaggcgacccggtcggtgaaaccaatcttcgccaccgagggtgacccgctggactgcgctgtgctgccgctcaccgcgcggggccgggtgctcggcaccctcgcgctgcggatggccgagaccaggcacgcgccggagaccgaccaggcgttcctgatcgacctggccgaccgggccggcctggcgctggagaacgcccggctctacgagcaggagcgggccgtcgcccggacgctgcagcgcagcctgctcgccgcggacgtgccgtccggtgacccgcggttcgcgctggagacccactaccgggccgccgggcacgatctggaggtcggcggcgactggttcgacgcgttcctgatcaccccgcacaagctcgccgtggtggtcggcgacgtggtcggccggggcctggaggcggccagcacgatgggccagctgcgcagcgcgatccgggcgctggccaccgcggagaacgggccggcccggctgctggagggactggaccggttctgtcagcgggtggagacggcccggatggccaccgtcgtctacggcgagatcgacctggacgcctgcgagctggtctacgcctgcgccgggcacctgccgccgctgctgcaccagccggccggtccggccgagttcctgctgcaggcccgctccggcccgatcggcacccgggccggcgaccggcgccgcaccgagacccggatacggctggccccgggcagccgcctgctgctctacaccgatgggctgatcgagcgccgggaccgcccgatcgaccacggcttcgaggtgctcaaccgggagttcagccggctgcgcggagccccgatgaagggactcaccatggcgctgaccgacaccctggccggccgcgagcacggcgacgacgtctgcctgctctgcctgaccctgggcgtcgaggagcggctggagcgcacgctcggcgccgacccgctgcagatcagcctgctccgctccgacctgcggtcctggctggccagccacggggtggaccgggagtgcctgaacgcggtgctgctggcctgctcggaggcggtcggcaacgcgatcgagcacggctaccgcgacgacccgttcggcacggtcgaggtgtccgtcacgatcaccgacgacgcggtggagatccgggtcgccgaccggggcacctggcgcggacccgggcactcccgcggccgcggcctgcagctgatcgaggagtgcatggacgagatgctgttcgatcagggcgagggcgggaccacggtgaccatgcgccggtaccggggggatgccgcatga

SEQ ID NO: 1684 - DNA, 1233 bp, Actinoplanes utahensis
gtgctcggtggtccaggccggagtgtcctggccggcccacgggtcgacggcgggcatcgtcgcccagttctccggttccggctcgggagcgccgccgacccggtcgaccagccggtcccacagcgaccggcgcggcccgggcaccggcaccggcgcggcgccgctccaccggggcggcagcacgccggtcggttcgtcggaaaagccgtccggcctggtgtcagccatggatttccgtctcctcctctgccggcggcggcacgcgccttcacccaggttaaggacggtgtgccagacgtgcagcggagcttgatccgggcaccggacacgaatggcggacaaccagggcgatgtgcggaacgctgcggagtcgtatggttacccggacctgatatgcggcccacatcacagagctctggggagggcgcggaccggatgagcagcacgcagaggaacgccgtcacgatctccggccgggagtccgggcagccgatgctgttcgcccacggctacggctgtgaccagaacatgtggcggctggtcaccccggccttcgccgacacgcaccgggtggtgctcttcgaccacgtcggcaacggccgctccgacctgaccgcgtacgacgacgagaagtactccacgctcgacggctacgcctcggacgtgctggacatcctccacgagcacgatctacgcgacgtgatcttcgtgggccactcggtcagctcgatgatcggcctgctggccgcggtccgcgagccggagcggttcgccggggtggtgatggtcggcccgtcgccgcgatacatcgacgacgaggcggacgggtacgtcggcgggttcacccgtaccgacatcgagcagatgctggtctcgctggacagcaacttcctcggctggtccagcgcgatggccccggtgatcatgggcaacccggaccgtcccgagctgggcgaggagctgaccaactcgttctgccgcaccgatccggcgatcgccaagaagttcgcccgggtcaccttcctctccgacaaccgggccgacctggcccggatgcgggtgccctcgctggtgctgcagtgctccgaggacgtgatcgcgccggccgtggtcggcgagtacgtccacaagcacaccccgcacagcacactcatcgcgttgaacgcgaccggccactgtccgaatgtgagcgctccgcaggagacggttgacgcgatcaagtcctggttgtaa

SEQ ID NO: 1685 - DNA, 1206 bp, Actinoplanes utahensis
atggctgacaccaggccggacggcttttccgacgaaccgaccggcgtgctgccgccccggtggagcggcgccgcgccggtgccggtgcccgggccgcgccggtcgctgtgggaccggctggtcgaccgggtcggcggcgctcccgagccggaaccggagaactgggcgacgatgcccgccgtcgacccgtgggccggccaggacactccggcctggaccaccgagcacctggcgccgctcccggagatgccaccgacccgcctggaggccccggccgctccgatcggcacggccggtccgggtgtcccggccgtgccgaccggcatcgtcgatcggggtgccccggccgttccgaccggcatcgtcggtcagggtgccccggccgttccgaccggcatcgtcggtcagggtgccccggccggcaagcaggagaagatcaaggcgctactggacgcgctggcggccaaggcggccgagaccgcggaggcccgcaacgccaaaccggcccgcggcggcccggctcacgacgtacccctcaaccgaccgcaagcggccgcgaaaccgccgtcgcgcggctggttccgcaagccgccgcccagcgccgcgccgccgcgcctgccggagaaaccccgcccgcggcgccggctacgccggctgcgacggctcgccctggtcctcgccgtcctggccgcggcctggttcgcagcccctctcgcgtacgagcggtggccggtcctggcgcagttcccggtctccgcggcgcttcccgaccgggtcggtgacctgcgcctgcgcgccgacccggcgagcacgaaagccgtcgaccgcctcgccgaccagctgcggtcggcgggcgtcgacggcagcgcgttcgccggcgtctacggcgacggcaacggcaaacgggtcaccgtgtacggcgtcaccggctggcgtttcaccccgcagtccgacgccctcggccagctggcccggatcgccggcgacgccgagctcagcgacgtcgcggactacccgctggacgaaccgggcgccttcgagagctgcggcaccgggcggctgggcggcacgtcgacggtgatctgcacctgggcggaccacggcagcatggcgaccgtgctgctcacccgacggtcgccggaggagagcgccgccctggtggcccggctgcgcggggcggtgctcagcccgaagttcggggcgtga

SEQ ID NO: 1686 - DNA, 669 bp, Actinoplanes utahensis
ttgcccctgatctacacgatcggcaagctcactgtcggcaacacgctgatggtgggttggaagccgcgcatcgagggcctcgagcacatcccgaagaccggcggcgcgatcttcgccggcaaccacctctcggtcgccgacgagctcttcctcggcgccgcggtcccgcgccacctggcgttctgggccaagtccgactacttcgtcggtaaaggggtgaagggtttcctctcgcggaagctgatggagggactcggcgcgatccgggtcgagcgggccggtgggcgggccgcgctcaccgccttcgacgccgccatccccgcgctcaagggcggcgatctggtcgcggtctacccggagggcacccgctcgccggacggcaagctctaccgcggacgcaccggcgtggcccggctggccaccgcggccggcgtgccgatcatcccggtcggcatgatcggcaccgatgtggtgcagccgatcggccggctcgcgccgaaactgatgcgcggcaccgtcacggtcaagttcggcaagccgatcgagacgatcggccgctccagtgaccgcacctcgctgcgcgagctcaccgaccaggtgatgggcgagatccagaaactcaccggccaggagtacgtgccgcggtacgcgccgaagcgcgaggagtga

SEQ ID NO: 1687 - DNA, 3111 bp, Actinoplanes utahensis
atgtatccgaagcacaccgatgcgcagggcgttccggcctccccggacctgcccgcggtcgagcgcgcggtcctggagcactgggcggccgacaagaccttcgaggcctcggtcgagcagcgtccggccggggagaacggcgcgaacgagtacgtcttctacgacggcccgccgttcgcgaatggactgccgcattacggccaccttttcaccggttacgtcaaggacgtggtgccgcgttaccggacgatgcgcggccagcgggtggaacgccgattcggctgggacacccacggcatgccggccgagatcgaggcggagaaacagctcggcatcaccagcaaggcgcagatcgtcgaactcggtatcgacaagttcaacgaggcctgccgcacgtccgtgctcgcctacaccaaggactggcagggatatgtcacccgccaagcgcggtgggtggatttcgggaacgactacaagaccctcgaccccgattacatggagtcggtcatgtgggcgttcaagaccctgcacgacaaaggcctggtgtacgagggtttccgggttctcgcctattgctaccggtgcgagacgccgctctccaacaccgagacgcggatggacgacgtctaccgggaccggaccgaccccgcactgacggtgaagttccggctgtcgaccggtgaggacatcgcggtctggacgaccacgccgtggacgctgccgtcgaacctggcgctcgcggtcggaccggacatcgagtacgcggtcctcgccgacggcgcggggcagaagctcatcgtcggtgccgggcgggtggccgcctacgccaaggagctcgacggctacgagcaggtcggcacggtgcggggcagcgagctcgtcgggcgccgctacacgccgctgttcgactacctggtggagccggccggggagaacgccttccaggtgctcggcgccgacttcgtgaccaccgaggacggcaccggcgtggtgcacatggcgcccgcgttcggcgaggacgaccagaacgcctgcctcgcggccggcatcccgaccgtggtcaccgtcgacgagcagacccggttcacctcgctggtacccgacttccagggcctgcaggtcttcgacgcgaacaagccggtgatcgccacgctcaaggagcgcggcgtggtggtccggcacgacggctacacccactcgtacccgcactgctggcgctgcgacaccccgctggtctacaaggcggtgtcgtcctggttcgtggcggtgaccaggttccgggaccggatggtcgagctgaaccaggagatcacctggacgccggcgcacatcaaggacggctcgttcggcaagtggctgtcgaacgcgcgggactggtcgatctcccggaaccggttctggggctcgccgatcccggtctggaagtcggacgatccgcagtatccgcgggtggacgtctacgggtccttcgaggagctctcccgcgacttcggggtggcggtcaccgacctgcaccggcccggtgtggacgagctgacccggccgaacccggacgacccgaccgggagatccaccatgcgccgggtgccggaggtgctggactgctggttcgagtcggggtcgatgccgttcgcgcaggtgcactacccgttcgagaacaaggagtggttcgagcaccactacccgggtgacttcatcgtggagtacatcgggcagacgcggggctggttctacaccatgcacgtgctggcgaccgcgctgttcgaccggccggcgttccggaactgcctgagccacggcatcctgctgggcgaggacgggcgcaagatgtccaagtccctgcgcaactacccggacgtgtaccgggtgttcgactcgtacgggtcggatgccatgcgctggatgctgatgtcgtcgccggtgctgcggggcggggacatgccggtcaccgagacggcgatccgcgactcggtccgccaggtgctcctgccgctctggaacgtctggtacttcttcagcctttatgcgaacgccgcgtcccatgaggcgaaatttcggaccgattccacccaccttctcgatcgctacatcctcgccaagaccggcgagctggtggaagatgtcgcgaaaaagatggacgaatacgacatctctggtgcggcggcgggtgtccgctcctacctggacgcgctgaccaactggtacgtccgccggtcccgggaccggttctgggcgggtgacgccgacgcgttcgacaccctggccaccgtcctggaggcgctctgccgggtggtggcgccgctcgctccgctcaccgcggaggaggtctggcgcggcctgaccggcggccgttcggtccacctcaccgactggccgtccgccgacgcgttcccggccgaccacgagctggtcgcctcgatggacgcgatccgcgacgtcgcgtcggccgccctgtcgctgcgcaaggccaaggccctgcgggtgcgcctgccgctggccacgctcaccgtcgccgccgcgcacggccggtcgctggagtcgctcggcgacctgctcaaggacgaggtcaacgtcaaggacgtggtcttcaccgacgacgtcgcggcgtactgccagcaggtcctcacggtcgtcccccgggcgctcggcccgcgggtcggcaagcaggtccagcaggtgatcaaggcggtcaaggccggtgactgggagctgatcgacggcgccccggtggccgccgggatcaccctggccgagggggagtacgagctgaagctggtcgccgcggacgcggagaactccgccccgctgccggccggtggcggcgtcgtggtgctggatgccgcggtcactccggagctggccgccgagggtctggcccgggacgtgatccgggtggtgcagcaggcccgccgggacgccggcctggacgtctcggaccggatctcgctgatcgtgtcggcctccgcggcggtgcgggcggcggtggagacgcaccgggagttcgtcgccggtgagaccttggccacctcgctgaccttcgacggcgtcgaggggttcgacggcgaagtcggcgacggcgagcagatcaccgtcggtgtgaccgcggtgtga

SEQ ID NO: 1688 - DNA, 417 bp, Actinoplanes utahensis
gtgtccaccagcaccgagcgttcgctcatcctcatcaagcctgacgcggtccgccgcggtctgctcggcgagatcctgtcccggttcgagcgtaagggcctggtcatcgaggcgctggaggtgcgcacgatgagccccgagctcgccgaccagcactacgccgagcacgtcgacaaggcgttctacccgccgctgaaggatttcatgaccagcggcccgctggccgccgtggtgctctccggcgacgaggtgatcgaggtggtgcgcgccatgatcggcgcgaccgacgggcgcaaggccgcggccggcacgatccgcggcgacctggccctctccaaccgggagaacctggtgcacgcctccgactcgccggacagtgccaagcgtgagctggcgctctggttcccgcacctgtga

SEQ ID NO: 1689 - DNA, 1326 bp, Actinoplanes utahensis
gtggcgaaccagaccgggcggcccatcgccccggcacgcaagttggtggcggcggtcatgggcacgctcgcgggctttgtgatcgtttacgggctcggcatgaagagctggcccgtctcgatcttcgggctggtcgtgctggccatcgcggtcacgctcgccgtggtcacccccggccgccgcggtggccgggccaccgtcgccggcaccgcggagatcatggacatcaccgcgccaccgctcgccggggcgtacggccgggccgagatccgggccatcgtcgtcgcccccggcctgggcaccttcgacaaggtgatccgggacggccgggtgccggtcgcgaaatggccggtcgccggctccaccgtgccgatcaccgtcgacgtcgacgacacccgccgggtccgggtcaactggaaggacgccccggacctcggcccggccggcgacccgccgccgccggtcaccggctccgcccactccgagttccacgaggacccgctgctccccgaggaggaggacgacgacgtgctcggcgcggtcgcccccaagccgtgggagacccgcgacgacgactgggccgcccaggagccggcgtacgaggaggagcgcgccaccaccccggtggtggtccgggacaccccgaacgggccgatcctcgaggggcagctggtcggcggcgaagaacaggtcgcgccgctgccccgccgcgccggcagcggcccgcgtcgctcggggggctccttcgactccgccgccaccgacccggtcggcttcgatccgctccccacggatccggccacgcccgacgaccccgccaatggggaggatccggccacccgggaagacccggccgcgcctgcgagcccggccgctcctacgggcccggtcgctcctacaggcccggccgcccccgcgagcccggccgccctggaggacccggccgtccctgcgggcccggcggcccctgcgagcccggctgccccccacaggcccggcgccatccgccgccgcgtcgtcgaccgctgtcgccgaggaatcgccggtcttcgccaccgaggcggagccggcggccgccgcgaccgtcccgcggccctcttcggcaacggcatccgtcccgttcgcgtccgccgccgaagtggacccggaccggatcgccgccggcagcgcctccagccggttcgggtcgggcgcctcctccgaggcctggccgtcggccagctacccgcccccgcccggacccgaggccgccggccgccggcccggcggcgacgactcgttcgacttcccgcccccgcccccgccgggcgccaccccggccggtga

SEQ ID NO: 1690 - DNA, 1101 bp, Actinoplanes utahensis
atgccggccacccccaccggggccgctgccatcccggtgcacaccgcttcaggtccggcagccgggaccgactccgacgacccgggcctcgacggttacccgccggccgccttcccggtcagcgcctacgcacccaccgacccggagcccccggttccgcccgcgccggtgtccaccgcccgggccgagccgaccccgctcaccgccccgccgaccgccccggagccggaccgacccttcccgaccgcgccaccaccggcgaccccgcgccccgccgcccccaccccggtcgccgacgagatcgacatcccgctggacgacgtcccggagtccacccccgaagccgccccggcggtcgccgccggcatcgtcgctcccccggcggaccccggcgacatcgtcaccccctggacagaccccggcgacatcgccaccccttgggcggaccccgccgacatcgtcacttccccggcggccgaacccccggcggagcagtcagccgccgctttccccgccaccgccgagccggacgatgcgcccagcgccgagaccaccgcctggccggtcaccgccgactcccccaccgccgcagccggcgcggagggccggaagggcaacccctgggctgatttcgccggccggccggtgcccgacgaccgcaccgccgaggtgatcaccgcctatcccagtgcccgccccggcccggccggcgcaatccacggcgtgggcatcaccatcctggtcaccgacctggcccggtcgatcgtcttctaccgggacacgctcggcttcttcgagatcgacaccggtgacggcagttcggtgctggcttccggcgacacccgggtggtcctgcgtaccgtcccgaacctgtccgccgaggcgggccgcctgatctatctgaacctggaggtcggcgacatcgaggcggttcacgacgagctccgggccaagggcgtcaagttcgtccactccccccgggccgtcaaccgcggcgacaagctggagctctggtccgcgaccttccgtgacccggacaaccacaacatcgcgatcacccagtggcgagccgtccgcccggatcccacccccgaggcctga

SEQ ID NO: 1691 - DNA, 396 bp, Actinoplanes utahensis
atgaccgggccggaggagaacgcggcgccggtcggggacgaggcgggcgctgggccgcggcgttccgggctgcgcaaccccgaagcggcggtacgcggtctcggagcgggcaccctggccctcgaagcgatcgtcctgctgctggccatccagccgatccggatcctcggtgggcacctcagcgggtgggggatcggcctggtcatcgggctcgccgtggtggccgcgctgctcgccggatgcatgcggcagcggtgggggtggggcgcggggacggcgctgcaggtgctgctgctcgccagcgggctggtgcactggtcgctcgccgcgctcggggtgatcttcgggctggcctgggcctacgcgacgtacgtgcggcggtcgatcctcgggtga

SEQ ID NO: 1692 - DNA, 1356 bp, Actinoplanes utahensis
atgagtcccgccgagcactcctccgagcacgcctccgcatacgcggcggtcgaggccgcgctgaacgagcgcggcttcacccggatggtcttcgacatgcagaagatccgggatctgatggacgtgctgggcagcccgcagcgggcctacccggcgatccacctgaccggcaccaacggcaagaccagcacggcgcggatgatcgacgggctgctgcgggcctgcgggctgcacaccgggcgctacaccagcccgcacctggaaacggtgcgggagcggatcagcctcgacggtgagccggtgtccgaggagcggctggtcgacacgtaccgggagatcgccccgctcgccgagctgatcgacgcgcgcaacagcgagccgctcacctacttcgacatgaccacggccatggcgtacgcggcgttcgccgacgcgccggtcgacatcgcggtcgtcgaggtggggctcggcggcgaagaggacgccaccaacgtgatcgatgccggggtgtgcgtgctcaccccgatcgggctcgaccacaccgagtggctcggcgacacgatcgaggacatcgcctgggccaaagccgggatcatccacaaggacgcgaccgtgatcaccgcggtgcagaccgaggaggccatgcggccgatcctggaacgctgcgcggagatgggcgccacgctggcccgcgagggcagtgagttcggcgtggtgcagcgtacccaggcggtcggcggccaggtcctcgtgctgcagggcctcggcggggtgtacgaggagatcttcctgccgctgttcggcgcgcaccaggcgcagaacgcggcgctggcgctggccgcggtcgaggcgttcctcggcgccgggccgggcaagcagatcgacatcgagctgatccgcgaaggattcgcccaggtggactcgcccgggcggctggaacgggtgcgcagcgcaccggccatcctgctggacggcgcgcacaacccgcacgggatggcggccaccgtcgcggcgctggaggaggagttcagcttccggcacctggtggcggtgctcgccgtcttcgccgacaaggacgtgaccgggctgctcgacctgctcgaacccgtggtggcgcggatcgtggtgacacagaacagctcaccgcggtcgatgccggtgcaggaactcgcgcagctcgccgccaacgtgttcggtgaggaccgggtgagcatcgccgaaaccatgccggacgccatcgaggaagccgtggtgctggccgaggaggacgcgtccggcgaactgagcggcgtcggcgtgctgatcaccgggtcggtggtcaccgtcgccgacgcgcggaaactgctcaaacgatga

SEQ ID NO: 1693 - DNA, 2640 bp, Actinoplanes utahensis
gtgaccgacacgaccgatacccgcactcccgacagccggcccaccggtggcctctccgctcagtaccagccgggcgaggtagagcagcggcggtacgagcggtgggtatcggagggctacttcaccgccgacccgaagagcgacaagccgccgttcaccatcgtcatcccgccgccgaacgtgaccggctcgctgcacgtcggccacgccctcgaccacaccatccaggacaccctggtgcgcctcaagcgcatgcagggcttcgaggtgctctggctgcccgggatggaccacgccggcatcgccacgcagaacgtggtcgagcgcaagctggccgagcggcagctgtcccggcacgacctgggccgcgaggccttcgtcgccaaggtctgggagtggaaggccgagtccggcggcgcgatcctggggcagatgcgccggctgggtgactcggtcgactggtcccgggagcgcttcaccatggacgagggcctctcccgggccgttcaaacgatcttcaagcggctgtacgacgacgatctgatctaccgcgcgaaccggatcatcaactggtgcccgcggtgtctgaccgccctgagcgacatcgaggtggagcacaccaacgacgagggtgagctggtctccatccggtacggcgagggcgcgaacgcgatcgtggtcgccaccacccgggccgagacgatgctcggtgacaccgcggtggcggtgcaccccgacgacgagcggtaccggcacctggtcggcaccgaggtcgagctgccgctgaccggccggcgcatcccgatcgtggccgacgagcacgtcgacccggcgttcggcaccggtgcggtcaaggtgaccccggcgcacgacccgaacgacttcgagatcgggcagcggcacggcctgcccagcctcaccgtgatggacgagcgcgcggtgatcaccgtgcccggtccgttcgagggcctggaccggtacgaggcccgtccggcggtcgtcgccgcgctgcgcgagcagggccggatcgtcgccgagaagcggccgtacgagcactccgtcgggcactgctcgcggtgcaagacgaccgtcgagccgcggctgtcgctgcagtggttcgtcaacaccacgccgctggccaaagcggccggtgacgccgtccgcgacggccgggtccggatcgagccggaggagctgtcgaagcggtacttcgcctgggtcgacaacatgcacgactggtgcatctcgcgccagctgtggtggggtcaccgcatcccggtgtggtacggcccggccggcgaggtcgtctgcgtcgggccggacgagcagccgcccaccggcgagggctggacccaggacaccgatgtgctggacacctggttctcgtccgggctgtggccgttctcgaccctgggctggccggagcgtacgccggagctggcgaagttctatccgaccagcgtcctggtcaccggctacgacatcctgttcttctgggtcgcccggatgatgatgttcgggctctacgcgatggacggcgtgcagccgttcaacgtggtgaacctgcacggcatcgtccgcgaccagttcggcaagaagatgtcgaagtcgttcggcaacgtggtggacccgctggactggatcgaccggtacggcgcggacgccacccggttcaccctgatgcggggcgccaacccgggctccgacgtggcgaccagcgaggagtggtgtcagggctcccgcaacttctgcaacaagctgtggaacgcgacccggttcgcgatgatgaacggcgccaccgtcgagggcgacctgcccgcgcccagcgagctcagcgcgatcgacaagtggatcctgtcccggctgcagcacaccatcgccgaggtcaacgagcagttcgacagctacgagtacgcgaaggtctgcgacacgctgtaccacttcgcgtgggacgacgtctgcgactggtacgtcgagctgagcaagccggtgctggcccaggacaccccggaggcggcacgcagccggcgggttctcgggcacgtgctcgaccagctgctgcgcctgctgcacccggtgatcccgttcgtcaccgaggagctgtggatcgcgctcaccggccgcgagacggtcaccttcgcgacctggccgatggtcgaccacgcgctggtcgacgacgccgccgaggaggagctggccgccctgcagaaggtggtcaccgaggtccgacggttccggtccgaccaggggctcaagccgagccagcgggtttccgcggcgctgaccgggctgggcaacgtcggcatcgacacgcacgagccgctgatccgctcgctggcccggctggacgcgccggccgacggcttcaccgcgaccgccaccctggcggtcaccggtgggatcaccgtcgacctggacacccgcggggcgatcgacgtggccgccgagcgtgcccggctggacaaggaccgggcggctgccgagaaggaggccgcgcagtgcagggcgaaactgggcaacgaggcgttcatcggcaaggcgccggaggccgtcgtggccaagatcaaggacaggctggccaccgctgaggccgacctggtccggatcgccaccgcgctcgaggcgctgccggccgcatga

SEQ ID NO: 1694 - DNA, 798 bp, Actinoplanes utahensis
atgtccgaccgcggccacgcgccccctccgcccgccggcgacgcccccgaaccggatcccgcggagcccgatttgtcgcgggacatcgagatcagcgcggttccggccgcggccgggcccgagccggccgataccgacgcggagcctttggacctcaccgaaggcgagccgatcgagctccaggccggcccgttcagcctggtgccggtcgaggacggcgacgatgcgccgttgagcccgcgccgccggcgcacccgcaccatcctgaccggctcgctgctggcggtcggcctgctcggcgtcgccggcctcggctggtactactggcagatccacgtccagcgcgacgtcacgctcagcctgccgccgtcggtcgccgacatgacgctggacgacagcccgaacgccaaggacaccgccgactatctgcagaccgcgctgaacaccgagatcgacatggacaagaccgtcggcggcgtctacagcggcaccggcgagaaggacgtgctgatcttcggcggcaccacgctgatctggagccccggcaaggatctggctacgtcgttcggcttgatcagcgacaagcagggcaccgtcaccggcctgcacgacgtcgacccgggcccgctcggcggctcgatgaagtgcggaatcaccaggaccgagggcggcaacatgccggtctgcgggtgggccgaccacggttcgctggccctcgccatgttcccgaaccgttccgaatccgaagccgctcccttgatgctgcaactccgaaaagccattcaaacccgcaattga

SEQ ID NO: 1695 - DNA, 216 bp, Actinoplanes utahensis
atgaacccatccgaggcgtcggcgagcgacgggttactggacctgatcgtgccgctctggcagctcgtgatcggcgtgctcgtgctggtgaccgtggtcgtctcgacccggaaactgctgctgcgcggcccctcccggatgagcggcgcactcctgctggtcggctcggcggtggtcggcctcgccgtcatcagctacctgttgcagaccctgtga

SEQ ID NO: 1696 - DNA, 795 bp, Actinoplanes utahensis
atgcgcgtcgccgtgtgccagctgaactcgcgggaagaccgcgcccacaatctcgacgtcgcgcgaggcctcctggagcgcgccgccgccggcggcgccgagcttgccgtcctgccggaatatgtcgacttcctcggccgggccaaggacgcgcccccgccggagccggtcgacggcgagttcgccgcgttcttcgccaccgccgcgcgcgagctggacatctgggtgcacgccggctcgttccacgagaccggccccgatgagcagcggaccttcaacaccacgctggtcttccggcccgacggttccctcgcggcgacctatcgcaagattcacctgtacgacgtggagatcgcgggtcgggtgtcctaccaggagtcccgcaccgtcgcgccgggcgcggaaaccgtggtcgcggcgatcggcagcgtgccgactgggctgagcatctgttacgacctgcggttccctgagctgtaccggcagctcgcgatcgccggggcgaagatcctggtggttcccgcggcgttcatgctgcacaccgggcgcgaccactgggaggtgctgctgcgcgcccgggcgatcgagaaccagtgctacgtcgtggcggccggccagatcggcgaccacgagccgggacggacctgcttcggccgcagcatgatcatcgacccgtgggggacagtcctggcgcaggtggccgacggggtggggatcgcgacggcggatctggacctgggccggctggacaccatccgcgaggagttgccgagcctggccaaccgccggctctga

SEQ ID NO: 1697 - DNA, 588 bp, Actinoplanes utahensis
gtgccggacccgtggctcgagatcgtgccaccgccgtcgtccgatcgggcggcggtggtgtcgttcccgggtcacgtcgtcgtcgcggccgcggtcgagccggtctgggccgagaagctcgccggcgaggatttcgccgcccccaccgggccgcggttcctgaccgccctggaggaccggttcggcctgcacgccggcgccttcgacgtctccctgctcgccacccccctcgccggtgatccgccgctgccgctcacgccgctgaacgccagcggacacccgcgggccctccgcgcccaccggtaccgcaccgacgtgcggctctggacgtcccagcacggtctgctggtcgtcggccgtggtctgggcggccgctgggaggtggcgttcgaggtcgacccggcagcgcgcgggcgcggccacggccggctcctggccgcggcggcccgccacctgatcccgcaggaccggccgatctgggcccagtgcgccccggggaacgccgcgagcctgcgcgtcctgctcgccgccggatttcagccggtcggctcggaaatcctgctgatgccacccaccgccggctggtga

SEQ ID NO: 1698 - DNA, 1290 bp, Actinoplanes utahensis
gtggcacggatcggtgacggtggcgacctactcaaatgctccttctgcggtaaatcgcagaagcaggtcaagaagctcatcgcgggccctggggtctacatctgcgacgagtgcatcgatctctgtaacgagatcatcgaggaggaactggccgagaccggcgaggtgaagtgggaagagcttcccaagccgatggagatctgccagttcctggacaactacgtggtcggccaggaacaggcgaagaaagctctcgccgtcgcggtctacaaccactacaagcggatccaggccgagtcgaacggcgctcccggcgggagcagcgacgtcgaggtggccaagtccaacatcatgctcatcggccccaccggctgcggtaagacgcacctcgcgcagaccctggcccggatgctgaacgtgccgttcgcgatcgcggacgccacggcgctcaccgaggccggctatgtcggcgaggacgtcgagaacatcctgctcaagctgatccaggcggccgactacgacgtcaagcgcgccgagcagggcatcatctacatcgacgaggtcgacaagatcgcccgcaagagcgagaacccgtcgatcacccgggacgtctccggcgagggcgtgcagcaggccctgctgaagatcctcgagggcacggtggcgaacgttccgccgcagggcggccgcaagcacccgcaccaggagttcatccagatcgacacgacgaacgtgctgttcatcgtgggcggcgcgttcgccggcctggaccggatcatcgagcagcgcgtcggccagggcggggtcggattcggcgcccggctgcggtcgatctcggagcgcaacaccgacgacatcttcagcaaggtgatgccggaggacatgctgaaattcgggctgatccccgagttcatcggccgtctcccggtgatcaccacggtccgcaacctggaccgggaagcgctcatcaagatcctcaccgagccgcggaacgcctacgtgaagcagtaccagcgcctcttcgagctggacggcgtcgagctggagttcgacgagggcgccctagaagcgatcgccgaccaggcgatgctccgcggcaccggcgctcgcggcctccgcgcgatcatggaggaggtgctcctctccgtgatgtacgaggtgcccagcaacccggacgccgcccgcgtactgatcacccgcgaggtggtcctggagaacgtgaacccgacgatcgtgccccgcgagttcgtcggccgccgtcgccacgcccgtgaggagaaatccgcctga

SEQ ID NO: 1699 - DNA, 663 bp, Actinoplanes utahensis
atgaccgacctttccatgcctcccgggttcgctccggtgcacaaccgctacgtgctgccctcgttcaccgagcgcacctcgtacggtctcaaggagtcgaacccgtacaacaagatgttcgaggaccggatcatcttcctcggcgtccaggtggacgacgcgtcggcgaacgacgtgatggcccagctgctgacgctggagagcaccgacccggaccgcgacatcctgatgtacatcaactccccgggtggctcgttcaccgcgatgaccgcgatctacgacaccatgcagtacgtgcggcccgacatcagcacggtctgcctgggccaggcggccagtgcggccgcggtgctgctcgccggtggcaccccgggtaagcggatggcgctgccgcactcgcggatcatcatccaccagccggccaccgagggtggttacggccagggttcggacatcgagatccaggcgcgcgagatcatgcggatgcggacccagctggaggacatgatctcccagcattcgggtcagtcgatcgagaaggtccgtaaggacatcgaccgggataagatcatgacggcggctgaggccaaggagtacggcctggtcgacgtggtgctcgcgacccgcaagaagagcctgcagacggtcggcgcgagcagctga

SEQ ID NO: 1700 - DNA, 636 bp, Actinoplanes utahensis
atgaccgaactccacatccctgccgggcccgtgtcgcggcgcggcggcgactccctgagtggcaacctcgacgactcggtcttcaaccgcctgctgcgtgagcggatcatcttcctcggcagcgaggtgaccgacgcggtcgccaaccgcatctgcgcgcagctcctgctgctctccgccgaggacccggagcgggacatccacctctggatcaactcgccgggcggctctgtctactcgggtatggccatctacgacacgatgcagttcatcgacaacgacgtgtcgaccgtcgggatgggcatggccgcctcgatggggcagttcctgctctgcgccggcacccccggcaagcggtacgccctgccccacgcccgcatcatgatgcaccagccgtccggtggtatgggtggcaccgccgccgacatcgccatccaggcggagcagatgctgtacaccaagcgcatgttccaggagcggatcgcgttccacacgggccagacccaggagcagatcgccgccgacttcgaccgggaccgctggttcacggccgccgaggcgcaggactatggcttcatcgacaaggtgatcaccggggccgtccaggtcccggacggtgccggaacgctgaactga

SEQ ID NO: 1701 - DNA, 1350 bp, Actinoplanes utahensis
gtgaagagcaccgtcgagactctgagcccgacccgggtgaagctcgccatcgaggtgccgttcgacgagctcaagccgagcctgcagaaggcgtaccgggagatcggcgcgcaggttcaggtgccgggcttccgaaagggcaaggtgccgtccgcggtgatcgaccagcgcgtcggccggggcgctgtgctgaacgaggccgtccaggaggcgatcccgcagcagatcctcgccgcggtccaggagcacgacgtcaagacgctcggccgccctgaggtggagatcaccgagttcgccgacaacgcgccgctgaagttcaccgccgaggtggacgtgcggccggagatcgtggttccggacctgtcgacgatcagcgtcgaggtgccggccgtcgagatcggcgacaacgagatcgacgagcagatcaacggcctgcgggagcgtttcgccacgctgaagacggtggagcgggccgctgcggagggcgactacgtccagctcgacctgaacgcgaccgtcgacggcgaggaggtgccgggcggctcggccaccaacatctcccacgaggtgggcagcaagcagctgctcccgggtctggacgaggtgctggtcggcctgtccgccggcgacgagaccaccttcaccacccagctggtcggcggcgacttcgccggccgtgacgctgacgtgaaggtcgtcgtgcgcaccgtcaaggacaagcagctgcccgagatcgacgacgacttcgcgcagctggcgagcgagttcgacactctcgaggagctgcgcggcgacctgcgcgagcggctcaccaaggtgaagaaggtcgagcagatctacgccgcccgtgacgaggctctcaagcagctcgtcgaggccgcgaacattccggccccggagggtgtcgtcaaggacgaggtcgagggccgcaagcaggccatgaccgaccagctggagcggatcggcgccaccctggccgactacctcgcctccgaggagaagaccgaggagcagatcgaccaggagctgaccgaggcggcccaggagggcgtccggatccagctgctgctcgacaccgtcgccgacgccgaggacgtccaggtcaccgacgacgagttcggtcacgagatcgtgcaccgggcgcagcgcgcccagatgcagcctcagcagtactacgaccagctggtccggtcgggcgccgcggcggccgtcttcggcgacgtgcgccggggcaaggccctcgcctcggtgatggagcaggtcacgatgaaggacagcgagggcaacacgctcacgctggacgacctgcgcgccgccagcgaggacgagcacgccggtcacaaccactga

SEQ ID NO: 1702 - DNA, 519 bp, Actinoplanes utahensis
atgggaacccgcacaagggtgctgctccggtgccgataccttccaagcgtgaccagccccaacgaaccgcccgacgtctcccgcccgcaggtcgccgccggcgtcctgttcttcgacgaggcaggatgcgtgctcctcgtccagccgagttacaagaccgggtgggagataccgggcggatacgttgaagccggcgaatcaccgaaggctgcctgtattcgtgaagtcgccgaggagctggggctctcgccggccatcggtgaccacctgatcgtcgactgggcacccgctacaggcgagggtgacaagctcctgttcatcttcgacggcggcatccttcccgagagagatcgagcccggatcgacttcgtcgacggcgagctggccgattggcgattcgtggccatcaccgatcttgagacgtacgtaccggctcgcctggcacgtcgaatcacgaccgcggccgcagcccggcaaggggcacgtcccgtctacgccgagcatggcgtcgcgaaatag

SEQ ID NO: 1703 - DNA, 1056 bp, Actinoplanes utahensis
gtgacgcacaacgacgaaggcggccccgaagatcggtcgtcgggcgagttcacgctgcgacgtccgttgttcgtgttgacctcggagacggtcaggccggccggtcggcatcggccttccgagaagccgggtgtcagcagcagctgggccggattcatcgcaccgaccggcatcgcgccgcactgcaccggccgggccggctcggccgcggctgccgacggcggagggacgggtggtcacgccccggcccggtcactgcgccgtccggtggcggtggcggccggcgtggccaccgctgtcgccgtcggcctcatcattctcgttcccgatcacgacaggggcgcgccgagtgccactggggacggacggaacggcatcgtggtcgacggtccgagcgccatggtgtccaccccgcccggcgcgggaacggagctgcccggcgcgggcagcgagcccgctacgacgcccgcctccccgcagccgcatgcgacgcagctgcgcaaggtgtcatcgtcagcggcggccaggacgcccgaggcttcccggttcgtggcggtggccggcgagagctgtccgcagagcgcggatcgcggttaccacgtgagcggtcaggccagcgactggtacttcccgtcccgcggtggttggacctccgacggctgcggggggcgggtcgcagccgtgcccatgagcggctcaccgaccagggacgaccgggacaacgtcatcgtgtggtggttccgcaccggaaccgtccgcaccggcagctgcgccgtcggcgtctatgtgcccggcaccggcaacccgaaggacgcggcgggtgagccggcacactacctgctccgtgccgatgacgacatcgatgcggacgtcgtcgccgagttcgacgtcgaccagtcggccaaccagggccgctgggtcgacgccggccggtacagcgtcacctcgggcgagatctcagtccagttggtgacccggggcgtcgactggggcagcggacgcgagggcgaccacctcggcgtctccgcgctgcgggcagactgccgcgccgagtga

SEQ ID NO: 1704 - DNA, 1290 bp, Actinoplanes utahensis
gtgacgcctgccgatttcctgccgaaggccacgacacggaaggagccaccactgttcgagaaccctgccgttcccaggatccgccagcgcggatcgacgcttctggtcgttgacggcgacgctgagcaggatctgccggagctgccacagctgcccggcgaaacccacgtgaccacggtggtggtgcacaccaccgtggtgccggacatcccggtgttgcggtccttgctcaaccgcggactggcaccggagtgtgcggcggtacggctcgtgctgccgggggcgggcgcaccgggaccggacggctggtgtgcggcccggcaccttgccgagtcgctgaacctccccgtgatcgccccggacggaccggtgatcgtcctccccgacgcgctgttcgccttcggcggagcgtggcggacattccgccccggggccgaacccgtcgtcgacggaccacgacaccccgcccccaggtggcagcgcacgctgaccccgccaccgcaggcggaggcgccgctgcgggcgacgccgatcccggccggactctggctgcacaccgcggaccgggtcgtcgcgcccgatgacccggtcttcgcggtgccggtcgatccggcctcggtgtccctggtcatcggccgtcccggcgatccggtgctcccggcggcagaagtggccgagtacatccgccggctcgcgcccacgatcggcgacgaacccctgctcatcccgtacgggtccggcggccacctcgtcgacgaactcgccgtacggttgccgggcgacgcggtcgcctccgtccgcgtcgacgcgggcatgcccgcggtcgaggcagacgacgtggcggtgcgcaccgtggtggatgccgcgggccgcgcggtctggcggcccccggcccagcagctgcggtttcagcccggcagggcacctcgtctgctgcactggcggccgcctctgccacacgcttcgacggtggggaccggcttgcaacggctcgccgacggctggctggtggaggtggtccgatgcggcctgtggatacgtcccgatcgggaggacgacgacgccgtacggcggatccctgccgatcctgatcgtctcctgctcctggtcggtgcgccgggggcaccgccggcgacggaggtgtggccggcagtgcgccgcctgctcgacgcactgcctgcggaccaacgggagcgggtacagccggtactgcccgccggcacggcccagccttccggattcccggccgcgtggaggctgtccccggatgcggacgcccaggcccgctga

SEQ ID NO: 1705 - DNA, 228 bp, Actinoplanes utahensis
gtggaacttcgtcgaagcggcgtcgcccgcgggcgacggctgacctcgtggcccagcgtgcgcaccgacctgcgcaacgccggggcggaggtggtcgacgagccggtcgtcaccgacggcaacatcaccaccagccggtcccccgacgacctgccggccttctgcgaacgcatcctgcacgagttcgccaaagccccgcagcccgtcggcgccgcgggccgggcctga

SEQ ID NO: 1706 - DNA, 390 bp, Actinoplanes utahensis
atggccggagagctcaacggacgccggatcgccatcctcgccgccgacggggtggaacgcgtcgaactggaacagccgcggcaggccctcgacggcgcaggcgcccgcaccgtcgtggtctccatcgccggcggtgagatccaggcgcgcgaccacgacctggaagcagccggcgccttcacggtcgatcagctggtcggcgaggcatcggtcgacgacgacgaggcgctgctgctgccgggtggcacggtgaacccggacaagctgcggatggaacccgcggcggcgcgattcgtgcgggacttcgtccgttccggcaagccggtcgcctcgatctgccacggcccgtggaacttcgtcgaagcggcgtcgcccgcgggcgacggctga

SEQ ID NO: 1707 - DNA, 1161 bp, Actinoplanes utahensis
atgaaggcagtggtgtacgagggaccgcgacaggtcagcgtcaaggaggtgccggacgcgcggatcgaacggcccacggatgtgctggtgcgcgtcacatcggcgaacatctgcggttcggatctgcacatgtacgagggccggaccgacttcgaacccggccgctggttcgggcacgagaacctgggccaggtcgtcgaggtcggcgacggggtcgacaaagtgcaggtgggcgagtacgtggtcctgccgttcaacatctcctgcgggcattgcaagaattgcgagcggcagctgacgaactactgcctgaccgctcagccggagccgaagatggccggcgccgcatacggtttcgcggacatggggccatgggcggggggacaggccgaactgctccgggtgccctggggcgacttcaactgtctgcggctgggtgcggacgccgaggagcgtcaaaccgactacgtgatgctggccgacatcttcccgaccggctaccacgccaccgagatggccggcgtgcagcccggtgaccagacggtcatctacggcgccggtccggtcggtctgatggccgccctgtcggcgaccatccgcggagcgagcaaggtgatggtcgtcgaccggcaccccgaccggctgcggctggcggagtcgatcggcgcgatcgccatcgacgactcgaaggtcgacccggtgcaggccgtcctggaccagacgatgggactcggggcggacaacggctgcgagtgcgtcggctatcaggcgcacgagccggacggccgggagcaggccaacctgacgatgaaccggctggtcgcctcggtgcgcttcaccgggaggatcggcaacgtcggcgtcttcgtgccccaggacccgggcgccggcgacgagcttgccaaacagggcagactcgccttcgactacggcatgttctggttcaagggccagcacatcggcagcgggcaggccccggtcaagaagtacaaccggcagctgcgcgacctgatcgccgccggcaaggccgaaccgtccttcatcgtcagtcacgagctgcccctcgaccaggcgcccgaggcctacgagcacttcgacaagcgcgacgacggctggacgaaggtcgtcctgcaccccgcgatggccggggcaggtgcctga

SEQ ID NO: 1708 - DNA, 1176 bp, Actinoplanes utahensis
gtgagggcgaacacctgggcggggcgtaacaaggtcgaggtccgcgacgttccggatccgaagatcctgaacgggcgcgacgccatcgtgcggatcacctccaccgcgatctgcggctcggacctgcacctggtcgacggctacgtgcccacgatgcaggacggcgacatcatgggccacgagttcatgggcgaggtggtcgaggtcgggtccggggtgtccgcggaccggctgcgggtcggtgaccgggtggtcgtgcccttcccgatcgcctgcggcgcctgtgccgcctgcgtcgccgagctgtactcctgttgcgagaacaccaatccgaacgcgggaatcgcggagaagatgttcggtcacccggtcgccgggatcttcggctactcgcatctgaccggcgggttcgcgggcggccaggcgcagtatgcgcgggtgccgttcgctgacgtcggcccgctgaagatcgagtccgacctgaccgacgagcaggtgctgttcctgtccgacatcctgcccaccggctacatgggcgccgagatgtgcgacatccagcccagcgacgtggtggcggtgtggggcgccggcccggtcggccagttcgccatggacagtgcccgggtgctgggcgccgcgaaggtgatcgccatcgacaaggagccgtaccggctgcggatggccgagcaggccggccacatcccggtgaacttcgacgaggtcgacgtgcggtcccggctcctggagctgaccggtggacgaggaccggacaagtgcatcgacgcggtcggcctggaggccacccacggcagtgcgcacatcgccgcgtacgaccggatcaagcaggccgtgcgctcggagaccgaccgcccgcacgcgctgcgccaggccatcatgtcgtgccgcagcggcggcgtggtctcggtcatcggcgtgtacggcggcctgctggacaagttccccgccggtgcctggatgaaccggtcgctgaccctgcgcaccggccagtgccacgtgcaccgctacatgaggccgctgctggaacggatcgagcgcggtgagatcgatccgactcggatcatcacccacacgctgccgctggacgaggcggaccgtggcttcgagatgttcaagaacaagcaggacgactgcgagaaggtcgtcctcaaaccctga

SEQ ID NO: 1709 - DNA, 723 bp, Actinoplanes utahensis
gtgccgggtttaggggattctccgcgggtatccgcacgtcgggaagccgttcgccaagcaggttgccggctggacgagtcgcggtcgggcagtggcgcgaccggcggctccgcgcaggccacccgcatcgagcgcatcggcccgacgccggtggcgcgagccaaccacaagggaggacccatggaattgacggccacgaccaccgttcgcaaacccgcggcggaggtgtacgggttctggcgtgatctggagaatctgccgaccttcatggcgcatctcgagcaggtccgcaccaccggtgaccggacgagccggtggacggccgacgccccgttcggcaaggacgtcacctgggacgcggagatcgtcgaggagatccccggcgagcggatcgcgtggcgctcgaccgggaacgccgacgtgcccaacgccggcaccgtgcgcttcctaccggcccccgacggtgtgagcaccgaggtgcacgtcgccctgacgtacgacattccgggtggcgccgtgggcaaagcggtcgccaagtacttcggcgaggaaccgcatcaacagctcgacgacgatctgcgccggctcaagcaggtgctggagaccggtgaggtggtccgatccgacggcgccccgtggggcaagcgggcgcgcaaggagttcccgcagcgtccggcacagccgctgtcggacgaggaactggcgaagggagcggacgcgtga

SEQ ID NO: 1710 - DNA, 549 bp, Actinoplanes utahensis
atggagttcctgtgctaccaccgagaccgccccggctcgctggcgctgcgtcacgaactgacggaagcccattgggcatacatggatcgtttcgagaaggagatgatcgcccgcggcccgacgctgtcaccggaccgcaccgctccgacgggaagcctgcacatcgcagatctctccggtgctgccgccgcccgcgcattcgccttcgacgagcccaaccatcaagccggtgtgtaccgggacctggtgctgcggcgatggcggaatgccctcggacgtacgatgtgggacttccccggtggcccggtcgatgacaatgggtacctggtgctcggtttcggagcgggcccggccgtcgatctcgaggtacccgcggggcgacatgatctgatcgcctacggcccgctgctgtccgacgacggcgcgacctggctcggcacggcgtcgctgctcgtggcctcggacccggaggcggcgtgcgctctgctgacgcgtgatcggtacgactcggtggaggtgcaccgttgggcacccggtggaagacgatga

SEQ ID NO: 1711 - DNA, 3426 bp, Actinoplanes utahensis
atgccacgttcggcacgaggggtgctgacagcatctctggtatccctgggggtcctgaccgccgctgcctatccggcggcggcgttcgcggcgccccctgtcgtcaagctgccggccaccgccggccagccggctcgtggcgtcatcgtgatgctgcgcgaccagcacaaggacctgaaggtcacccgcagcagcaattcgccgcgtgcgctcgccgaccgtaaggaccaggctccgctcctcagccgcgcccggtccgcgggtttccgcgacctgcacggattctcgaacgtcaacgcgttcgccgggaccgcgacggccgcgcagatcgccgccctgaccgcggatccgtcggtggccgccgtcttcccggacctgccgatcaccaagacgccggtggccgggcggcccgaggcggcggccgccacccggaccagccccgcgaccagcaaagcggcgcagatctgcccgaccgatccgagcaagccgctgctcgagccggaggcgttgcagacgacgaacacggcgttcggcaatccggcgacgccgcaggcgcagtcgctggcgaccggcgccggggtgaaggtcgcctggctggccgacggcatcgacatcaacaatccggacttcgtccgcgccgacggcagccacgtcttcgtcgactacaaggacttctccgaggagggtccggacgcgccgagttcgtcggccgaggccttcggtgacgccagctcgatcgccgcgcagggccgccaggtctacgacctgtcgacctatgtcaacccggcgcacccgctgccggccggctgcaccatcaccgtgcggggcatcgcaccgggcgccagcctggtcggcctgaaggtgttcggcgccgcccccaccgcgcccacctcccggttcatcgaagctctcgactacgcggtgaatgtggccggggtcgacgtgatcaacgagtcgttcggctcgaacccgttcccggacctgggcaacgacccgatctcgctggccgacgacgccgccgtcgacgcgggtgtcacggtcgtggcgagcaccggtgacgccggcctgaccggcacggtcggatcgccggccagcagcgccaaggtgatctccgtcgccgcgtcgacgacgttccggtcgtacctgcaggagggctactcgggcgcccgtgacttctccaacggcacctgggccagcggcaacatctcgcagatcagctccggcggggtgacccagcgcaaccgggtgcccgacctggccgctccgggcgacctcggctgggcgctctgcacgccgaatccggacgtctacgtcgactgcaccgacgacaagggtgacccggcgtcgctccagaacttcggtggcaccagccaggcatcaccgttcacggccggtgccgcggcactggtcatcgaggcgtacaagcggacgcacggcggcgaccggcccaccccggacctggtgaagcggctgctcaccagcaccgcgaccgacctcggctacccggcctcccagcagggtgccggccagctcgacacgctcggcgcggtccgcgccgcgctgagcttcaaggacggcaacggcgcgccgcaggcgcagggcacctcgctcgtcgtcgaccgcagccagctgtcggtcgccggtcagcccggccacaccgtcacctcgaagctgggcatcaccaacgtcagccgcaacacccagaccgtgcggctgtccacccggacgctcgggaaggccaccagcacgacgaacggcacggtcacgctgaactcggcgacggccccgaccttcgtcgactcgaccggcatcgtgcgcagttacgtgatccagaagttcaccgtcggcgtcggtgccgaccggctcgacttcgcgctgaccggggcgtccgcaccgggagcgctgaaggccagcctgatcgacccgcacggcacgttcacgtcctacacgttcgcgcagggcgccggcaactggggccacaccgacgtgcactacccggcgttcggcacctggaccgcgatcatcttcatcaccaaggcggtcgggttcaacggcccggtccactaccaggtctcgacctcgaacttcgcccgcttcggtacggtgtcgccgtcgacggtgacgctggcgccgggggcgagcaagaaggtcacggtcagcacgaagctgccgtcgaacccgggtgacaccagcgcctcggtgcagctgtcgaccccgctcggcgtcaccgtctcggtgccgctgaccgcccgcacgctgatcccggccgggcgtgacagcaacagcttctccggagtcctgcagggcggcaacggccgtgccggcgccggcgggaacgcccagtcgaacttctactacatcgacgtgccggccggtaagaaggaccttggcgtgagtgtctcggtggccgacccggcggtgcagttctccggcgtgctgacgtcgccggacggtcaggtctactcgtaccagagcaaccggtacgtgaccgcggccggcgaagcgaccaacgacaagtcgctgcagctgtaccgacgcaacccgcgggccggtcgctggacgctggcgctcgatttcaccaacccgcagagtggggccgaggtcagccagccgttcaccggcaagctcaccttcaacacggtgaaggtgtcggcggcgctgccgtccaaggccacgctgaccgcgggcaagccggtcaccgtgccggtgacggtgaccaacaccggcgccgcgccgctggcgtacttcgtcgacggccgcctcaccaccaccggcgacctgccgctggccgagatctccggtgcgccggggaccatcgatctgccggtgccggccggcatcgtcccgcagtggatcgtgccgtcggaaagcaccggcgtgaccttccaggcgtccgccaccctcccggtgaacctggacgtcttctacaactccggtgagccggaggtctactcggccgcgcagggcaacagcgcggtcgtcaaggtgcaggcgccgctggtgtcgccgggcgtctgggccgccgacatcggcgagagcgggccgttcgacggaccggcgccgatcggcacggtgcaggtcgcggcggtggcccacacccggctcttcgacccggcggtgacctcgtcgaccggtgacttctggcagaccgcgctgtccggcgcgccggacagcgcgctgtcctcggccgtgcgggccaacgccaaggccggccggttcgtcaccgcggccgggagccgggccgcggccgccccggcgccgatcgtggtggctccgggcaggtccgcgaccatcctggtgaccatcaccccgagcgccccgcgcggcaccacggtgcgcggtcacctgtacgtcgacacgttcagccagatcactgtctccggtgacgagctgatcgacctgccgtacagctaccaggtcggctga

SEQ ID NO: 1712 - DNA, 1251 bp, Actinoplanes utahensis
atggcatcgaccggggcgcgcagggtgtcgttactggcgttcgcgacgctgttcgtggtgggaacggacacctttctggtggcgccactgctgccgaccctctcccaggcattcggcgtcggcaccggtgtctcggggtggatggtgagcgcgtatgcgctcggctatgccgggctggccctgttcgccggcccgttctccgacggacgggaccggcgcgccgtgctgctcggcgggctgctggcgtttgcggtgacgaccgcgctgtgcggattcgcgcagggtttctggagcatgctcctgttccggttcctggccggggtgagcgccgccttcgtgaccccgcagatctgggcgtccattccggtgctggtggcgccggaggtcgtgctccggacgatgggattcgcgacggccgggctgtcgatcgcgcaggtggtcggcgttccggtcgggagctggctggccgcggtgtcgtggcatacgccgttctgggtggtggccggggcgtcggtgctcctgtggctggcgctggcgcggctcttcccgtcggtagggtcaccgtcggcgggcgggatccgacagacctacgctgccgtgctgcgggatcggacgctcgtgctctacctgctggcctacctggtcttccagaccggcaacttcgaggcgttctcgttcatcggatcgtggctcacccgtgacttccggctcggggtcgccgaggtgggcaccgcgatgatcgcgctcggtctcggcaacacggccggagcgctgttcggcagccggctggtgcgacggatcgggcaacgcacggcgctgctcaccgcgtacgccatcctgatgctgtgctatgcgatgctgccgttcgcgccgggtctgggcatcgcggtgacgctgttgacggtgatcttcctggtgggtggcttcatcttcccggtcttcatgacgatgctgcagtcgcgggccacggcggcgcgcggcaccgtgtcgtcgctgtcgaacgccgcgatgtacgccggatcgacggtgggcggcgtggccggcggggtgctgctggccggcgtcgccgggttccatggggtcgcggcgttcaccgtcgtcgcgtacgcggtgtccctcggtgtgttcgccgcggccggcgccctcaagcggcagccgtcaccaggctcagcagcccgggaaaccgccgctccagctcctcggtgcggaccttcacgaaacgatgcgtgccggacagccgggtctgcgtga

SEQ ID NO: 1713 - DNA, 624 bp, Actinoplanes utahensis
atggtggaacgcggcacgagccgccgggcggagcacctcacgccggtggcccaaccggagaccgaggcgccaccggtgctggccgacgagctgttacgggccgtcggccgcggtgacgagcaggccttcgggcgactgtacgacctggtggccccccgggtgtacgggctgatccggcgggttctgcgggatccggcgcaggccgaggaggtggcgcaggaggtgctggtcgaggtgtggcgcaccgcggcgcgcttcgatccggcccgcgggtcggcgaccgcctgggtgttcacgatcgcgcaccgacgcgcggtggaccgggtgcgcgccgagcagtccgcgtccgaccggaccatccgggccggtgcggcggcgctggacacgccgtacgacgcggtggccgacgaggtctccggtcggctggaacgccagcaggtacggcgctgcctggacgtgctgaccgagctgcaacggcaggcggtgaccctggcctactaccagggtcactcgtatccgcaggtggcggaattgttgaagacaccgttgccgacggtgaagacacgcatgcgcgacggcctgatccggctgcgcgactgcttgggcgtggaggtgacggcatga

SEQ ID NO: 1714 - DNA, 753 bp, Actinoplanes utahensis
atgatcgcggacattcattcgctggtcggcgcatacgcgctcgactcggtggacgatctggaacgcgccgccttcgagcggcacatcggcgattgcgaggcctgccggatcgaagtggccgagctccgcgagacgaccgcgcggctggccgacagcacctggtcggcgccgccgccgcggctgcgggagaacgtgctcgccgcgatcgcgacgacccggcaggcgccgccgctgaccgcggcgacgccgtcccgcgaacgggccgcgacgcgggcccggatgtcccggcgccagctgttcagtgccgcggccgccgtcgtggtcgcggccgccggggccggcacggcggtctacacgatccaggatcagcgcgtacgcgatgagcgggccgccgccgaggccgaccgtgacctgcaggcacgggtccgggccatcctcggctcccccgacgtggtgctgcgcggcgagcagctgcgggacggcggacgggtgaccgtggcgtactcccggctgcgcgacgccggcgtggtcaccctcgcggctgacggtccacccagcggcgggcgggtgtaccagctctggacggtccgttcccgggtgccggtggacgagggcgcccttccggtcggccagtcctcggtcgtgaagatcgtcgagcgcatgtcgtccgccgaggtcgtcggcgtctccgaggagccgcccgggggttcggcccggccgaccgacatggtggccggcgtgaaaacaatctga

SEQ ID NO: 1715 - DNA, 645 bp, Actinoplanes utahensis
atgcgcgcaacgaagctcaccgccctggccgccgcgaccgtcttcgcgatctcgttggcggcctgcgggagtgactcggacagcaacagcggcagcggcacggcggcggccccggcgaccaccgccgccatgcccagcgcggccccgagcatggccaccgacccgacggtcaacttcggtcccggctgcgccgcggtgcccgccgacccgtcgaacgcgggcagcttccaggccatggccaaggtgccggtcgcgaccgccgcctccggcaacccgctgctgtccaccctggtcagcgcggtcaagcaggccgggctcgtcgactcgctgaactcggctgacgggatcaccgtcttcgcgcccaccaacgacgccttcgccaagatcccggaggcgacgctgaagaaggtcctcgccgacaagaagacgctgaccagcatcctcacctaccacgtggccaaggggaagctcacccccgccgacctggccggcagccacgagaccctgcagggtggcaagctcaccgtcaccggcagcggcgaagacttcaaggtcgacggcaccgcctcggtgatctgcggcaacgtgcagaccgcgaatgccaacgtctacatcatcgactccgtcctgatgccgaagaagtga

SEQ ID NO: 1716 - DNA, 129 bp, Actinoplanes utahensis
gtgagcctgccgggtcgcggctgcgaggagttccgcggccgcgacccggtggtggccgcgacgatcccgctgatcgtcgcggccggtttgccgccggtcacttcttcggcatcaggacggagtcgatga

SEQ ID NO: 1717 - DNA, 372 bp, Actinoplanes utahensis
gtgatcgacgccgctccggtcgccgtcaaggatttcgcggtacgcgggtggggcgtccccgacaagccggccctgctcgccgcgaccgccctggccgaccctgctcgcggcggcgaccgggctgacggcgaagcggtggcgcccgcccgcgatcgcgggcggaaccgttccccgggcggccggggtggcggcgacgctgacccggccgcgcaattccgcgcagcgatccggctgccggcgccggcccgccccgtgcccgacggcggggcgccccgaccgctcaccaccaccgggcacctctaccgggtggacacggcgctgactgtgccacgcatcgctgcggcgagtgccggctgcgcatccacggcatag

SEQ ID NO: 1718 - DNA, 192 bp, Actinoplanes utahensis
gtgcgggccggcgcggaccggatcctcgcccgctccgccgacggcatgacggtcggcacatcgctgagcaccgcgctggacgggcgcgacaccatgcccgccgtcggcatgaacggcgagcccctccccctcgacccggcttacccgtccggcagccggaggcccgcgccgcaccgttcccggacggggtga

SEQ ID NO: 1719 - DNA, 321 bp, Actinoplanes utahensis
atgacggacgacgatcgggtgttcaaggcgctggccgacccgagccgtcgctttctgctcgatctgctgttcgtgcgggacggtcgcacgctcaccgagctggagaccgagctggagatgacgcgcttcggcgtcgccaagcatctgcgggtgctggaggaggcgggactcgtcgtcacccgccggtcgggccgggagaagctgcactttctcaatccggtgccgatccggcagatccacgaccggtggatcgacaagtacaccgagcaccagatcaccaccctcatcgacctgaagcgcacgctggaggaggagtcatga

SEQ ID NO: 1720 - DNA, 507 bp, Actinoplanes utahensis
atgagcgagaccaaggtgttccggatctggatcaaagccacgccggagcggatctggcaggcgatcaccgacccggagtggaacgcgaagtacggctatgccaccccgcagtacttcgagctgaccaagggcggccgataccactccacggccaaccaggggatgctggactacgccgcggcgcagggattcgagctgcccgacccgattctggacggcgaggtgctggaggcggaggccccgcgccggctcgtgcagacctggcggatgctgatggatccgggcaccgcggccgaggggttcaccacgctgacctacgagatcgaggattcggcgcccggtgtctgccgggtgaccatcacgcacgacgtgacggacgcgccggcggtgggcgccatggtgtccggcaacccggacccggcggccgagggcggcggcggctgggcgtgggtgctcagcgacctcaagtcgttgctggagaccggcaaggtgctggctgacgcctga

SEQ ID NO: 1721 - DNA, 99 bp, Actinoplanes utahensis
atgacggtgttctggttcatccttctcggactggggacggcgatgagcgggacggccatctggctcgcggcccgggatcggcgccgcgggcgggggtga

SEQ ID NO: 1722 - DNA, 897 bp, Actinoplanes utahensis
gtgagagatccacgggtcggcgtcgtcgtcatcacctggcagcggcgcgaggaggcgctggcctgcgtcgagcggctgctggccctgcccgagcagccgcccgtcgtgctggtcgacaacggctcgacggacgggaccgccggcgcggtccgcgctgcctttccccaggtcgacgtcatcgccgcgggccgcaacctgggcgcggtcggtcgcaatctgggggtccgccggttgaccaccccgtacgtggctttctgcgacgacgacacgtggtggcggcccggctcgctcgcccgtgccgccgacctgctcgacgcccacccgcggctggccgtggtcaacgcccggatcgtggtcgagccgtccggcgccgaggacccgatcgtcgccgagctgcgcgactcaccggtgcccgccccggactggctgcccggcccggcgctgggcagcttcctggccggcgcctcggtgctgcggcgcgacgcgttccagcaggccggcgggttcagcgcccggctctggctgggcggtgaggaggagctgctcgccaccgacctggtcagcgccggctgggaactctgctaccgcgaggatctgaccgtgcaccaccacgcgtcgaaactgcgggacgccacccaccggcggcgggtcgggctgcgcaacaccctctggttcacctggctgcggcgaccgctggcccccgccgtacgccggaccctctttctggcccggaccgtgccccgcgaccggacctcgctgctcgcggcctgcgacgcggcccgcggcctgggctggctgctcgccgagcggcgggcccgcccgcaccgggtcgaggtgcgcctcgcgtcgttggacgaggcgcagcggcgctcggcggcccgtcgatacgtcggctga

SEQ ID NO: 1723 - DNA, 612 bp, Actinoplanes utahensis
atgccggagcaaccgcagtggtcggagcggacgctcgacatgccgccgcaggatccgtgggccgatcagcccacgtcgccggtgcacgagttcgacgccacccagccgacgccggtcagcccgcacccgccggcgagcccgcagtcaccgttcagccaggggcgcgcgcaggtcaacccgcgcgtgcaccgtgagcctgagccgaccgcgacccacgagccgaccggcaccggctggcccggcgcgcagccgccgcgtccgcgccacagcctgcgctggcacgtggaccagctacgtcggggcggcgagtggagcaccgcggccgcgctgttcgtcttcgtctgctggggcatctgggcgctgtccggcagcggttcgctgtccctcccgctgaccgccctgctgctcacgctgctggtcggggtcggcgtgttcgcactcgcccggctggtcggacgcctggtgctggagcggtacctgaaccggacgcggcacaccgcccgcggcgcgcacctcgtgtccggactgttcctggtcgtcgccggcttcgccttcctgcaccagaccgaatgggtgatgacggccttcgactgggtcaagcacgtgttctga

SEQ ID NO: 1724 - DNA, 1212 bp, Actinoplanes utahensis
atggacggcattgacatccggcgaggttccagcgccgacatccccgcggtctgcgacctgatcggcatcgtgttccacgaggatctcaccgacgagggcagacaggacgaggccgaggtcttcgagccggaccggtcgctgatcgccgacgaccggggcgtggtggccgggcacacgctgacgcattcgcggcatctcacggtgcccggcggggtgctgccggctgcgcacatctccagcgtcggggtgctgccgacgcaccggcggcggggcatcctgaccgcgctgatgcgccgccagctcaccgagatcgcggccgggccggagcccatcgcggtgctctgggcgagcgagacctcgatctatccgcggttcggctacggcctggccgcccaccggttcaagctctcgatcgagaaccgcgaggtccggctgccggaccggccggccggccggctccggatgggtgacccgggcgacctgcgtgacgatctcgtcaagatgtacgacgcgatccgcccgcagcgggtcggctggtcggaccgcgacgaccgctggtggcgccacgtgctgcgggacatggagtcgcaccgtggcggcgccacccggcggcgcgcggtggtccacgacggcgcggacggcagcccgaccggttatgcgctgtggcgggtcaagccccgctcgaccgcccacggcccggcctgcgaggtgcaggtccgcgaggtggtcgccgccgacccgcagacgtatctggcgctctggcgcttcctgctgagcatcgatctgagccgcaccgtcaccttcgacctggccgcggtcgacgagccgctgcagtacctggtggacgagccgcgccggctcggtcccgagttctccgactcgctgttcgtccgcctgaccgacctgccggccgcgctggccggccggcggtacgccgccccggtcgacgtggtgctggaggtcgacgatccggtcctgccggccaacgccgggcgttggcggctcaccggcggcccggattcggcgacctgcgtgcggaccggcgacccggccgacacggtgtgctcggtgaccgatctgggcgcggcctacctgggcggcacctcgctgtccgcgctcgcggcggccggccgggtacggcagctgaccgccaacgatccgggcgtggcgttcggctggcaccgggcgcccagcgtgaccgagacgttctga

SEQ ID NO: 1725 - DNA, 222 bp, Actinoplanes utahensis
gtggccaagcggcccgccgcgccggccgccgctgaggaccgggaggccgagcgcggtctgcgcgggctggtcggttccggctcgtcgcaggtgggtgtcggtgccgcgctgcgcgcccgggacgcgtcccggcccaccgaggcggatctcgcggcggccgaccgtgacctggtgatcgtccgccgcaactggcttccccgggaggatctcccccgccgctga

SEQ ID NO: 1726 - DNA, 702 bp, Actinoplanes utahensis
atgcagtggaagaaccgccccaatggcctgacctggtcaggagtcatcaagaacgaggaagccaagcgggaggcggcggcccggctggccgccgagctgcaggacgggcagaccgtcgggatcggctccggctcgaccagcttcctcaccctgcaggcgctggccgcccgggccgcggccgagggcatcgcgttcaccgcgatccccacctcgatcgaggtggccaacgcctgcgccgcgctgggcctgcgcaccgcgacgctgaacgaggcgcgccccgactggtgcttcgacggcgccgacgaggtcgacccgaagaagcggttgatcaagggccgcggtggcgcgctgtaccgggagaagctgatgatggccgcggcgccgaaggcgttcatcgtggtcgaccagtcgaagatcgtcgagcgcctggggcagaacttcgcggccccggtggagatcgacccggacgcgttgagtctgatcttcgagcagctggcggactttcccgggctggacgaggtcaccctgcgcccggccgggggcaaggacggcccggtcatcaccgagcgcggcaacctcaccctcgacctgcggttcagcgagatcgccgacgacgcgcacacccggctcaagcagatgtccggcgtcgtcgagaccggcctgttcttcggctacgactacgaattgatcctggccggataa

SEQ ID NO: 1727 - DNA, 918 bp, Actinoplanes utahensis
atgctccacccgcaggtgacggcggcggcgagacttcgccgccgcccctccgccgaggagtcggcgggcagcccccacgagcggctgcggtacacccgggccgcgatggaggagtccaacgaggcggagaccggcccggcgctgcccctgccggtcgtcgccgacctggacgccgacggggtgccgtgccggctgtacgccacccgcgccggcgctccgctgctggtctatctgcacggcggcggctggtgctacggcagtatcgagaccgtcgaccggttctgccggcgggtcgccgaccggtccggcctggcggtgctgtcggtgggctaccggctcgccccggaacatgtccacccggccgcgctggacgacgtcgccaccgtgctcgaccacgtccgcaagaacgccgcggagctgggtgtggacgcgtcccggctggcgatcggcggggacagtgcgggtggccagctggccaccgtgaccgcgcgccggcagcgggacgccggcacgccgctggacttccaggcgctgatctacccggcgctcgacccgctgacctccgccgagtcgtacgacgagctgggggagtacgggctggaccgggcctcgatgcggctcgcctgggagaccttcgtgccgcagccggcgctgcggctcaccccggacgtggcgcccctcgcggtcgccgacctgtccgggatgccggccacgctgatcatcacggcggagtacgacgtgctgcgcgacgagggcgccgattacgcggacgcgctgatcgcggccggggtgccggtggtgcacacccgctacatggggatgaaccacggcttcgcccggaagatcgcgacgatcgacgcggcgcgggcggcggccgatcaggtggccttcgcgctccgcgccgcgttgatcttctag

SEQ ID NO: 1728 - DNA, 1197 bp, Actinoplanes utahensis
atgacggtcgtgcacccgatcagccgggcctggatcaccactggcggcaccggcgcccagaattacgacgagttcgccgacgacgccgaaatcaccgacatcatcaccgccaacccgcacagcgcgctggccgtggagatgccgcacctcgcgcccgagaccctcggcaagaccttcgcggacagcctcccggacgccgtcgtccggctggagcgcgacaagtccgagggccactaccggcacgctgagcacgtcgtggtgctctaccggatcaccggcaaggacgagcccgcggcgtacgggctgtggagcatggtggacaccgaccagatctccaccagcgccgacgagccgggcctggtcatccgcaacgaggacgtgttcatcgccaaggtccgcgagcgggtcgcgctggccggggcgctgcagaccctgctctccccggtgctgctgctgcagaccggcaagggcgaggaactgcacgcggcgctggcgcaggcctgtgacgcggccggcgagccggaggccaccgataccgaccagagcggccgcacccacgccatctgggtggtcggcgcgggcccgctgcaggaccggctgaccgggctggccggcggcggtgagctggtggtcgccgacggcaaccaccgcagcctggccgcgcagaccggcgggctgccgcgattcctcgcggtgatcacgacgcccgcgtcggtggcgatccagccgtacaaccgcctggtcggcgacatctcggtgacgcccgacgagctcgccgagcggcttcgcgaggccggtgcgacggtcaccgagctgccgcgtcccgcggagctgcccgccaaggggacgatcgagctgtacgccgcgggccgcacgttcgcggtcggcctgcccgccgcggcgtccgccaccgccgtggagaacctcgaccacgccctggtggagcgggtgctgctgggtgacgtgctgggcctggagccgggcgacaagcggatctcctacatcggcggcgactacccggtcgcctggctgcgcggcgaggtggacgccggccggtccgcgctggccgtgctgatcgccccggtcaccgtcgacgatttcgtcgaggtcaacctggcccggctgaaactgccgcgcaagagcacctggttcaccccgaaagcgcggggcggcctggtcctcgcgcagctcggctga

SEQ ID NO: 1729 - DNA, 237 bp, Actinoplanes utahensis
gtgccgtcgttggatggggtgatgtacacctcatccagcgacgcgggcggcgtgaccgtcggcgtccaacgcgcagtatggccggatttatcccctgagctggcggaactcgtcgccccgccgatcatcgtcaccaccgggccggtgaaacgaccggtgaacgcgcatcgacgcgcacagttgagccggtcacgcgggaacatgccggtgggccggcaccggcacaccgccgggtaa

SEQ ID NO: 1730 - DNA, 3330 bp, Actinoplanes utahensis
atgaggtgtacatcaccccatccaacgacggcaccggtgaacaggtggcgaaccagtcaaaaagaactagtcgaaaatcgggccgatctcgcggctgcgcttgatctcgtagaagccgggtgtgccggccaccagcaggacgccgtcccagagcctgccggccgcctcgcccttgggcgccggcgtgatcaccgggccgaagaacgcgaccgtctcgccgtcgaccgggccgggcgcgtggatgaccggcgtgccgacatccgtgccgaccggcttcatgccggcgttgtggctggcccgcagcgcctcgtcacgctcgtcggtgagcgcggccgcggccagttccggatcgaggccgacctcggtcagcgcctcgcggaacagcttctcgtccaactcgtacttctgcaggtggatccgggtgccgagggccgtgtagaggtcacgcagcacctgcgggccggcggtctcggccgcggcgatgcagacccgcaccgggccccagcccttcgacatcagttctcggtactgctcgggaaggtcgcggccctcgttgagcacggacaggctcatcacgttgaatcggacgtcgagggggcgcaccttctccacctcgagcagccagcgggaggtgatccaggcccacgggcacagcgggtcgaaccacatgtcgacggtggcgcgttcagtcatacatcgatcctgccaccaccgggacgcgcccggccgcataggcttcgggaaaagcagtcagctcgaaggagagtgcacgtggccggtgttcacaacctgacccaggtcgaggccgcggagcggagtcgattgctcgaggtgaccgggtacgacatcaccctcgatctgaccgacggaaacggcaatcccggttccggcgtcttccgctccaccactgtcgtgacgttcgggtgcaccgagcccggcgccgagacgttcatcgaggcggcggcggtcaaactgcaccgcgccacgctgaacggcgaaccgctcgacctggactcctggtcggcggagaagggtctgccgctgcccggtctggcggccgagaacacgctcgtcgtcgagggcgacttcgcctactcggcgagtggccagggtctgcagcgcagcgaggacccggtcgacaaggagatctacctctacagccagttcgagaccgccgacgcccagcgggtgtacgcggcgttcgaccagcccgacctcaagagcgagttcacctggcacgcgaccgcgccgaaccactggaaagtggtctcgaacatgccggtcgagcgggaggagccggtcggcgcgggcgcgcggaccgtccacttcgcgaagtcgccgcggatgagcacgtacatcaccgcgatctgcgccgggccgtaccacgaggtccgtgatgcgcacgacggcatcgagctgggcgtcttctgccgcgcctcgatggcccgatacctggacgccgacgacctgttcctcatcaccaagcagggcttcgacttcttccacgagcagttcggggtgcgctacccgctgcccaagtacgaccagctgtgggtgccggacttcaacgccggcgcgatggagaacttcggctgcgtgacgcacgccgaggcgcactacatcttccgctcgcaggtcaccgactacgagtacgagcagcgggccaacacgatcctgcacgagctcgcccacatgtggttcggtgacctggtcaccatgcgctggtggaacgacctgtggctgaacgagtcgttcgccgagtgggccagccactggtgcaacacgcacgccacccggttcaccgacgcctggtcgacgttcctggccatgcgcaaggcgtggggttaccgccaggaccagctctcctccacccacccggtgtactgcgagatgccggacctggaggcggtcgaggtcaacttcgacggcatcacgtacgccaagggcgccagcgtgatcaagcagctggtcgcctacgtcggactggacgcgttccggaccggcctgcgggcctacttcggcaagcacgcctggggcaacgccaccttcgacgacctgctcaccgagctggagacggcgtccggccgggaactgcgcaagttcgccgcacagtggctggagaccgcgcaggtcaacacgctgcgcccggtcgtcgagctggacgacgagcagcgctacacccgcgtgacggtgctgcaggaggccccggccgactacccgacgctgcgcacccaccggatcggcatcggtctgtacgacctggacggcgaccgtctggtccggcgcgagctgctggaggtcgacgtggccggcgagcgcaccgagatcaccgcgctggccggggtcaaggcaccggacgtgctgctgctcaacgacgacgacctgacctacgccaagctgcggctggacgagcgctcgatgggcgtgctggtcggccacatcgccggcttcgagtcgtcgctgccgcgggcgctgtgctgggcggccgcgtgggacatgctgcgcgacgccgagctggccgcccgggactacgtgcagctggtctgctcgggtctgccggccgagagcgacatcaacctgaccaccgccaccctgcggcaggcgggcagcgcgctggtcagcttcgccgacccggagtgggcgccgcagggctgggcgatgctggccgagctggcgcagagccggctggcggtcgccgagccgggcagcggatggcagctgacctgggcgcgggcgttcatcaccgcggcgcgcaccgaggagcaggcggcggtgctgcgcggctggctgaacgacggccgggcgccggccgggctggtcgtcgacaccgagctgcgctggtcgctgctgcaggcgctggccgcgatcggggcggccaccgcgcaggagatcgacgaggagctcggcggggaccggacggccagcggcgagcgggaggcggcgatcgcccgggcgctgctgcccaccgcggagaacaaggcgcgggtgtgggccgagctgaccgggccgcaggccctgccgaactggctcaaccggtcactgctgcagggcttccagagcacccggcaggtggctctcacggcgccgtacgcggagaagttcttcgccgcggtgggtgacgtgtgggcccgctcggacagtgagccggcgcaggagttcgccaccctggcgtacccgagcttgcagatcagcgaggacacggtcgcgctgaccgacgcctggctggcgcaggacgggcatccggcgtcgctgcgccggctggtggccgagggccgggacgggatcctgcgggcgttgaaggcccgcgcgaaggaccgctccgcgggctga

SEQ ID NO: 1731 - DNA, 546 bp, Actinoplanes utahensis
atgctcagccagggttcgccggcgcgctggaatgcgccggtcggccgatggaccgaacccgacctgcacctgttcccgcaggacggtcatcggtacgagatcgtcgacggcagcctgcacgtcaccccgccaccgcgggacgcctcgcacgacgccgtggtcgaggcgatcgtcacgacgctgcgcgccgccgccccgccggactggtgggtgtgcgtccgactgggcgtggagatcgcggagagcagtctggtgcccgatgtgaccgtgctgcgcccgcggtcgtccggggcggtctgggtggacccggccgacgtggcgctggtggtcgaggtggagtcggcggagacccggctctacgaccggctgctcaagcccgcggtgtacgcgtcggcgggcatcccggcgtactggcgggtcgcgcccggcctgctgaccgtctacaccctggacgatggggagtacctgcatgtggcggagggcgccgagcatctgcgcctcgacgccccgtatccggtgcgggtgaccccgaagggctggttctag

SEQ ID NO: 1732 - DNA, 390 bp, Actinoplanes utahensis
gtgacaagtggtgagctggccgacgccgatcgcgagactcccttcacgacgagtcagctgctgcgcctcgacgaggcgctgcgcctggccgaccaggcgaccggcctgaccttcagcatctatctcggtgagctggccgagccggtccgcgaatccgccgagaaactccacgccgagatccggaatccgcagcgtgccgtgctgctggcggtctcgccggaccagcgccggctggagatcgtcaccggtgacgaggcccgccggcggatcaccgaccgcgacgcgaaactggccgccttcggcatggccggctcgttctccggcggcgacctgctgggcggcctgctgatcggcctcgaccagctggcctcgcacgccggtagggcctag

SEQ ID NO: 1733 - DNA, 288 bp, Actinoplanes utahensis
gtgtctgtaaccaccaccgttctggtctatgtgatcatcccggccgcggtcatcggcacggtcgccgtcatcgtgttcgccggctccggcaagggcaagccgtcccggcgctaccgccccggccggccctacgagttcgccccgatgtggttcctggccgcgcccgagcgcgccgcggccggtcacgggcacgcgaccccggcgatcgagcgtggactggtcatcgaggacagctccggcgccccggtccggcccggcccgacaggaggcgcaagtgacaagtggtga

SEQ ID NO: 1734 - DNA, 495 bp, Actinoplanes utahensis
atgcgcctggccgtcgctctcgttttcccggtgctcgccgccgtcctgctgctgccaccacccgccgcgcgggccgccgcggtggtctacgtcgagctgaacccgagcaccgtgcgcgccggggacaccgtctcggtgcgcgcctcctgtgacgacaacctgaaggcggccgcggtcagcgccgccccgatcgggtcggtcacggtcgagccgcagtacggcttcctgaccgccaccgcgacggtgccggtcgggcaccgggccggcgactacccggtgaccctgcactgcccggacggccggacggcgaccgccaccctgcacgtggtcgcccgggtggagccgagccgcgggccggccaccggggggcggcggcaccgccccggagcggatcgtgccgctgctggtcggcggcggcctggtggccatggtcgcgggcgccgcgctgggcctggtgtcgatccgccgccggcgggtgggctgaggccgcggtga

SEQ ID NO: 1735 - DNA, 807 bp, Actinoplanes utahensis
gtgaccgacccgaccggaaagccgccgcacgtgccggagtcggtgcgccgcaaacgcccggcccaggtgatcaccgccccaccgccggggacggtgaccgggccgttgccggccccgcgcccgcagggcggccggccggcgttccgggtgccgctgccacgccgtacgcccacgccccggcccgccccgggccgtcgccggcgctggccgatcggctggatcgcgctgatcctgttctttctcggcctgttcgcggtcggcatgggcctgggcgtggcgaccggcttcgacctggggatgttccgtggcccggacgcgccgccgccgcgctccttcccggtgctggagccgagccgcccggaacggctgagcattccggagctgaaggtcgatgcgccgatcctgcaggtcgggttggccggcgacgggtcggtggacgtgccgccgctgaaccggcacaacgaggtgggctggttcgacggcgggccgacgccggggcagttcgggccggcgctgttcgtcgggcacgcggacacccgcaccgggccgtcggtcttccacgacctgggccggctcaaaccgaaacagcggatcgaggtgcgccgcgcggacggcacggtggcggtcttcgaggtgaacgcggtcgagcactacgacaaggaccagctgccggtgggcaaggtgtacggcgattacagccggccgtcgctgcggctcatgacctgtggcgggcggtggctcgggggcgagcagggctactccgacaatgtggtcgtctacgcctcgctgatcgactcccggaaatga

SEQ ID NO: 1736 - DNA, 558 bp, Actinoplanes utahensis
atgcctgacatacgacccacagtgggctcttccgcgttggtgctgaacgctacctacgagccgctgtgcgtcgtatcggtgcgtcgggcgaccatcctcgtcctcaccgacaaggcggagtgcgtgtccgacggcgacggcatcctgcacagcgcgcacgagcagctcccggtcccgtccgtggtccgcctcacgcggtatgtgaaggtgccctaccgcacccatgtcgggctctcccgccgggccatcttcgcccgggacggcggccgctgcgcctactgccggggctccgccgagaccatcgaccacgtctttccgcgcagccgcggtggtttgcacgcctgggacaacgtggtggccgcctgcgccaagtgcaaccacagcaagggtgacaagaccccggccgagctcggctggcggctgcatgcgataccgcaggcgccgcgcggggtggcctggcgggtgctcgggcaccggacgcccgatccccgctggatggactggctcgacctgcccgacaatcacgccgccccggccctggaagccgaggcggcgtaa

SEQ ID NO: 1737 - DNA, 1077 bp, Actinoplanes utahensis
gtgttccttgctccgtcaactcccgatcccagtcttccgacggtcaacctgaccaagtcgtgcaccgaggactcggtgtgcaactggatgacccaccacgacgtgccgggctggatcgcccagagcggttacgtgatcgtggtcaaaccggtccggatcatcgcgatcatcgcgatcgccatgctgatccgctggctgctgcaccggatgatcacccggctcaccgccagcacctcccgggccgcgatgccggcgctgctcaagccgctgaaggagcggtccgacgtcaccgccgaggacgcacagttcatcccggagcgccgccggcagcgggccgaggcgatcggctcggtgctgcgcagcttcgtcagcgcggtggtcttcaccatggcggcgctgctggtgatgggcgagttcggcttcaacctgggcccgctgctggccagtgccgggatcgtcggggtggccctcggcttcggcgcgcagagcctggtcaaggatctgatcgccggcctgttcatgctgctggaggatcagtacggggtgggcgacacggtcgacctgggcgaggccaccggcgtggtggagagcgtcggcctgcggatcaccacggtccgcgactcgcgcggcgtgctgtggtacatccgcaacggcgagatcgtccgggtcggcaacaagagccagggctgggccatggtggtgatcgacattccgatcgggttcgtcaactcggaggaggcggtcgcggtgctcagcacggccgccgcggcggtggccgagcatccggagcaccagaccgagttcatcgagccgcccagcgtggtcggcgtcgagcagctgaccgtggacggcgccacgatccggacgatcgccaagaccaccgcggacagtcaggcgtccgtgcagcgggagctgcgccgggcgctggccgaggcgctggagagcagcgggatgtccgagcgcatcgccgcgtcccggctggccccgcggtccgcggtgccgccgcccgcctggtacacgacgcccggaaattcctcgtcttcgatcggtgaccagcggcccggcggaacggcctga

SEQ ID NO: 1738 - DNA, 1359 bp, Actinoplanes utahensis
gtggccaacgatccggagggcccacagcacgccgcgaaggttacagaaggcgatcacccggtcaccttccgtagccttctcgcgctgcgggagttccgggcgatctacgcctcccaggtcatcagcgtgctcggcgacttcctgacccgcgccgcggtgaccgtcctggtctatcagcagacccactcggtgctgctgtcggcgttctcgttcgccgtggtctacctgccgaacatcctggtcggcccgctgctggccacgctcggcgaccgctacccgcaccggcgggtgatgatcgcctccgacctgttccggatggcgctgaccgcactgctgctgatccccggcctgcccaccgcgctgatcctgctggtggtgctggtggccagcctgggcacccccgccgggcaggcggcccgctccgcgctgtacccgctggcggtcggccgggaccgcctcaccctggcgctggtcacctccaacagcaccgtgcagatggcccaggtggtcggctacctgaccggcgcggcgctggcggtcggcctcggcccgcgggtcgccctcggcgtggacgtcgccaccttcgcggcctccgtgctgctggtcgccgccggggtgcagacccggcccggcgcgatcagcccggaacgtcgccgacacctgctgaccgagaccgccgagggtttccggctggtcttcgggcatccggtgctgcgcccgatcgcggtggtggtgctcaccaccgtcgccttcagcgtcgtgccggagggcctggccgcctcctgggccgccgaggccacccccaagggcatcccgcaggggatcgaacagggtctgatcatggcggccgcgccgctcggcttcgtcgccggcggcctgctgttcagccacctggtcccggtcgagcgacgctggcggctgctgccgatcctggccgtgctggttccgctgagcctggtgccggtgctgcccggcccgcagggcaccaccgtcgcggtgctgaccgctctgtgcgggatggcggccggcgccgccctgcccgccctgaacgccgcgttcgtcctggtcctgccgctcagccaccgggcccgcgcgttcggcgtgatgagcagcggggtgcaggccagccagttcctcgccgtgctggtcaccggcgtgctggcggaccacgtccggatcccgctggtggtcgcgtcgtggagcgccgtcggggcggtcgcggtcgccctgatcgggctccggtggccgagccgggaacgcttcgccgccgccgagcgggaggcggccgccgagcaggccacggcgccggtcccgcagcaaccgtcccggcccgcggggcaggccgaaccggccacctga

SEQ ID NO: 1739 - DNA, 393 bp, Actinoplanes utahensis
gtgagctccttctacgacgaagtgggcggcgaacccacgttccgccgcctggtcgacaagttctacgagggcgtcgccgaggacccgctgctgcgcccgatgtatccggaggaggatctcggcccggccgccgaccggctgaccctcttcctgatgcagtactggggcggcccgaacacgtactcggccggccgcggccacccccggctgcggatgcggcacgcccccttcccggtcggcccggccgcccgggacgcctggttgacacacatgcgcaccgcggtcgactcgctggatctcgacgacgcgcaccgcacgaccctctggaactacctggagcacgcggcgaacttcatggtgaacacgatggatcccgtcgagccacctcgatga

SEQ ID NO: 1740 - DNA, 1263 bp, Actinoplanes utahensis
atgcgtcgtcgcctgctggccgtcgccaccgttttcctcgccgcgctgggaggttccccgccgccggcggtggccgacatcacgcagtccggcatcgtctcggccaacccggtcgactggaccccgcacgtactcgacggcaccgtctgggcgctcgccgtcgtcggtgacacggtcatcgtcggcggcgccttcacccgggtcgccgacgccggccggcacaccaccctggcccgcaagaacatcttcgcgttcgacctgaacgacggcacgatccgctcgttcgccccggaggtcgacggcgcgatctactcgctcgcccccggcgccgacggcaccgtctacgccggtggcgcgttcaagaccgtgaacggcgcctcctcccgcgggctgacccggctctggctgggcagcggcaaccgggacaccggattccgcgcccacgtcaactggggcgacgtgcgggccctcgccacccgcggcgacgacctgtacgccggtggcaccttctccgcgatcaacggcaccgagcgggtcggcctggcccggatgaacgccgagtcgggcgcggtcgaccggggcttcgacgcccgcctgtccggccccggcctgagccgcgtccgggtcgagcacttcgacgtcaccgcggacggccgcaaactcgtcgcggtcggcgccttcctgcgggccggcagcgccgaccggacccagatcgccctcttcgacgtcggcggctccgcggcccagctcagcggctggtacaccgacgactacaagccgcagtgcatgaagggcttcgacacctacctgcggcaggtcaaattctcgccggacggctcctacttcgtggtcgccgcgaccgggcgggcctcctccgcccagaagctctgcgactcggcggcccgcttcgagaccaaccgcaccggcggccagcatccgacctgggtgcagcgcaccggcggcgactccctctacgcggtggcgatcaccgggccggccgtctacctgggcggacaccagcgctggttcgacaacccgtacggcaccgacggcaacggtccggggccgggggcggtctcccggccgggcatcggggcggtcagcccgatcaccgggagggcgctgtcctggaacccgacccgggcccgcggcgtcggcgtccgcgccttcctgacggtgccgcgcggcctgctggtcggctcggacaccgatcagctgggcaaggagtaccacggccggatcggcatgttcccgctcgactga

SEQ ID NO: 1741 - DNA, 708 bp, Actinoplanes utahensis
atgccttggtggtcatggcgtccgggatcgtccgcggcgaacgagccggacaccggcggcgaggtggcggtgcagagcaccgtccgcgtcggagttccggctcagcgcgagcccggccggaccggggtgccgtccgacaacgacctgagccgcggcgccgaccgcgagcccggtcgcggcgccgcccccgaccgtgtccccgagtgcgagctcagccgcacccccgaccgtgagctcggccgcggcgcgaccccgtccgatctgtcggccgtctccggctccgccgaggtggtcgagccggtcacgctggcccgcatcggcaaggccctcgacctgctcgacattcggttcctcgccgacggcggtggcagcctcctggccatgtgggagcggcacgcggtgctgttcacgctggagggtccggaggacgagatcctggtgatgcgggcccgtccgcacgcgaccgtcccgccggactgggccgaccgggcctaccgggtggtcaacgagtggaaccacacccgccggttctgcaaggcctatgtgggggacgcgaccgagcgcgggcagctgccgatctacgccgagctgcaggtgccgctggccgccggcgcccacgacacgctgctggtggagctgctcgactgcggcgccgcggtcgccacgtcgttcgtggactggctccacgacgagggcgccctgctctga

SEQ ID NO: 1742 - DNA, 660 bp, Actinoplanes utahensis
atgtccgggcacggcctgctcggggtgccggacgccggcgcgttcctggctcggctgacccggctcgacccgggcgccccggtgcggctgcgctccaccgccggccgcaccgcgctctgggcccacctgccgtgggacgtgctggtcacccgcgaggtggcaggacccgggccgggcgacgccacggtgtccgcggcggagctgctggccgtgctggccgccggcggcgcggagctgccggagcgccgggacacccggtggcgctggccgctgccgccggccgcgagcaccgcggtcgagtcggtggccggcgccgaactgacccggctggccgccgcggccgccggcaccctgcgcgaggtgaccgcgggcggggtcgccgggcgcgccgtcgggcagcgggcggtccgcgacgcgctcctggaccacgtcgcgcttgtcgtcaccccggagggagcaggtccggtcgaggtgtcccagcggctcgtccaggcggtggcgcgaatgggatttctcggtcctcgcggcgccgagccggcggacgcccgcgtgcgcacagcggggtcctgggtgggaatttcggcaccatatggagtcgcgtggcgacagagcgcccacaaattgaccgttatgccgatgtcgagtcacccgaaagggtga

SEQ ID NO: 1743 - DNA, 411 bp, Actinoplanes utahensis
atgagtaggcgattcacctacgacgtgcccgtgcgctggtccgacatggacgcgtacgggcacgtcaacaacgcgcgcttcctcaccctgtacgaggaggcgcgcgtggcgatgttcttcgtcggggcgcgcaaccacggcctcggctcgttcgaggagggcatcgtgatcgcccgccacgagatcgactatctgcgcccggtggacttcggcgagccggtccgcgtcgaaatgtggatctccgagctgcgggcggccgcgttcaccgtgtcgtacgagctgttcgacgacggcgtgctggccagccgggcgaaatcggtgtgcgtgccctatcacctggccgccgggcacccgcggcggctgaccgacgccgaacgcgacttcctgaagccctacgtcgaggtggcctga

SEQ ID NO: 1744 - DNA, 1677 bp, Actinoplanes utahensis
gtggcccagtacatctacgtcctggaaaaggcgcgcaaggcgcacggcgacaaggtcgtgctcgacaacgtgacgctgagcttcctgccgggcgccaagatcggtgtcgtcggcccgaacggcgccggtaagtccagcctgctcaaaatcatggcggggctcgacaagacgagcaacggcgaggcccggttgatgcccggctacaccgtcggcatgctcgcgcaggagccgccgctcaacgacgcgaagacggtcctcggcaacatcgaggaggcggtcgccgagaccaaggccaagctggaccggttcaacaagatcgccgagcagatggcgaccgactactccgacgagctgatggacgagatgggcaagctccaggaggagctcgaccacctcgacgcgtgggacgtcgactccaagctcgagctggcgatggacgcgctgcgctgcccgccgccggacgccgacgtcacccagctctccggtggcgagcgccgccgggtcgcgctgtgcaagctgctgctcgaggcgcccgacctgctgctgctcgacgagcccaccaaccacctcgacgcggagagcgtgagctggctggagcagcacctggccaagtacgcgggtaccgtcctggcgatcacccacgaccggtacttcctggacaacgtggccggctggatcctggagctggaccgcggccgggcgatcgggtacgagggcaactactcgacgtacctggagaagaaggcggcgcgcctggcggtcgagggccgcaaggacgccaagatgaagaagcgcctcaccgaggagctggagtgggtgcgctccaacgccaaggcccgccagaccaagtcgaagtcccggctcgaccggtacgaggagatggccgccgaggcggagaagacccggaagctggacttcgaggagatccagatcccgccgggcccgcgcctgggcaacaccgtcatcgaggtcaacggcctgaccaagggcttcgagggccgcacgctgatcaacaacctgtcgttctcgctgccgcgcaacggcatcgtcggcatcatcggcccgaacggcgtcggcaagaccacgctgttcaagaccatcgtcgggctggagcagccggacgagggctcggtgcggatcggtgagacggtcaagctttcgtacgtcgatcagagccgcgccggtctcgaccccaccaagacgctgtgggaggtggtctccgacggcctcgaccacatgatggtcggtaaggtcgagatgccctcccgggcgtacgtggcggccttcggcttcaagggcccggaccagcagaagccgaccaaggtgttgtccggtggtgagcgcaaccggctcaacctcgcgatgacgctgaagatcggcggcaacgtgatcctgctcgacgagccgaccaacgacctggacgtggagacgctgtccagcctggagaacgcgctgctggagttccccggctgcgccgtggtgatctcccacgaccggatgttcctcgaccgggtggccacccacatgctcgcgtgggagggcaccgacgaggagccggacaagtggttctggttcgagggcaacttcgaggcgtacgagaagaacaagatcgaccgcctcggcgccgacgcggcccgcccgcaccgggtgacgtaccgcaagctcacccgtgactga

SEQ ID NO: 1745 - DNA, 483 bp, Actinoplanes utahensis
gtgatcgccacggtgttgctgaccatcatcggcatgatcggcgggtatctgctcagcgagcgtcgcgacgcccggggcaccgccaggccctccgcctcggccaccaccgacgcctccgacgggccgtcgttgctgcccaccgaggggttgtgccccgaccagacccaggagatggggcaccgcaacggcgcgaccggcgacctgctgcaggtgttccgcgtcaccaccgagcgcaagacggtgatctggatctgccaggacgaccgggggcggctgttctaccacgccaaccgcggtggcaccgccgcgccgtggaaggagggggtcaccgcgctgtttttggccggagtgacgaggcaggacgacggcagtttccaggcggtcgcgccgcaggacggcaacaccttttcgatcaaccgggagcggctgctggtcaccaagtcggacgggaccgaggcggaacagcgggtggtcggcgactga

SEQ ID NO: 1746 - DNA, 1503 bp, Actinoplanes utahensis
atggcatccaagtcaagaccccgagagcagagtgggtacgttccttggtggctacgcacagtaggctcgctaggggaacagaaaccacccggaggtgtactcagcgtggcccaacgaagttccttcgtcgtcgtcgccaaccgtctgcccgttgacgaggtcaccctgcccagcggggagaagcagtggcggtccagtccgggaggcctggtcacggcgttgcatccggtgctcaccgagcatcgcggcacctggatcggatgggcgggcggcgacggaccggcgcccgagccgttcgatctcgagggcatccacatccacccggtgccgttgagcgccgacgagctggaacgttattacgagggtcagtcgaacgcgacgatctggccgctctaccacgacgcggtggagacgccggcctacaagcgccgctggcgcgactcgtaccgtacggtcaatcagcggttcgccgaggcggccgcggacgtcgcggccgagggcgccaccgtctgggtgcaggactaccagctccagctggtgcccgcgatgctccgggagatgcggcccgacctgcggatcggcttcttcctgcacatcccgttcccgccgatcgaactgttcatgcagatgccgttccgggccgagatcctgcgcggtctgctcggcgccgacctggtcggcttccagcagcgactggccgcgcagaacttcgtccggctggcccggcacctgctcggcctgcgctacgagggccagtcgatcctggtcgacggccggcgggtgaaggccggggcgttcccgatcagcatcgacacccgggacatggagcggctggccgccgacccggcggtgcaggcccgggccaagcagatccgcgccgagctgggcgatcccaagacggtcatcctcggcgtcgaccggctggattacaccaagggcatcgagctgcgcctcaaggccttccgcgagctgctggccgacgagaaactgcaggtcggcgacgcggtgatggtgcaggtcgcaacgccgagccgggagcgggtcgagcattaccagacgctgcgggtcaaggtcgagcgtgaggtcggccggatcaacggcgagttcggcaaggtcggcacgccggcggtgcactacctgcaccagtcggtcgacaagcaggagctcgccgcgatgtacgcggccgccgacgtgatgatggtgaccccgctgcgggacgggatgaacctggtcgcgaaggagtacatcgcctgccgcggtgacaccgggggcgccctggtgctcagcgagttcgccggcgcggccaccgagctgcgccagtcgttcctgtgcaacccgcacgacccggacggggtgaaggacgcgctgctgcgggcgatcaacgcggagccggccgagctcaagcggcggatgcgggtgatgcagcggcatctgcgcacccacgacgtcgcccggtgggcccgcacgttcctggacgaactcaccgtcgacgacgagagctga

SEQ ID NO: 1747 - DNA, 1209 bp, Actinoplanes utahensis
atgagcctctatcccctcgccctccggctggagggccgtcgcgtgctggtggtcggcggcggctcggtcgccacccgccgggtgcccgcgctgatcgcggccggcgcccgggtcgacatcgtctcgccggtgctcaccccggcgctgcaggcgtacgtcgacgccggccgggcccgctggacaccgcggcgcttcgagccggccgacgtggccggcgcctggctggtccacgtcgcggtcgacgacccggaggcggccgcgcaggtcagcgacgcggccgaggaacaccggatcttctgcgtccgcgccgacgaccgggacgccgcgaccgcctggacgcccgccgtcacccggcacggccaggtgaccgtcgcggtgaccgacggtggtgaccggcggcgggccatggcggtccgtgacctggtggcgcacgcgctggaggcggcacccccggtcgcccccgagctcaagggcgtcgcgctggtcggcgccgggccgggcgacccggagctgatcacggtgaagggccgccgcctgctggccgccgccgacgtggtggtcgccgaccggctggtccccgggatgctgctgggcgagctgcggccggaggtcgagctgatcgacgccgccaagatcccgtacgggccgtcggccgcccaggaggagatcaaccggatcctggtcgaccgggcactgcagggcagattcgtggtccggctcaagggcggtgacaacttcgtcttcggccgcggcggtgaggaggccctggcctgcgccgaggccggcgtcccggtgctggtggtgcccggggtgaccagctcgatcgcggcgcccgcactggccggcgtgccggtcacccaccgcggggtggcgcacgagttcacggtcatctccgggcacattccgccggagcacgccgactcactggtcgactgggccgccctggcccggctgcgcggcaccctggtggtgctgatggggctgaagaacctggcgaagatcgccggccggctgatcgccgagggccgggacgcggccaccccggtcgcggtgatccaggaggggtcgaccgcgcaccagcggtccctgcgcagcaccctgggagcggtcgcgcaggacgtggcggcggccggcatccggcccccggcggtcgtggtgatcggcgaggtggtgagcgcgacggccgggttcaccccggcagccggctga

SEQ ID NO: 1748 - DNA, 1053 bp, Actinoplanes utahensis
gtgaccctggagaccaccctggcggccatccgcccggccgacgagcgggccatggccgccgctcgcgagctgcagtcccggctgaccaagccggccggctcactgggcgcgctggaggagctgtcggtgcgcctggccgggctggccggggtctgcccgccgccgctgcccgcgccggccaccgtcgcggtcttcgccggcgaccacggcgtgcacgcgcagggtgtcaccccgtggccgcaggaggtcaccgcgcagatggtggcgaacttcgtggccggcggcgcggtggtcaacgcgttcgcccggcaggccggcgcggacgtgatggtggtcgacgccggggtgaagatcccgctgcacggcgggcccaacctgctggacgccaacatccggcgcggcacccgggacatgaccgtcgagccggcgctgacccgcgaggaggcccgggccgccgtcgagctcggcgccgcggtcgccgcccagctcgtcgccgccggtgcgcgatgcctgctcaccggtgacatggggatcgccaacacgacgcccgccgcggccctgatcgcggtcttcaccggcagcgcgccggccgtggtgaccgggcgcggcaccggcatcgacgacgccaccctggcccgcaagaccgaggtgatcgcggccgcgctggcccggcacaccccggacccggccgacccgctcggcgcactggccacggtcggcggcctggagcacgccgcgctgaccggtttcatcctcggcgcggccgccgcccgggtgccggtgatcgtggacggggtgatcgccgcctcggccgcgctggccgccgccgcgttcgccccggacgcggtcgccgcgatggtcgccgggcaccgttcggccgagccgggtgccaccgtcgccctgtcccacctgggcctggagccgctgatcgacctcgggatgcgcctcggcgagggtagcggcgcggtgctggccctaccgatcgtcgcggccgcggtccgggttctgcacgaggtcgccacgttcgattcggcgggggtctcagagaagtga

SEQ ID NO: 1749 - DNA, 1083 bp, Actinoplanes utahensis
gtgcggcatgctgtcccggtgacccacgaccttgatcatcacggcgacgcggaggtgggcgacggcctgatcgatctcgcggtcaacgtgcgccaccaggcgatgccggactggctcgccgacccgatccgggaggcgctgacccggctgtccgcctatccggacgccaccgccgcgaccgccgcgatcgccgcccggcaccggcgtgacccggccgaggtgctgctcaccgcgggggccgcgcagggtttcgtgctgctcgcccaggcgctgcgcggggcccgccggccggtcgtggtgcacccgcagttcaccgagccggaggcggcgctgcgcaacgccgggcacaccgtcgagcgggtgctgctgcgcgaggcggacggcttctgcctcgacccggggctggtcccggacgacgccgacctggtcttcgtcggcaatcccaccaacccgacctcggtgctgcacccggccgcggacgtggcgaggctggcccggcccggtcgcgtgctggtggtcgacgaggcgttcgccgacaccacgtaccgcgacgatcgtcccggcgaaccggaatcgttgaccgagcgtcgcgacctgcccgggctggtagtgctgcgcagcctgaccaagacctggggcctggccggtctgcggatcggctacctgctgggtccggccgccctgctgccccggctcgccgcggcgcagccgctctgggcggtctccacgccggcgctggcggcggcatcggcctgtgcctcgccgatcgcggtcgccgccgagcgcgagatcgcggccgcgctcgcggccgagcgggcccacctggtggaacggctgcgggaggtgccgaaggtcacggtcgccggtcatccggcgtccgcttttgttgccgtacgcctgcccggggccgatcggatacgcacccacctgcgggaacgtggctacgcggtgcgccgcggcgacaccttcccgggcctgggccccgactggctccggatagcggtgcgcgacactgccaccacggaccgattcgtgcagactctgcgagaagtgatcggcgatgtgagcgaggagcgaccgtga

SEQ ID NO: 1750 - DNA, 2160 bp, Actinoplanes utahensis
ttgtcataccttcgaagggtgactgaccgacgccccaccgtagccggaagagtcgccctcctgatccgtgccgggctgatcgcgggcctggtcatcgccggcctctcctatccgttcacggcattggccgggatgggcgtcaaagccggcaccgacgccctggacaacatgccggagcagctcaccgaggtgcccgcggcgcagaccacctacgtgtacgccaaagacggcaagaccctgctgaccatgttctacgaggaataccggcgtcaggtgccgctcaaggacatgtcgccctacatcacccaggccatcgtggcctccgaggacacccgcttctacgagcatcacggggtcgacgcgaagggcgtggcccgcgcgttcgtcgccaaccagcaggccggcggcgtctcgcagggcgcgtcgacgctgaccatgcagtacgtccggatggccctgcgggacagcgcgaaaaccccgaaggaggcactggaggccaccgagcagaccgcggcccgcaaactgcgcgagatgcggctcgccgtcgaggtcgagcagcggctcagcaagcaggagatcctgcagcggtacctgaacgccgcctacttcgggcaccgggcgtacggcatctacgcggcctccgaggtgttcttctcgaagccggcgaaagacctcaccctcaacgaggcggcactgctggccgggttggtcaaggcgccgtccgcgtacgacccggcgaccagggaccaggacgccgccctgcaacggcgcaactacgtggtcgaccagatgctgaagatgggctcgatcaccgaggcgcaggccaccgccgccaagaaagccaagatcaaacttcggttgagtacgccgccgaacgactgcgtgtcggtctccgacgagcacaacgactggggcttcttctgcgactacttcaagaactggtggcgggaacagcccgcgttcggccgcaacgtcctggaacgggaggagaacctgcgccgcggcggctaccgggtggtcaccacgatcgacccggccgtgcagggctacgcgatcagacacgtgctggacaaggaggggcgcaacagcccgttcgcgcacggcgaagtggtgatcgagcccggcaccgggcgggtggtcagcatggcggtgaaccgccggtactcgctgcagcaggacaacaacggcaagcacagcgaccggaaccagcgggacgtccgcggcaactatccgaacacggtgaacccgctgctcggcggcggcgacatggccggctaccaggccggctccaccttcaagatcttcacgctgctggccgcactggacgccgggctgccgctctccacgtcctactacgccccggaacggttcgtctccaaatacatcaccgcgcccggcccggcgacgtgcggcacgcactggtgcccgaagaactccagcaagtcgatgaccggcgaacagaccatgtggagcggtttcggcaaatccgtcaacacctacttcgtccagctggaacagcgggtcggcgcggagaaggcggtggcgatggccgaaaagctcggcctgaagtggcgcaccgcggtcgaccgcaccctggccacaccggaacacgccgccgggtggggcgcgttcaccctcggcgtcagcgacgccaccccggtcgagatcgccaacgtgttcgccacggtcgccgccgaaggcaactactgcgagccgctcccggtcatctcgatccgcacgccggacggccgggacgtcacctccaggggccggaaggtcgccgatccccgctgccaccgtgtcttcagccgggacgtggcccgcgccgccaccgacgcggcccgctgccccaccggttacggcgccgcccgcggcagctgcggcggctggggcacgtccgagatggtgtacgccaccatgggccggccggtcgccggcaagagcggcaccacggacaacaacaagaccgcctggttcagcggcttcaccccgcagctggccgcctccgcgttcgtcgccgacccggacaacccggagcattacgtcggctcgggccgctccaccatctcgaaatacacggtcgcggaaacgttgcgggacgccctcaagggccggcccgaactcgacttcaccccaccgtccgacaaactcgtctggtag

SEQ ID NO: 1751 - DNA, 657 bp, Actinoplanes utahensis
gtggccgctcgcctgccgctggatctggacccgccggttcgtcggctcaaagctctgctgctgggggtcgacgaccgcgagttggccgctgcgacaccctgccccggctggtccgtcgcgaccctcctcgatcatctgatgcggctggccgaggcgttcaccgacgccgcgcacaagggcgctgacgcgtccgggaccggcccgcccccggcgccgtccgccgagcatctgtccccgcactggcgcagccgcctgccggtgctgctggaggagctcgccacggcgtggcatgacccgtccgcctggcgcggcacggcccgggccggcggggtcaccatgcccgccgccgagctgggcacggtcgccgccaacgagctggtcatgcacggctgggacctggcacgcgccaccgggcaggacttcgcggccgatccgcgcgtcctggccacgctgatcacgttcctctcggccggcccgccggagggtaccccgggcttcctcggcccacgagtcccgatcgacccgtcggatgacgacgacctgccccgcgccctcgccctcgccggccgcgatccgtcctggcggccaccccggatgcgcgacgtccccacggcccgcctccgccacgaccagccccccgccgcccgtccggcctga

SEQ ID NO: 1752 - DNA, 2793 bp, Actinoplanes utahensis
atgacccggacattaatcggcgccgttctgcgccgcgaggcgacggtccgcctcctcgacccgatcgaccggttccgcggccttccccgcggcggcccgcaggtcggcctcctcgacccggtcgcgggggcggtccttgctcgcgcggcgtcggtcggcgacgtcgacgcggtcgcgggggcggtccttgctcgcgcggcgttggtcggcgtcgtcgacgcggtcgcgggggcggtccttcttcgcgcggcgggcctcgacctccgcgacgcggtcccgggtgcggggcgcgggggacgccaccggttcgccggccggctcggggcgttcgccggccggggcgttgacgccgtgcgcctcccggcgcgcctgatagccccacagggcaagggccatgaccgagaacaaccaccactggacggcgtagccaccgttctgccaggcgtcctcgtgatcgatcgggaccgccgcgaaggccggatcgttggccggcgtctgggaggtcagcagcacatacgccccgtacacgggaaatggcagctcgtgcgcgagccggggcacgttgatccggcgggtgtcccaccggccgtcacgtcgctcgatcggggcaggtcgactttccgacaggtgaacctgtccgacaacggtcacctggccggtgggtgcgggcggcgcctgcgggggagcgagcgctccggcggccgccggcggcacccagccgcggtcgaccagcacggccgtgccgtcggccagcatcagcggggtgacgatctcgaaccccacgtcgccgttgaccgtgcgaccccgggcctggatctcgtgcgccgggtcgtagcggccggtgacggtaacctttgtccaggccacagccttgccgggggaggcgcccggggtgccctgcacggtgggtgcggcgagcttcgacgtcatcggcacggccggcgtcgagtccgccgcgtcgatccgggcgttgatctcgctgcgctcgtgataccggcggagctgccagttgccgagcatcaccatgatcaccgaggcgaccacggcgaggacggcggtggccagccagcggggtgtcagcaggaaccggtacaccccccgaggctacccggcgaggcggtagcctccgccgcagccgggtactgtgcgaacttccggcggccaatagcacgtgaccgccggtccgcgaaaccctcgggggaaacattgatcaccgcccagccccgtctggtcgtgagcgcgccgtcatccggccacggcaagaccgcgatagccgtcggtctgctcgccgcgatggccgcccgcgggctgccgacggcgggtttcaaggtcggcccggatcacaccgatgcggcgtacctcggattggcggccggacgccccggccgcaacctggacccgcggctggtcggcgcgcagcggatcgcgccgctgttcgggcacggtgccgccggggcccagctgtcggtgatcgagggcgccatgggcctgttcgacagtctcaccggtcagccggagatcgacggcaccgccgcggtcgccgccgcgctgcgcgccccggtcgccctggtggtcgacgtggccgcgatggggcactcgctggccgcgatggtgcacgggttccggatgttcgacgagatggtccacctgggcggcgtcatcctcaaccgggtcgcctcgccgcgccacgagcagatgctgcgcagcgccctggacgacatcggcatgccggtgctcggtgcgctgcgccgcggcgacctgcccaacgtgctgccgtcgcgcgcgcacgggctggtcccggtcgcgcaccgcacggtcgaggccggtcgcgccgtgcgccggctcggtgaggcggtcgcccagtcactcgacctggaccggctgatggcgctggccaacgcggccccgccggtgccgggcccgctctggacgccggccgaggcggccggcgagcccgccgacatgcggccggtgatcgccctcgcgggtggtccgggcgccccctacacgtacgtcgagaccgccgagctgctgaccgccgcgggcgccgacgtgatcgtcgtggacccgctccgcgacgagtcgctgccgccgggcacgcgggcgttgatcgtcggttccggtcttcctgaggggtacgccgaggaactctccgccaaccgtcacctctgtgccgacgtggcgcaattcgcccgcgacggctggccggtgatcgccgagggggtggcgctgccctggctcggccgtgacctggacggccgcccgatgtgcggggtgctggacatcaccggcaccaccggcgagcagaccgtcgccggctatcgggaggccaccgccccggccagctcggtcctcgccccggccggcgcccggatcaccggatacaagcagcaccgcgctgtggtcgcgccgcgcgccggtgccaccccggcgtggacctggtcgggcggcaacccggagggcttcgtctggcgtcagatccacgcctcccagctgggcctgcactgggcagccgccccggaaatcgcgaaacgcctggtggcagccgcgatcgcgggaccggtcaagccgggcgggccgggccaccagccgtccggccacgggccgcagtccggcagcccgatgccgcagccggccggccacgcctcttcgggccacggtccgtcgtcgggccacgcctcttccagccacggtccgtcgtcgagccacgcgccggcggtcgggcacggggcgccatccgcggggccgggcccgcagcagccgggcgggcatggctcgccgctagctagctag

SEQ ID NO: 1753 - DNA, 471 bp, Actinoplanes utahensis
atgaccttcccgccggacgacccctggggcacccccacgccggccccggccgggcccccgccgactccgcccgtgccgcggccgcagcccgcgtcgccgtatgagccgccccggcagagcggcccggtcatcgtgcagatcgccgagatcgaggtcacctcgtcgacgatccgcaccccggccggcgacttcccgctggccggttcccgctggcaggtcaatgagttctgggtgaccttgcgccgcaccccgctctgggccaagatcgtcggcttcgccggcatgtgtttcacgttcggcctgagcctgctgctgttgctggtcaaggagacggcgccgcagggcaccgtgcaggtcaccgtcaccagcggcccccagcagtacgtcgcgcggatcgccgtcaacgacgagcaggacgtgatcacgatcaatcagcaggtcaactacgtgcggagcctgtccgccctgtga

SEQ ID NO: 1754 - DNA, 1548 bp, Actinoplanes utahensis
atggggatcgtgcggtttcttgacattgcggccacgtcggcggcggttgcggcgaccggcgggcggaaagcgaagatcgagctgctcgcgcacgcgctgcggcggctggagccggacgagatcgcggccggttccgcgtatctcgccggggagctgcggcagcggcagaccggtgtcggctacgccggcctgcgagagcggccggccccggcgctggagccgacgctgaccgtcgccggcgtggacgcgtcgatcgccgagatcgccacggtcgcgggagcgggctcccaggcgcggcggcggcagctgctcggcgcgctgttcggcgcggcgaccgcggacgagcagcggctgctgaccgggctgttcagcggggagctgcgccagggcgcgcaggccgggctgctgaccgaggcgatcgcggtggccgcggcggtgccggtcaccggcgtacgccgcgccctgctcctgtccggcgatctgaagcaggtcgcggccgcggccctgaccgggggagcggccgcgctcgccgcgatcagcttgcgggtgggcacaccgctcaccccgatgctcgcgcagagcgcgccggacatcgccgccgctctgctggccaccggcaccccggcggtggtcgacaccaagctcgacggcatccgcatccaggtgcaccgctccggcgacgaggtggccgtcttcacccgcagcctggacgacatcaccgaacgcctgcccggcgtggtcgccgcggcccgggcgttgccgctgcgcgaggtggtgctcgacggcgaggcgatggcgctcgacgagcagggccggccccgcccgttccaggagacgtcgagccgcgccgccacccgggcgaagacgggcgggaccgacgccgcggccgtgctggtgccgtacttcttcgacctgctgcacctggacggcaccgatctgctggacgagcccggccgggtgcgctgggccgcgctggccgacgcactgccggcggggctgatcgtcggccggcagaccgtggagacgcaggagcagggggccgccgcgttcgccgccgccctggccgccggacaggagggcgtcgtggtcaaggctcccgacgcgccgtacgacgtgggccgccgcggctccgcctgggtgaaggtgaagccccggcacaccctggacctggtggtgctggccgtcgagtggggacacgggcggcgccgcggctggctgtccaacctgcatctgggcgcccgggatccggagaccggcgggttcgtcatgctgggcaagacgttcaagggcctcaccgacgagctgttgcgctggcagaccgaacggttcaaggaactcgcggtcgacgacaacggctgggtggtgcgggtccggccggagcaggtggtcgagatcgcgttcgacggggtgcagacgtcgccgcgctatccgggcggggtcgcgctgcgcttcgcccgggtgctgcgttatcgcgacgacaagccggccgccgaggcggacaccatcgacgcggtccgggcgatcgggggcggcgccgtgacctcctga

SEQ ID NO: 1755 - DNA, 294 bp, Actinoplanes utahensis
atgcgttcgataggtgctgttccgaacggcagcgtgacccggcccaagcccgccgggccacgcgccactctggatcggcttcggactcgcgatcggatcgagtcgatcgcgcggctgcgtgccgcggtccgggctctgggggacgtcgacgtctccgggtgggacgacgccaccctcaccgagcatctcgacgagctctcccaggcactgtgtggcatcgacaccgagctgacccgggttgcagaggcggtccgcgcccgaggtttccgaatagacgagcagcgcgccgcgtag

SEQ ID NO: 1756 - DNA, 1479 bp, Actinoplanes utahensis
atgaccgagctgtcgtgtgaggtcctcgtggtgggcgccggcccgaccgggctgatgctcgccaactggctgacccggctcggggtgcaggtgctcgtggtggacggcaaggacggtccgacccgcgagtcccgggccctcgtggtgcaggcgcgcagcctggagatctacgaccagctcggcatcggcgaccagatcctcgacgcggcgaaccgggcggaggcgatctcgcccggcagcggctcccgggtgttcggccgggtgccgctcggggcgctcgggcgcggcaccacgccgtacccgttcctcgaggtcctcgaacagagccgcaacgaggagatcctctacgaccacctgcgcaagctcggcggtgacgtgatctgggagaccccggtcaccgcggtcacccaggtcgagaggggactcgaggcgaaggtcggcaaccacaccgtccaggcccggttctgcgtcggctgcgacggggccaactcggcggtccgcaaggctcgccggatcgcgttcgagggcagcaccaacgcgcatcggttctacgtgctggatgcggccgcggcggccggtctggtcggcggcgcggtcaacgtgcggccgggcgggcgggacttcctgctcgccttcccgatgcccggccgggacaactggcggctgatcggcatcgtccgggacgtcgacggcgactccgcgctcgacgaggacgacgtgcgcggccggctgcgggagttgttcgcggtcacctacaccgaggcgcgctggttcgcgacgtaccgggtgcatcaccgggtcgccgccgccttccgggacggcccgttcctgctggcgggggacgccgggcacgtccactcgccgatcggtgcgcagggcatgaacaccggtctgcaggacgcccacaacctggccttcaaactcgccgacgtgctgcgcggccgccgccgggacacctggctcgaccggtacgaggcggagcgccgcccggtcgccaagacgctggtggccaccaccgaccggctcttccaggcgatcacctcgcagcgcacgctgagccgggtggtgcggaccgccatgatcccgctgatcgccccgatggcggcccgcgcgctgccgcggacctccggcgggtcccgactgttccagtacgtctcacagacccgcatccactatccgatcggtccgcaggcgcgcaccccggacggcaaacgggacccggtcgtcggccgccgcctgccgtggaccggagcgaacttcgccgtgctgcgcaccgccgattggcagatccacgggtacggcggcgtcgagggcaccgaggccccggatctcggcctcccggtgcacgtcttcccggccgcaccggccaccccgctacagcccggcttgttctatctggtccgcccggacggcttcgtcgcgggccgcgccacgccggccgaggcggaggtgactttccgacacgccttggcggtgtga

SEQ ID NO: 1757 - DNA, 1353 bp, Actinoplanes utahensis
atgagcctgactgaatccgaactgcgcgccacaatcgcgcagcagatgcccggtgtccgcgccgacctcgaacggttggtgcggatcccgggcgtcgctttcgagggtttcgaccattcacacgtggagcgttccgccgaggcggtcgccgatctgctgcgcggctgtggcctcgacacgcagatcgtgcggcacggcggccagcccgcggtgatcggccgcaagcccgccccgcccggcgccccgacggtgctgctctacgcccaccacgacgtccagccggccggtgaccccgagctgtggacgagcgacccgttcgagccggtcgagcgggacggccggctctacggccgcggcgccgccgacgacaaggccggggtgatggctcacgtggccgcgctgcgcgcgttcggtgaccggctgccggtcggcgtggtcgtcttcgtcgagggcgaggaggagtacggctcggactcgctcgacgcgatcattcaggcccaccgtgacgagctgcgctcggacgtgatcgtgatcgccgactccggcaactgggacatcggccagcccgcgctgaccacctcactgcgcggcctggtcaacctgttcgtcgaggtcgaggtgctgcgcggtgcggtgcacagcggcatgttcggcggcgccgttccggacgcgctgatcaccctgtcccgcctgctcagctcgctgcacgacgacgacggcgaggtcgcggtcgacggtctggtcggccgggagggcgccagcgtcgactacccgcaggaccggttccggcacgaggccggcatgctcgacggcgtcaccctgatcggccgcggcacgatcaccgaccggatctggaccaagccgtccatctcggtgctcggcatcgacgcgccacgcaccctggaggcggccaacgcgctgcaggcctcggcgaaggccaaggtcagcgtccgggtcgctccgggtgacgacccgaaatcggtgtacgccgcggtcaagagccacctggagaagcacgtgccgtggggcgcgcacgtcgaggtgaccctggagagcgacggcgacccctgcgtgatcgacgcgaccggccccggtttcgacgccgcccgttccgcgttccggtccgcgtgggacggcaccgagccggtcgacatgggtgtcggtggatcgattccgttcatcgccaccttccaggagctgttcccggatgccacgatcctggtaaccggtgtcgaggacccgcactccgccgcgcacgggccgaacgagagcctgcacctgggcgagttcgagcgggtctgcctcgccgaggtgctgctgctcaagaacgttgcggagaacctgacgaagtga

SEQ ID NO: 1758 - DNA, 1080 bp, Actinoplanes utahensis
atgaccaccgacgaggagaaccgcccggtgcgccgccgggtgacgctgaccgggatcagttcccgggcctgggagcacccggccgatcggggggccctgtccgctctgcgtgagttgcgcggtttcgacgacgtggtgaagacgttcttcgggatgtggaacgagcgcggtttccggctgagctacctggccggctcgatccgcgtcgaccaccggcagtatccgcgggtctaccagcgcttcaccgaggccgcgagcacgttggacatcgccgagctgcccgagctctacgtgacccagtcgccgatgatcaacggctcggcgatcgggctggaccgcccgttcatcgtgatcaccacgggcgcggtggagaagctggacgacgacgagctgcgggccgtgctcgggcacgaactggggcacgtgcgcagcggccacgccgtctacaagaccatcatgatgatcctgaccaactgggcggcgaacatcagctgggtcccggtcggggcgatcgcgctgcgggcgatcatcgcggggatgctggagtggtggcgcaaggcggagctctccgccgaccgggccggcctgctcgccggccaggacccgtccgcctcgctgcggctgctgatgaaactggcgggtggcggtgacctgtcgcagatcgacaccaccgcgttcctggagcaggccgcggagtacgagggtggcggcgacatccgcgacagcatccacaaactgggcatgaccgcctggagcacgcatccgttcccggtcgcccgcgccgccgagctgcgcaagtggatcgactcgggggcgtacgcgcagatcctcagcggcgactacccgcaccgtgactcggatggtgactcgtcgttcagcgcggacgccaaggcggcggcccagtcgtaccgggaggacttcgccaattcgcaggatccgctggtcgggctgctgcgccgggtcggcgacggtgcgaccgacatggccggcgcggctgccggccgggcgatgaactgggcgagcgacgcccggcgccgggcccggggcgacggcaacggcggcgacggcgaagcgagctga

SEQ ID NO: 1759 - DNA, 1581 bp, Actinoplanes utahensis
atgagcgatccggtggtggcggtgggggcgggggcggggccccaacggggccgtcaggcgaacacgctgctgatcgcgggcaccacctcggacgccggcaagagcatcctcaccgccgggatctgccgctggctgcaccgcaacggcgtccgggtcgccccgttcaaagcccagaacatgtccaacaactcggtcgtcgtcgtggccccggacggccgcggcggcgagatcggccgcgcccaggccatgcaggccgaggcctgcggcctgccccccgacctccgcttcaacccggtcctgctgaagccgggcagtgaccgttccagccaggtgatcctgctcggcgaggcgatcgacacggtcaccgccggcaactaccggtcgctgcggcccaagcttgccgagacggcgtacgccaccctgaccgaccttcgtgccgacttcgacgcggtgatctgtgagggcgccggcagccccgccgagatcaacctgcgggacggcgatttcgtcaacatgggtctggcccgccggttcggcatgccggcgctggtggtcggcgacatcgaccggggcggggtgttcgccgcgttcttcggcacgctggccctgctctcgcccgaggaccaggcgctggtctccggcttcgtcatcaacaagttccgcggcgacctgggcctgctccagccgggcatcgacatgatcaccgcggtcaccggccgcccggtgcacggtgtgctgccgttccaccgcgacgtctggctggacgccgaggattcgctagcctacggcaccgtgctgggccgaccgggcccgccgcacggccgggagtggctgcgggtcgcggtgatccgcctgccgcggatctcgaatgcgaccgacgccgaggcgctcgccgccgaaccgggcgtgcgggtgcatctgaccgtcgagccgggcgatgtggccgacgccgatctggtgatgctgcccggttccaaggcgaccgtcagcgatctggcctggctgcgcgagaccgggctggcggacgcggtgaccgcgcacgccgcggcgggcaagccgctggtcggagtctgcggcgggttccagatgctggccgggacgatcgacgacgaggtggagagtgggcgcggcgtcacgccggggctgggcctgctgccggtggaggtcactttcgcggcccgcaagacgctggcccgcagcgccgggtccgcgctcggggcgccggtgggtggttacgagatccaccatgggcaggtcacccgggaggctcccgaggcgtttctgcggtacgccgatggccggcccgagggtgcggtacgcgcaaacgtgtatggcacgcactggcacggcacgttcgagtccgacgagttccgccgccgattcctgaccgcggccgccgcccaggcggggcggcacggcttcacggtcgccccggacacccggtatgcggcgatccgcgcccgggccctggacgtgctcggtgacctggtggccgagcacctggacaccgcggcgctctggcggctgctggaaaacggcccgccacctgggatgccgttcgtgccgccgggcgccccgtag

SEQ ID NO: 1760 - DNA, 987 bp, Actinoplanes utahensis
gtgctcaaccggtggaccgcggacgcggccgggctgatcgccggatacctgctggacgccgcgctcggcgacccgcgccgcttccacccggtcgccggctacggcaccgcggcggccgccctggaaagacgggtctaccgtcccgaccgccgggcgggcgtcctgttcaccacggtggccgtcggcgtgccggtgctggcggggctggccgccgggcgggccacccgccacctgccggccgcccggttcgccctcaccacggccgcgacctggaccgtgctcggcggccgcacactgcgcagagaatcccggacgatggcccgacacctgaccgcgggcgacctggtggcggcccgcgggcggctcggccacctgtgcggccgtgacccgtccgcgctggacgagaccgaactcgcccgggccacggtcgaatcggtcgccgagaacacctccgacgcggtggtggcccccctgctctggggagccgccctcgggccggccgggctgctcggctatcgggcggcgaacacgctggacgcgatggtggggcaccggtccgcccgctacgcccgcttcgggacggcggcggcgcggctcgacgacgtactcaatctcggtccttcgcggttgaccggtcttctgaccatcgcgatggcgccgatcggcgggggcacgccgcgggagacggctcgggtgtggcggcgcgatcggggggatcatccgtcgccgaacgcggggcagtgcgagtccgcgatggccggagcactgggggtgcgcctgggtgggcgaaacgtctatttcggacgcagcgagacccggccgttcctcggtgacgggccgcggccgtccgccgtacatctgcggcgtgcggcgcgggtgtcagcggcggtgggagcggcggcgatgctgctcgccgccggtggtgcgctggtcagaggtggtttcggggcggcgctgcggcgcgccgggcgggacggatcccgatga

SEQ ID NO: 1761 - DNA, 657 bp, Actinoplanes utahensis
gtgtggcgcccggcggcccggccggaaaggggtccgaggccgggccgccggtgcgggaaacccgcacgtgacgatctcgtcgacaaaacccgattccctcgatcgggatgggccgatcggtccgcttctcccggccgccaggcggagcggcccgattggtctcaggacaaccacaaccggcagactgaagtggtgatgctgaaggacatccgcgccgtcgccgaagagacgatggtgctaacgcccgaggatcaggacgccgaatacgtcaacaccacgtggttcggcgcgccaccgcacgaacgcatgggcatgtcgcccgacgaggtggtgaccgccttcgaggagaccgcggccgcgctgcgggaacaggtggccggctccggccaccgcggcaccgccacgttcttcgtctggcatgacccggaagcaggccagctgcgctgctcggtcagcacccgcaaaccgggcgatctggtcttcccggtcacctaccaggtgaccgatgacctgcacgccatcgtggtggaattcctggtcgaccgcgcccccggctcgatccagtggggcgccctcgaaccggtgccctacccggaggaggccggtccggccgcgctggcggtctgggcgttcgatctgacgcccttcggccgctga

SEQ ID NO: 1762 - DNA, 795 bp, Actinoplanes utahensis
atgagtacgccgcggcgcgccatatcagatccaccacgccgccggctgttgtccacactcccgcgccgtccacaggcagatccccgccgaggcgccgcacccgccagtctcatcacgtccgcggcaatcgacgtcaaggagacaacgatgaacgacacctacaccaccatcgtcggcaacgtgctgaccgcacccgaatggcgccgcaccaacaccagcggccagctcgtggccaacttccgggtcgccgccacctcccgccggtacgaccgggacaacaaccgctgggtcgacggcgacaccctgcggatccgggtctccgcgtggcggcgcctcgccgaaggggtggccgcctccatccgggtcggcgacccggtcatcgtgtacggccgcatctacacccgggactggaccgacgacgagtccaacccgcgggtcgcctacgagctggaagcgctcgccgtcggcctcgacctgtcccgcggccgggcccgcttctaccgcacccgggcgctcgccgcgctcgccgtggtcgaggacaccgaggccgagaccatggtcggcggcgagcccgccgacccggtcaccgacgggcaggtcccggtccgcttcggcgaaggccttcccgagccgctgcccggcgagaccgagccggacttcctcgaagtggtggccggcctgaccgaccccaccgacgagcccaccgaggagcccggcgaggagccgccggccgacccggtgaccaccgaggtccgtcgcacccggcgggtcaggcgcgagccggtccccgcctga

SEQ ID NO: 1763 - DNA, 1086 bp, Actinoplanes utahensis
gtggtggtggagatcgacgtcctgggccggccgtatgagcggcacaccatcgagctgggcgccgacgacgagggcccggtcgtggccactctcgtccggcggcgcgccgagcaaccgacccgccgggcggtgctgcacgtccacgggttcgtggactacttcttccagacccatctggccgacttcttcgtcgagcgcggctgggatttctacgccctcgacctgcggaagtacggtcgtagcctgctgccgcaccagacgccgaacttcgcgcggagcatgaccgactacttcccggagctggacgaggcggtccggatcatccgcgagcaggacggccacgaccagttgctggtcagcgctcactccaccggcgggctgatcacctcgttgtgggcgcacacgcggcgtggccggggtctcgtcgacggcctgttcctgaacagcccgttcttcgagttcaatctgccctgggtgatgcgccggccggcgttgtccctggtcgtcgcgatctccgggcgcaccccttaccggattctgccgaccgccgggctgggcctctacggacagagcattcatcaggaccatcacggcgaatggtcgtacgacctggcctggaagccgattctcggttttcccatccggttcggctggctggccgcgatccgccgtggccagcggcgcctgcaggccggtctcgacatcgacgtgccggtcctggtggcctgctcggaccgcacgtaccgcggccgcgagtggcacgacgacgtccacgtgaccgactccgttctggacgtcgaccacatcgtccgcttcgcgccgggcctcggcccgcgggtgacgatcgcccagttcaacggcggtaagcacgatttgaccctgtccggcaaggaggtccgcgccgaggtcttcaccgagctggcccgctggtccgaggcgttcctcgcggccccgggcaccgcggaggtcacgatcccgccggccccggaggatcagggcggccgggcgatcctgctggaggccgcggaggccgccgtcgaaaaggccgccgacgaggcggacgacaagtccggcacgaccgcctag

SEQ ID NO: 1764 - DNA, 333 bp, Actinoplanes utahensis
atgccggacccggactgctgggtccgacgagccgacgcggtgccgatcgcgaccatcggggcccggctttcggtgtggaaatctgccgatgtgctgctcgtcgtggaggtctccgacgaaaccgtcctgcaggacctcaacgtcaagaccaggttgtacggtgcggccggctacccggtctactgggtggtgacccaggagcggatcttcgagcacaccggacccaccgcgtcgggttatcggacccggatcgagtatcggcccggggaccggattccggtcggctacgcgagcctcgaccttccggtcagctcgctgctcagcgacgactga

SEQ ID NO: 1765 - DNA, 999 bp, Actinoplanes utahensis
atgtatcggtcgtcggaaatcggcaagtcgcggcgctggcagatcgtcgcggtcacgggagtagcggtggtcctcgccggcatcggcctcggggtcgcgtccgccgcggagtccacgcccaccgtcaactgcccccaggtcaaggtcaacgtcgccatcccggcgcaagcccagaacgaggtgaagagcaacctggccctgctgcagacacagatcgacgaggccaacaaacggatcgtcgacaccaagggccagggcggcccgaacttcatccagaacgccatcctcggcccgctgaaggacaagcgtttcgccaccatcagccggatcgagacggccatcggccgcaacgcgccgaaacccaacctgaacgcggccggcctgtccgcctgcaccctcaacggcgccgcggccccggccgccaccaccgccgcggccaaccaggcccccggcagcaacctgggcatcctcgccaacaactgcgacaagagcaggctggcccggcacgacggtttccagaagggcgaccgctgcgtcaccaccgagttcggtgaggtcggctcggcggccaacaacccgtcgctgctgatcacccaggcgccccgcgtggtcaaccggaacaccgccttcaccctcaaggtcagcacccgcaacctgatccgcgaccgcttcctcgcggccggccagggcggttactacgtcgagtccagcgtgctgcagaacggcatcgtccgcggccacttccacaccgcctgccggatgctcgccggcaccaacgtcgccccggcccccgacccggtgccggcgttcttcgtcgccaccgaggacagcaagggcggccgcaccccggacacggtgaccatccaggtcccgggcctgccgacggccggcaccgcgcagtgcgcctcgtgggccggtgacggctcgcaccgcatcccgatgatggagcgggccaaccagacccccgccttcgacacggtccggatccaggtccgctga

SEQ ID NO: 1766 - DNA, 141 bp, Actinoplanes utahensis
ttgggaagagaaatgctcgccgctctgctgttcgccgtcgccgcggtcgccttggcggccggtgtgctgctcggatatcgactcggacgggcccagtgccgggctgccggacaccggcattccggcaccggaactcagtag

SEQ ID NO: 1767 - DNA, 126 bp, Actinoplanes utahensis
gtgaccggttcgggcgtcgcccccatcagctctccggaggagagcgacagcgcgtcgcggtggccggcgccgtcgccggcgaccccgccggcccggccgcccctgaccgagacgctcagctactga

SEQ ID NO: 1768 - DNA, 147 bp, Actinoplanes utahensis
atgaccaccgcacaccgcgcaacgaccgagtccccggcgcccgactggatgcccgagatgctggaacgcgccgcgcgacggcgggccgagctggccgagcgggccgcccgccggcaggcgacggcgcagcgccgcgcccatggctag

SEQ ID NO: 1769 - DNA, 1218 bp, Actinoplanes utahensis
atgatgatcgaccaggccaaggttcgagtcctgctgttggaaagcatccaccccgatgcggtgtcccggctcgaggcggacggcttcgccgtcgagtccgtgccgaacgcgctggacgaggccgagctggtcgagcgcatctccggggtgcacctgctgggcatccgttcgaagaccaaggtcaccgcgaaggtgctggaggccgccgacaagctggtcgcgatcggcgcgttctgcatcggtaccgaccagatcgacctgaccaccgcctcgtcgaccggtgtcgcggtgttcaacgccccgttctccaacacccgctcggtggtggagctggcgatcgccgagatcatctcgctgacccgccggctcaccgagaagaactcgctgatgcacgccggcatctgggacaagtcggcggacggcgcgcacgagatccgcggccgccggctcggcatcgtggggtacggcaacatcggcacccagctgtccgtgctcgcggagaacctgggcatgtcggtctcgttctacgacaccgccgacaagctggcgctgagcaacgcgcaccgctgcgccagtctggacgagctgctggagtccagcgacgtggtcaccctgcacgtcgacggccgcccgggcaacgccggtttcttcggcgccgagcagttcgccaagatgcgcccgggcagcctgttcctgaacctgtcccgcggcatcgtggtcgaccacctggccctgcgggacgcgctgcgcagcgggcacctgggcggcgccgcggtcgacgtcttcccgaaggagccgaagggccggggtgacgagttcctctccgagctgcgcggcctgccgaacgtgatcctcaccccgcacatcggcggttcgaccgaggaggcgcagtcggacatcggcggcttcgtggcgaacaagttggccaagttcctcagcgagggcaacaccacgctgagtgtgaacctgcccggcgtggtcctgcccgagcagcccggcctgcaccggatcgtgcacgtgcacgtcaacaccccgggcgtgctggcccaagtcaaccggatcctcgcggagcacaacgtgaacgtcgagggccagctgctgagcacccgcggggagtacggctacctgatcaccgacatcggcaagggctacagcgaagaggtgctggagcagctgcgcggcatggagcagacggtccgcctgcgcgtgctgtcctga

SEQ ID NO: 1770 - DNA, 1425 bp, Actinoplanes utahensis
gtggcgccttcgtcctcggtggcggcttcttcctcgtcggcggcggcttcgtcctcgtcggcggcgacgaaccgggtgcgcgagacgcccgcggcaccggaatacgggccggcttcgccggccgggccggggcgggcctcgttcggattcagcgccgggccgatcagtgggaaccggccgctgggcgggtccggtgacacggccgactcggacgggacgacggccgcgccggttcagggcgcgtgggcctcctccccgtcctcctcctcgacggcgtcctggcccgcggcggagcagagctcctggcccgcggcggagcagagctcctggcccgcggcggagcagagctcctggcccgcggcggagcagagctcctggcccgcggcggagcagagctcctggcccgcggcggtcgacgccggcggccggtcggggggtccggtggacccgggcgggctgccgatcgtacgccgcaatgccgccgagacggatccgacctcgccggcggcagcgggatgggcggcgccggaggcggccgcgacgcgtccctccattccggacagcaacttcgggtcgtgggagagcatggtccggtcggacaatccgggcgtgccgcggaccccgtcgcgctccgcggcggcggccgccgcgctgcggcccccgcgccggcgttcccccgtggtgaccgccgggatgaccgtgctcggtatcgtcgcggtgctgatcatcgcgctgaccggggtggtcttctactccggtccggattcccggatcacccggatcctgcacctgagcgcggccaccaccagccccggcgggtcccggatggtgaccgcgccgctcggcggacggtccacggcgtccttcgagatgctcgcggccagcgaccggacccggctcagcgtcgccgacatcggcgacgacctcttccggatcagcaccccggacgactcgcccctgctgcccagcccgcaggtcgacggcgacgcggtacgcctgcaggtgacccgctccggcgccggcgcggacggcgaagtggatgtcgtgctgagcgcccgggtccgctggtcactgcgcttctccgggtacgccgccgaacgcgacgtggacctcgggcagggtcaggtgaccgggatcgaggtggtcggcggcacccggcgagccgtgctcgacctgtccgcggtctccgggacggtacccgtgaagatcaccggcggggtcgaggaactcaccctgcgctccccggccggcaccccgatccgggtcaaggtgggcggcggcgcggcgaccgtcaccgcgggcacgcggaccctgcgcaacgtcgcgcccgggtccacgctgaccccgaaggactggaacgccgtgggacggtatgacgtgaacgcggtcgccccggtcacgctgctcagcgtcgaggcgggctga

SEQ ID NO: 1771 - DNA, 657 bp, Actinoplanes utahensis
atggggaacgacgaggcgatccgggtgctcgtcgtcgacggtcaccagacctttgccgagctgctcggacacgccctggccgggcagcccgacctgcagtgggtggggcacgcgcggaccggccaggaggcgttgcacctcgcgtccgagctgtcacccgacgtcatcctgctcgacccggaactgtccgatgcggacggcatcgccatcgcgcagctgatccgggtccgccaacccgacgtgcgtgtggtgatcctcacggcccgtgaggaccaggggctgatcagccgggccaccaccttcggcgcggccggctacatctccaagaacggcgcgctcgccgaggtgctcaacgcgctgcggaccgcgcacggcggcgggatgaccgtctccaccgacatcatggcccggctgctgcgcagcaccccgccggtgtcggtgacccgcgagggcgggctgaccgcgcgtgaggacgaggtgctgcagctgatggccaccgggctcgacgcccgggcggtggcccggcggctcggcatcagcgtgcacacctgccgcggctaccagaagtcggtgctggccaagctcggcgcgcactcccagctggaagcggtggcgatcgccacccggcgcggtctcgtccgtccggaccatcggtga

SEQ ID NO: 1772 - DNA, 522 bp, Actinoplanes utahensis
ttggggcttgccgaccggcggcgggggtcgccacgattctgcatcatgtacgacatccagctcttcggccgcatcgaagttcgcacccggggcatccgcctggcgggcgacgacttcggcggtgaccgcccgcgccagttgctcgcgctgctggcgctgcacggcgagcagtcccttgtggagctgtccgacctgctcggcgcaccgcccgccacggtgaaggcggatctccgcgtgctgcgggaccggctggagccgggcgccagcggccgtgactcggtggtcgtcggccggcacgggagctaccacctggacaccgagcgcgtccgggtcgatgtcgccaccttcgagaagctgctggccgccgccgagggccgcaccccggagcgggccgcccgcccgctgaccgccgcgtcgtacgtggccgcccgcccgctgctggaggacgaggacgccgcctgggccgccgagctgcgggcgaagtacgacgccaagcggcgactcaccgccaccgccgcctga

SEQ ID NO: 1773 - DNA, 600 bp, Actinoplanes utahensis
gtgctcgacgctccgaccgctctgctcccggtcccgctcgccccggagatctcgctccacctggtcgacgctccgctcggcctgttcgatctgaccggcggcgagttccacagcgacaccccgccgccgttctgggcgttcgtctgggccggcggccaggccctggcccgctacctgctggatcatcccgccgaggcggccggccgccgggtgctcgatctggccaccggctccggggtggcggcgatcgccgcggcccgctgcggcgccgccgaggtggccgcctccgacatcgatcccgccgcggtcgccgccgcacaccgcaacgccgcggccaacgcgctcaccctggcttccgcggtgtcctcgcccgatctggtgctggccggtgacgtctattacagcccgacggtcgccccgctgatcaccgcacagttgcgcgccttccgccgggaaggcgccacggtgctggttggggaccccgggcgtgggtatttcccggagagactcttcacgctcgtcaccgactatgtggtgccggtcccggagagcctggaggagaccggtgaactccgcaccggggtgtggcggatgcgctga

SEQ ID NO: 1774 - DNA, 486 bp, Actinoplanes utahensis
gtgcaagaacagcagagcatctcgagcaccgcacgactgtccgacgaaatcatccggttcatccggatgggacagcgtttccgaggcatgctcaaaacggaggatctcggcgccgagttctccgcgttgatgctgctgctgcccttgcgggcgatgggcccgatgcgggtcaccgatctggccgagctcaaacaggccgacccgtcgacgatcagccgtcaggtcgcccagctggtcaaggccggcctggcccggcgggaggccgatccggcggacggccgggcctcccggctggcggtcaccgagaccggccaggacgcctgtgcgcgcctgggcgccgctcgcaccgccctgctcgaacgcgcgctgaacgactggccggccgaccgggtcgacactttcgtccagctcttcgaagaattcaacacgtccgtcgaggcgctgctgcgcaccgacctcggcgcaccaccacgggagaacgcgtga

SEQ ID NO: 1775 - DNA, 1698 bp, Actinoplanes utahensis
gtgagccaccccaccccgacggccgcgagaccggccgcggaattcacccaccggcagatcctcacgatcctcgccggcctgatgatgggcatgttcctcgccgccctggatcagaccatcatggccacggcgacccggaccatcgccgacgacctcaacggcttcgacctgcaggcctgggccaccacggccttcctgatcacctcgacgatctccaccccgctgtacggcaagttgtccgacatctacggccgtcggccgttcttcctgttcgccatcggcatcttcatcgtcggctcgatgctctgcggcctctcccagaacatgtacgagctggccgccttccgggcgatccagggcatcggcgccggcggcctgatgtcgctggccctggccatcatcggtgacatcgtgccgccccgtgagcgcgccaaataccagggcttcttcctggccgtcttcggcaccgcgagcgtcctcggcccgatcctcggcgggttcttcgccggcgccgaccagctgctctgggtggacggctggcgctgggtgttctacctgaacgtgccgatcggcatcgccgcgatggcggtggtcgccaaggtgctgcacctgccgcacacccgggtcaaccaccggatcgactggccgggcgcggtcgcgctgatcgtcggtctggtgccgctgctgaccgtggccgagcaggggcgcacctggggctgggactccggccgctcgatcctctgctacgtgatcggcgtggtcggcctgatctccttcgtgatcgccgagcgggcctacaaggacgaggcgctgctgccgttgcgactgttcggcaaccgcacgatcgcggtcggcaccggggccagtacgatcctgggcatcgcgatgttcggcggtctgatgaccgtcccgctgtacctgcagatcgtcaaggggtcctcggccaccatggccggcctgcagatgatcccgttcgtgttcggcatcatgtccggctcgatcatcgccggtcagctgatcgcccggaccggccgctaccggatcttcccgatcctcggcagcaccttcatggtcatcgcgctgttcctgttctccctggtcggcgcggacacgccgctgtggcgcaccatgctgatcatggtgctgatgggcctcggcctgggcggcaacatgcagccgatgatcaccgcggtgcagaacgcggtctccccgcgggagatcggcgtcgccaccggcgcggtcaccttcttccgctcgatgggcggcacgatgggcaccgcggtgttcctgtcggtgctgttcaacgtgctcccgggcaacatcagggacgcgtacgcggacgccgcgaagaatccggagttcctcaaggccgcggccgacccgacccagcagcagctgctcaagcaggcgcagggcggtggcgggctgagcgacacgtcgttcatcaacaagctgaccgacgtggtcgcgcacccgttcaaggtgggcttctcggacagcgtccacgtggtctatctgctcgccttcgcaatcatgctggtcggcctggtgatcgtcttcttcctgccggagattccgctcgccatgcgctccgcccagcagcagcgggccgatgacgcggcggcccagggcgacgcctccggcgccgatcagggcaccgcgggggtcaaggccggcaccgaaggtttcgctcactga

SEQ ID NO: 1776 - DNA, 309 bp, Actinoplanes utahensis
atggctgttgtgaagatcaacgcgattgaggtccccgagggcgccggccccgagctggagaagcggttcgccgcccggcacggggcggtcgagaacgagcccggcttcctcgccttcgaactgctgcgcccggtcgccggcgacaaccggtacttcgtctacacgaagtgggagtccgaggaggccttccagaactggtcgcagggcagcgccaaggctgcccacgccggcgagcgcgccaagccggtggcctccggcgcctccctcctcgaattcgaggtcatccagcacgtcaccaagcaggactga

SEQ ID NO: 1777 - DNA, 342 bp, Actinoplanes utahensis
gtggcggtcgcgtcggttcccctcgacgtccgccggcacgcggtcggcgcgctcaccgtcgggctcggcgcgcccggtccggtcgcgccggaggtgctgctcaccgtgatggcggtggccggccaggccgaggtgctgatcggcgagctgcaccggcgggaggcactgaccgagggcgccgcggtcgaccgggcggtcggcgtgatcattgcccagcgcggctgcggcgtgcaggaggcgtaccggatcctgcacgacagcgcgcagcggctcggcctggaccgggtcacggtcgccgagcggctggtcgccgccgctgcccgcgaccgcgaccagtcctga

SEQ ID NO: 1778 - DNA, 207 bp, Actinoplanes utahensis
gtgaccgaatccgaggaaaacctacgcctggccgcgttcctggacggcgcgtaccgcgccgaggaacggatgagcagcggcgatctgcagcggcgggcgatcgccgaggacctgccggcgagcctgctcacccgggtggacgcgctgcccgagggcgaatacctgcaggacgaggccgccgaggcactcagcgccccggcgatctga

SEQ ID NO: 1779 - DNA, 516 bp, Actinoplanes utahensis
atgtccagcctgcaggcccgggtcgccgaggtggcccgcgcttacgccccgcacgaccaccggccgctgggcggctacctggtggcgatgggcgccttcggcacgctcgcggccagcctcgcggcggccgccaagctgaccggtaagccggtgccggaacgcccggccatgaccgacgtggtgctgctctcgattgccacccacaagatcagccggctgatcgccaaggactcggtgaccagcccgctgcgggcgccgttcacccggtacaccgagcccgccggggcggccgagctcaacgaggaggtgcgcgacgagggcagcccggtgcggcacggcatcggtgagctgatcacctgcccgttctgcctggccgcctggatcgccaccggcctgaccggcgggctggtcctggcgccccggctgacccggctggtggccaccgcgttcaccgcgaccgctgtctcggacttcctgcagatggcctacagcatcgccaaggagcgggccgagtga

SEQ ID NO: 1780 - DNA, 240 bp, Actinoplanes utahensis
atgacgacagcgcgacccgagaccggcaccgacaccgggatcgacccggccggactcgccgacgacgacctcttccgggagttgaccagcctctaccggacccggctgcagaccctgcggcacgggccggacgcggcgctggacaaccatttccggcgcaccgcggagctggagaccgagtacatggcgcgcttccccggtcgtgaggtcgacccggagcggctgacccaggccttctga

SEQ ID NO: 1781 - DNA, 507 bp, Actinoplanes utahensis
atggtgcacctccagcgatgcgggcgaacggggacaaccggtggcttgcccgcgcgggtccgcgccaaacccgccggtaggctcgggggcatgaaagggctgtggtctccggcgtggatcgcccgccacctgctggcgctgatcctcaccgcgggctgcctcggcctgggctggtggcagtacagccgggccaccggcggcaactcgctcagctggggctacatgttcgagtggccggtcttcgcgggtttcgtggtgttcatctgggtccgcgagatccagttgttccgcaagccgcgggacaccggggcggaggccgagccggccgagccggagcgggttccgggcgccccggtcgccgtgggccggccggtgcgggtcgcggtccggcccgccgaggcggtggcggccgacccggagctggacgcctacaacgactatctgacctggctcgccgagcaccccggcgcccgcccggccgactaccccggccgcatcatcaagtag

SEQ ID NO: 1782 - DNA, 321 bp, Actinoplanes utahensis
gtgcgcggcgcgctcacccgttaccggatcattgcctggatcgtcggcgtgttcctggtcgttctcgtactggtcggcatgccgctgaagtacttcggcgacaacgacacggtggtcgcggtgatcggcccgctgcacggtttcctctacatgatctatctgctgttcagtttcgacctgtcccgccgggcccggtggcccttcggccggatgatcctggtgatgctggccggcaccatcccgttcttctcgttctgggcggagcgtcaggtgacccggcactggatgactgaagtagcgtgggaaccggccgtcaaataa

SEQ ID NO: 1783 - DNA, 981 bp, Actinoplanes utahensis
gtgccactcccccgtaccaggctccgggcgctggtggtcgcgctgaccgcgctggcgatcaccacgtcgggcgctaccgccgcgcacgcggccccgtccaaggacgagctgaagaagcagatcgaggcggcttccaacaagctggacgacgtcaccgaggcgtacaacaagacccgcatcgacctgaaggcgacgcagaccgacgcggccaagctcaccgcgtccctcaagccggccgaggcggcgaagaaccaggccgtcacgaaggtgaacgcgatcgccgcgtcgtcgtacatgaccggccgggtcggcccgatgaccctgatcctcggcggcaaccagcatgacctgctggagcggctgagctacctggaccagctcagcaagtccaaccaggcgcagatcgacaactacaccgaggtcagccggacctacacgtctcggcaggccgagctcaaggccaccgagcagaagcaggcgctgcagctcaaggagctggacgcgcagaaggccaagtacaccaaggatctgcagaagctgaccgcgacgcagaaggaactgtacggcaagccgacgcagagctccggctcgtggaccggcccgatcccgaagggctccggtgacgccggggtggcggtcgccttcgcgtacaagcagatcggcaagccgtacggtttcggggacgagggtcccaactcgtacgactgctcgggtctgaccaaggccgcctgggccgcggccgggcactcgctgccacacagcgcgtccgagcagcgatacgccagtggtgtcacctacatcaaggcgggcaccgcggggttcgtccccaagcagggtgacctggtgttctatcgcgacggtggccacgtcgcgctgtacgtcggcagcggcatggtcatcgacgcaccgcacggtggcgccgacgtgacccgccgcacgatcaacatcatgcccgtacagggatacggccggatctcgtaa

SEQ ID NO: 1784 - DNA, 1002 bp, Actinoplanes utahensis
atggacgcaggtaatgcccgtaacagggttagtgacggcaatgaggggaccgtgggcaacgtggagaagaacaccgtgatgcgtaccgaccaggttgccgaggagcgcgacctcgtcggagtctacctgcacgagatctcccggacgccgctgttggacgccgcgcgggaggtcgagctctccaaggcgatcgaggcgggcctctacgccgagcacctgctcgagcagggcgaggagcgccgcggcatcagccgggaggagctcgagcgcctcgtcaccgagggcagccgggcgaaggacctgttcattcgcgccaacctgcgactggtcgtctcgatcgcccgccgctacgtgcgctcgggcatgccgatgctcgacctgatccaggagggcaacaccggtctggtccgcgcggtcgagaagttcgactacgagcgcggctacaagttctccacgtacgcgacgtggtgggtgcgtcaggcgatcagccgggccatcgcccagcaggagcggaccgtccgcctgccggtgcacctggtcgaggacgtcaaccggatgcgcaacgtgacccgccagctggtccgtgagctcggcggcgacccggagccggagcagatcgcggcggctctcggcgtcaccgtcgagcgggtcaacgagctcacccgctgggcccaggacaccgtgtccctggacactccggtcggcgacgacggcgacaccaacctgggcgacctggtcgccgacagcgacgcgccgtcgcccgaggagatcgtgcttagcgccctggagcggcagcggatcgaggggctgctcaaccacctggacgaccggtcggcaggcatcatgcgggcgcggtacggactggaggacggtcgggagcactcgctgaccgaggtggcgtcgcgcttctcgctcagccgggagcggatccggcagctggagatccaggcgctcggccggctgcgtgagctggcccgggccgagggcctgcaggccgcctga

SEQ ID NO: 1785 - DNA, 138 bp, Actinoplanes utahensis
gtgggtgaagtgagcaacaccacacccgggaagatcttccccatgaccaatactgctctggtgaccggcggcaccggcgggctcggcgccgccaccgtcgcagcgttcctggcggccgggtggcgcctagctagctag

SEQ ID NO: 1786 - DNA, 501 bp, Actinoplanes utahensis
gtggcggcggccaccgccgagccgggcgccccgctgaccgcggtggtcaatctggtcggtgggtatgcgggcagcggcctgatcgccgacaccccggtcgacgagttcgaggcgatgttcaccgccaacctgcgtcccacctatctggtcaccgcggccgccctgccgcacctggtggcggccggcggtggcgcggtggtcagcgtctcgtcgcgggccgcggtggcgccgttcgcgggcgcggccgggtatgtcgtgtccaaggccgcggtgctggccttcgccgagaccgtcgccgtcgagtaccgccggcagaacgtgcgcagcaacacggtgctgcccagcgtgatcgacacgccggcgaatcgggccgcgatgccggacgccgaccacagccgctgggtcgacccggagtcgattgccgcgaccatcctgttcctcgcctcggatgcctccgcaccgaccagcggcgcgcgcatcccggtctacggccaggcctga

SEQ ID NO: 1787 - DNA, 714 bp, Actinoplanes utahensis
atgacagctcgcccgcgcacgatcgccctggtcggcatcgacggctccggcaagaccacccaggcccggatgctcgccgccgcgatgacccgggccgggacgccggcccgctaccggcagaacgccggcggccgggcccggctcgggcggctggccgtacgcctcggccgggaggacgcggtcgggctgctcgggcgccgcggcctgctgctgatggagtcggtgttgcggtggctcgcgatcgcccggacgctgctgcggcgagcggtccgtcgggaggtcaccgtgatggaccggtacgcggtctgccagtacgccagcgtgcgggcgcaccgggggacggcggccgccgagcgccgggcgcggctggcttaccgggtgttcccgcggccggacgtgacgctgttcctggccgtggatccgggcgtggccagagcgcggatcgagctgcgcggccgggacagcgagtcactggaatatctgacggccgcggatatggcgtaccgccaattgccggaatttgccgaatttaccgtgattgatgccaatggttcgcccgaccaggtcttcgacgccgttcagcgggcgctgggccggccggcggcgccggttcagcgcccgctccgggtacggagcctggtgctggccggcgcctccgccgtgaccggcgccgccgtgtcggcctggcagcttgctgagtctttcccggcctga

SEQ ID NO: 1788 - DNA, 576 bp, Actinoplanes utahensis
atgccgcaccgggtcgacgaggggctggccggcacgatgaaacgtgtcgccgcgaccctgaagaccgcggagatccccttcgcgctggggggcagtttcgccgtctatgcccacggcggacattccagcgatcacgacgtggactttctgatccgcgagcaggacaaggaacgggccctgcaggagctgtccgaggtcggcttcgagacgctggagccgccggaggactggctggtcaaggtcttcgaggacggccggatggtggatctgatcttccgcccggtggagactccggtcaccgacgagacgctcgccgacaccgagcggatctcggtcgaggcgatctacatgccggtgctctcggccacccagctgatgattcacaagctgctcagttacagccagcaccactgcgatttcgcccaggggctgccgctggcccggtcgctgcgcgagcagatcgactgggcccgggtccgccgggagaccgcgaagtcgccgtacgccgaggcgttcctcgtcctgctggaccggctcgacgtcgtgccgaacaagtccgacgagggtgaggactga

SEQ ID NO: 1789 - DNA, 249 bp, Actinoplanes utahensis
atgaccaaacagatcgacctggaggccgagatccagcggctgctggccgagcacgaccggatcgccgagcagggcgtgaccgtgcaccgccgggagaacctgctgatgctgggcggcgaggtggagagcgcgcagcgtcgggacgagatctgccggcagatcagcgcgcgctaccccgacctggagatcgcctgcgacatcggcatcacccggacccaggcgcccgccgaggtggaggagatttcatga

SEQ ID NO: 1790 - DNA, 753 bp, Actinoplanes utahensis
atgatccggatcgccgccgtgggcgacgtccacgtggacaaggacgtggtgggccggtaccggccggctctggaggagctgcccggccgggccgacgtgctgctggtcgccggggacctgacccggcacggaaccccggaggaggcacggtgcttcgccgccgagttcggtgacctggccgtgccggtcgtggtggtgctcggcaaccacgaccatcagagcgaccagcaggacgaggtgacccgggtgctgaccggcagcgggatcaccgtgctggagggggccgccaccgtactggagatccgtgggcatcgactcgggatcgccgggaccaaggggttcggcggcggcttcgccggcgcctgcgcgagcaacttcggcgagcgcgagatgaaggacttcgtcgggaccaccgagcggtacgccgcggctctgcgcgacgcgctgctctcggtggagtgtgacgcgctggtggcgatgacccactacgcgccggtcccggagacgctgaccggcgagccgctggagatctacgcgttcctcggctgttaccagctgggtcaggcgatcgacgacgcgccgaccgcgctggccctgcacgggcacgcgcaccacggctcggaacgcggccggaccccgggcggagtaccggtccgcaacgtcgcgcacccggtgatcaagcaggcctacaacgtgtatcagctgctcacggacaccgtggacacccggaacgaggaactcgtcaacgtctga

SEQ ID NO: 1791 - DNA, 144 bp, Actinoplanes utahensis
atggacctactgctctggattctcgccgtaatcctcgtggtcgccggcatcctcgcgctgttccggcggcagatcctctggggcgttgtgctgatcatcgtgggcctgctggtcggccccggcggcgtcagcatcttcacctga

SEQ ID NO: 1792 - DNA, 876 bp, Actinoplanes utahensis
gtggccgcacatattcaccacttcacctatggagccttcaacccgatcgccgcggcgctgctggcgtacctcggctcgttcctcggactgctctgcaccgagcgggcccggggcgcgcacagccggggccggcgcaaccgctggctggcgatcgcggcgttcgccatcggcggcggcgccatctggctgatgcacttctccgccatgctcggcttcgacgtgccggacagcccggtccgctacgacctgccgaccaccctgctcagcatggtcttcgcggtggtcaccgtcgggatcgggctgatggtggtggggcacggcgcgcccagcccggccaagaccgtcgcggccgggttcctcaccggtggtggtgtgctggccatgcactacaccggcatggagggcatgcggatgtccgcggtggtgcactacgacccggtgctggtcgccgcgtccgcgctgatcgcgctggccgcctgcaccaccgcgctgtggttcgcggtgtcggtgcgcgggctgacccggatagccggcgcggccgcggtgatggcggtcgcggtctgcggcatgcattacaccgggatggccgcgatgtcggtccggctggacccgtccatcgtcccggcggccggcggcatccggccgctcaccatgatcgtgccgatcactttgatcaccgcggcgaccatcgtcggggtggcgctgagcgcgctgcaggcgatgaccgaggaggagttcaccgacggggccggcaccccgaagcgcggtatgcacgccgaaccgcaccagccgtggacgctgcggcaggcctcgcagttcggcaccggggtgcggctgagtccggcggcgagggcggtggccgccggccctagctag

SEQ ID NO: 1793 - DNA, 897 bp, Actinoplanes utahensis
gtgccccgccgatcgtcccggtcgcgaccgaaccgaccgtcccggtggcgccaccacccgcgccggtcccgccggtgccgatcccggaccaggcgagcggcccggtggcgggtccggccacatccggcacgtgaggttttccccgtcgcggccgatgatccggtatacctgatccgcatggcgccacggatgctgctctcgatgccgctgcacgcgatcaccgaggtgtacggcgaggaggggctgcggcaacgcttcggcctggagctggagtcgtttccggccgccgaccgggagcggctgaccgaggccctcgacctggccgccaccctgcacgccgacgatcggcgggtccgtgagccgtacctcaaccacctgctccgggtcgccatccggatcatccgctactaccaggtgcgtgacgtcgacgtgctggtggccgccctgctgcacgacgcggtcgaggaccatccggcagagctggccggcctgccggcggacaccgcgtaccccaaggccaccgaggcggccctggccgtgctcgcccaccggttcggcgcgcgggtctccgagctggtccggtcggtcaccaacccggcctacgacccggggcgggaccggcacgagcagtaccgggagcacgtcacggcgagcctggaccgggacccgtgggcgcggatcatcaagatctccgacttcaccgacaacggggtcggcgtgatccacaccacgctggacaaggcgtaccgctcggccaccaagtaccgcccgctggtgccgaagctgcgtgagctgatcgggcggccggacaccccgctctccacccaggccaaggagcacatcctggaccagctggacctggccgaggagcgtttcgcggccatcctcgacgactga

SEQ ID NO: 1794 - DNA, 1605 bp, Actinoplanes utahensis
atgccctcccacgattcctggtggcgcgacgccgtcatctaccagatctacccccgctcgttcgccgacgggaacggcgacggcatgggcgacctgcccggcatcacggcgcgcctgccccggctgcgcgagctgggggtggacgccgtctggctgtccccgttctacgtcagcccgcagcacgacgccgggtacgacgtggccgactaccgcgatgtcgacccccgtttcggcaccctcggcgacgccgacaagctgatcgccgccgcccacgacctgggcctcaaggtcatcgtcgacctggtgccgaaccacacgtccagcgagcacccgtggttccgggccgctctggccgcgccgcccggcagcccggagcgggaccgctacatcttccgggacactccgccgaacaactggcagagcgtcttcggcggcccggcctggcggcaggtcgccgacgggcagtggtatctgcacctgttcgacgtctcgcagcccgacctgaactgggaccacccggaggtccgcgccgagttcgtggcgatcctgcggttctggctggaccgcggggtcgacggcttccgggtggacgtggcccacggcctgatcaaggacgccgagctcaccgactggacggcgccggccacggtgctcggcggcctggagccggccggtcccccgccgccgatgtgggaccaggagggggtgcacgagatctaccgggagtggcgcgccgtgctggacgggtacgacggcggccggatcctggtcgccgaggcctgggtgcagcccgaggagcggctggcccgctacgtccggccggacgagatgcaccaggccttcaacttcccgtatctggaggcaccgtggcagccggccgagctgcgcgcggtgatcgactcctcgctggccgccaccggtgcggtcggcgcgacgaccacctgggtactgtccaatcacgacgtggtgcggcacgcgtcccggctcggtttcccgcccggcggaaagcgcaagccggggatcgggatcggcgacccgcagccggacaccgggctgggcctgcgccgggcccgggcggccaccctgctgatgctcgggctgcccggctcggcctacctctaccagggtgaggagctcgggctgccggagcacaccacgctggccgacgagttccggcaggacccggcgtgggagcggtccgggcacgccgagcgcggccgggacggctgccgggtgccgatcccgtgggaggccgacgccccgtcgtacggtttcggcccgggtgacgacagctggctgccgcagcccgcgctctgggcggagtacgccctggaccggcaggtggacgtgccgggctccacctacgagttgtaccgctcagcgctggccgcccgtcgtgcgcaccggctgggcggcggcacgctggcctggtcggcgaccgagggtgccgtgctggcgttccgcaacggcccggtactggtgctgaccaacttcggggcggagccggtcaccctaccgcccggcgcccgggtcctgctgagcagcgagcccctcgacgccgacgggcggatccccagcgatgtcacggtctgggcgctggcctga

SEQ ID NO: 1795 - DNA, 1464 bp, Actinoplanes utahensis
gtgaaggccaggggaggtgccgcgcaccgcgcgtacagcgtggtggtgttcgtgatcctcgcctcgctggacaatgtggcgatcggcatcgtgccgccgctgtacggcagcatcggcgccgcgttcggggtcggcgagggccggatcgcgctggccaccacggtcatgttcgggatcagcgcggtcgccgcgatcggctgggcttacgcgggcgaccgcaccgaccgcaaaccggtgctcatcgccggcacgctgatctggatcggcggcaccgcgtggtccgggctggccggcgggtacggcgcgttcctgagcgcccaggtgctcgccgcggtcggcctgggcgcggtcgcctcggtcagtttctcggtggtcagcgacctgatctcaccgcggcgccggggcctggtgatgagtttctggggactgtcgcagggcgtcggcacgctggccggcacgctggccggcggcattctcgggcacgccgactggcgcaggccgttcctggtcaccgcggtcgccgggggcatcgccacggcgctgtacctgttcacctacaacgtgccgcgcggcgacagccagccggagttggccgggatcgactacgacgagcggatccaccacgaccacctgccgatcatcctgggccgacgcaccaacatctggctgatcctgcagggtggcaccgcgcagatcgccttcggctcgctggtctggctgccggtgctgttccgcgcccgggccgaggaccagggctactccacaccgaccgcggtcctggtgggcagtgtcttcgcgacggtcttccagctcggcgccgcgctgtcgatcctcggcgggctcgccggcgaccggctgcaacggcggacaccgcgcggccgggccctggtcgccgcggtcggcatcctggccgccgtgccgttctatgtggtgctgttcctcgtcccgatgacgattcgggtgccggaccgggcgagcaccggcgcggtgatccgcggcgtgctgaccaatgtggtcaccgagccgacggtcgccgcctgcctggccaccgcggtcttcgcactgatgctgacctcggcgaactcgccgaactggttcgcgatgatctcggacgtgaacccgcccgagcaccggggcaccgtctacagcctgggcaacctggtcaacggggccggtcgggccggcgggaacgcgctggtcggggtggccttccagcggctggccggggcgttcccgccgccgctgaactacgcggtcgggctcgcctcgttccagttcttcttcatcccgaccgggatcatgtactggctggccagcaggacggtcgcggtggacatggcggccacccacgccgccctgctggccaagcgatcaggccagcgcccagaccgtgacatcgctggggatccgcccgtcggcgtcgaggggctcgctgctcagcaggacccgggcgccgggcggtag

SEQ ID NO: 1796 - DNA, 1401 bp, Actinoplanes utahensis
atggcgctggtggccgggatcgacagctcgacgcagtcgtgcaaggtcgtcgtccgggacgccgagaccgggaagctggtccggcagggccgggcggcgcacccggacggcaccgaggtgcatccggacgcctggtgggccgcgctgcggcaggcgatcgacgaggcgggtggcctggacgacgtggccgccgcctcggtcgccggccagcagcacggcatggtcgtgctcgacgagaacggtgacgtggtccgcccggcgctgctgtggaacgacacccgcagcgccggcgcggccgccgacctgatcgccgagctcggcggcggcgcggcctgggccgaggcggtcggcatcgtgccggtggccagcttcaccctgaccaagctgcgctggctggcccggcacgagccggccctggccgaccgggtggcggcggtctgcctgccgcacgactggctgacctggaagctgtccggctccaccgacctggccgacctgcgcaccgaccgcagcgacgccagcggcaccctctactggtcggccagcaccgaccggtaccggcacgacctgctggagctgggcttcggccgggacctgcgggtgcccgaggtgctcggccccaccgggatcgccgggcacctgccgaacggcgcaccgctcggcccgggcgccggcgacaacgcggcggcggccctgggcaccggcgcgctgcccggtgacgtgatcgtctcgatcggcacgtccggcacggtgttcgtctcgtcggacgcggcgccggccgacccgagcggcacggtggccgggttcgccgacaccaccggccggttcctgccgatcgtggtcacgctcaacgcggcccgggtgctggacgccgcggcgaaactgctcggcgtctcgcacgacgagctgtcccggctggcgctgtccgccccggccggcgcggacggcctggtcctggtgccgtacctggagggggagcggaccccgaaccggccggacgccaccggcgcgatccacggcctgaccctgaagacgtccgatccggcgcatctggcccgggccgccgtcgagggcatgctgtgcgcgctggccgacggcctggacgcgctggtcggccagggcgccgcggcgaaccggatcgtgctggtcggcggcggggcacgcagcgaagcggtgcgtcggatcgcgcccgcgctgttcggcaaaccggtgctggtcccgccgcccggggagtacgtggcggacggcgcggcccggcaggcggcctgggtggtcgccggtggggacaccccgccggcctggtccgccgagcccccggaggtcttccaggacgacgcggtgccgttgatccgggagcagtacgcggccgcccaggacagggtggtggaccggagccgttga

SEQ ID NO: 1797 - DNA, 1185 bp, Actinoplanes utahensis
atgtcgcttcagcccactcgtgaggacaagttctcgttcggactctggaccgtcggctggcgggcacgtgacccgttcggcgaggcgacccgtcccgcgctcgacccggtcgaggccctgtacaagctcgccgagatcggggcgtacggagtcacgttccacgacgacgacctggtgccgttcggatcggacgcgcagacccgcgacggcatcgtggccgggttcaagaaggcgctggacgagaccggcctgaccgtcccgatgatcactaccgacctgttcttccacccggtgttcaaggacggtggcttcaccagcaacgaccgctcggtccggcgttacgcgctgcgcaaggtgatgcgccagatggagctcggcgccgagctcggcgccaagaccctggtgctgtggggcggccgcgagggcgccgagtacgactcggccaaggacgtcaaggccgccctcgaccggtaccgtgaggcactcaacctgctcgcgcagtattccgaggaccgcggctggggcctccgcttcgccatcgagccgaagccgaacgagccccgcggcgacatcctgctgcccaccgccgggcacgccatcgcgttcacccaggagctggagcggcccgagctgttcggcatcaatcccgaggtcggccacgagcagatggcgggtctcaacttcacccagggcatcgcccaggcgctgtggcacggcaagctcttccacatcgacctgaacggccagcacggcccgaagttcgaccaggacctggtcttcggccacggtgacctgctcagcgcgttctccctggtcgacctgctggagaacggcgccgacggcagccaggcctacgacggcccgcggcacttcgactacaagccgtcgcgcaccgaggacgtcaccggcgtctgggagtcggcgaaggccaacatccggatgtacctgctgctcaaggagcgggccaaggcgttccgcgccgaccccgaggtgcaggaggcgctggccgcgtccaaggtcgccgagctggccgcgccgacgctgaaccccggcgagacgtacgccgacctgctcgccgaccacagcgcgttcgaggacttcgacgccgacgcggccggcgcccggggctacggcttcgtgcgcctcaaccagctcgccatcgagcacctgctcggagcgcgctga

SEQ ID NO: 1798 - DNA, 273 bp, Actinoplanes utahensis
gtgacggcccggctcaccagcagatccagcacgcccgtccggcagtcaagcgtccgcgcccataatctcgcgctggtgctggacaccgtggcgaacagcgcggatccaccgtcccgggcgtccgtcgcggccctcaccgggctcacccgtgccaccgtctccgcgctcaccgacgacctgatcgccggcggcctgctggtcgagcgggacccgccgccgcgcaccggggcggggcgcccggccgccgggctcgcgctcaccgcggctagctag

SEQ ID NO: 1799 - DNA, 729 bp, Actinoplanes utahensis
gtgatcgccggcgccgcgctcgccgtgcccggcctggtctccaccggcctgatcccggccggcccgggcgcggccggacccagcggccccggtgcggccgggctggtccgggtcgcgccgaacctcggctggcaggacgtggacgcgccggcgctgctgcgcggcgtcccggaactggccgacctgagcatcgccgtcgacaacgaggccaacctcgccgccctcggcgaactgcgggtcaccggcggaaaccccgacttcctgtacgtttcgggcgaggtcgggatcggtgccggcctggtcatcgacggcgagctgtaccgcggcgcccgcggctggagcggcgagatcggacacgtcaccgtctatccggacggccggccctgccgttgcggcgcgaacgggtgcctggagcagtacgccgggcaggaggcgctggccgcggacgagccgctggccgccgccgcactggggatcgcgctggccgccgtggtcaacctgctcgacgtgccggtgatcgtgctcggcggggcctacgcgccactgttcgaccggctgcgcgacgggatcgaggcggagctgcgccgacgggtgctgacctcggggctggcgccggtcacgctgcgcgcggcgcgactcggggccgaggcggcggtgcgcggggcggcggacgcggtgatccgggaggtccgggacgatccggcgcgctggctacggcgtaccgcgtaa

SEQ ID NO: 1800 - DNA, 1776 bp, Actinoplanes utahensis
atggagcgcgtgtctggccgccatcgtagaaacttcaacttaaaaggggcgagcgtcgtcggcggaacgatggcgatcgttctcgccgtcgccggtggctggttcgcctatagccggctcgtcgattcgagctgcagcggatcagtcagtctgtccgtcgcggccgctcctgagatagcacccgctgtgaccgacgccgcgaacgcgtgggccaaggacgggggcaacgtcaacggcgtctgcgtcgcggtcgcggtcacctccgtcaacccggccgacgtcgccagcgcgatcgccgcgcagcacggtgtcgtgctggccggcctcgggcaggcgtcgggcgccacccaggtgccggacgtgtggatccccgactcgtccacctggcagctccgcctgcgcaacgaggcctccggcttccagcccaccaaggtcacctcggtggcgcagagcccgctggtcgtcgccatgccgcagccgatcgcggtggccaggaaactggagggccagaaggtcccgctgaccgcgctgctgtccgccggtctcaagtcggcggacgggccgaagttcggcatcgtcaacccggcccgggacgcctccggcctgaccgcgctgatggcggtcacgcagaacgtcggcaccggcgacgcggcggtcaaggcgcaggtccaggcgctcacgctgctcgccaagaaccggtccgagctgcgggacgaactgctggagcagttccccaaggcgaccgatcaggacaccctcgaggagagtctgggcgccgccccgctctccgaggaggacgtgatctcgtacaacgcgaagcgtccgccggtcgagctgaccgccgtctatctggacggtccctcggtgccgctcgactacccgtactcggtgctgccgcaggtcgtcgacgggcagaagatcagcgccgcgcagggcctgctcacccagctcacctcgggctcgttcaagagccggctcgcggggcaggggctgcgcgcgccggacggcacgtacggcgccggcttcgtcgccccggtcggcgcgccgaaggcgtcgccggcgatcaacacggcgggcggcggtgacaccggcggcaccgcagcgtcgggtgtcgacgccgcgtcggtcagcaaggtggtcggcacctggaacgcgaccacccaggccggtcgggtgctggccgtcttcgacgtctccgggtcgatgaacgacccggtgccgcaggccggcaaccggtcgaaagcggtggtcacccaggccgccgcgcggaccggtctgcagctgttcagcgacgactgggcggtcggcgtgtgggagttctccaccgacatggacggcaccaggccgtggaagcagctgatcccgatcacgccgctgagcaccggacggcaggacgtgcaggccacgatcccgctgctgaacccgaagaagggcggcaacaccggtctgtacgacacgatccgggacgcctacgacacgtcgaagaagaactggaaggccggcaaggcgaactcggtcatcctgttcaccgacggcgtcaacgagaacgacgacggcatcgaccaggacaccctgctggcctatctgaagaaggcgcaggacccgacgaagccggtccggctcgtgctgatcggcatcggtgacggcgtcgaccgcaccgagctggagaagatcagcaacgtggtcaagggcagcggcgtgttcctcgccaaggacccgacccagatcaccggcatcttcctgcaggcgatcggctcgcgcaccggcgtcgagtaa

SEQ ID NO: 1801 - DNA, 1059 bp, Actinoplanes utahensis
atgggcgcgaacgctgagtacgtcttcgtcggctgttacaccggtgacaaggggggtgagggcgacggcatcacgctgctgcggcgtgatccggccggcggcgagctgacccggctgggcctggctgcccgcacgccgtccccgtcctttctcacccggcatcccaccctcccggtgctctacgcggtgaacgagctggacgagggcaccgtctcggccttctcggtcgcgccggactgctccctgatcccgctcgcggtccgggccaccggcggcgccgacccgtgccatctcgcggtcaccgcggacggccggcacctggtggtggccaactacaccagcggctcggtcgccgtgcatccgctggacgcggacggcgtcccgggggagcgcagcgatctgctcaccctgtccggctccgggccggacgcggagcgccaggcaagcccgcacgcgcacatggtcgttccggctccggccggccccgacgtgctgatctccgatctgggttcggacacggtgtggcgatcccggctcgacccggtctccggccgcctgggcgcgcccgagccggccgtcgaggcgaagccgggcaccggaccgcggcacctgacccgctccgcggacggcgcgctgctgctggccggtgagctggccggcacgctgagctggtatcgggcggccggcggcccggtctgggagctgcgcggtacggcggcggccagtgcggtcaccggcggcgtcttcccgtccgaggtgatcgcggggcgtgacggccggttcgtctatctggccaaccgcggtccggacaccgtcaccaccttcgcgtgggacggcgagagcgctgccgtggtggccgagacatcgaccggcggggtgtggccacggcacatgatcgtgattggcgatcacctctacgtagccaatgaacgttcacacacggtaacggttttccggatcgattcggacagcggaattcccgttccgcaaggcgagccgaccggtgagccgagtcccacctgtctgcttcggtggagtccgccgatgatcaggccatag

SEQ ID NO: 1802 - DNA, 1458 bp, Actinoplanes utahensis
atgccgggtgagaaaggacggggacggcgtgcgggcagccaggcccagccgggtcagctcgccgccggccggatcacgccgcagcagcgtgatgccgtcgccctcaccccccttgtcaccggtgtaacagccgacgaagacgtactcagcgttcgcgcccataccccgatcccatcacagcgggccgacgaaacctggcaggctcctcatcttgaccggtacagaaggcgggcttactgtaccggtatagaagacgccccgaggaggtccccatggaatttcccgccgcctacctgcgcggactcaccgagacccaccgcgagctgtacagcgcgttgccggacgccccggtcgtcgcggaccggccacgccgccgctttttgcgccgggccctgcgcggcataccgtttgctggtgcccagggtgacgttgcagaccatcgcggaccgggtcggggtgagccgcatgacggtgtcgaacgcgttctcccggcccgatcagctctctcccacgctgcgccgcaagatcctggacgcggcgcaggagctggggtatgccgggcctgacccgaccgcccgggccctggccaaaggcaccaccggcgcggtcggcatcctgctcaccgactcgctgcgttacgccttcaccgacctggtcgccggcggcttcctcggcgccatcgccgaggagctcgccccgaccggcctggccatcaccctgctcacctcggccggcgccggcgacctgattccggcccgggacgtcgcgatggacggcgccctgatctactcctgcgacccggcctcacccgcggtcgcctggctgcaacgccgccggctgccgatggtcttcgtcgaccagaccccgctcgacggctacgccagcgtcaacgtcgccgaccgggagggcgcccgggccaccgcccggcacctgctcgacctggggcaccggcggatcgcctacgccatcgccggcatccacggcgcgcacggcgtgatcaccgacccgtccaccctcaccgaaggccacgcctcggtgcagcgccggctcggctgggacgacgtcctgcacgcggccggcctgcggccgaccatcatccgcgagccgttcgagcaggtcggtgcgatccgccgggacgcccgggagctcctgtccggccccgaccggccgaccgccttcctctgcttctccgacgtcaccgcggccggcgtccaccaggccgccggcgacctcggcctgcgcatcccgcaggacgtctcgatcaccggcttcgacgacggcccgaccgccacccagctgcggccggcgctgaccacggtccgtcaggacgtcgaggagaagggccgggtcgccgccgccctgctcaccgccgccctgcgcggcgagccggccccggcgccggtgatgctcgccgccaccctggtgatccgggagagcaccggcccggctccggcctag

SEQ ID NO: 1803 - DNA, 624 bp, Actinoplanes utahensis
atgacgtcgacgtactcaaggcggttgtcaatggactccgtgcgctctgaccgcaccggcggctcacgcatcccggtcgcgctcaagatcctgatcgccggaggtttcggtgtcggcaagaccaccatggtcgggtcggtcagcgagatccgtccgctgcagaccgaggagatcttgaccggcgccgagggcgccgacgacgtgtccggtgtggagggcaagaccaccaccaccgtgaccatggacttcggccggatcacgattaccgaggacctgcagctctacctgttcggcacccccgggcaggaccgcttctggttcctctgggacgagctgtcccagggcgcgctcggcgccgtggtgctggccgacacccggcgcctggccgactgcttcccctcgatcgactacttcgagcagcgcggcaccccgttcgtcgtcgcggtgaacacgttcgacgccgagcaccgcttcggccccgaggcggtggcccgcgccctcgacctggacccgggcgtcccggtggtcatgttcgacgcccgcgaccaggtggccgcccgcaacgtgctgatcgagctggtggagtacgtcgcgcgccgccagtacgcgaccgccgcgccctag

SEQ ID NO: 1804 - DNA, 387 bp, Actinoplanes utahensis
atggcctctgatggacagcgggtgagtcacgactggatggaccaggacgccggcccggtcgtccgcccgtacgccatgacccagggccgggtcgccccgtccggtggtgacttcgacctggtcgccttcgtggtcgcgaccgtgccggacctggcgcccggcatccagctccagcccgagcaccacgccatcgtggcggccgcctgggagccgatctccgtggtggagctcgcctcccagctcgacctgtcgatcggcgtggtccgggttctgctcggtgatctacgctcggcgggtctgatctcgctgtacgaacccccggcggcctcgcagccgcatgacgtcgacgtactcaaggcggttgtcaatggactccgtgcgctctga

SEQ ID NO: 1805 - DNA, 420 bp, Actinoplanes utahensis
gtggcacagacgacgaagcagagcgcgaacctcacctggctcctcgacgacctcgtggagcgggtgccgaccgcacagcaggccgtggtgctctccgcggacggcctgatgctgggcgcctcggccgcgatgagccgggaggacgccgagcacctgtcggcgatggcggccggtttccagagcctggcgaagggcgcgagccggcatttccaggccggcgcggtccggcagacggtggtggagatggaggaggcgttcctcttcgtcaccgccgccgggcagggggcgtgcctggcggtgctcgcgtcggccgacgccgacctgggcctgatcgcctacgagatggcgatgctggtcacccgggtcggccagacgatgagcgccccggagcgcaccctgtcggcgcccgatggcctctga

SEQ ID NO: 1806 - DNA, 2631 bp, Actinoplanes utahensis
atgagaagccgcaactggtcgatcagatcgaagatcatcgcgatggtcgcggtgccgctcgccgcgcttctcgcgctctgggtcttcgcgaccgcggccaccgccggtccggcgatggatctgctcaacgcccgcgacgcggtgcaccggctcggcgacccgggcctgcagctgatcgcccagctccagcgggagcggcacttctcggccgtctacctgtccgcccgcaagacgccgctgaccgatctgcgcacccagcgggccgccaccgaccaggcgatcgacaggttccgcacggcggtgcgcgacctgcggatgagcgacgatctgtccgcccggaccggcaccatgctggccgacctgagcgcgctcaccggcgtccgcggccgggtcgacacccgcgacatcgacgtgctgaacatgatgaccgcgtacggcgacacggtggacgccggcttcgaggtctccaccagcgccgcggtcttcttccacgagaaggtggaccgcgaggtccgcggcctgatcgccggctatcgcggccaggagtacctgagccgggtcgatgcggtgctcgccggggcgaacgcggccggccggatcgaccagaagagccgcggccggctcatcgaattcgtcgcgacctcccgctacctgctctcctccggcgtgcaggacatgccggagcaggcccgcggcgactacgcccggctgatcaccggatcctcgttcgtccagctggacatcatgcagaaccagctgatcgaccagagctacaccgggggcacgccaccggtctccggcgccgagtggcaggccacctacgaccaggtgtcggccgacctgcgggcgttcgagctgcgcacggtcgacgaggtggcctcggacgccaccccgctggcgatcaccgtgttcctctggctcggactgtccgccctggtcggcctgggtgccttcctgctggccatctgggtctcggtgcgggtcggccggtccatcgtgggccggctgatcaagctgcgccgggaggccctggagatggccacccaccggctgccgaccgtggtccggcgcctgcagcacggcgaggcggtcgacgtggaggtcgagacgccgccgctggagtacggcaaggacgagatcggccagctcggccaggccttcaacgacgtgcagcggaccgcggtgcagtccgcggtcgacgaggcgaacgtgcggcgcggcatcaacgaggtgttcctcaacatcgcccggcgcagccagacgctgctgcaccgccagctgtccctgctcgaccggatggagcgccgggagaccgagccgcaggagctggaggacctctaccgggtcgaccacctcgccacccggatgcggcgccacgccgaggacctggtcatcctggccggtgcggcgcccggccggggctggcgcaacccggtcccggtgatcgacgtgatccgcggcgcgatcagtgaggtggaggactacaagcgggtcgacatccgctcggtggcctccgccgcgatgctcggccgctcggtcggcgacgtgatccatctgctcgccgagctgatcgagaacgccgggtcgtactcgccgccgcacacccgggtgcaggtctccggccagctgctgccgaacggctacgtgatcgaggtcgaggaccgtggcctgggcatgaccgccgacgccatcgaggtggcgaaccggcggctggccgagccgcccgacttcgacccggccgacagcgcccggctcggcctgttcgtggtggcgcaactggccgaccggcaccacatccgggtgtcgctgcaggcctcgccgtacggcgggatcaccgcggtggtgctggtcccggccgagctgatcaccgaggcgccgcagccggcgggcacgcggggccgtggcgaggtcaccggtgacctgaccgccccgctggccgcggccaccacccgtccggcgctgccggcaccccgggtgaacggcgagtcactgcccgcggcgaaggtcgagagcctgaacggccggcaccgcaccgagcccgaggccggcggcccgacgcccagctcggtcgcctccggtctcaccccggacggcctggtgcagcgcaagcgggtccggcgggccccggagacgacggcgggcctgccgccggaggcgaccccgagccggctcggcgacgtggccggcgcgctcggcgtgggatcgcgggcggtgccgcgcaactcggggccggtgctgccgacctccgccgcgccgctgttcaccaccccggagccaccgcttccggtcgcgccgacctcggccgcgccgatgttcgccgcaccggtgtcggcgccaccggccgatgtggacggcggtggcgaggaggtgaccgcgcagttcggcctggacggcctgcccaagcgggtccggcaggccagcctggcgccgcagctgcgcaacccggtggtggagccgccgcgctccaccgcgccggaacgcacacccgaacaggtacgtacgctgatgagtgccctgcagcgggggacgacgcggggccggatccaggcatccagagacgctgaagaggcgaacaacggcggcgagagcgccggggggaatgacgtgtaccggccggagaaggacgcatag

SEQ ID NO: 1807 - DNA, 633 bp, Actinoplanes utahensis
atgtctcccaccgccaccatcgttctgatcgtcgtcatcctgctggtgctggccgcgatcgtgttcggcgtccgggcggcccggcgccgccggttgcagcagaccttcgggccggagtacgaccgggtggtcgccgacaccggcagccgcaccgaggccgagcgtgagctgctggaacggaagaagcggcacgcgcagctggagctcaagccgctctccgcgcagtcccgggcgaaatactccgccgcctgggaggaagtccagatccgcttcgtggacagtccgaaggaggcggtggccaccgccgacgagctggtcacccggctgatcgccgagcgcggctacccgaccggcgactacgacgagcggctcgccgacctgtccgtcgaacacgccgccacgctggagcactaccgctccgcccacgagatcagcctgcgcagtaagaatgacgaggccgaaaccgaggacctgcgccaggcgctggtccactaccgggccctgttcgccgacctgctcggtgcggacccggtggcggccggcaccgcagtacccgccccgcgaccggccaccgaggacaccaccgccaccgaccggaccgcgcccaccgaacccgacgccaccagccgctga

SEQ ID NO: 1808 - DNA, 768 bp, Actinoplanes utahensis
atgcgcttcttcaccaacgaggacaaggacgacaccgaccgggaggaccgggcggaccgggccgcggccttcccgcagcagcgggccggctcgccgtggaccgacgccccggccgacgagacggccgcgcccggcgcgcaccgtgacccggccgaggacgacaccacccggatcgacaccctgcggccggaccacgaggaccgggtcgcggacacccacgccgccgacgccacgcaggagatccacgaccaccgggacgacgacgaggacccggtggacgtggcgctcgacgaccgcggcaccttcgacgacccggtcgtcgtcgaggagccggtcgtcgaggagccggccgccgaggcggtccgggacgagcgcgcgggcgacgagaaccgggcgacgctgaccgagaccgacccggtggtcgccgtggccgagccgatcgaggcggaaccggtggccgagccggtcgtcgcggtcgccggcgtgcccgggcagacgcccaccgccgccgggccgtccccgttcttccccgagtcggagacccagccgctgcgcgaccgctggcgcgaggtgcagctgcgcttcgtcgacgacccgaaggcgaccaccggcgaggcggccgccctggtcgacgagaccatcgagaagctgaccagctcactgcgggcgcaccggggctcgctggccaccggggccgacgacaccgaggcgctgcgggtggagttccgggcgtaccgcgacatcctggaccgcctgctgggcctctga

SEQ ID NO: 1809 - DNA, 288 bp, Actinoplanes utahensis
gtgtccgcctactccgcggcctcgacggtgtccggggacggcgagccggacaccgctccggacccggccgagggtgacgcggaggccgaagccgacgcggaagccggtggcgccgaggccgacgcggacggggaagcggacgagacggcgaccgacggggaggccgaggcggacgccgaggtgaccaccgcggccggcgacgcgcggtggcgggcgggccggatcgacggcggcagactccaccggtcggccgggtcgtcggtgccggacacctcgccggcaccgtaa

SEQ ID NO: 1810 - DNA, 1971 bp, Actinoplanes utahensis
ttgagcaacgacgcgcgagcggccaccagatcggccgtcgccctgaccggcttcctgatcgtggccggcctgcaactggccgcggtgctgggcgtgctctgggcggtgctgacgctgctgcccgccgcgttcgcggtacgcgccggggtgccgctgagcatcgccaccttcggagcgctcggctacgccacatggcgggccctgtacacccggcaccgggtgccggccggggtcccgatctcccgcgcggacgcgccgcaactctgggccctggtcgacgcggccgcggccgccgccggggtgaccccgccggccgggttgaccgtggtcgccgacgccaccgcggtggtcggtgagcggacccgggcgctcgggctgctcggcggccggcgcgacctctacctcgggctcccgctgctgctcgcctgggaccccgcgcggctgcgcgcggcggtggcgcacgaactggcacacgggtcttcccggctcgggcggtgggctcccacggcgtaccgcggaaggatcgccgtgggccggatcgcgccgcgctggaaccgcggccgcaacccggccgcggccgtcttccgggcctatgcccgggtctaccgcgagtgggacgcgccgttcagccgggcgcaggagctggccgccgaccgggtggcggccgggcacgccggggtcgccgcgaccgtcggagccctgcgcgacctgccggtgctcgccgggatgcagcggctcttccacgccgagtacgtggcgccgggctggaccgccgggcatgtgccggaggacgtgttcggcggtttcctgcgggtgctcgcggcccgcggcgaggatgtggcgatcctgcgggcccggggggccgagccgggcggaccgtgggacacccatccgccgctcgccgagcgcctcgccgccctgatcccggccgcaggggacgcctctgccgaggccgctgccggttccccggccgctgccggttccccggccgccgctgattccccggccgccgtcgaggctccggccgccgccgacgttccggccgaaagtggtcagccggcccccgaggatctcgtgcccgatctgcccgggctcggacgggcgctgcaggccgtcgccttcccgccgcacggccgcaccgagatggcgtgggacgacttcctcagcgtcgcccgcacggccgagatggaacgtgaggccgaggccgcgatggccgcggtcgcccgcgcggtcggcgccgaggtgccggacgccgaggggatcctgcgcctggccgccgacgggcggctgcggaccgccgccgcgacgatcttcccgggcctgccgccggaggagaccgccgagcggatcgtcgatctgctcgcgctcaccctggcgctggccgcgctgcgcagcggcgtcgcccgctggcggcacaactggaccggtaccgccgagctggtcgccgcggacggcgcccacctgaacctgaccgacgtggccgcggccgccgccgatccggagcaggccgaggcggtccgcgcctacctgacccggctcggggtgcggctggccgcgccggacggcgcccgcccggccgcccgggcgcaggtgctcggcggcctgatcaacctgtccgcggacggcgggcggaccgacgtgctcgtcaccgacctcggtttcctgctggtccccggcctgccccgggggcggggaccggaggccaggcggcgcctgcacgagatcgccgcggccggggtgaccgccaccgccggcggcggcgaccgccggttcctgccgttcatcgaggtcgcggcggtgaccacgatgcccggccggcgccgcggctgggtgatcgagctgcacgacggcggccgggtcacgctgcgcgcgtcgctggacaccgacgaactgcccggtgggtgggcggcctgggaggacgcggtcgccttcctgacgaagacccgagtctcatccgcgacgaatcagtaa

SEQ ID NO: 1811 - DNA, 1458 bp, Actinoplanes utahensis
gtgatcgccatagcgaaacagtttagagtcttcagagtgcgctctcagacgaagcggctcggtgacgtgatcccggcgcccgctctggtggttccggaaccggctgtgaccttcacgatcactccggtgacgacggtcagcgcgccgccggcggccgccgccgtggccgcccacctgggcccgctcgccgacgacggaccgatccgcctggaactgaccgacacggacggtctcggcgccgagggataccgtctggcgatcaccgcgaccggggtgtcgctgcgcgccgccgagccggccggcctgttctggggcgtgcagacgctgcgccagctcgcggccgacgacggggtgctgcccggcggtgtgatcgaggaccggccgcggttcgcctaccgcggcgcgatgctcgacctggcccggcacttcttcaccgcggacgagatcagggcgcacctcgatctgctggtccagttcaagatcaatcacctgcacctgcacctcaccgacgaccagggctggcggctggagattcccggctggccccggctcaccgaggtcggcggcggcccgggcaccggttgcgacggcaccggaccgggctttctcaccctggccgagtacgccgacgtggtggcctacgccgccgagcggttcgtcaccgtgatcccggagatcgacatgcccgggcacgtgaacgcggccctggtcgcctacccggaactgaccgcggacggccggccggtcgcgccgcgcaccgacgccgaggtcggctacagctcgctggtggccggcaaggacgagacgtacgccttcgtcgaaaccgtgctcaagacggtcgccgacgtcaccccggggccgttcctgcacatcggcggcgacgagtgcctgtccacctcggccgaggattaccacgcgttcctgtcccgggccctgccgctggccggcaaatacggcaagcgggcgatcggctggcacgagatcgccgcgaccgacctgcccgagggcaccgtggtgcagtactggcggccggagccggaggacgcccaggtgctcgccgcggtcgcagccggtcaccaggtgatcatgtcgccggccgaccggacctacctcgacatgaagtacgccgcggacaccccgctcggcctggactgggccgggctggtcccggtccggcggtcctacgagtgggacccggccacccgcctcgccggagtcggcgagcaggccctgctcggggtcgccgccccgctctggtcggagaccctgcgcacggtcgccgacgtgcagtacctcaccttcccccggctgcccgcggtcgccgaggtcggctggaccccgcaggccggccgggactgggcggcgttccgcgagcggctggccgctttcggcccgcgctgggacgcggcgggcgtcaactaccaccgctccccggagatcgactggccctcggcctga

SEQ ID NO: 1812 - DNA, 534 bp, Actinoplanes utahensis
atggcgatcactgtgcgtcatgccacggcgggcgacgagcaacctttgcacgcgctggcgacacttaccttcggattggcctgcccgccggaggccagacagacagacatcgatgaattcatcgccacccacctgtccgtcgagcggttcgccggccatctcgccgacccggcccggatcctgctgatggcgctcgacgacggatcgccactcggttattccatgctggtccgcggcccgatcacggacccggacgtggccgccgtggtggacgccgcgaccagcgtcgagctgagcaagttctacctgctggccgaccggcacggctcgggcgccgcccacacgctgatgaccgcgaccctggcggccgcggccggcaccggcgcggcgtcgtgctggctcggggtgaatcagcggaacgtgcgggccgcgaagttctatgccaagcacggtttcggcgtcgtcggcgtgaagcgtttcctggtcggcgagcagtggcacgacgaccacatccgggaactcagatttcgctga

SEQ ID NO: 1813 - DNA, 957 bp, Actinoplanes utahensis
atggcgaacacgagtgcccggatgctacggctgctgtcgctgctgcagacacaccgctactggccgggcgccgagctggccgatcggctcgaggtctcgccgcgcaccctgcgccgcgacgtcgaccggctgcgcgagctgggttacccggtggacgccagccgcggcgtggccggcggctaccagctgcaggccggcgccgcggtgccgccgctgctgctcgacgacgacgaggcggtggcgatcgcggtcggcctgcgcagcgccgcggccggtgcggtggccggcttcgaggagacctcggtgcgtgccctggccaaggtgatccagctgttgccgccgcggctgcgccgccggatcgacgcgctgcaggcggtgaccagcccgggcgcgaacggcttcggccccgtgctggacgccgcggtgctgaccacgatcgcgctggccacgcgcggtgaggaacggctgcgcttcgactacgacccgcgcgagggcacggccgctcggcggcacgtcgagccgcaccggctggtcccgctcgggcggcggtggtatctgctggcctgggacctggaccggggcgactggcgcagcttccgggtggaccggatcaccggcccggagctgaccggcgcccggttccgcccgcgggagatcccgggcggcgacccggtggcgtggctgcgcgcgcggatccgggcgatccccagccgttacgacgtcgcggtgctgctggagaccgatccggagacggcgcgcggggtcaccgggcactgggccaccttcgaaccggccggcgacggccggtgccggatgcggatgaacgtcgacgacctgggctggcccacactggtgctgggggtgctcgccgtgccgttcaccatcgaggcgccggccgagttgcacgaccgggtgcgggcggccggggaggccctgctgcgcggctcgcggacgtga

SEQ ID NO: 1814 - DNA, 1101 bp, Actinoplanes utahensis
atgctcggtcgggcgctccagcggccgttccggcagctcctggaaaggctcaccgggccgcccggagcccggccggcgctgcggcacggcaacccggacgcggtcgtcgactgcgcggtctatgccggcgggctgcggcgcgccgagccggggcagccgcgccagatggcgtacgcggaagccgcccggatggcccggcgccgccgcaacgccttcgtctggctgggtctgcacgagccggaccggccgaccatggatcagatcgccgaggtcttcggcctgcacgagctgctcgtcgagcgggccaccggcggcgggcaccggcccggcgtccagacggtcggcgaggtgacccggctggtgctgcggaccgcgcggtacgtcgagcacgaccggctcaccgccacctccgaggtggtcgagacaggcgacatcaccgtgctggtcggcgcctggttcgtgatcaccgtgcggcacggcccggtcggcccgctctggcaggtccggcaggagctggagagccgtcccgaggtgctgcggcacggcccgtgggcggtggcgtacgcggtgggcagccgcctggtcgacaactacctggacgtggccgggcacgtcgagcgcgacctggagcgcctggaggaggagaccttcagcgtctcgcgcggcgccgggatcgcccacatctaccagctcaagcgggagatggtggagttcaagcgggcggtgctgccgctggccgacccgctggccaagctgctggagaccagggagctgccggccgcgctgcgtccctacctggtcgacgtgcgcgggcgactgagccgggcggtcgaccgggtggccggcttcgacgacctggtcaattcgatcctgcaggcccgcctcgcgcagatctcgatcgatcagaacgacgacatgcgcaaaatcgccgcgtgggcggcgatcgccgcggtcccgacggtgatcgccgggatctacgggatgaacttcgaggtcattccgggattggattcgccatacggattctccggcgccatgaccgcgatggccgtcctggccggcggcctgtactggcgcctgaagcggaccggctggctctga

SEQ ID NO: 1815 - DNA, 273 bp, Actinoplanes utahensis
atggcgctgcgcggtccccggccggtcaccacccggctcccgtcgatccgcgccgccgtcgccggctgggtcgacatcgcgtggcgcaccgatcacccggtctgtgacgcgcaggtccaggtccgcggtgagcgggtccgggtggactaccccggcaaccgccgggccgccttcttcgcgaccggccgcaccctcggtccgcggcgtccggaggtcacccgcgtccgggtgaccccggacttccggctcgccggtgacgtggcccggctctga

SEQ ID NO: 1816 - DNA, 105 bp, Actinoplanes utahensis
atgcacctgagtcggcgaatcgcagcaaccttcgcgctggccaccacggcggccggcctggcgacggcggtcgcggccgcaccggtcaccgccctagctagctag

SEQ ID NO: 1817 - DNA, 330 bp, Actinoplanes utahensis
atgacagagaaggcggaagacctgggagaaccggtcgcctacctggtcctcaaggagggggtgccggtctacgcgcccagcggcgaccggatcggcacggtggagcacgtgctgtccgacgagccggcggacgtcttccacggcctgctgatcagcacgccggacgggcggcgcttcgcctccggcgaccaggtggccggcctgtacgagcacggggcggtcctcaccgagccggccgagcaactcgcccgctccggcgccgacctgcccggggagcgatccggaggcacgctcaaacgggcgtgggactggctggtccagccccactga

SEQ ID NO: 1818 - DNA, 909 bp, Actinoplanes utahensis
atgcaccgcggcggaactcgtcgggagagggagcgcggcaccatggcggagattcaccacttcgatcacggatgggtgaccccagccttcagttatctgctgtccgtgctcggatcgctgctcggcctcaccggcgcggtgcgcctgcggtccgcgcgcacccgggccgagcgcggctggtggttggtgctggcggcgctggcgatcggcaccaccggcatctggaccatgcacttcgtcgcgatgctcggcttcgaggtggtcggcaccccgatccggtacgacgtgaacctcaccgtcgccagcgtggtgatgtcgttcgtggcggtcggcgccggcctggccatcgcgctgctcggcaccagcgcccggcagctgcggatcctggccggcggcgtgctggccggcctgggcgtggccgcgatgcactacaccggcatggcggcgatgcggctgtacggcgacatccactactcgggttcccgggtgatcctgtcggtggtgatcgcggtggtcgccgcgaccgtcgcgctctggctcaccctggtggtcagcaggccgctgatcatcttcatctcggccctggtgatgggcgtcgcggtcaacggcatgcacttcaccggcatgtccgcgatgtcggtcaccccggaggggcactccggcgtgatcgagggcgccaccgcccagtcgatgctcatcccgatcggcatcaccgtggtcttcggcctgctgggcatggcgtacgcgctggcctccgcgcccaacgaggaggaccgcgccgccaccgagtacctcaacgcccggatcgaggcccggatggcgcagcaggccgcccaggcgaggaacgcgaccggtcggggcaccctcggcaacggcgcatggacgtaccgcgaccgcgcctcgaagtag

SEQ ID NO: 1819 - DNA, 879 bp, Actinoplanes utahensis
atggcgtccatcgtcatcgcggaggacgaccgcgacatcgccgaactgctggccaccgtgctgagcaacgcggaccactcggtgcggaccgtcccgaccggcgcggccgccctggaggcgatcggcgccgagacgcccgacctggtcatcctcgaccaccacatgcccgggatgagcggtctggaggtggccgaccggctgcgggccgaggccgccaccgccggactgcccctgatcatgctgtccgcggccaccccggccgcggcccggcacctctgcgatctcaccatctccaagccggtacgtccgcgcatgctgctggaggcggtcggtgagctgctggccgcccgcgtcgacggtgggccgcccgccgacatccacccggatgccgccacccagctggccgacgtgccccggctgctggccgtctcggacctgctgacccgtccggcgcacgccgccggcctggacgccttcgccgagcggctggccgggctgaccggggtgccgaccgcggcgatcaccctgatgctcaacgacacggtggtggtggccgggtcgttcggcctgcccaggtgggtccgtgaggcgggcggggtgccggccgagtggtcaccggacaccatcgtggtggccgaggacgtgccggtgctgatcggcgacagccgggagaacgaggagtacgcggacacgccgctgttctcggtgagcggcgtgcgttcctatgcgagcgtgccgctgcactcgccggagggccacatcgtcggcacgctgtgcgtgatggacgagcggccgggcagctgcaccgaggacaccgtgcagacgctccactcgcagcgtgccgccgcgctggggctgctgttgcccgccggcgcctga

SEQ ID NO: 1820 - DNA, 1761 bp, Actinoplanes utahensis
atgtcggtggacccggccggacgcgcctcctgctccctggtgagccgctcggcccgcgccgacagcagggccaccgcccgctccgccggcagcgccccgaggcaggccaccgccagcgcgaagtcgaccgaggcgaccggtgtgtcgcgcagcccggattccacccgcgcccggaagtcggcggcgccgcggtcggtcagctcgtacacggtgcgcggcgggcggttgccgacccggcccggttcgcgcgccgccaccaggccagcccggtgcaggaacttgagcagcgtggtgaccgtgctgcgggtcggggtgagctgcgcgtgccgctcccgcaggcgggtgcccaggtcgtacgcatgcgccggccgctccccgagaagctcgagaatcggcagcaccagactgttccgtgaggcatccagcggcatgaaactacgttatgggcgtatacacctagagacaacccaatattgccctggatctgtcgaaaacgccgcagttcggcggtcgggatccttccgtagggtggctcgggtggaacccttgacgaactgggccggcaacatcaccttcggcgcgcggcgagtcctgcgcccgcagaccgtcgacgaggtccgcgagctggtcgcggccgcggccgagctgcgggtgctgggcagcggtcactcgttcaaccggctcgccgacaccaccggcgacctgctctcgctggccggcctgccgcgcatcgtggagatcagcccggaccgccgcaccgtccgcgtcgacggtggcatccggtacggcgaactcgccacccgcctgcacgccgagggcctggccctgcacaacatggcgtcgctgccgcacatctcggtggccggggcggtcgccaccgccacccacggctccggggtgcggcacggcaacctggccaccgcggtcgccggcgtggagatcgtccgcgccgacggcgagctcatccggctccgccgcggcgacgccgacttccccggcgcggtcgccgcgctcggcgcgctcggcccggtcgtcgcgctcaccctggacgtgcagcccaccttcgaactgcggcagtacgtcttcgaccacctgccggtcgccgcggtccgggccgacctcgccgacatcctcgccgacggctacagcgtcagcctcttcacccgctggaccggcaccgacatcgaccaggtgtggctcaaacgggaagatccgatcaccggcgacacgttccacggcgcgcggctcgccgacgggccgcgccacccggtgcccggcatgcccgcggagaactgcacccggcagggcggggtacccggcccctggcacgagcggctgccgcacttccggatggaattcacccccagcagcggcgaggaactgcagtccgaatggcacctgccccgcgaggcggcggacgacgcgctgcgggcggtggccgagatccgcgagcgggttgcggacgtcctgcagatctgcgaggtgcgtacgatcgcggccgaccagctgtggctcagcccgcactaccagcgggacagcgtggccctgcacttcacctggatcgccgacccggaggcggtgctgacggtggtcgccgacctggagaaactgctcgggctcctgggcgcccgaccgcacctgggcaagatcttcaccagcgcgcccgaaccgccccgggtggccgacttcgccgcactggccggacggttcgacccgaccggcaaattccgcaacgagttcctccggcggctcctgccgtga

SEQ ID NO: 1821 - DNA, 828 bp, Actinoplanes utahensis
atgaccgcccctgacggtggtgccggctttcccggccgggtcgacgcttccccctcctccacgccgcgctccgatcccgcgcagcctgctgccgccgcgccgcctgctgcggacacgccgcttgctgccgccgcgccgccggccgtcatcgcgccgccggccctcaccgtgccggtcgagccgaccgcggctgccgcctctgtcgtgatcagcgcgtttcgggcggaggcggacgcgctcgggcacgtcgcctcgcgctggaccggcgaagactggacgcgacccacccggtgcacgccgtggaacgtacgcgaattattcgcccatatccggatagttctcgcctggctgcccggcatgctggacgctccggcgccgggggcggcggacacctccgccgcggcctattaccgccccgaccaccgcttctccgcggacaccgacgcgacccgcatccgcctggcccagcagcatgcccccgggctggacgtccgcgcattccgcggcttcaccgccgacctggccgaccgctgcggcaccgaaccccccggccgcgtcgtgcgtacccgccacggcgacgccatgctgctcaccgacttcctcatcacccgggtcgtcgaactcgccgtgcacggcctggatctggccgacgccctcgcccgaccggcctggctcaccccacccgccgcggacgtggtcctcgggctgctcttcggccgaccggccagtgagctgcccggcccggctgacggcctgctccgccaggccaccggccgcgccccggccggcctcgacctgaccggtctgcggccgctgaccctgggctga

SEQ ID NO: 1822 - DNA, 801 bp, Actinoplanes utahensis
gtgaccgaagccagccccgaccagccgccgaccccggcgtccgcaccgcggcctcccgacgcggtgcccgcggcccagccaccgtccgccagcgcttcccgcccctccgccggccgtgcgggttccggcggccaagccccggtcaccgaggagccttccctggcagcgtcggcgggcgaaccgccggcagcgcaccccggcagccaaccgaccgacggcatggaccaccaacccaccgacggagcggacggccaaccgacggcgggctcgggcggtcaggcggtggtgcggcgtcggcggccgatcgtgaccgcgctctgggtggccgcgctggcggtgatcggtttggtggcctgggttcagagcaggccgtcgtcgccggatgccgagcgggatgcggcgctggacggcctgttgacgttcggtgggccggccgggtggcagctgtcgcaggatccgggggtgccggccgcggggggcttcgcctggactcagcgggatgggcggccggtgctgctcggcgacaacggattcaccgtggtctggtcggtttcgccggcgacgccggacgcctgcacggcgctgtccacctggacgaccagccggatcggggacgaggccgcgacccaggtcgccacggcgtgcccggccgccctggcacgcaaggacggcgcagagcgcgtgttcacgagctaccgcaccgatccgggtaagcacgggcgctacctgttcgccgcacgcgtcgggggcggggcgctgttcgccggtttgacctacgagcgcccgggcgcggcgcaatag

SEQ ID NO: 1823 - DNA, 978 bp, Actinoplanes utahensis
atgccgcggcggcgtgggccgtcggtcaccgtgctggctttcgacggcatgtcgatgttcgagctcggcatcgtcaccgaggtcttcggcctgccccgtcccgagttcgaccgcccctggtacgagctgacgatctgcgccgaaacccccggcccggtccgggtgatcggcggtgcggccctgcacaccgaccacggtctggacaccttcgccggcggcgagacggtgatcgtccccggggtgcccgacgtccgggccgacccgtccccggccctgatcggtgccctgcgcaccgcccacgcccgaggcgcccgcatcatgtcgatctgctccggcgcgttcgctctggccggcgccggcctgctcgacggccgccgcgccaccacccactggcggtacgccgaagccctccgcacccggcacccgtccgtccaggtcgacgcggacgtcctctacctcgacgacgacgacgtgctgaccagcgccggcagcgccgccggcctcgacctgtgcctgcacgtggtgcgccgcgaccacggcccggcgatcgccaacgcggtcgcccgccgcctcgtcgtccagccgcaccgggacggcggccaggcccagttcatcgaggccccggtcccggacgacccggccgacgaccgcctggcccgcagcatgcagtgggcgctcacgcacctggccgagccgatcagcgtggacgttctggcccgccgggcccacatgtccacccgcacctacctacgccacttcacccgagcgaccggtaccaccccgatccgctggctgatcgcccagcgcatccacgccagcctggccctgctcgaaaccaccaccatcccgatcgaaacactggccgccaccgtaggcttcgacgcggcggtcaccttccgccaccacttcgcccacctcatgcgcacgtcgccctccgcgtaccggaaagccttcgcccgcacaccaccggtcacctga

SEQ ID NO: 1824 - DNA, 543 bp, Actinoplanes utahensis
atggtgaagacgccggtggggcggcggccgggagcggaggcatggcgcgatcttagcggtggatggcatcagcgccactggggtcggcggggtggcgacggcacgatcaacggcatgacgaacaccgatgcgatcgcgcacttctcccgccggctggctttcgagaccgatgtcagcgacgtgcacgccgacctgagggacggcatcgctgggctggtggtggtcgactcgcgcagtgacgaggcgtggcggcaggggcacatcccggccgcggtgcacctgccgaccgggcggatcgcggcgctggcggcggagctggttccggccgggagcacggtggtcacctactgctgggggccggggtgcaacggggcgacccgggcggcgctggagttcgccaggctcgggtatgcggtgaaggagatgatcggcggctacgagtactgggtccgggagggtttcccggtgcgggacgagaagggcgaatggtcccggcccgccgatgagctcgcggctccggccggcgcgacctgcggctgctga

SEQ ID NO: 1825 - DNA, 2283 bp, Actinoplanes utahensis
atgtctgcaagaaagctgcaggctgggctgctcgcagccggcctggctgtcggaatattggtcgcaccggccgcgcccgccacggcggcacccgccgcgccggccgcggccgccgcctcggtcaccgacccgacgaacctcgccaccgacgaggacaaggtcaaggccgccggcgcgatcggcgtcaacccgggcgtcgacctgctcgtcctcaacgaccagggcttcgtcttcgccctctaccagcgcgccgaggccgggccgtacgtcaaggccgaggcgctgcgcagctacctgtcgtccgacccgcgcgcggcgtacaccttcatcgtcaccggcatcttcgtggcggccaacgacgacgcccaggccaagatcgccgagacggccgcgcaggcccgccggcgctcggtcgcggtgaccgtcgggctcgactcgtccgacaccgcgctgatcgagaagaacgaccgcgacttcatcttcgcggtctggcagcgggtcaccgccggcacccacgtctggaccaccgcccaggccgcgatcgccgacggcaccacccagaccgactgggacaccttcctgaacaccggcgcggccgccgccgccgatcaggacatgcgcgacgcgatcgcgaaggcggacgagcagctcgccgcgcagctgcgcgccaagcagctcgccgacgccaagaagtcgctgctgcagctcctgctgctgcaggtgaccgacgagctggtcaacgcgccgaaccggcagttcgtgctgttcgtccacaacaacgccaagggctccgaggtctccctggcctcccaggtcgccctgaacgcccccgacgaccagctcgacaaggcgctcagcgacttcatcttcaccggcggcgccgccgccaacaagcgcgacgaggacgccgccgcggtcatcgaacgcgacggctaccacgcccgggtcatcccgatccgcgacgccgccgagcacgacggcttctcgccgaacctgctcgccgcggcccaggcggcactggccgccaacaccctggtcgccctgcagaccttcctgctcaagggccaggacgaggcgcgcgccaaggaccgccggctggacttcacctccggattcgagaccaccgacccccggcccaactggcaggacacggtcgacaccaacggcggtggcgcgacgaacatcggcggtgtcatcgccggcctgaccaaggcggagctcggggtccggtcgttctcggacggaaccaagttcctgctctactccggcaaggacaacagcgccacctcgtcgtacagctacaacgcgctctactcgctgagcaacgtcaaggtccggccgacgaccaagctgtcgtaccagatctacccgctgagcagcgccggcgacccgaacgtgagcggcatcaacagcacctgcgtggcggtcgacatcatcttcgccgaccaccccgacctgcgtgactccggcgccaaggaccagcgcggcaactcgatccacccgggcgggcagtgcggcaagctcaagctcgacgcctggaacaccgtcgtggtcgacctcggcgcggtcgcggccggccggaccatcctgcgtgtcaacgtcggctacgaccaggccgccaacaccggcggctaccggggctacatcgacaacctgaagctcaccgacctggagagcgcgcccaagttcgtcacctccgccgagcccaccgacacccacccgacctgggtcaactcgctggacacggtcaagccgggcggcaacacgtggaacgtcggcccggtcgtctccagcgtcaccggccccgagttcaaggagggcacggactacggccgcaccgggaccggcgtcgtgctctactccggcaaggacaacggcaccgacgcgtcgtacgcctatctcaaggcgtacgcgctcaacgacacctacgtgtcgtcgacgacccagctgtcgtactggatctatccgcagagctccaagaagtggagcacggtggtcgggaacaacagcacgtgcgtggcgatcgacctgatcctgcaggacaggatcgacggctcgacgatcagcctgcgggacaccgacgtcaaggacaaccgcggcaacatcttccacccggccaagcagtgcgccaagctgccgctcgacacctggacccaggtgaccgtgccgatcggctcggtcgccaacggcaagcggatcgtgcagatcgacttcgggtacgaccaggcgcccggcaccggcgcgtaccgcggcttcctcgacgacatccgcatcacccagtaa

SEQ ID NO: 1826 - DNA, 1110 bp, Actinoplanes utahensis
atgcaccgcaacctgcgccccctggcgctcgtcaccgcctccgccctgctgatcggcctgccggtgacggcacagccggcctcggccgcaccgctcggggccggcccgctgctggccgccgggccgtccaaccccaccgaccgttaccgcacgctggtccgccgcctggccgacaacgacccccgctgggaggtgcagagcgcggcctggtcggcgctggtcagcgacgtgcccaccgcggtgaccgacttcctgagcagcggcggcggctacgagaaggcccgcgcccgggccaccaccgacgcctcccgcaacaacctggtgatctcgcgcgccatcgcgaccaccaccgacaagacctcgccgatcgtgcacctgaccgcgcaacgggcctcctacggcaccctggccgagaaggaccgctacgtgcggaccgggctcaaggaggcgcaggacctggacgccaagcactccccggtggagcaggccaaactgcaggcccagcaggaccgtgactacgtgaccgacatcgccgcgcacggctccggcgcctgggtgcgggcggccgcgcagcgggcgatccagaagggcaccgacaacgacatcgccgagttcttcaagtactcgtgggcgtccgcggcgaactgcgacctgcaggcctaccggatggacctggtggagcaggacctgacctaccggcaccgcctcgaccagctgatcgccgccgcccaggccgcccagcaggcctacgaggcggcgtccgacgcggccaaggccaaggctgccgaagaggcgaagctggcctggaacaccgcggccgacaccgcggccgccacccaggcgtcctggctggccaacagcgccgccgcggcggcgcaggcgcaggcctgggctgcggtgcacgacttcgcggtgaccgcgtccacccagcaggactggccgacgatcgccggcaacgcggcgaacaccgacgcatcctggaccgacgaggtggcctgggcgcagaaccaggcgcaggagtggaccgcgctgtacgagtcggccaaggccagcgccgaggcgatcccggccgcgccggcgaacggcccgagcgcgtcaccggcggtctga

SEQ ID NO: 1827 - DNA, 633 bp, Actinoplanes utahensis
atgacctcagcgggacaggcggcggcattcgccggagtgatcgcgctggccgcgatctcccccgggccggacttcgcggtggtggtgcgccggtcggtggtggccggccgccggcacggggtggtggccgggctcggcgtggccaccggggtgttcgtctggtcggtggccgcggcgatgggggtggccgccgtcctggaggcgtcggccgtggccttcaccgtggtcaagctcgccggcgcggcatacctgttgtggctgggcgtgaccgctctgctcgccgcgcgccgaggcggtgccgccccggagatcaccaccgaccgggacacggacgtgcggttgtgggtgtcgtaccgcaacggggtgctctgcaatgtcttcaaccccaagtgcggggtcttcttcatggccgtcctgccccagttcgtcccgatcgacggccggccggccgacgtgctgctgctgtcgtcggtggcggtgatcgtcacgatcagctggttcaccgtggtcgccaccctggtcgccgcgctgcgacgggtgctggcccggccccgggtgcgtcgcgcggtggacgcggcgaccggcgcggtgctggtcgcgctcgggctgcggctcgcgaccgccggcgcctga

SEQ ID NO: 1828 - DNA, 417 bp, Actinoplanes utahensis
atgggtgacaacgaggacacgggtcgggtcgggaaacagatcggtgggacggtcgccgttgctgtcctctccgcgctcagctggctcgcctggatgggctgggaccacgagtatcagacggatccggccaccggcgtgaccagcgggccgtacgaagcctggcaggtgatcggctgcgcgctgaccctgctcgcggtcttcgccggggcgatggccgccggggtgcggccggtgctggtgtcggtggcgctgccactggccttcaccgcggcctggacggtcaccgccgccgccgacgacaccaccgggctgtatgcggcgggcgctctcctgctgctgctcggcctcggcgcggcgacagtggtggcctcagcgatcaccgcggcgatccgacactggcgagccgccccacactga

SEQ ID NO: 1829 - DNA, 588 bp, Actinoplanes utahensis
atgctgatcaaagtcatcgaccagatcaccgacggtgagatgctggaggccgcgtggggtctctacctcgaggcgttcgaggatctcaactcactcgcggtgcagcggcacctgatgtaccggtcggagttcgacgaggtgatgcgggaccccagggtcgacaaatacctcgcgttgcaggaggacggcacgctcgccgggctctcctgctacacgaacaacctggacgccatcccgttgatcgcgcccgcctacttcgagcggcactatccggagcactaccacgccaagcggatctggtacatcgtcttcgtcgcggtgaagccggaagcgcagggccaggacgcgttcgcgcagatgtcggaacagatgtacctggtcgcggccacccagaacggcctcgtcggcctggacgtgtgctcctacaacgatgacgtgcggcacatgtcccgggtgttccggctgctgatcggccggctgtgcaatttcaacatgacgttccagcagatcgaccagcagtcgttctggctctacaacttcccggcagtcgcgtcggagaataccgtcgacatcccgcgtgcggcgtga

SEQ ID NO: 1830 - DNA, 615 bp, Actinoplanes utahensis
atgacgtacgccatccaggaattggtcatccgggatgtcaccccggttgacaccgacgagatcaccgatctcgtcgccgaggcgatgcgtgacggcccggtggcgaagtggctgcacggtgacccggaggtgcgccggcgggaggctccgcgatacttcgagatcttcgtcgagcatgcgacccggtacggcgaggtctatgccaccgccgactcggagaccggccggctcgacggcgtggcgctgtggttcccgctcacgtcgctgatcccgccgccggtcgactacgagcgccggctcaaggaggcggccggcgacgccttcgaccgcgcctgccagctcgacgtcacgctggacgagcaccacccgctcgaaccgcaccactacctggcgttcctggccgtccgccccgactcgcagaacaggggcatcggcagcgctctgctcgagcgccaccatgcccggctggaccaggccggcctcccggcctacctggaggccaacgacccgcgtaaccgtgacctgtaccttcgccacggctaccagatccgttccgtcatcaacctgcccggcgggcctccgttgtggacgatgtggcgggcgcctatggcctga

SEQ ID NO: 1831 - DNA, 1605 bp, Actinoplanes utahensis
atgagcgtcggacggcaccagctgcggcacaacaacaccgaccagtgggccggtcggctcctgacccagcggaaatcggccgccgagccggacatcatcagccgggcgctggcccagaaccggctcggcaccgcctcggtcgtcttcttcggcgtcgccggggccgcgccgctcaccgtgatcatcggatccatttcggcgatctacgcgatccagggcagcaccgcggtcccggtcgcctacctggtggtggccggtatcctgtcgctgttcacggtcgggttcgtggccatgagccggcacatcgtgaactccggcgcgttctactcgtacatcagccacggtctgggccgggtggtcggcgtcggcgccgcattcgtcgccctgccggcgtattcactgatgcagatcggcctcttcgggctcttcggcaccgccgcgtccggcatcttcgccgagttcgggctccaggtgtcgtggtacgcgtgcgccatcggcgcctgggtgctggtcaccgtgctcggcatgctctgggtcgacctcagcggcaaggtgctcgccgcgctgctggtcgccgagatcaccatcgtgctgctctacgacctggtgatggtttcacacccggccggcggtcacgtcagcttcgcgacgctctccccggcgccgatgctgacacccgtggtcggttcgctgctggtgctggccatcgccgggttcgtcgggttcgaggcgaccgtcgtactctccgaggaggccaaggacccgaagcggaccatcgcccgggccacgcacatcgcggtcctgctggccggcctgctctgcggcgtctccgcctgggcgatgtcggtcaccaccggcccggaccggatcaccgcggtggccgccgagcaccagaccgacctggtgttccggctggtctccccgcacctgccggtggccctcgtcgacgtgggttacgtgctgttcatgaccagcgtcttcgccgcgctgctggcgttccacgccgctgtcgcccgctaccagttcgccctcggccgggagggtgtgctgccgtcggcctggggttacacccatccgcgcaccggtgccccgctggtcggcgccatcacccagagcgtgctggcactcggcgtgatcagcatctatgcggtcgtcggcctggagcccctgctgtacctgttcgcgtggctgaccacgatcggcggcctgggcgtgctgatcctgatgtggtcggcctcggccgcggtgatcgcgttcttccagcgcggccggcgcggggagagtgtctggcgtgcctacctggcgccgttcatcgccttcctgctgctctccatcgtgctggccgcgaccatcatcggcttcggtcagctgctgcaggtgtccagcggctccatcttcaactggatcgtgccggtggcctacgccgtcgtcgcgctgatcggcttctcctgggccctgatcatgcgcaggacccggcccgacgtgtacgcggcgatcggtcgtggcgccgaaacccgggtcgccttcccggccctcgagaccgacttctccccgcacgtgctgcctccggcgccggtgggttcgcgtggctacccctcatggtga

SEQ ID NO: 1832 - DNA, 642 bp, Actinoplanes utahensis
gtgttggctgaccagtactacctgatcgcacacgaggaccgcaccgggcggtccaggctacatccccgtgcgaccggccttgggttggccgccgcattactctccgaactcgtcctggaaggccgcatcggcgtcaccgacggcgaccttttcgttcttgatcgccatccgccggcggacgcgctcgagcacgacattctcgatcttctcgtcgcccagccgcagcatcgtgacgtgcgcacctggctcgcctttctctcccaggacgccggattgcgggtgggtgagcgactgatgcgcatcggcgcggtcgagccgatcgtccgccgtcgcatgctcggctccccgtcggtcacctacatgccgaactcggcgcagcagcgcaacgccgcggcctgggcctccacccggctggccaatctcctggtccgcggcatggagctgagcatcgtcgaccagatgctggtcagcctcgtctccgcgaccgggttgacccggcacgtcctctatggtttcgaacagtatccgcacgccttccagtacgtgccgaacgtcgcgttcggattgccgagcgacctgcgggaaatcgtggagtacaccgaggcgtccatcggatcggtgctgaccgtggggcgtcgatga

SEQ ID NO: 1833 - DNA, 849 bp, Actinoplanes utahensis
gtgtccgatattgagggtccgacactccgccgccgccgcctcggggtggaactcaagcggtgccgcgaggctgcccatttgacgcagcaggacgtgtcgcggcatttcgagtggcactctgcgaaggtgacccggatcgagacggcgcgggtcgcggtgacgccgcgcgatgtccgagatctactgaccctctaccgggtggaggacgatacctaccgcgaggctctggtcgagctggcccgctcgtcccgggagcgcagctggtggaccgactacaaggacatcatgcggccgggcaacttcgtcggcatggaggccgcggcgacgtcgatgcggtgctgggagccgatcatcattcccggactcctgcagacggaggcgtacatgcgcgctctgatcagtaccggtcgatcagccgacccgccccagcgcatcgacaggcgcatctcgctgcgattgacgcgccagagccggctgcacggcgaccacccgctggagctggctgcgatcgtcgacgaatcggtggtgcgccgcgtgatcggcggcgaagacgtgatgcgggcacaactcgaccatttgatagaaatagctaaattgccgaatgtctcattgcagatcttgccgttcggatccggtgaacatccgttcctgggcggcgccgtcacccttttggaataccgggataccacccatttggatgttgtctacctcgaaggcattgcgggagactactacgaggagcagccgactgaggttgcccggtacaggcaggagttcgagcgattgagcaccagggcgctcgaccatcgcaccaccataaagatgatcgagagtctgctcgtcgcctga

SEQ ID NO: 1834 - DNA, 219 bp, Actinoplanes utahensis
ttgctcgcgcaccagctcaacggtgccgtctggaagaagggcagtcgtagcaacggcaacggcggcaacaactgcgtcgaggtcgcattcctcgacgaaggaggaatcgccgtccgtgacagcaagaaccggacaggcccagctctcttgttcacgccggcggagtggaccgccttcgtggactctgccaaggacggcgagttcgatatcgctccgtga

SEQ ID NO: 1835 - DNA, 825 bp, Actinoplanes utahensis
atgcgcctacgtcgcgcagtcgccgtcatggccgccgcagtcgcggccaccaccgcggtcctcgccggacccacccccgcccgggcggtcaccgcggtcaccctcgccaacacgatcaagctcagcaactgctcggcgtcgctggttcgctaccccacctcggtcagcagcgaccgggcgatgatgctcaccaacggacattgttacgaaggtggcctgatcccgtccggcaccgtcctgcagaaccgcaccagcagccgctccggcaccctgctcaacagcagcggccgggccgtcgccacggtgcgcgccgaccgcgtgctgtacgccacgatgaccggcaccgacgtcaccctgtaccgactgaccagcacctacgccacgctgtccagccggtacggcgccaccgcgctgaccatttcggcgaaccacccggcagccggatccagcatcgtcatcccgtccagctactggaagcggatctggaactgcacgatcaacggtttcgtgccgaccctccgcgaagacgaatggacatggcacgattcgctgcggtacgacagcgcctgccaaaccattcacggcacctccggatcgccgatcgtcgacgccaccagcggacagatcgtcggcatcaacaacaccggaaacgacgacggcgagatgtgcacgctgaacaacccgtgcgaggtcgacgcgaacggcaccacgcacgcatacctcgggcagagttacggcgaggagacgtactggttcaccacctgcctcaccggtacccgcaccatcgatctgaccatctccggctgcctgctgaccaaaccgtag

SEQ ID NO: 1836 - DNA, 1362 bp, Actinoplanes utahensis
atgaccatgcttgccgaaatgctgctgcacgagccggccccggtggctatctgggcggccctgtggctcgccaccatcccggcgatggtggtcctcgccagccccaccggagtccgcaacccggtccaggccctcatcgacgcgggcgcgttcctgatcggccgcccgctgcgccacccccgccgccgcgaaccccccaccaacgatttcttccccggcgacccgatcccgtttctgacctccggggacccctccctcgccaccccggcagggcctgctccattcgccgactccgcggattccaccccgtccgccacagcgagcggcgccccttcgctgagctcggcggattccgccacagcgagcgccgccccttccttgagctcggcggattccgccacagcgagcgctgccccttccctgggctcggcggattccgccacagccagcgccgccccttccctgagctcggcaggctcagcgccctctgttccggtgggcctcgcctccaccttcagctccgcggaccccgccagagaagtcccggcggacgtcactccgggcttcccggccgtctccgcccctgccgcgcaggaggggacgtctttcgcggcgcggggttcttcggcgggtcgccaccacgcggcgggcctcgccggtcacgcgggggagggggacgccgggttggcgagccgggcgtcggggcggcggccactgctgcgccgcctcttccaccgcgccgcggcgcggcgggaggaacgcctccggcgggagaccgaggcggtgcggtcggtccgctacgccgaggaggtgcgggtcgcggcagagcaggccgggtacgccgcggaccgctggcaggagcactgggaggcgaccgccgcgcgggtcgacgcggcgttccgtgcctggcaggcggccgacgcgcggctccagcgcagccggacggcgatcgcctacggcacgccggccacggagcagagcccggccgagtatgtcgaccgcgagcgtttcctgcacctggcggtccgcgccgccgcggagcgtggcgaactgccgaccagcgccgtcgccgacgccctgaccggccgtggcggatgggacgcccgcctgcacccggtcgaccaggagctggtcatccagcgtgccgcggcgacccacctggaggctgtctggaagcgtgccgccgccgccgagaaactggcctggcgcgacgcccagaccgcccgccgcaactggcagagcctctgccaggagacgatcctcgcggctgcccacgccaccgcggttcaccacctgctgcccaccgagccgatcatcatcccggccaccacccacccggccccggtcgcccgcgtcgcctga

SEQ ID NO: 1837 - DNA, 258 bp, Actinoplanes utahensis
gtgccggcgaccggatgggtgctggccgcgaagaaggccaggaccagcgcgaacagtgcgggcaacgaccggagcaccgaactgcggtgcgcggtcgtggtcatgactgtcaaggtatccgcccgtttcggccggccgggggaggcggcgcgccgcaccgccgggttcacccgcaggtggcgaggccgcgagtcagaagcacacaaagtgggggagagccggaagtggggagaccgggaatggggagaccgcgagtga

SEQ ID NO: 1838 - DNA, 1821 bp, Actinoplanes utahensis
atgcggatacgggccggtgccgccgatcctgtgctggtcggtctgctggtgctgggtgtgctgctgtttcccctgttcctcaccgggctgggcggggatcgcgcgtcgtggaccgtgcagaccgcgatcgacctggccgatgtgctgttcgcctggcggctggcccggcaccccgatgtcccaccggtcggccgccgtttctggcgggctctggtcgtcgcctgcgccgcctgcaccgccggcgacagctttcagacgatgctggcgtacgcgggatccggcgcccagatcagcatggtgcagacgattctcgtggtggccggcatggcgatcgtggtggtcgccatgctgcgccatccgctgggcggggagggccggcagcgactgcggttgtggctggacgccgccacggtgctcaccggggtggccgtcttcctctggtactacctgctcgccgacgagtggagcggcccgcaggagatgcaccgctggggtgccgcggcgaccgccggggtgatgttgctgatcgcgtttggcgtgctgaagatgctgttcagcggcacggcgccgttttcccggacggcggggctgctcgggtgtgtggggctggccggcacggggccgggcgcggcgctggccggggtgctggccggcggcgagatggatcccggggtgatgtatctggtgcagctgctgccctgcctgatcatggcggtggcgttgcggctgcagctggtgcagagccggccggtggatccggcgcgcgcccggcgggtggcgcagcgaccgagtgtgctgccgtacgtcgcggtgatcgcgactcaggtgctggtcgtctcggcgctgcggggtggccggcccgggctgggcacatggggtgtggcgatcggcgcggtggtgatcacggcgctggtgctggcccggcagttgtccgcggtgcgggacaacgaacggctgctcatcgagctggatcagcagcgggagtggttccgggcgctggtgcagcacacgtcggacctgacgctggtggtgaagcgggacggcaccgtgcagtacgccagtcaggccgcggaccgggtgctcggactgagcccggcggagctggtcggcacgtcgctgcacgatcgcacgcacccggacgaccgcgcggcggtggatcggctggacgagcaccagagtgcgcatccgggggagagtgtggctttccaggtgcgctggcggcatgccgacggcacgtaccgctggctggatctgatcagcaccgacctgtatcacaatccgcatgtgggtgccgtggtgctcaatgcccgggatgcgaccgagacccgggcgctgcacgacgagctgcagcggcaggcgacgcacgacgcgctgaccgggctggcgaaccgggtgttgctgcagcggcggatcgacgaggcggcgggcgacgacccgtacgagacgagcatgctcttgatcgatctcgatggtttcaaggcgatcaacgaccggcacgggcatcacgccggggaccgggtgctggtgctggtcgccgagcggctgaccgcgctgctcgggcccggcgaggtggcggcccgcctgggtggcgacgagttcgcggtgctgctgcccggaaccggggcggcggaggcggcggcgctcgccgagcggatcaccgcggtggccgccgaacccatgttgatcaatgggcggtggctgtcggtgggcgccagcgtgggggtggcgtccgggcgggccggcgagggcgaccggctgctgcgcgaggcggatgcggagatgtaccggcgcaagcacgaccgtagggccgcgatcggctga

SEQ ID NO: 1839 - DNA, 564 bp, Actinoplanes utahensis
atggggaacggattcatcgaagccgcgctgagcttcccgaccgttctcctgactccgttgctgatcctcgtgatcggctactggatcgtggtgatcgtgggcggcgccggtccggacgccgggcacgatcacggcgggctgctcggcgtgccgctgccggtgtccgtctcgctgctggtggcgctcgcctggttcggcacgctggccggcagccagtggcccggaccggtgccacccggggtgatcccgccggtcgcgctggtcgcggccgcgctggtcacccggctgatcgcgatcccgttgcgccggctgctgccggacggcccggacgcctcgcgcgccgatttcgtcggccgcacctgcgtgatccggaccggccgggtcaccggcacgttcggccaggccgaggtgcacgccgaggacggctcctcggccatcatccaggtccggcagaccggcgtggacgcgttgcccgccggcacggtcgccctcatctacgacgtcgacccggagggcgagttcttctgggtcgttcccgccgacatcgccaggaaaggcctttga

SEQ ID NO: 1840 - DNA, 1923 bp, Actinoplanes utahensis
atggatgtggtgtccaccggtttcggtgtgcttctcgccgtggtcgtgctcatcgcgatcggcgtgctgttcttcctcagccggatgttccggaaggtggagcagggcaaggctctgatcgtctcgaaggtgcgccgggtggacgtcaccttcaccggcgcggtggtgcttcccgtgctgcacaaggccgaggtgatggacatctcggtgaagacgatcgagatctcgcgcaccggccgcgagggcctgatctgccgggacaacatccgggccgacatccggatcaccttcttcgtgcgggtcaacaagaccaccgaggacgtgatcaaggtggcgcaggcgatcggcaccagccgggccagcaacgaggcgacgctgcaggagctgttcaacgcgaagttctcggaggcgctcaagacggtcggcaagcagctcgacttcgtcgatctgtacaccaagcgcaacgacttccgggatcagatcatcgaggtgatcggcaccgatctgaacggctacagcctggaggacgcggcgatcgacttcctggagcagacgccgctgggctcgctggatccgaagaacatcctggacgcccagggcatccggaagatcaccgagctgaccgcgatcgaggcggtgctcaccaacgacttccggcgcaacgaggagaaggagatcacccggcaggacgtggacgcccgggaggcgatcctcgaactggagcgccgcaaggcggacgcggagatcaagcagcgccgcgagatcgagaccatccgggcccgcgaggaggccgagatcgcgctggcccgggccgaggagacgctgcgctcggaggccgcccgcctcaagaccgagcagcagctcggagtgcaggcggagaacaagaaccgggagatcgcggtcgccgagaagaaccgcgagcgggtgatcgcgatcgagaccgagcggatcgagaaggaccggatgctcgaggtgatcggccggcagcgggagaccgagctgtccacgatcgccaaggactccgaggtcgagaccgagaaacgggcgatggccgaggtgatccgggagcggatcgcggtggagcggacggtcgccgagcaggaggagaacatcaagcgcctgcgggtggtcgaggaggccgagcggacccggcaggcggtcgtcatcaacgccgaggccgaggcgcaggaggcgctggtcaaggacatcaaggcggccgaggccgcggaggccgcggcccggttcaaagcgcgcgagcagctgctgctggccgaggcgaagcagcaggccgccgagctggaggcgcaagccgcgatccggctggccgagggcaagcaggccgaggcggccgcgttcggcctggccgaggtgcgggtccgggagcgcaacgcggaggcgatcgagaagaccggccgggccgaggcgatcgtggagcgggagaaggcactggtcgccgccgaggcgatcaaggagaagctgaagggcgaggcggagggcctggagcagaaggcgtccgcgatggccacgctcgacgaggtcacccgggcgcacgaggagtaccggctgcggctggagatggagaaggagatccggctggccggcatccacgtgcaccgggagatcgccgaggcgcaggcccgggtggtcgcggccgggctggagaaggcggacatcgacatcgtcggcggcgactcggtcttcttcgacaagctgatcggctcgatcacgctgggcaagagcatcgacggtttcgtcgagcacagctcggtggcgcaggcggtcggcgcccgctacctcaacggcgacggtgacctcgccgaggacctgcgcaaggtcgtcggtgcggtgtccaccgcggatgtcgccaacctgagcgtcgcggccgcggtggccaactccgtcacgaaggacaagtctgagtga

SEQ ID NO: 1841 - DNA, 1506 bp, Actinoplanes utahensis
gtgaccatcgacgcgggcacgtacgaggtgctccggggccggctcgacgccaaggcgcgcgagctggccgggcgggccgagacgctgaacgcccggcggatcgaggccttcggcgcccagcagaccgaactgctgggcaccgagcggatccgcaccggcaacaacgcggtgccggccgacgtcgcgccggccggggaggtgctgctgttcggcgccaacgcgttcctcgggatgaaggccgagaccgcggtggacgacgtgttcaccgtggtcgaccggaagttccagccggccgcggcgccggggctgctggacgatccggggttccgccgtgacttcgccgagctgtaccggtactaccgggggacccggctgcggcagctgcgccgggtcgagggccagctgctggcgatcttccagaccggggcccgggccggcgacctcaaggtgctgcgctggcagatcggcgtggacggcacggtcgcgtatcaggacgcgcgcggcgagcgggaccacgtgctgccgcccacgcacgacttcgagtggacggtcaccagccgcgagcagcacgtgctcggccggcacccgcacgtgtcgatcgaggacgaggtgttcgtcgagacggtcggcggcgacctgaccgtcaaggtggaggacaacaccgaggacggcgcgggcgtctactcggagccggtggaccagccgctgcagagcctggcggacgcggagatcgcgtacgcccgggtcgggccgttgatccttctccgggtgctgccgtatcaggagacggcgtaccgctacctggtcttcaacacccgcacccgggatgtacgccgcctggacgggatcgggcaggcgtgccgccggctgccggaggaccagggcgtcatcttccccggcgggtactacctggtgaccggggcggccaagacattcgaccgggacaccgccgggctggcgttcgagcgggtggtccggtcggtcaacggcgaggacgtgctgcacgtcttccacgacgccgattccgggcggtatctgctgctgccgtacaacgtgatcggcaagcaggtggcgacgccgatcaccgggcacggctacgcgatcttcgacgacggcaccctggtggtgctccgctcccccggcgacgaaccggcccgggtccacccggtgcaggtctggcgcacgccgtacgtctcggacgcgcacgccgcggcccagccggccgggaccgggccgctggcccggatcggcaacgccgacctggtccggggaatcgccgacgcgctcaccgtgagccggatggtcggcgagatgtcggcggccgggccggtcttcgaggcgatcatcgcggcctgcacccggaccttcgacacctatcactggctggccgacccggagctggagaatctggccgagccgctggccgaggtgcgcgccgcggccacccgggtgctcgacgagttcgccgcggtgcaggcgctgaccgcgcaggccgagcctagctag

SEQ ID NO: 1842 - DNA, 3270 bp, Actinoplanes utahensis
atgcggtacgccgacggcgcgcggctggatgccatcgacgcgtcgctggtcaccgcgaccgacgacaccgcccggcgcgcggtcgagttcctgcgccaccccgacgcgttcgccgactaccaggcgagcgtcgaggagctggccgggcaggccgcggcgatcggcacggtggccgagggcgagccggtcgccggccggatcaccgagcagtccgacgggctgcaggtggtcaccgaggtggtcggcggtctggagatcgccgacgccaccgtgcgggtgtccattctggaccggatcggcgcggtgctgggcgggctcaaccgcgcccgcgccacggtggacgcccggcgccgggagctggccgcggtcgagggccgggccgcgttcgccgccgagttcgcgctgttcggccagtcggtctccgccgcgctcgccgccgccgacaccccggagcactgcgacgagcacctggcccggctgatggcccaggtggagacgctggagagccggttcggcgaggtcgacgacttcggcgagcggctggccacccgacgcgccgaggtgtacgaggcgatcgccggacgccggcagtcgctgctcgacgagcgggcccgccgcgccgaccggctggccggctcggcccggcggatcctggacgcgatccaccgccggatcgccacgctgggcgatccggacgaggtgaacacgtacttcgccaccgatcccatggtggccaaggtccgctcggtcgccgaccggctgcgggccgacggcgacccggtccgcgccgaggaactggacgggcggctcacggcggcgcggcaggaggccgggcgggcgctgcgggaccggcgggagctgttcggcgacggcgggatccggctgggacggcacaccttcgcggtcaacgggcaggccatcgacctcacgctggtgccgcacgacggcgggctggcctacgcgatcaccggcaccgactaccgcgcgccggtcaccgacgaggcgttccagcagacccgggatttctgggaccagccgctgatctccgagtatcgccgcctgtaccgggcggagcacctggccgcggcgattctcgccgaagaaccccgggctgcggccaccgcacaggccgagggccggttgcgggagctggtgcaccggatcgccgattcgcggtacgacgaggggtacgagcggggcgtgcacgacgccgacgccacggtgatcctcgacgcgttgctgcggatgcacacgaccgccggcctgctccgctacccgccccggatccgggtcgccgcccagttgttctgggcctacggcgccaccgccgggcagcgtcaggcctggcagctgcgcgccgcgtcgctgatccgggtccgggccatgttcggctccgccggccgggccctcgacgacctccgggccgaactgaccgacgccgccaccgatcacctgggtacggccggcctgtcggcggcgggcgtggcgaccggggacgcggagatcggcgagtatctggtcgacgagctggccggcaccccggccgggttcgtcaccggcgccggtgcccgcgccttcctggaccgcttccaccgcgagctgggcggtgcggagtccgcgccggcccggcagtacgccgaggacctgcgcgccctggccggcgagccggccgtccggcaccagctggtgtacgcctggctggaagccttccatcgggcccggccggactccggcgacctgaacgacatgctggaggcggtgggcatcgaggtcgtcggcaccggactgacccggtacgacgtggccgcgacggtccgcgagacggtcaccgggctgctcggcgtgcacccgcggatcaaggacgggcagctgacggtacgcctcgacgcgctgctgtcccgggcccggcacttccgggagaagcggatgccggcctaccgcgactaccagagccggcgggcggcgctcgcgaaggccgaacgggcccggctgcgactggacgagttcaagccgcgggtgatgaccaccttcgtgcgcaaccggctgctcgacgacgtctatctgccgctgatcggggacaacctggcgcgtcagctcgggacggccggggcggaacggcgtaccgaccgatcggggctgttgatgttgatctccccgcccggttacggcaagacgaccctgatggagtacgtggcggatcgcctcggcctggtcttcgtcaaggtcaacgggccggcgctggggcacggcgtcacctcgctggacccggccgacgcgccggacgccaccgcccgccaggaggtggagaagatctcgctggccctggagatgggcaccaacgtgctgctgcacctcgacgacatccagcacaccagcccggagctgctgcagaagttcatctcgctgtgcgacgcgcaacgccgcatggagggggtctggaacggccggacccggacgtacgacctgcgtggcaaacggttcgcggtgtgcatggcgggcaacccgtacaccgagagcggccgtcgtttccgggtgccggacatgctggccaaccgggccgacgtgtggaacctgggtgacgtgctggccggccgggaggacctgttcgcactgtcctatctggagaacgcgctgaccgcgaacaccgtgctggccccgctggccgctcgggacggcgccgacctgccgctgctgctgcggctggccgagggcgacgagacggcccgggcggaccggctggcgtacccgtactccgccgccgaactggagcagatcctggcggtgctgcggatgatgcgccgggcgcagcgggtggtgctgcgggtcaaccaggcctacctggcctcggcgtcgcaggccgaagccggccgcaccgagccgccgttccggctgcagggttcctaccgcaacatgaacaagctggccgagcggatcgtgccggcgatgaacgacgacgaactggagcaggtgatcgacgactactatctgggcgaggcgcagaccctcaccggcggcgccgaggccaacctgctcaagctcgccgagctccgcggccggctggctccggcgagagccgcacgctgggccgaggtcaaggccgcgtaccggcgggagcagacgctcggcggggccgaggccgacccggtgacgcgggctgccggggcggtcgcgctggtcgcggaccgcgtggccggggtggaggaggcgatccggctcaggacacgggcagctgcgtggacagctgagcggcctgaccggccagcgcggtga

SEQ ID NO: 1843 - DNA, 621 bp, Actinoplanes utahensis
atgatgtcgcgcgtgtccgacatgtatgagccgcgcccgtccgcgccggactggcagacccgggtgctgccgacggtgccgacgatcgacgagcgggaggcggtggccaggcgccgccgcctgatcgtgctcggctcggccggggccttcctggcgctggccatcggttactgggcgctgtcgggtccgggcgacgacaagtcggccccggcggccgccccggcgacctcggcccaggtgctgcagaccaccagcatcgagccgctgatcgagtcgagcaccgggccgtcgccgaagccgagcagcgcccggcccagcagccggccgccggccgtctcggccgctcagctcacccgggtgctgcagcagatgcggggcgaggtgttcgtcctgttccgcagccgtcagctggagcgcgacgacgcccgggcgttgaacacccggctccgcaagatcgccgaggagctccgcaaggacgatcgggagggcgccggcaaacagctgaagtcgttcgccaagaagctcgccgacctgcacgacgacggcaagatcagcgacgccggcttcaccgcgctggccggtcaggccgctcagctgtccacgcagctgcccgtgtcctga

SEQ ID NO: 1844 - DNA, 978 bp, Actinoplanes utahensis
atggcgcccggtgtcgccgccgcgatctcgcagcacatgctggccgtcgacccgcccgaccacacccggctgcgccgcctggtctcggccgcgttcaccgcccgccggatcgaggcgctgcgcccgcggatcgagcggatcaccgccgatctgctggacgcgctgtccggccgggacgaggccgacctgatcgacgcgttcgccttcccgctgccgatccaggtgatctgcgagctgctcgggctgccggccgaggaccgtgacgagttccgcgagtggtcggacacggtggtcgccggttcgcaggccgggccgcggctggcgccggccctggaggcgatggtcggctacatccgcgacctgctcgcggtgcgccgccgcacccccggcgacgacctgctctccggtctgatccaggtccgcgacgcggacgaccggctcaccgaggacgagctctgctcgatggtgttcctgctgctgatcgccggccacgagaccaccgtcaacctgatcggcaacgggacgtacgtgctgctgcgcgaccgtgccgggtgggagcggctgcgggccgaccgctcgctgctgccgtccgcgatcgaggagttcctccggttcgagggccccctgcagaccgccacgttccggatcgccgtggcggacgtggagatcggcggggtcaccatcccggccggcgacccggtgatcgtcggcctgctctcggcgaaccgggacggcgagcggttcccggcggcggccgaactgcacctggaccgcgtgcagagccccgctcacctggccttcgggcacggcatccactactgcctgggcgcgccgctggcccggctggaggcgcaggtggcgttcaccgccctgctcgaccggctgcccggcctgcggctggccgtcccggccgaggcgctgcggtggcggcccggcctgctgatccgcggtctggagacgctgcccgtccgctggtga

SEQ ID NO: 1845 - DNA, 285 bp, Actinoplanes utahensis
gtggagcgctgccacccacgggtggagatcggggtggatccgacctatggtcgggctatgacgcaggagatcgccgatctgggcgacgcggttttccaggccgacccgcacccggtgtacgagcggtggcgcacgagcggcccggtccgtcaggtgcggatgccgtccggtctgaccgtctggctgatcacccgctacgaggacgcccgacgcgcgctggccgatccgcggctgtccaagcgggccaccccgatgccggccgggcaggcggcgctagctagctag

SEQ ID NO: 1846 - DNA, 504 bp, Actinoplanes utahensis
atggaaatcctcaccccgctcctggtcatcgccgctctcgcctacgccatggtccgccgttacctgggcgagccgctcaccgcgcgccgcctggtcgtactgccgctggcgctcaccgtctacggcggtttcatggtcgcccaggccggcctcacccacgtccgggccgacgtggtcgcgctggccgtcggcggcgtgctcgccgtcgccggcggtgcgctgcgcggcgccacggtgcgggtcatggtccgggacgggcacctgtggtaccgctacacgtgggtcaccctgaccgtctggatcggcctgatcgtgctgcgcctcgtccaggccacggtcgccggcaccctgggcgccgaccgtccggtgctggccgcctcgctggtgctcgccctcggcctgagcttcctcggcgaggccgcggtggtcgggccccgggcgatggcggtcggcgcgccgttcgcgccgcgccggtcccggcgccgggtcgccgccggccgctga

SEQ ID NO: 1847 - DNA, 1089 bp, Actinoplanes utahensis
gtgaacaccgccgatcgcacccggctgccggagctctggcgccgggcccgcaatctgctggtcctgatcgccgtcaccgtggtgatggtgcaggaccacgcgccctggccgctcgtggtcatcggcggcctgggctgggcgctgctgacgctgcgcgtcctgccaccccggccgcacctggtcgcggtctgcgtgacgctggcctccggactggcgctgaccgcgctcggcgcccgcggtgtcgccccggtctatctggtcgtcgcgctggccggcagcgccgccgtgctcgacctgatcaccaccggcgtgctggccggcatcgggctgctggccctggccgcgacgctggccacgcaccacgccgacctctcctcgatcgcggtctggtgcggggtgctgatcgcggtgaccctgctggtcctgctccgccgccagcgggaggcgagcgccgagcaggagcggttgctcgccgacgagcaggcgctggccgcgatgctggccgagcgggcccggctggcccgggagatccacgacgtgctggcccactcgctgtccgccctgtcggtgcagctggagacggccgcggcgctgctggagcgggaccggacgacggaggcggcggcgctgatcgaccgggccgggacgctggcccgcgacgggctgaccgagacccggcgggcggtcagcgcgctgcgcggcgatccgctgccggtgcccgaactggtcgccgagctgaccgcgggctatgcgcgggacctgggcgcgccggccaccttcacggtcggcggggagccgcgcgagctcgacccggagaccgggctggcgctgttccgggccgcgcaggaggcgctgagcaacgtccgcaagcacgcgccgggcagcgccgtcgacgcgcacctggcgttcgaggcgggcgccgtcgcgctgcgggtgcgcaaccacggcccggccggccccccggtcaccggactgtccagcggctacgggctgatcggcctgcgggagcgtgccgagatggccggcggcagcgtcacggtcgggccggacagcgacgggtggctggtggatgtcaggatgccggggtga

SEQ ID NO: 1848 - DNA, 666 bp, Actinoplanes utahensis
gtgagcatccgcgtggtggtggccgacgatcagaccgcggtccgcgaggggctctcgctgatgctgagcctgctcgacgacatcgaggtggtcggcgaggcggccgacggtgagcaggctctggagctcgtcggccgggagcggcccgacgtggcgctgatggacctgcggatgccgcgacgcgacggggtctcgacgaccgcgatgatccgcgagcagttcccggagacgcgggtggtggtactgaccacgttcgccgacgacgagcacatcctcggggcgctgcgggccggcgcggtgggctatctgaccaaggacgccggccgggtgcagatcgcccaggcggtgcgggccgcggcgatcgggcagggggtgctcgatccgcaggtgcagcagcgcctgctcgcggccgcgaccgggggcgccgcggcggccgggggcacggcggcacgggcggagcgggagctgccggacgggttgaccgcgcgcgaggcggaggtgctccggctgatcgccgccggactgtccaacaaggagatcgcgaagcggctgttcgtcaccgaggtgacggtgaagtcccatgtgaaccggctcttcgcgaaggcgggggtgcgggaccgggcgcaggccgtgcggtatgcgtatcagcacggcctgagcgcctga

SEQ ID NO: 1849 - DNA, 624 bp, Actinoplanes utahensis
atggcctgcgtcctgctgatctcgggtagcactcgcgagggttccgtgcacaccgccgcgctgcgcaccgcggcccggttcgccccggcggagatcgacgcccgactctattcgggactcgccgcgctacccgccttcctgccgggtgacccggcgccgccggcgtcggtcgtggacctgcgccgccaggtcgccgccgccgacgcggtgatgatcagcaccccggagtacgccggtgccctgcccggcagcctgaagaacctgttcgactggctggtcgacggcggcgacctgaccggcaagccggccgcctggctgtcggtggtcgcgcccggtcaggacgagggcgcccgggccggtctggagtcggtgctggagcacggcggcgcgcggctgctgcgggccggctgcgtgcgggtcccgctggacgtccgggccgtcgacgagcgggggctggtcgacgacccgttgctgcaccgggcggtgcaggacgtggtgcaggcactgatccggtcgctggccgggccccgcccgcagccgtcctggcaggtgcactcgagcgtgtatccggtgatcacccggaacgacgcgccgagcttcgtccgccggccggacttccgctga

SEQ ID NO: 1850 - DNA, 1824 bp, Actinoplanes utahensis
ttgggcatcgtgaggcgccgcccgtaccaccttccgttgatcctgctcgtgctcgtgaccacgtcctgctcggtgccccaccccgcgccgcgtccggccccgcggccgggcctgcccgccgcccagatccgggtcgaccaggccggctgggccaccggcgagtccaaggtggccacgctgctggcgccggccgacgcggccggcgcgcgggccaccgtggtcgacgccgccggccggaccgtgctgaccgtcgccgccgggcgcagccgaggtcactggaacgaccatttcgccgcgaccaacccgctggacctcaccgccctgcgcaccccgggcacctatcggatccgtctcgacgaccactaccacgcggagtcgccgccgttccggatcggcgcggccgccgacctgtacacgccgctggtggccgacacggtccgctacttccaggcccaccgggacggcgccgaccaggttcccggcccgtggcagcggacacccgcacacctcgacgaccggaacgccaccgtctacgccaccccggagcccgacgacagcgtgctcgcctcgaccggcgccacccttgacgtctccggtggctggtacgacgccggcgactacctgaaattcgcccacaccaccgcgtacgcgctgatcctcatgcagctcgtgcagcgcgacggcccggcgccggcggccctgcccgacgagatccggcacggcctggactggctgacccggatgtaccgcgacggcgtcctctacacccaggtcggggtggccggcaacgatcactacctgggtgaccacgacatctggcggctcccgcaggccgacgacgacctgtccgtgcaacccggcgaccgcgcgtactaccagcggtaccgcccggtgttccgggccgccgcaccgggcgagccgatcagccccaacctggccggccgggtgaccgccgccttcgcgctggccgcccagctgtcggccgccaacgacccggcccgcgccaggttctacctggatctggcggccacgctgttcggccaggccgccaccgcacccaccggcgacctggtcaccacggtgccgcgcgacttctacccggaggagagttacgaggacgacctggccctgggcgccaccgaactggccctggccggcaaggcgctgggcgatccgcggaccgccggctggaccgggcaggcccggcactgggccgacgcgaccggcggcggtgacgacggcctgaccgtgtacgacgtcgacgcgctcgccgacgccgagctgtaccgcctggccccggccgcgccactcgtcgccgacctgcgcgaccggctggccggggcggtcaaggcggccggccgggacccgatggacgccaccaccggggcgggcggcgccgactacgcggcccggcaactgggctgggccgcgaccgccgccctctaccagcgggcgaccggcgacacccgctacgcggcgttcggcaccgcgcagcgcgacgtcgcgctgggcgccaacggctggggagtgtccatggtgatcggtgccggcgcccggtatccacagtgtccgcacgatcagatcgggacgatcacccacgcggcgctgaccggggcggtggtcaacgggccgaacgtggccgggcgggtcgagtcgctggagagcgaggacgactcgatgtgcacggccgggtcgtattcggcgttcaaccgggacgacgcgcagtacgccgacgacatgcgggtgtcggcgaccaacgagccgtccctcgacttcaccgcgaccgggatgctggccttcgccctgaccgcccggccccgttga

SEQ ID NO: 1851 - DNA, 225 bp, Actinoplanes utahensis
atggtgctgtccgagcgcaccgcagggtacgacgacccgggcgaaccgggccggatgatcgagtacaccgccgcgatgtgcggcgagacactgaccggcgcggcccgacccggcgccggccccgacgacttctgcagccgggtggcggtgacctgcggcccggcccccgcaacggaagaagggccctcacgaggagggcccttcccggtgttgtgcgccgcgtag

SEQ ID NO: 1852 - DNA, 1272 bp, Actinoplanes utahensis
atgcgtcaggatggctgcgccgagaactccagaacggggaccgagatggtcgacctccgccgctgtgtggcgacactgctggcactgtccgtgaccgtgccgctggccgcgtgcggcaagggcgacaagcccgcgccggccgccgcggcgagcgtcgcgccgggggccgccgcgatcccggagagcgccaccacggcggccccggtcacgctgacggtcagcccggccgccgggcagaaggacctgccgaccagcaccgagatcgggctcaaggtgggcaacggcacggtcacctcggtccggctcaccgacgccgagggcggcacggtcgccggcgccctgcgccccgacggctcctcctgggtgccggccaggacgctgaagaacaggcaggcctacaccgccgaggtcaccgcgaccggcacggacggcaccaccaccacggcgaagaccagcttcaccacgatggcggccggcggccggcacaccggcaccgggctctacctgttcgacaagcagacgtacggcgtggccatgccggtcgtcgtcgaattcagccccggcatcaggaaggccgaccgggccgccgtgcagaaccggatgttcgtcgagaccaccccgtcccagccgggcacctggtcgtggacgtcgagcggcaccgcggcgtactaccgcgccccgcagtactggcagaccggcacccggctcaaggtccggatcgcggtcggcggtctgcccacgggcaagggcctccacggcgaccgggaccggtcggccacctcgacgatcgggcgcaagctcgagatgaaggtggagaacgccagcaagaagatgaccgtgctgcaggacggcaaggtggtccgcacgatgccggtgagcctcggcaagaagagcacgccgtcgtccagcgggcacatggtgatcatggacaagatggcgcagaccgtcttcgacaccaccgacaccgacccgaccggcggttaccgggtcaacatccagtacgcgcagcggctcacctggagcgggcagtacatccactccgccccgtggtcgacctacgcccaaggtcaccagaacgtgtcccacggatgtgtcaacgtgtcgccctcgaacgcccggtggctgttcgacaagacgctgatcggcgacccggtcacggtgcagggcaccggcgaccggctggactacggcaacggctggacaccgtgggacgtgagctgggagaagttcgccgcgggcagcgccctgccggtgcccgccgggctcggctga

SEQ ID NO: 1853 - DNA, 1236 bp, Actinoplanes utahensis
atgacaccagttcggtcggcgggcagtggccgccgccagatgcgcgtgacactcgtcgcgctgctggcgggcagcctgctgttcaccgcggcatgcagcggcggcaagtcgccgagctggcagggcggcagcagcgggggcggcaccaccgagtccgggacggcgccgtcggcccagccgacgctgagcaccgtggcggtcacctcgccgcaatccgcggcgaccggcgtcgaggcctggtccgacgtcaagtacaccagcgaggacccggagaacaccacggtcaaggtgaccgacgccgacggctccgaggtcaagggcaccgtcgacaaggacgccaaggtgtggcacccggccgagtcgatggactggggcaagcagtacacggtgaccgtcagcaccccggccgcacagggcaagggcaaccagaccaccagcaacttcacgatcatgaagcagccggccaacctggtgcgggtcaccagcttcctcggcgaccaccagaccgtgggcgtcggcatgccgctgatcgtcaagttcggccgggccatcccgcagagctaccgcgccacggtcgagcgcaacatgaaggtcaccgccacccccgcacaggagggcacctggcgctggatcagccccaccgaggtgcacttccgtccgcagacgtactggaaggccaactcgaaggtcttctacaaggtcgcgctcaagggcgtcaagatgggcgacgggtggtacggccgctccgacatgacggtggacatcaacatcggccgctcgctgatcatgacggtctccaacaagaccaagaagatgacggtcacccaggacggcaaggtcatcaagaccctcccggtcagcctcggcaaggccgccaccccgtcgtccagcggcaccatggtggtgatcgagaagaaggagcacaccgtcttcgacaccaccgacaccgacccgaccgggggctacaagaccaacatcgacttcgctcagcggatcacctggagcggccagttcatccacgccgccccgtggtccgagggcgtccagggcaagcgcaacgtctcgcacggctgcgtcaacgtctccgaggcgatgggcgcgtggctcttcaagcagaccatgatgggcgacgtgatcacggtctccggcaccgaggagaagctgaagaacggcaacggctggaccgactggaacatgagctacgccgaatacaagaagggcagcgccctctcctga

SEQ ID NO: 1854 - DNA, 588 bp, Actinoplanes utahensis
atggcggcgtacgccgtgaagcgacccgccgcgcgcggtccggcaccgcccgggcggcgtgtcacccccggtgatcgcgttccgcggacgccgtgtggcgacggtcgtaacgtcctgggcatgcacatccgcccgatccaccagggtgacgcgccccggctggcggtcctgctcgaacagctcggctatccgtcgaccgagaaggacgtccgccaccggctcggctactggctcgacgaccgggccagccacctgctcggcgccgacgacgacggcgtcctggccggggtcgcggccctgcacgtcaccccgatcatcgaggtgaccgggaagttcgcccgcctggtcgccatcgtggtggacgccgacagccggcatcgcggtgccgggcgcgccctgatggccgccgcggagcagcgcgcccgggcggccggctgcctgttcatggaggtgaccagcgaccgggagcggctgcccgcccaccgcttctacgagagcctcggctacaccgacacgcacgagagctcgcgccgcttcatccgccgcctcaccccggccgatccggcgcgttccaccaccctcgattga

SEQ ID NO: 1855 - DNA, 528 bp, Actinoplanes utahensis
atggttgccctcatcgtcacctgcgagatcggattctggatcttcctgcttgccggactggcagtccggtatctgctgcgccgtcgccggaccggcgccgcgctgctgctcggggcgcccctgctggacgtcgtgctgctcggggccgcggccgtcgacctgcggcggggcggggtgcccgacttcgcgcacggactcgccgcgatctacctcggcatcacggtcgttttcggccacgagatggtgcgctgggccgacacccggttcgcgcaccggttcgccggtggtcccgcgccggtcccgccgccgcgcaccggccgggcgcacgcggcccgggaacgccgccagtggctgcggcaccttctggcctatgcgatcagcgccgccctgctggccgccttcaccccgctggccggcggcttcgaccgcgccgcgccgctctggcaggcgatgggcccctggaccctgatcctgctgatcgacatggtcatctccctgagctacaccctggccccgcgccggccctga

SEQ ID NO: 1856 - DNA, 372 bp, Actinoplanes utahensis
gtgttgttgatcctggtggccggggtcgccggatgctccgatcagcggcagcccggcgcgccgggctcgcccgccgccgcgagcccatcggtcgccgacgatccgccgggacggctcacctgtcagaatctggccgcggccgtccgatcggcgtccctgatggaccccggcgtggtggaccggatcgtggcggccagcggcagcgcggacgccccggtcgcggacgcggcgaccgcactgggcgaggcctaccggaacgcgcgggcctcgcacggcacaccgaacgagccggacgcgatcgccgcggtcagcgccgcggccgccgacatgtctcaggtctgcgcggacagcggactggactccgccgactga

SEQ ID NO: 1857 - DNA, 783 bp, Actinoplanes utahensis
atggctgatctggcggagatcctgcgccgggaggccgaccggcacgtgccggacggcgacgcgatgttcgaccggatcgaccggggccggttcgcgccggagccggtccgggcgccgcgccctttcctccgccgcttcgcgggcctgcgtccggtcgccgcggccgcctcggtggtcgccaccctggtcgccggcttcaccgggatcaagctgctgaccgctgaggaaccggaccgcgcgccggccgccaccaccaccaccacgacggcgtcgccggcatcgtcgccgtcgccgtcaccggcggttcccggcacgtcctcgccggccgcgaaggcgaagagtccggccggccgcggtcaggtgacgtcggcgccgcccagcttccagccggtgaacgggttcctcacctcccgcggagtgatcgacgtgtactcgacggacgactgggcgcagagcgacgtgacggtggcgagcaccaaggtgatcaccgcgctggacctggcgatcagcgtggcccgcaccgacggggtgatcagtaccggtagctggagcaccatcccggccgcgatgatcacgatgagcgtcaccgaggagaaggcggcggtgatctaccggttcatcctgaagccgggcgggacgctggcggcgggcagctacgtgttcgcggcgcagtatcagcacgcggccgggaagcggcagccgggcgcggatctgtatggggggatcgtcgcggcgggggaccggaaggcggaggtcaccgggggtttcccggcgggcggctga

SEQ ID NO: 1858 - DNA, 666 bp, Actinoplanes utahensis
atggctcgacaagaccaagtatctgtccagcgtgcaggccggaaccgaggtgttcaccggctcggggcggctcgacaccagcgcgtactcggtgaagatcagctaacccggtcggcctgcgggccctcgacggtcaggaagagccgcgtgccggagacggacgacgaaggcgccttccggcgtttcttcgacgagcaccacgccgatctgtcgcgtctcgcctatctcgtcaccggcgagacgcaggtcgccgacgacctggcgtccgacgcgttcgtcgaggtgtggcggcactgggcgcgggtgtgcgcggcggacagcccgatcgcgtacgcccgcggcatcgtcaccaacctggcccggcagtggatccggaagcagacccgggaccgcgccggcctgttgcggctcggtctgttgcgccgcgaccgcggcgaaaccgacactcccgcgatcctcgacgtgcgcgcggccctgcggcgacttccgctgcggcggcgcgagtgcgtcattctgcggtacgcgttcgacgtgccggagaaggaggtcgccgccatcctcggcatctcgctcggcgccgtgaagagtcacacctcgcggggcgccgcccagttgagcgagttcctgcgggagatgccgctgacgaccggaggtcaccatggctga

SEQ ID NO: 1859 - DNA, 1212 bp, Actinoplanes utahensis
atgctcgtcaagcgtttcgtcgtgccactcgcggtggtggcggtcggtgccggcgccgcggttgtcggcgtgttgaacgccgatgccgcggtgaccgccgggtgcgccgtcacctacaccgtcggcagccggtggaattccggtttcaccggcgacgtggagatccgtaacaccggcgggtcggcgatcgacgggtggacgctcaggttcgctttcccgtccgggcagaggctggcttccggctggtccgggacgtggacgcagaccggtgccaccgtgacggtgaccgacgccgggtggaacaggagcatcgcggcgggggcgacggtgtcgctcggcttcaacggaaccctgggtgggccgaacgcgatccccgacgcgttcgtcgtcaacgggatgacctgcggcacgacgccggccgctacaaagacggcaacagcggccactacaaagacggcaacagcgaccgccgcaaagaccccgacagtgaccaccacaaggacccccacagcgaccgcgcccccggtcaagaactgcaccgactacgccgccctggtccgcggcaggtactgggtcaacaacaacacctggggcagggccgacggcgccggctcccagtgcgtctgggtgaacggccgtaccggtgacaacctcagctggggcaccgactggacctggtccggcgacaccaccaaggtcaagtcctatgccggcgccgtcctcggctggcactggggctggaagaccaccggcaccggcctgccggtccggctcagtgccggcaggtccgtccggagcagctggaatttcacggtcaccccgaagacctcgaacatcatgaacgtgtcgtacgacctgtggctgcacgcgatgggcaacgccgactggcaggaccagccgaccgacgaggtgatggtctggctgtaccgcagcggcggggccggcccgatcggcacccggcaggcgaccgtgatggtcggcggcaccacctgggacctctacaagggcaacatcggctggaacgtgtactcgttcgtgcgcacctcgaacaccacctccgccgacctgagcctgaccgatttcaccactgacctggcggggcggggatggctcgacaagaccaagtatctgtccagcgtgcaggccggaaccgaggtgttcaccggctcggggcggctcgacaccagcgcgtactcggtgaagatcagctaa

SEQ ID NO: 1860 - DNA, 114 bp, Actinoplanes utahensis
gtggcgcacgtacccaccgtcgataacaccaacgggggaactaagctcagtcgcttttaccgcgacatgcgtgtctgggacaacgacccgttcttcgtccaggtcgtagactga

SEQ ID NO: 1861 - DNA, 540 bp, Actinoplanes utahensis
atgaccgacgaggacacgtcgcccaccctgcgtctggcgggcaatggggaagtctcggcgtcgaacggcttctacgagctactcgactacgaggggttcgatgacatcccgccggacgctaacgtcgacaacgggctcgtatccgtcgggtcgaccggggcgatcatcctcaccggaacaatggtcgggcctgtggcgctgcgtgtggaaattcaccacgcagcgccgcggctggacgttgccggatgggaacgggtcgtcgaggttgagcagtacaccgccagcggcatcgtgtcggtcaactccccgctcatcggtgatcccggcctgccctcgctggaaacgaccggaaacagttggtaccgcatccggattcacgcccgcggcatcgaagaagcccgggcctaccccgcgaccgtcgacagcccggtggaacaccaccttctccagctctggcccgctgttccagaaacgagcaccgaagaccacgagttccccaacccggcactacgcgaataccgagtgcttcaccctggataa

SEQ ID NO: 1862 - DNA, 114 bp, Actinoplanes utahensis
ttggacatcgccgcccacgcgttcctcgccgcagcgaccactgtcagcagcgaaactccggacggcctgatcgcggtcacggtcacgaactccgccgtctgttccacgccctga

SEQ ID NO: 1863 - DNA, 330 bp, Actinoplanes utahensis
gtgcgcatggagccgtccttgagcctgccccggcccccctgctcgcgccgttgccggtcaagaactgctggacgatcgctgaacacgccagcgacgacggcccgggtggcatgcaggacctcatcggtcgtgccagctgggacgacgcactggtccgtgcggacgtgcgggactttcgtgaccgcccggctcgggcatctcgacggcgtgctgctagtcgatgagaccggtgacctgaagaaaggcactcagaccgtcggtgtgcagcggcagtactcgggcaccgctgggaggatcgagaattgccagctcgcagtgcacctatcctaa

SEQ ID NO: 1864 - DNA, 576 bp, Actinoplanes utahensis
gtgtggatcgactgtgagatgaccggtctcgacctcggcaaggacaagttgatcgaggtcgcggcgctggtcaccgatcccgatctcaatgtgctcggcgacggtgtcgacctggtcatccacgccgacgacgcggcgctcgacgcgatgccgccggtggtgcgcgacatgcacgccaagtcggggctgaccgaggaggtgcgccgctcggtgctgaccatggcggaggccgaggagcagatcctggcgtacgtcaaggagcatgtgccgaatccccgcaccgccccgctgtgcggcaattcgatcgccaccgaccgtggcttcctggcccgggacatgcccgcgctcgacgcccacctgcactaccggatgatcgacgtctcctcgatcaaggagttgtgccgccgctggttcccgcgggtgtatttcggtcagccggccaagggcctgtcgcaccgcgcgctcgccgacatccgggagagcatccgcgagctggagtattaccgccgcaccgtcttcgtcccgccgcccggcccggacgtggagaccgccaaggcggtcgccgccgacctctga

SEQ ID NO: 1865 - DNA, 4527 bp, Actinoplanes utahensis
atgcggctgatccggccggtcctcggcatgctgcttttgacgatcggactgcccgcgctgctggccggcggatgcctgtgggccgtcctccggcaccgcgacgccggcggcgctttcagtgctgagctgcagcgactcgacgcgcccgggtacgcgatcgtggtaccggacgtcgaccggctactgcgcgacgacgcgtcgttcgcccggatcggcggcaccgaattgcgggtcaccgcgctcaccgccggcggtcccgccttcatcggcctggcgccggccgccgatgtcgacgactacctgcgtgacgttccgcacaccgaggtgagcggcgtccaggtcggcaccggcgaactgccgatcaccgccacccgggtcgacggctcgaccgggctgccgtccgcccccggtcaccagagcttctggaccagcaccggcggtggcgcgctgcgctggaccccggagacggcctccggcgactacagcctggtgatcatgaacgcgaccggcgcccgcggcctgcgcctcgacggcaccgtcgaagcccgccccggctggctcgacccggccgcctgggccctgctcaccctcggcgccatcctcctgatggccggtgtcgtggtcctggccacccccggccgccgtcgcgacatcgtctacgtcgtcgaacccagccaggtccccgacctgatgaaggcgatcggtgcgccgctgccgatgcgtgccctggaaggcggcaccaccgatggcctgaacccggccggtgcgctcgcgctgatgcggcgtggcctggtcggattcggtcacggcgacgacgccggccacgccggcctgctgcagcgcgccttcggccagcgtctccccggcagccaccgcgacagcgacaccctcaccggcgtcttcggggggccggacggggcgcaccgcccgcgcaccctggccgactcgcagccggcccggccgccggcgctgccccagttcgcctggccgccgaagaaggccggcggcacggaaggcgagcacctcccggtcacctccggattgcgcggtacgtcatcagccgcctccgcctcgcacaccgcgaccagcatccgccccaacgccctgacccccgtggtccccggcgctctgcccgtcccgtccccggcttccgcgaccgagtccgcttcggcgggttcagcgccggccgcgggccgggcggtcccctccggatcgtcggcggccccgggttccgagccgatcgccgactcggcggcttcgggtccggccgtgatggacggatcggcggccccctggggttcgatggccgacccggcctccgtggacgtcgccggggccgctgtgttcggggcgggccggagcgcgcaatccgcggcggccgctgtgttcgcggcgggccggggcgcggaatccgcggcggcccctgtgtccatgaccggtcaggacgcggaatccgcatccggaccggtgaaggcccccggcggtgcaccgggcaaccggcagcgggcggaagctccggccgccggcccgaacgcgacgggcctcgccggtgccgcggcaccggcgctcacacccggccggccgctgggccttctcggcgagacaccggcaccggccggcctgcccgccgccctgccgggcacccgccccgaccggcagagtcgccgccggaacgcggccgcggccgacctgccggaattccacgccaccgcggtcggtgcctgggtggcccagactgccccggaacgcgcccgccagaccgaggcccaggccgccgcggccctccgcgaggcagcccgccaccgcgcggcgcccgccaccggggtcacaccggcgaagcaggcggacaccgcgttccgggccgcaccatccgacgcggaacctgccgaagctgttcctgctcagccggtcgaggcgacgtcggtcgaggccgggaagcccgaagccgtgaccggcggcgctacgtcggccgcggtcgtgcagggcgcggccatgaccggcgggcttgcatcgaccgatggcatgaatgcggacgtcgcgccgatcgagggtgcgaagacccaagccgcgacgaccgaggtctcgcagcctgagggtgcgacggttgaggtctcgcagcctgagggtgcgacggttgatggcacgtcgaccagcgttgagccggctgacgtgcagtccggcgaggtggagtcggccgaggccacgcggcgcggagaagggaagcccgggcacggccgcggggcctggccggctccggctccccggcgggttgcgctgctcaccgggccgagtgctaccgactggtcggcgaccggactgacccggatgggcagcagccgtccctcgcccaagtccgccgctcacccgtcgaccgcgggatcaccctcccacgccgggttcgaacctggtcggcagtccagcgccgctcggtccactgacaccgttgacgctgccgccgacgccgctgacacgtttgacaccgccgacaccgccgtcgccgcggcgaagccgcaggccatgccgtcgcgagccgcgatgggcgctgccaagatcgccgttgcgtccggagcggtcaaggtcgcggcccccaaggacgccttggacaccaaggacgccttggacaccaaggacgccttggacaccaaggacgccttggacaccaaggacgccttggacaccaaggacgccttggacaccaaggacgccttggacaccaaggacaccgagatcgcggatgccggggacagcagggccgcccttacaggaaccgccccgaaggcggtgccggctcaagctccggccacggagcccaccgcgaaggaggccgtcaccaccggcacggccgcccccgacgaggccgctaccgcgactgccgtcacttctccggctgacgccggcccggccgcgaaccagacgccgaccactgacccggcagccggtgacacggccgcgactgaggtgtcggcttcagggacggcggtctcgcccgcatctgctgcgggagctgtcgtcgaggacgagccggaatcggtggacaccgcggcggtcgacggagagactgccgtcgaggccaccgcggcggtgaccggggatgccccggcaatcgagggcgtggtgtccgggactgagcagcggaacgcctcgggcgagccggctccggagaccgagaagcgggacgaaccgaagacgccgatcgtgccgttcccgactcggcacccgagcactcccgcccggccggtgccgtccgctcgggtcggtgagcgccggctgtcgatccacgaggcggaggccgctccggtccccgacacggaagctgttccggccgagcccgcccgccccgagaccgagaaactggtcgaggccggcggctccgcggccgtggagctggtcgagaccgacagctcacagaccgtggagctggttgaggccggcggctccgcggccgtgaatgtggtcgggaccgacagctcccaggccggggagctggtcgaggccggcggctccgcggccgtggcgaaggctgaggccggtgactccgcgggggcgaacccggtctccagcgcatcccagacggtgaaggccggcgggtcggagggggtgccgtcctccgcggcggagcggccctccctccatgccgctgaggccgggatcgatggcgaggcgtcggaggttccggggagcgccgcggagtcggaccggccgggtggcgaggcgggaccgcgggcggatgcgctggagaaggcgggtaagccggcggtgaagcgggccgagccgaagcggaccgccgagccggaccacccgctgtcccgcgcccaggatcgtttgagcggagctgccggccggcagtccgggtccgccgtcgcccggaaggtgccggccgcctggctcaaggcggcggagacggtggccgcccgcgcggcctcgcagacgtcggccgacgagcccgccgccccggaatctgccggatccacggaaaccccggcggcatcgggtgagccgtccgcggctgggactgcctccgtcgggtccggggccggctcggtggcgccggccgtggcccaggccgccgaggtgtcgccggtggcgcggaagcctcggccccggaccgcccggccggcggccgagaagccggccgtcgtcaggcagtccgctggcacgtcggacagcggccagcctgccgcacggggcgccgcgggcaggacggatggcgtcccgcagtctggccgcaccggggaagaggcccgcggtgccgagcaggctgtcggtgcgcggcaggtcagcggcgcggggcaggttggcggcgccgggcaggccgacggtgacgctaaggctgcgggcgccggggaggccggcggcgctgcggacaccggcgctgtggaagtggcgaagccggcgccgcggatgccgaattatcgggaggaggcggcggagctgctggccgggaccggggagccgaagcggcgccgggcggcgggcggccgcggctcggcgcgcaaccggggcaaggggacgccggaacaggggtga

SEQ ID NO: 1866 - DNA, 1662 bp, Actinoplanes utahensis
atggccgtcatgaccgttgaccgacgccggggcgcgaccgttctgctcggactcctgatcgggctgatcggggtccttctctcggccgggccggccagcgcgcacgcggctctggtcagcagcgacccgggcaccggcacgatcgtgccggacgcgccgaacaaggtgaccctcaccttcagcgagtcggtgcagctgatctccggcaagatccgggtggtcgcgcccgacggctcccgcgccgaccagggcgatccggcggtcgacggctcccgggtgaccatcccgttgcgctccggcggcgcccgcgggacctacctcgtcaccttccgggtgatctccgccgactcgcacccggtcggcggcacgttcagctattcggtgggcgcgccgtcgacgccgccctcggcggacgactccgcgaacgtcaaggtcgatccggtggtccggaccctcatcccggtcgggaaatatctggggtacgccggactcgtgctcctggtcgggccggtgctcgtgctggccctgctgtggccgcagcggctgtcccgccgcggccccggccggctgatctggaccggcatcggcctggtcaccggcagcaccgtgctggccatctggctgcaggcgccgtacacgctgggcaccagcctcttcgacgtccgggtcggcgacctgcgcgacgtgctgggcagcacgttcggcgcggtgatgctggtccggctggcggtcgtggtggccgccgcgttcctgctgcgcccgctgttggtcggcgcgggcggcgagtcccggctcgacctggcgctgctcggtgtcctgggggtggccgcgctggccacctggccgctgaccgggcacccgaccgcgtccccggtggcgggcgtctcggtggtgctggacgcgctgcacctggccgccatgtcggtgtggctcggcgggctggtcatgctgttcgcgttcctgctgccccgggccaacgcacgggagctgaccgcgatcctgccgatctggtcgcgctgggcgttcaccgcggtcggcgcgctgatcttcgccggcgtggtccaggcgctgatcgagatctccaccctcagcgggctgttcaccagcacgtacggccggctcatcctggtcaaggcgggtctcgccgcgctggtggtgggcatcgcggcgtactcccggaaactggtcagggaccggaccgccgaggagtccccgcgcgtcctgcgccggatggtgctggccgagctcgcggtcaccgccgtggtgctcggggtcacctcggcgctggtgcagatcgcgccgccacgcaccgccgaggcgtcggagaacaccaccaccgacaccacggtttcccagacgctgaccgagaagaccatgacgctgcagatggacatctatccggcgaccgtgggcaacaactcgatgcacgtgtatgcgtacaccccggacaacaaaccgcagacggtgctggagtggaaggcgaccgcggcgctgccgtccgcgggcatcgaaccgatcgaggttcccctgctgcggatcaccgacttccacgcgatcggcgacttcgcgctgccgcaggccggcgactggacgttcaagttcaccgcgcgcacgtccgacatcgatcagaccaccttcaccgcgacggtgaaaatccgctga

SEQ ID NO: 1867 - DNA, 603 bp, Actinoplanes utahensis
gtgcgcaacacgcggccggttcgggtcccggacgatgcgcgtacgatgcggctcgtgaccgatggtgagcacgagacggacgagaccaccgcgctggcgctggccgcccgcgccggcgacccggtcgcccaggccgcgttcgtgcgggccacccagaccgaggtgtggcgattcaccgccgcgctggtcgacccgggcgccgcggacgacctcacccaggagacgttcctgcgggcgttccgggcgctggactcgttccagggccggtccacggtgcgcacctggctgctcggcatcgcccggcgtgcctgcgccgaccacctgcgggccgtggtgcgccgccgccggctggatgtgcggctcgccgcgcaggccgcgaccgaggcgccggcgcccgacccggcgcaccggatgaccagcgcggacctgctgagcaggctgagcgacgagcggcggacggcgttcgtgctgacccaggtgatcggcctgtcctacgcggaggcggccgaggtggagggggtgccggtgggcaccatccgctcccgggtggcccgcgcccgcgacgaattgatcaccgcggtcgcccgggcgcaggcgagctga

SEQ ID NO: 1868 - DNA, 486 bp, Actinoplanes utahensis
atggaaaccaccacgcgcgcatcggcctggccgtgggtctccacgctggcccggctcgggctggccgccgtctggctgatcgccggcgccacgaagatcggtgacctggccgagtcggcgcgggcggtctacgcgtaccacctgatgtcctatgacgtggccaaggtcgtcggcggcgtgcagccgttcctcgagatcgcgctgggcctgctgctgctggccggcctgtcgacccggctggtcgccgggatctccgcggtgctgctggccgtcttcatcttcgggatcgcctgggcctgggcgaaaggcctgcgcatcgactgcggctgcttcagcaccggcggcgatctggccgccggccgcgccaccgagtacggcttggacatcctgcgtgacctcggtttcctggcactctccgggatcctgctgtggcggccacggacccggttctcaatcgatggcgtgctgatgggggatgcgtcgtga

SEQ ID NO: 1869 - DNA, 795 bp, Actinoplanes utahensis
gtggcggccacggacccggttctcaatcgatggcgtgctgatgggggatgcgtcgtgagcaagggcagccgggaccgcgcggtgaaggcgcggcagatcgtcgagcgacagcgggcgcaggagaaacgccgcaaggtgaccctgtggacctcggtggccgtggtcgcggtgctggtcatcgccggcttcatcgggtattcgcagctgtccggcacggatgacggcaagctggtcaccccgagtgtggcggtcgacgagggcaccgcgttcgcggtcggctccggcccggtcaccgtcgacctctacgaggacttcatgtgccccaactgcaagaacttcgaggggtccagcggcgccacgctgcggcagatggccaccgccaacaagatcaccctgcggtatcacgtcgtctcgatcctggaccgctcgtcgaacgggacgcggtattcgacccgggcggccggcgccggcgcggcggcggccgaggacggcaggttccccgagttccacgacgtgctctacgccaaccagccgcaggagggcagcgacggcctgtccaacgcgaagctgatcgagctgggcaagtcggtcggcttgacgagcgacaagttcgcgaacgcggtcaacgccggtacctatgaggcatgggcgacgcagaacaccgagacgttctccaagcgtggcttcaacggcacgccgaccgtcgtggtcaacggcacccagctcaagggtccgaacgacaccgtgccgcagctcgaccagatcacccaggccgtcacgaaggcggccgggtga

SEQ ID NO: 1870 - DNA, 1131 bp, Actinoplanes utahensis
atgggcgacgcagaacaccgagacgttctccaagcgtggcttcaacggcacgccgaccgtcgtggtcaacggcacccagctcaagggtccgaacgacaccgtgccgcagctcgaccagatcacccaggccgtcacgaaggcggccgggtgagacggatcaccctgatcctggccgtggccggcgcgatgatcgcgccggccacgcccgcgttcgcgcacggcggcgagggggcgaacgtgacctcctaccgcaccacggtcagcgggatcagcgacccgatgcgcggcctgtcggtacgcaccgtcgagggcggggcccggctggaactgaccaacgacaccggccggtcgatcgaggtgctcggctactccggcgagccgtacctggagctgcgccccgacggcgtctaccagaacctgggctcccccgccgcctatgtgaaccggaccctggccggcgacaccccggtccccccggtcgccgaccccaccgcaccgcccagctggcagaaagtgtccgccggccacacgatccgctggcacgaccagcgcacccactggctcggcacggtccgcccgccgcaggcggtgaccgaccccggccatgcgcaccggctgcgtgactggacggtcccgctgcgcgaccaggtccgcctcttcgcgatccgcggcgcgctggactacgagccgccgccggccacctgggcgtggtgggccggcgtgctcctgctcaccgcggccctgacggccctgatccgcttgcgcccacgggtgatcccgccactcgcggtcgtctccgctctttccatcctcgcgtacgccgtgacccgcggcctggacggcgccggttggtccggcgtcctgctcctgaccgccgccctggccctcggcgccgcctggaaacacccgccgttctacctggccctgtccggtttcgtgatcgccgccttcgccggtttcgccagctccgacgtctatctggccgcggtcgtcccggccaccggccccggctggctcgcccgcgcctgcgtcaccgccaccctgaccaccggcgccaccctcgccctcaccggcctcctccagatgcgcgccgccgtccccgaccctgcccccgcgactagggtgtcgtaa

SEQ ID NO: 1871 - DNA, 1320 bp, Actinoplanes utahensis
gtgtatctgcaccgcctacggatcagcgacgtgcgcggcttccatggttcccacgaggtcgacctcggcttcgagctttccgcggacggcgagccgaccgaccgctatcccggcttggtcgtcatcgcggggcgtaacgggtcgggcaagacgacactgctccgggccgccgccaccgccctcgccgggccggaggtcaccaacagtttgaccgaaggcgtccgcgactgggtgacccacgaggcggcgacggccgtcgtgcacgctgacattcggctggccggagatgagatcttcccgccggaacgcttcctcgaggcacgcctgcggtggccgcggacggaaggcgcgcgcgccagaccggaatcggggcttgattcccggagcgagcagcacgcgagaatttcgctgtggcggtccaacccggagagctggttcgcggccggctacggaccattccggcgcctggccggttccagcagcgaggtcgcacgcctgacggccggcgattggaccgtcgcccggttcgcgaccctgttccgggaggaggcctcgctcgccgagaccgtccactggttgcagcaggtcaactaccgtgcccggtccggtcagcagcggtacgccgacatggagggcttcctcctcgccctgttgaacgacgggctctttccggatggacatgccgtcgaccgcgtcgacccggatggactctggatcgcccggcagtccggcccacccatgttgatcgaggagatgagcgacggctaccgcagtgtcaccgcgctgatcaccgacatcgtccggcagatcagtgactgcttccggctgggcgttccgtggaccggggaatacccgcccagggtgctgacgtcggggatcgtgctgatcgatgaggtcgatgcgcacctgcacgtttcctggcagaaacggatcgcgccatggctgcgggagcacttcccgaacatccagttcatcgtgaccacgcacagcccatacatctgccagagcgcctcccccggcggtctcatccaacttcccggcccggacgacgatttcgcaccccgcgtcgtcgatgacgagctctaccgccgagtcgtcaacggcagcgccgacgacgccgtgctgaccgagctgttcggcctggaatcgccatactcccagcgggtcgacgaactccgtgccgagctgacccggctggaacgactggccatccgcggccacgcccaagccggcgacctggagaaactcgccgagctgagcgaggagttgtcgccgtcgccgagcagcagggcccgcgacgtcctcggcggggaagcgtga

SEQ ID NO: 1872 - DNA, 732 bp, Actinoplanes utahensis
gtgatcccgttcgcccgccggcccctcccgggctccctctccaccagtctcgccgccagaaccaggcagctcagcggtagcaccagcccgtaccaggacgcgcggaaagcgtggaagaccgccaccaccacgcgtcgtggcctgaagacacacctgtgtgtcagttgcgcccgaccggctttctgcatgtactgccacgagagccggggcaccgacgtcgaccactacgagccgatcaggcgggctccgctgcgaaccttcgtgtgggacaaccatctgctcgcctgcgcgtactgcaatcagcaggctaagcaggaggtgttccccctcgacgggaacggacagccgcttctgctggatccgtccgtcgacgactcggccgatcacatgacattgctttcgaccggggtcttcgaagggctgaccacgcgcggggctgaaacgatcgaggtgctgggcttgaacaagcggcccgagcttgtccgggcgcggaccgtgtcctggcgcggtgtggtgcgggtgttcgatcaggccgctctgcacggaggcgtgctgaccccgaacgacctggaggacctgcggttcctgccggtagtggacgctttccaccacttcgcgcatgacgttgtggcggggcggctcgggttcaaaggcgtacggccccatgtggtgacttctgctgacgcgaacctggcggtgatccgcggcctctttcccgcatgtcgcctttag

SEQ ID NO: 1873 - DNA, 564 bp, Actinoplanes utahensis
atgaggattccgtttcggcaggccgtgcccgcacggctttccctggtgaagacacggtggacagtgcgctttccgatgtgctcccgcggacatgggaatgccggtctggccagccgccacggatcttcagtacgctccccggcggagtcgcgagtcgcgcttccgtgtcgagagcggagtacacaggccatgaccgaacccaccggcggcaccacggcgaacggcaacaccaccgtctccggcgaggtggtggagaagatcgcggccgccgccgcccgcaccgtccccggcgtcgccgacctgggtggcgacgtcgcccgcttcttcaacagcgtcctcgacagggtcggcctggacaccgtcggcgacgcgagccgcggcgtccgcgccgacgtcaaggagggcaccgccaccatcaacgtggtcgtcgtcctggccgccggcacggtcgtcgccgaggtcgtcaccgccgtccagcagaaggtcaccgaggcggtgcagagctacggcctgcgcgtgctggccgtcaacgtcaacgtcgacgacatcgcccttcaggcctga

SEQ ID NO: 1874 - DNA, 426 bp, Actinoplanes utahensis
atggacaacgatcactacggcgatgagctgaccctccggttgtccggcatcgccgacatcagcgcgctcgacgacgacgaggtcttgacccggttcatgcgcgacctcgtcacccggatcgggatgacggtgatcgccgggccgctggtggccaccgagggcgggccgccggagaaagccgggaaatcagccgtggtgatcctggccgagtcgcacgcggcgatccacacctatccgcacctgcgggagatcttcgtcaacgtcttctcgtgcaagccgtttcgggagacggacgtgctggccgcattccaccggctggtcggcgactactcggtcaccgagtacacgctgcgccgccgcggtgagcagtggccccgggacctgaccgccgcggaacgcctgtggagtgcccgccgcgctgcctga

SEQ ID NO: 1875 - DNA, 477 bp, Actinoplanes utahensis
atgactgacaacgtgcgtctcagcgccggcgacgccgcgcccgacttcaccctgaccaccgacaccggcgaaagcctctcgctgaaagacctgcgcgggcgcaaggtcgtgctctacgcctacccggccgcgatgacgcccggctgcaccaagcaggcctgcgacttccgggactcgctggcgtcgctgcaggccgccggatacgaggtggtcgggatctctccggacaaaccggccaaactggcgaagttccgcgaccaggacgcgatcaccttcccgctggtcagcgacgaggacaagagcgtgctgaccgcgtacggggccttcggcgagaagcagttgtacggcaagacggtgaccggcgtgatccgctccaccttcgtgatcgacgagaacggggcgatagagcgggccctctacaacgtgaaggccaccgggcacgtcgccaagctccgccgcgacctcggcctggactga

SEQ ID NO: 1876 - DNA, 930 bp, Actinoplanes utahensis
gtgagtgctcatcgacgcccgttcccgacccgatggctcgcggccggcggcgccgccggcctcgccggcatcatcggcgtggcactggtgctgcagtccggcggatcggcctgcgccgcgccgccgagcaccaccaccaagaccggcaaagccaccttctacgacctgggtggcacgtccggcaactgctcgttcgaggtcccggccgacgacctgtacgtcgcgctcggccccgacgagtactccggcggcgcgtcctgcggggcgtacctcgacgtcaccggcccgaagggcaccgtccgggtcaaggtcttcgactcctgccccgagtgcgacaccggacacctggacctgagccataccgcgttcaagaagatcggtgccgaggtcgccgggatcatcccgatcaagtacaagctggtcgccaacccgcgggtccccggaccgatcacggtccggatcaaggagggcgcgtcccggtactggttcgccgcccgcatcgacaaccacgcgaacctgctgtcgtcggtcaaggtggcgggccccggcggcacgttccggagcgcgcagcgcaccgactacaactactggctgatcgacggcggggccggctccgggccgtaccggttgaagatcaccgacgtctacggcatcacgaccacggtgtccggcatcgcgatgaaacccggcgtggtgcagaagaccggcgtgtcggtcagcggccgctccgcgatcgtcgagaacgggaccgtcgccaagaagaacgcctccgccaagcctgctgtgtccccgtcggggtcggtcgcccccaaggccgctaccccgtccgcgtcctcggtggccccgctgcccgcttcggctgttgccgtcccgggcaccaccgaggacgcactcctcgccgccgccgacgccacaaccagctgcggctga

SEQ ID NO: 1877 - DNA, 813 bp, Actinoplanes utahensis
atgcggatcagggacctgcacacgtatccggtcaaaggctgtcatcgcctggaccacgccgaggccgaagttcagccctggggcctggcgggcgaccgccggtggatgatggtcgaccccgacggggtgggcctgacgcaacgcgacgagccgcggctcacccagctcgccgtccacccgaggcccggcggcctgcgcctgagtgccccgggcctgcctgacctggagatcgatgagccggccgccggcgccaagatcagtgtccgggtgttccggaacaagccggaggtgcccgcccgggttgccgagagtcagtggagcagcgccttcctcggccgcgacgcccggctgacctggcaggccgacccgaccggtcgcaccatcgcggaccgcgccctgccgagcgaccgggtcagtttcgccgacagctacccgctgctgctggccagcacggcgtcgctggacgcggtcaacgactggctggccgaggccggcgaggatccggtcccgatgcaccggttccgccccaatctggtggtcaccggtgctcccgcctgggccgaggacggctggctgggtggccggctgcggatcggcgaggtcaccttccgggtggccaagcactgtgcccgttgcctggtcgtcaccatcgaccaggagaccggtgagaccggccggcagccgctgcacgtgctcggccggcaccggcggatcgatggcggcctgatgttcggggtcaaactgatcccggacctcgcggccggccggagcggagtggtacgtcccggtgacgcggtgacaccgctggagtga

SEQ ID NO: 1878 - DNA, 834 bp, Actinoplanes utahensis
gtggtcaggacggcggagcgggtgctcgacctgtttcagggggcgcgcctgaccccgacccagcggcggatcgcgcacagcctggtcgagcacgcggccaaggcggcctatctgtcggcggccgaggtggccgagatcgccggggtgagtcagccgtcggtgacccggttcgcgatggcgctgggctactccggatatccggcgctgcgccgcgagctgcgggcgctcgcctcggacgcgccgagcgagccgggcggggagaacgcgatgcagcgggcggtgctggccgagaccgagcatctgcgccggctcgccgaggagctgcagcggcccggcgatgtgcggcgggcggccgagctgctggccgccagccggccgctgccggtgctgggattgcgcgcggcggctccgctcgccgcgtatttcgggtatttcgccgccaaggccttccccgatgtgcgggtgctcgacagcggcgggaccgggttgtacgaccggctggatcaggcccgcgcggcgggcgccggtgcgatgctggcgatcgtgctgccgcgttacccgcgcgagtcggtcgaggcggtccacgaggcgaaggccgccggcttcgccgtggtcgcgatcaccgactcggcggtcagcccggtgtccgaggcggccgacgtggtgctgcccgccgcggtcggcacccagctcgtgttcgacctgcacaccgggccgatggcgatggcgatggtgctgctcgaggcgatgtgcgacgccgctccggagccggtgcaacgccggcttgaggagttcgaggcgtcggccacccgccggaacatctttgtggcgtag

SEQ ID NO: 1879 - DNA, 1644 bp, Actinoplanes utahensis
atgaccaggatggacgagatccgggcaccgcgtggcacgtcgtacaccgcaatgggctggccgcaggaggccgccaagcggatgctgctcaacaacctcgacccggaggtagccgagcggccggaagatcttgtggtgtacgggggaaccggccgcgccgcgcgcaactggccgtcgttccacgcgatcgtccgcgagctggacacgctcaagggcgacgagacgctgctggtgcagtccggcaaaccggtcggggtgctgcgcacgcacgagtgggcgccgcgggtgctgatcgccaactcgaacctggtcggcgactgggccacgtggccggagttccgccggctggagcagctcgggctgaccatgtacgggcagatgacggccggctcgtggatctacatcgggacgcagggcatcctgcagggcacgtacgagacgttcgccgccgtggccgccaaacgcttcggcggcgacctgggcggcacgctcacgctgaccggcgggtgcggcgggatgggcggcgcccagccgctcgcggtgaccatgaacggcggcgtctgcctgatcgtggacgtggaccggacccggctgcagcgtcgcgtcgaccaccggtacctggacgtgatcgccgactccctggacgacgcgatcaaccgggcgctggacgccaagtcccggaaggccgccgtctcgatcggcatcgtcggcaacgccgccgaggtcttccccgagctgctgcgccgcggcgtcgcgatcgacatcgtgaccgaccagaccagcgcgcacgacccgctgagctacgtgccgatcggcgtcgacgtggcggacgccctggactacgcgcggaccaagccggaggagttcaccgagcggtcccgggccagcatggcgcagcacgtccaagccatggtcggtttccaggacgcgggcgccgaggtgttcgactacggcaactccatccgcggggaggcccagctgcacggatacggccgggcgttcgacttcccggggttcgtgccggcgtacatccggccgctgttcgccgagggcaagggcccgttccgctgggcggcactctccggcgatccggccgacatcgcggccaccgaccgggccgtgctcgacctgttcccggagaacgagccgctggcccggtggatccggatggccggtgagcgggtcgccttccaggggctgccggcccggatctgctggctcggctacggcgagcgggaccgggccggggtccggttcaacgacatggtggctcgcggcgaggtgtccgcgccgctggtgatcggccgggaccacctggactccgggtcggtcgcctcgccctaccgggagaccgaggcgatgctcgacgggtccgacgcgatcgccgactggccgctgctgaacgcgctggtcaacaccgcctccggggcgagctgggtgtcgatccaccacggtggcggggtgggcatcgggcgtagcatccacgccgggcaggtgtgcgtggccgacgggaccgcgctggccgggcagaagatcgagcgggtgctgaccaacgacccggcgatgggcgtgctgcggcacgtggacgccgggtacgagtcggcgtgcgccggtgacgtgcggattccgatgcgcgatgagtga

SEQ ID NO: 1880 - DNA, 1155 bp, Actinoplanes utahensis
atgagtgacttcgcgaggctctggggagagatcgccgggatcgggcgcgcttccagcggaggatatctgcggtacgcgctgacgccgccggaaatgcggctgcgggagtggttccggggtcaggcggggtcgcgggggatgaccgtgaccgaggacggcaacgggaatctgttcgcctggtgcggggagccgtgggcgccggggaccgtgctgaccggctcgcatttcgactcggtgccgcacggtggcggttacgacgggccgctgggcatcgtgggtgcgttcctcgcgctggaccaggtcggacattcccgaaatatcgcgattggtgctttcgtcgacgaagagggcgggcggttcggcgtgccgtgtctcggctcccggctgctgaccggggcgatcacgccatcccaggcggccgcgttgaccgaccgggacggggtcagcttcggggaggcgctcgggagtgtgccaactgggaagatcacctcaataagtgacatatcagcctttgttgagctacatatcgagcaggggcgtgcgctcgaagtcccggtcggcgtcggcagcgcgatctggccgcacggccgttggcggctggagttcgccggcgccggtgaccacgccggcaccacccggatgaccgaccgccgcgatccgatgctcaccttcgcctacaccgtgctggccgccaacaaggaggcccgcctgctcggcgcgcacgccacgatgggccgggtccaggccgagccgaacgccaccaacgccatcccgtcgctggtccacggctggctcgacgcccgggccgcggacaccgccacgctcgaccggctgctcgaatcggtgatcaagaaggcgaccgagcgggccggccgggacggcaccgacctgaccgtggtcgccgagtcggtgaccggcgaggtggccttcgacacggagctggccgggcgactgtccgcgctgctcggtgacgtgccgatcctgccgaccggcgccgggcacgacgccggggtgctgtccgcgcacgtgccgaccgcgatgctgttcgtccgcaatccgaccggggtgtcgcacgcgccggccgagggggcctcggacgaggactgcgaggcggggatcgacgcgctggcacgggttctggaggcgctgacgtga

SEQ ID NO: 1881 - DNA, 1290 bp, Actinoplanes utahensis
gtgacggcctatgtcgcgcagtacgcctggatcggcgacgaggtcagagagaatgtcggcatcgagatcgccgacggccggataagccgggtatcaaccgggatttcgggtgaaaggctgtcgggtctcgttctgccggggatggcgaacgcgcactcgcacgccttccaccgcgctctgcgcggccgcacccacggcgaccgcggcagcttctggacctggcgcgacctgatgtaccgggtcgccggccgtctcgacccggacaactacttcgccctggcccgggcggcctacggcgagatggcgctggccggcatcacctgcgtcggcgaattccactacctgcaccacgggccggacggcacccggtacgccgacccgaacgcgatgggtcacgcgctgaccgccgccgccgccgaggccggcatccggatcaccctgctcgacgcggtgtacctgaccgccggtgtcgacggcaagcccctcgacggcgtgcagcgccggttcggcgacggcgactacgacgggtggtattcccggttcgacgccctgcgcggcggtggccacgtccggatcggcgcggccctgcactcggtgcgcgccgccccggcggacgggatggccgccttcgccgcacgcaccgacggcctgccggtccacgtgcacctctccgagcagccggccgagaacgagcagtgccgggcggtgcacggctgctcccccaccgaactgctcgacgccatgggtgtctggcagccgatgaccaccgcggtgcacgccacccacctgaccgacgccgatcgcgcgctggtggagggcagccacgcctgtttctgccccaccaccgaacgcgacctggccgacggcatcggcccggcccgcgccctggccgacggcggcaccacgctgaccctgggcagcgacagccacgccgtgatcgacctcttcgaggaggcgcgcggcctggagctggacgagcggctggccacccggcagcgcgggcacttcaccgcggccgagctgatcaccgcggccacccgggccgggcacgcgtcgctgggctggtccgacgctggagagattgccgtcgggcagcgggccgacctggtcgcggtgtccctggacagcccgcgcaccgcgggcatcgacccggccgggacggtcttcgcggccaccgcggcggatgtcaccgacgtgatcgtggacgggcgaccggtggtccgcgacggacggcatctcggcatggacgtgccggccgcactgcgctcggcgatcgcggcggtgctgtga

SEQ ID NO: 1882 - DNA, 1182 bp, Actinoplanes utahensis
atgagcctgctgatcacgaacatcggcgaactgttcaccaacgccgaacgggacctgatcccggacgcggccgtggtcgtcgacggcgaacggatcgcctgggtcggcccggccgccgaggcgcccgccgcggaccagcggatcgacgccgagggcgcggcggtgctgcccggcttcgtggacagccatgcgcacctgatgttcgccggggaccgggccgccgagttcggcgcccggatggccggcgagccgtacaccggcggcgggatccggaccacggtccgggccacccgcgcggccaccgacgaacagctgcgggccaacgcccggcggctggtccgggaggcgatgcggcagggcaccacgacgatcgagatcaagtcggggtacggcctgaacgtcgccgacgaggcccggtcgctgcggatcgccaccgagttcaccagcgagaccacgttcctcggggcgcacgtcgtcccggtcgagtaccaggaccggccggacgactacgtcgggttgctgtgcgggccgatgctggcgatggccgccccgcacgcccgctgggtggacgccttcgtcgagcgcggcgcgttcgacgccgaccaggcccgcgcgatcctggagtccggcaaggagctcggcctgggcgtccgcgtgcacggcaaccagctcggtcccggccccggggtgcggctggccgttgagctggacgccgcgagcgtcgatcactgcacccacctgaccgacgcggacgtggacgcgctggccggcacccggatggactgcatgtgtgcgtgcggcgggatgaccaccacggtggccacgctgctgccgggcgccgagttctccacccgctcgccctatccggacgcccgccggctgctcgacgcgggagtgaccgtggctctggccaccgactgcaaccccgggtcgtcgtacacctcatcgatgtccttctgcatcgccctcgcggtccgcgagatgcggatgacgccggcggaagcggtccgggccgcgaccctgggcagcgcgcaggcgctgcgccgctccgacatcggcgtgatccggcccggcgcgcgcgccgacctgctgatcctcgacgcaccctcgcacctgcacctggcctaccggcccggtgtacccctgatccgcaccgtgatccacaacggagtcgtgcaatga

SEQ ID NO: 1883 - DNA, 1536 bp, Actinoplanes utahensis
atgaccgttatcgttcaacccaccgggatcgaccccgccgacgtcatcgccgtggcccggcacgacgccaaggtggagctctcccccgccgccgtcgaggcgatggccgccagccgcgccatcgtggacggcatcgaagcctccggccgccccgtctacggcgtctccaccggcttcggcgcgctcgccaacacctcgatcgccccggaacgccgggccgagttgcagcacgcgctgatccgctcgcacgccgccggggtgggcgcgccgatgccccgcgaggtggtccgggcgatgatgctgctgcggatccggtcgctggcgatgggccgttccggggtccggccggtgctcgcccagggcctggccgacctgctcaaccacgacatcaccccgtgggtgccggaacacggctcgctgggtgcctcgggcgacctggcgccgctggcgcactgcgcgatcgtgctgctcggcgagggctgggtgatcggcaaggacggcgcccgggcgtcggccgccgaggcgctgcacaccgccgggctgcgcccgctggagctggccgccaaggaggggctggcgctgatcaacggcaccgacgggatgctcggcatgctgctgctggcgatcgccgacgcggcgcacctgttcaccatggcggacgtgaccgcggcactggccaccgaggcgatgctcggctcggagcggccgttcctgcccgagctgcacagcatccggccgcatccggggcaggcggcgtcggccgccaacatccaccggctcctgcaggactccgcgatcatggactcacaccgggacgacctggcgcacgcggtgcaggacgcctactcgatccgctgcgcgccgcaggtcgccggggcggcgcgggacaccctcgacttcgtccgggtcaccgcgtcccgtgagctcgtctcggtggtggacaacccggtggtgctgccggacggccgggtcgagtcgaccggcaacttccacggggcgccgctcgggttcgccgccgacttcctggccatcgccgccgccgaggtgggcgcgatcgccgaacgccgggtcgaccggctgctcgacgtgacccgcagccgggaactgccgccgttcctgtcgccggacgccggcgtcaactccggcctgatgatcgcccagtacaccgcggccgggatcgtcgccgagaaccggcggctggccggaccggcctcggtggactcgctgccgaccagcggcatgcaggaggaccacgtctcgatggggtgggcggccactaagaagctgcgcaccgtgctggacaacttgaccagcctgctcgcggtcgaactgctgtccgcggtgcgcggactgcagctgcgggcgccgatcacgccgtcgccggccggccgggcggcgatcgccgcggtcgagccgttcgccgggcggccggggccggacgtcttcctggcaccggtgctggagcagacccgggcggtgatcgccgcccgggatctccggaccgccatcgagacggcgacgggtccgctgggctga

SEQ ID NO: 1884 - DNA, 615 bp, Actinoplanes utahensis
gtgagcgcgcggctgctgctggccaccgcgaacaagaagaagctgatcgagctgcagcgcatcctggacgccgcgctcggcatgagccagatcgagctggtcggcctgggcgacttcccgggctacccggacgtgcccgagaccgggctcaccttcggggagaacgcgctgatcaaggcccgcgagggcgccaagcgcaccggcctgccgaccgtcgccgacgactccggcctggcggtgaacgcgctcaacgggatgcccggcgtgttcagcgcccgctggtccggcgggcacggcgacgacgccgccaacctggacctggtgctggcccagatcggcgacgtcggtgacgagcaccgcggcgcctcgttcgtctgcgccgccgccctggtcctgccgagcgggcgggagcatctggtcgagggccggcagtccggccggctgctgcgcgcgcgccgcggcgagggcggtttcggctacgacccgatcttcctcggcgacggccaggaccggaccaacgccgagctcgccccggcggagaaggacgcgatcagccaccgcggcaaggcgttccgcgagctggccaaggtcgtcgccaaggaactgccccgctga

SEQ ID NO: 1885 - DNA, 729 bp, Actinoplanes utahensis
atggcgcgacccgacggccgagcggccgaccagctgcgaccggtgacgctgacccggcattggagcatccaccccgagggatcggtgctggtggagttcggcaacacgcgagtgctctgcaccgccagcgtcaccgagggggtgccgcgctggcgcaagggctccggcctgggctggctgaccgcggagtacgcgatgctcccgcgggccaccaacacccgcggcgaccgggagagcgtcaagggcaaggtcggcgggcgtactcaggagatctcccgcctgatcggccgcagcctgcgggcctgcatcgatctgaaggcgctgggggagaattccatcgtcctggactgtgacgtgctgcaggccgacggcggcacccgcaccgccgcgatcaccggcgcctatgtggcgctgcacgacgcggtgacctggctggccgggcgcaagtcgctggccggcaaggtggacaaggtgctgcacacctcgatccaggcggtcagcgtcgggatcatcgacggcgaggcccgcctcgacctgccgtacgtggaggacgtcgccgccgaggtcgacatgaacgtggtgtgcaccggcgccggcgacttcgtcgaggtccagggcaccggggagaacggcgtcttcaagcgcgcccagctggacgccatgctcgacctcgggctcgcgggttgcgccgagctggccgtcgcgcagcagaaggcccttgcggcatga

SEQ ID NO: 1886 - DNA, 1209 bp, Actinoplanes utahensis
atgcgcatagttcgcctggccaacttcgtcacggtgcataccggcggcctgcggaccaccctgcgcgagctcggcaagggataccaggatgcgggccacgaggcggtcctgatcatccccggtcgccagttccgggatcaggagaccgcacagggccgggtgatcaccctgcccagcgcgccggtgccgcgcaccggcggctaccgcgtgctggccggtcggcgtgagctgatcaaattgctggacagcctggagccggaccgcatcgaggtctccgaccgcaccacgctgcgctggaccggcacctgggccaagcagcgcggggtgcgatcgatgatggtctcccacgagagcctggccggcctgctcggcgtctggggcatgccgaaacgcgacgcgctcgccgaccggttcaaccggcgcaccgccgaggccttcgacacgatcgtctgcaccaccgcgttcgccgccgccgagttccgccggctgggcgtgccgaatctggtcgaggtgccgctcggcgtcgacctggagctgttccacccgagccggatggacgtgtcggtccgctcgcgctacgcgcggcccgaggaactgctggtggtgtacgcgagtcgcctgtccgccgcgaaacgccccgagctggccgtcgacaccgtggccgtgctgcgcaacaacaaggtgccggcggtgctggtggtggccggcgacggcacccggcgggccgccctggcctaccgtgccgcccggctgccggtccggttcgccgggcacatcgccgaccgcaaggcggtggccgccctgctcgcctcggccgacgtggtggtcgcgcccggcccggtggagaccttcgggctgtccgcgctggaggcgctggcctgcggcaccccggcggtggtcgacgagcagagcgcgctgcccgaggtgatcggcgaggccggcatcgcggtgccgggcaccccggaggccttcgccgacggcatctcccggctgctggaacgcccccgcgaccgatggcgggccacggcccgcgcccgggcggaacgcttcggctggccgcgcgcggtcgagggtttcctccgcgcgcacgccgtcgaccccggtcccggcccctcgctgatccgcccggcggccccggaatcccgcgcgagcatcccgtggacccgcgaacccggggcggacgaagcgggcacaccgcggtacgcatag

SEQ ID NO: 1887 - DNA, 747 bp, Actinoplanes utahensis
atgcgactaaccgttctcggttgtgccggcagtttccccggccccgagtcggcttgttcggcctatctcgtggaagccgagggattccggctgctgatcgacttcgggtcgggcgcgctctccgccctgcagcggtattcggacatgcgcgcgatcgatgccatcctgctcacccacctgcactgtgatcacatgctggacgcgtgcacctatgtggtcgtccggcgctacgacccggccggtccgctgccggcgctgccggtgtacgcgccgctcggcgccgccgagcggatcgccgccgcgtacagcgccgacggggagccggtcgacgacgtctacacgttctacggcctgcagccgggcaccttcccgatcggcccgctgaccgtcacggtcgaccgggtcaaccatccggtggagacgtacggcgtccggatcgagcacaacggccgggtcctggcgtactcgtcggacaccgcgccctgcgaggcgctgctgcggctggctgccggtgccgacctgttcctgtgtgaggccagctacatggacggtgtggagaatccgccggacctgcacctgaccggcggcgaagcgggggaggcggccaccaaggccgacgtcgcccgattgcttctgacacatctggtgccggcgtgggccagtgaggccactatcgtggaggcagccggagccgcatacgcgggaccggtggaagtcgtccgcccgggtgccagatacgatctctga

SEQ ID NO: 1888 - DNA, 402 bp, Actinoplanes utahensis
gtgaccgcggtggaaccggccggcatcaccagaaccgcggtacccgaaatcctgccgttcgaatcgtcctgggaaccggtgccgtgggatccggacggcccgattttccgatttccggccgaggacgacccggctcccgacccgcaccgggtgctcgccatggccggatactgcgcgatgctcggcctgaccggggtcggtgccggcctgtacgcgctgatcgccgtgttccgtggcgcgcccggctggtacctgccggcgctggccctgctcaccatggtcagtgtggggctggtggtcggcgcgttcctcgccgtccaccagcgcaccctgccctggatcctgctgctcgccgcggcgccgccgatgttcgcggcgctcttgttagcggtggcctattag

SEQ ID NO: 1889 - DNA, 966 bp, Actinoplanes utahensis
atggctcgctatgagagcctgctggacgcttgcgggggcacgccgctcgtcggcctgccccgcctctccccggcggtgcccgagggggcgccgccggtgcggctctgggccaagctggaggaccgcaacccgaccggcagcatcaaggaccgcgccgcgctgtacatggtgcgcgaggccgaggagtccgggcatctacgcccgggcgacaccatcctcgagccgaccagcggcaacaccggcatcgccctggccatggtggccaagctccggggttaccggctggtctgcgtgatgccggagaacgtctccgccgagcggacccaactgctgcggatgtacggcgcggagatcatcttctcgcccgcggccggcgggtcgaaccaggcggtggccaccgccaagcagatcgccgccgagcatccggactggaagatgctgttccagtacggcaacccggcgaacgcccgcgcgcactacgagacgaccgggccggagctgctgcacgacctgcccacgatcacgcatttcgtggccgggctgggcaccaccggcacgctgatgggcaccggccgcttcctcaaggagaaggtcgacggcatccagatcatcgccgccgagccacggtacggggagctggtctacggcctgcgcaacatcgacgaggggtacgtgccggagctgtacgacgccaccgtgctggaccgccggttctcggtcggcacccgggacgccgtgctgcggactcgtcagctggtcgaggtcgagggcatcttcgccggcttctccagcggcgccgtgctgcacggcgcgctggccgtggcgcacgaggcggtcaaggcgggcaagcgggccgacgtcgcgttcgtgatcccggacggcggctggaaatatctgtcgaccggggcgtacggcggcacgctcaacgacgccgaagaggctcttgaaggccagctgtgggcctaa

SEQ ID NO: 1890 - DNA, 315 bp, Actinoplanes utahensis
atggctatcgaagtccgcgttcccaccatcctgcgcagctacaccggcggttccaagatcgtcgagggtgccggggacaacctctccgcgctgatcgacgacctggacgccaagcacagcggcatcaagggccggctgatcaccgccgagggcggcctgcaccgcttcgtcaacatctacgtcaacgacgaggacgtgcgcttcctcggcgcgctcgacgcgaagctgaacgacggtgactcgatcaccatcctcccggccgtggccggtggcgccctgggcttcgcggcggcggccgccttcttcgggcgctga

SEQ ID NO: 1891 - DNA, 474 bp, Actinoplanes utahensis
gtgtgcctcgccacgcgcggagtggcgaaacctttcggtaatgtgaacgccgtgctgaccatcgacagtgcgatcgtgcgtgcgatcgtcgcccacgcccgccgggaccatcccgacgaggcctgtggcgtggtcgccggcgcgatcggcagtgacgtgccggcccggcacatcccgatggacaatgcggcccggtcgatgaccttctacgagttcgactcgatggagcacttccgggtctggcgcgagatggacgacaacgacgaggagccggtggtcatctaccactcgcacacggccaccgaggcctacccctcgcgcaccgacatctcgttcgccggtgagccgaacgcgcactatctgctcgtctcgacccgtgagccggattccgaggagatccgctcgttccgtatcgtggacggtgtggtgaccgaggaagaggtcaacatcgtggatgcgacggtgaagtcgtga

SEQ ID NO: 1892 - DNA, 501 bp, Actinoplanes utahensis
atgttccgacgcagcggcggtcagtgtgtggccacgttcgcgcacgacgaggtgcgtgtcctgcggaaggtggccgccgaggtggtgggcctgctgaccgacgggatggaccacaccgacccggtggtgggccgtctcttcccggacatctatccggagcgcccggaggattcccgggaattccggctgtacaccgagagcgacctgaaaagcgccaagatcgaccaggccggcgcgatcctggccgccctacccgacgagggcgagggcgaggtgcggctggacggtgaggccgccgaggcctggctgcgcgcgatcaacgacgcccggctggcgatgggcacccgtctggacatccaggccgacaccgatctggccgaggaactggacgacgcggtgctggaggatccgggttccagccgggtgttccagctgtccgtttacgcctacctcggttatctacaggaatcactcctcaatgcgctgccggagatcaaatag

SEQ ID NO: 1893 - DNA, 1278 bp, Actinoplanes utahensis
atggggccggccctgctgaccgatcactatgagctgaccatgatcagtgccgccctcaaggacggcaccgccgagcggcagtgcgtgttcgaggtcttcgcgcgccgcctgccgaccggccgacgctacggcgtggtggccggcaccgaccggctgatcgagatggtcgccggtttccggttcgacccggccgagatcgagttcctgcgctcctcgggtgtcgtcgacgaggccaccgccacctggctggccaactaccggttcaccggcgacatcgacgggtacgccgagggcgagctgttcttccccggctccccgatcctcaccgtctccggcagattcgccgagtgcgtggtgctggagacgctgatcctctcggtgctcaaccacgactgcgcgatcgccgccgccgcggcccgaatggtcaccgccgcccgcggccgtccgatcatcgagatgggctcccggcgcacccacgagcaggccgcggtcgccgcctcccgggccgcctacctggccggcttcgcctccacgtcgaacctggccgccggccgcgcctacggcatcccgaccaccggcacctcggcgcacgcgttcacgctgctgcacgacgacgagccgaccgcgttcgggtcccaggtcgcggcgctcggcaagaacaccacgctgctcgtcgacacgtacgacatcagccagggcatccggaacgcgatcgcggtcgccgggcccgacctgcgcgccgtccggatcgactcgggtgacctgtcggtgctcgcccagcactcccgcgagctgctcgactcgctcggcgccaccgagaccaagatcatcgtttcgggtgacatggacgagtactcgatcgccaccctcgccgccgaaccggtcgacatgtacggcgccggcaccgcggtggtcaccggctccggggcgcccaccgccggcctggtctacaaactcgtcgaggtcgccggccgcccggtcgtcaagcgctcggagaacaaggccaccgtcggcggccgcaagaccgcggtgcgccggcacaaacccaccgggaccgccaccgaggagatcatcgtctcccagggggtgcccgaccaccaggccaacgaccggctgctgcagcgcccctacatcaccgggggcgaggcgcagacccgacccaccctgcaggagtcccgcgaccacctgcgccgcaacctgatctcgatcccgtgggagggcctgaaactctccgcgggcgacccggccatcccggtcatcctcattcccaccgcatag

SEQ ID NO: 1894 - DNA, 582 bp, Actinoplanes utahensis
atgactcgcgcgctgatcatcgtggacgtgcagaacgacttctgcgaaggcggctcgctgccggtcgccggcggcgccgccgtcgccaagggcatctcgctggtcctcgacagggccggcgaccgctgggaccacgtcgtcgccaccaaggactaccacatcgacccgggcgcgcacttcagcgccagcccggacttcgtcgactcgtggccggcccactgcgtcgccgggtcctcgggcgccgacttccaccccgagctgatcaccgaccggatcgaggcgatcttccacaagggcgcgcaccaggcggcgtactccggcttcgaagggcacaccgaccagggcgaaaccctcgccggatggttgcgggcccgggcggtcaccgacgtcgaggtcgtcgggatcgcgacagatcattgcgtacgcgccaccgcgctggatgccgccaccgaaggcttcgccaccaccgtcgtcctcgaactgaccgcgggtgtggcggcggccacgaccgaggcggctctggccgacttccgcgccgcggcggtgtcgatgaccggagccccgatcgtcgacccgatgtga

SEQ ID NO: 1895 - DNA, 774 bp, Actinoplanes utahensis
gtgacccgcgtgcccgacgagacgccgcccccttcggccaccacggcaccgccttcttcgtccgtggcggcggcgccgttgtccccatccgcgccgtcatcgtcgccttctccggccgcgcccgcttcggtcgcgcccgtttctgccgcgcccgtttctgcggcaccttcggggttggcgcggccttctcggggcgtgctggccgctcgccccgcggctgtcatccggcccgtggcggacggtgattgggggcaggtgtggccgatcgtccgcgaagtggtgcgggccgccgacacctacccgttcgacccggcgatgaccgagcccgaggcgcgggccatctggctggagcagccgcccgggctgaccgtggtctcgaccgagccggcccgcggcggggcggaccacgacgtaccggcgaacgggtctccaccggagaagatcaccgggaccgcgaagatgggcccgaaccgcggcggacccggcgcccacatcgccacggcaagcttcatggtcgccgccggcagccgcggccggggcatcggcgcggccctctgccgctacgtgatcgactgggcgcggaccgaaggctacgccggcatccagttcaacgccgtcgtcgccaccaacacggccgccgtgaccgtctaccgccgcctcggcttccagatcctcggcacggtcccgcgcgccttcgaccatcccacccagggccgcgtcggtctccacctgatgtacctggaattcccacggcacggcgggcacaccggctga

SEQ ID NO: 1896 - DNA, 1068 bp, Actinoplanes utahensis
atggagttcggcctcggcctgcccatcaatgaccccgctctgctgcccgcctgggcccggctcgcggaacagcacgacttcgccacgctggctctgctggaccgcctcaccttcgacaaccccgagccactgatcgccctcgccgtcctggccggcggcaccgaccggatccggttgcagaccgaagtgctgctcggcccgctgcggtcgacggccttgctggccaagcaggtcgccaccctcgaccggatgtcaggcggccgcttcgtcctcggcatcggcatcggcggccgcgaggacgatcatgaggcggccggtgtccccctcgcgggccgcggccgtctccttgacgcccagctcgccgacctccgaaggatctggcgcggcgagccctaccgcgccgcgaccaccccggacccgcgcgaccggtcggtcgccccggacggcgcgggtcaccccctccgccaccgccgcgctgaacatcccggtggcacggaaaccgctggtcccggcgggcccgatggtgctgggcggccgggtgggtccggtgtggtgtcgcggtccgggggatccggagtggcgccttccacggaggatgactgggggctcgggcggcgagtggccgccggtgtcgccgggatcgggccgcggccggttgcgggggacgggccgccgattctgatcgggggattcgcgccggcggcgttgcgccgggtggcgcggtttgcggacgggttcatctgtgcggcgccgttgggatgggcaggaggattggttcgtactgtcaatgaacagtgggaggaagcggggcgggcggggcggccccggctggtctgccagatcaatgtgtcggtgggggatgccgcgacggtcgagcggggcaggcgggcggtggccgactactacgccttcaccgggcgtcccggattcggcgtgccgctgagcgatccgggggagatcgccgaggcagtggcggcgtatcgggagttcggggccgacgaactcgtcttctactgctacgccgacgatccccgccagatcgacattctcgccggaattctgcgctga

SEQ ID NO: 1897 - DNA, 1380 bp, Actinoplanes utahensis
atgttgctcaagccttaccgggaaaccctcgcactgcccaaggtcatgtccgtgctcgcgatcgccacgctcgcgcgcatcccgatcgcggccggcgccgtcgtgctcaccctgcacgtcgtcaccgacctgggccggggctacggcgcggcgggcctggtcggtgccgcggcgaccctcggcgggtcactcggcgccccgatgatgggccggctcgtcgaccggcgcgggctgcggccggtcctggtgctgaccaccgtcgccgaggtgatctactggatcgtcgcgcaggcgctgccctactgggcgctgctcccggtcgccgtgatcggcggcttcctggccctgccggcgttctcggtggcccggcagtcgatcgccgcgctcacccccgagtcgcaccgcctgcccgccttcgccctcgactcgatgaccaccgagctgtcgttcatggccggcccggccctcggcgtgctgatctccacggccgaccacgccggcccgcgcgtcgccatgctcgccctggccggcggcatcctgctggccggcctcggcctgtggctggtcaacccgcccacccgggccgaccacgaggccccggtctcggccggcgagcgggtcgcccgccgcgagtggctcaagccccgcttcatcgccatcctggccgtcaccatggccgccaccctcgtcctgtccggcaccgacgtgtccgtcgtcgccgtcctgcgcgcctccggcgagctcagctggtccggcctcgtgatgaccctgtgggccctgttctccctgatcggcggcttcgcctacggcaccgtccggcgcggcctcccggtcctcgccctgttcatcccgatggccgtgttcaccgtcccggtcggcctcggcggctcccactggtggctcctggccgtcctgctcatcccggccggcgccctctgcgcccccaccatcaccgccagttcctccgccgtcagccagatgatccccgccgccgcccgcggcgaagccatgggcctgcacaactccgccctcaccgtcggcgtcgccctcggcggcccgttggccggcctcgccatcgactcgtggggcccggggtggggcttcaccgccgtgggcacggtcggcgtcctggtcgccctcgtcgtcatcccggccgagctccgtcgccgccgcgacaacccgccggcccagcccacctcaaccggggcgcccccggctgcctcggcgccggtcgcttcgaccgcggttgcctcggtcccgcctgcctcggtcccgcctgcctcggtccaggccgcctcggcgccgatcgcttcggtccgggccgcctcggccgaggcgattccggcgccggttgccccggttgaggcgacctcggtctaa

SEQ ID NO: 1898 - DNA, 1248 bp, Actinoplanes utahensis
atgacgaatcgccggatgttcatccgagccggtggggcggccgcgatgggggtcgccgcgacggccgtcggcagtggcccggccgcggccgccggggacgagcccgcctatgccgagggccacctcgggttcagcgtcaaggaattcggcgcgaagggtgacggcaccaccgacgacaccgcggccatccaggccgcgctggactacgcggcggcgccgggccggaccggcagcatcgtgtacctgccgcggggcacctaccggacgtcgaaggcgctgcgcgtccacccggccaccaccctgcagggcacccacggcaaccacatcgacgagggcgacaagacctgggtgcagaccgagtcgcggatcaaaccgctcgacacgttcagcggcccggcgtgcatcgagatcgtcgaccgggacaccggcggctacccggccggttccgccgagcagcggctgttccacctcaccctgaacggatccgcgctggccgccggcaccggcgtcgacggcatccgcttcaccggcaagatccacggcgtggtggtccgcgacgttgcgatcttcgactttccgaaccacgccatcaccaccgcgtaccgcacgccgagcgacggcggcccgcaggcgctgtactcggcccgcttcgaacggatcgcggccaagggcaacggcggcatcacctacagcttcaacaacaccaccgactcccagttcaccgacctggagtcgatcgagggcggcagccacggcttcttcatcgccggctgcggcaactcctgtttcaccaactgccgctcggaatggagccggcacaacggcttcgacctgcgcggcggcaacggcatcgtggaactgctcggctgcagcaccgaccgcaacggcttcaacggggtgagcatcgaccagaacagcaccggcgaaggcgtcatcgtgctcaacgggctgcgcctaaaccgggacggcaagagcgacaacggcggctacgccggactcaagatcaacgggacggcggcggcgccggtggcgacggcggtgctggtcagcgccctcgccgtggagaccgggacgaacgatgacaagaccggacccacgacgccgcagtacggggtgagcgtggacaacgcgacgacggtggtgctggagagcggcatcgtgcgcgggcgggtggccggatatcgggccggaggcaccaacacgacgctgaaggtgggggcgacgttcctcagccggaccgcttcgtaa

SEQ ID NO: 1899 - DNA, 1752 bp, Actinoplanes utahensis
gtgacgaccgttgcgccgtcgccgatcgcgacccgtccatatccggtccggcggcaggtcaagggttcggccttcgcccgaatcctgcgcacgacggacgcgaagcagatcgggatcatgtatatggtcaccgccttcgtgttcttcctgctgggcggcctcatggcgctgctgatgcgcgccgagctggcccgccccggcatgcagctcctgtcgcccgagcagttcaaccagctgttcaccatgcacggcacgatcatgctgctgttcttcgcgacgccgatcgtgttcgccttcggcaactacgtggtgccgatccagatcggcgcgcccgacgtgtcgttcccccggctgaacgcgttcgcgtactggctgtacctcttcggtggtctgatcaccatcggcggcttcctcacccccggtggcgcggccgacttcggctggttcgcctacacgccgctgagtgactcgctgcactcgccgggcgtcggcggcaacatgtgggtggtcggcctggccatctccggtctgggcacgatcctcggctcggtcaacctgatcaccacgatcctgaccctgcgggcacccggcatgaccatgttccggatgccgatcatgacctggaacatgctggtcacggcgctgctcgcggtgatggtcttcccgttcctggcggccgcgctgttcgcgctcgccgccgaccgtgtcctcggcgcgcacgtcttcgacgtggccaccggcggcccgatgctctggcagcacctcttctggttcttcggccaccctgaggtgtacatcatcgccctgccgttcttcggcatcatcaccgaggtcatcccggtcttcagccgcaagccgctgttcggctacaagggcctggtcgccgcgaccctgctgatcggcgcgctgtcgatgtcggtgtgggcgcaccacatgttcgtcaccggccaggtgctgctgccgttcttcagcttcctgagcttcctgatcgcggtgccgaccggcatgaagttcttcgtctggatcggcaccatgtggcgcggccagatcagcttcgagccgccgatgctcttcgcgatcggcttcatggtgacgttcctcttcggtggtctctccggcgtgctgctcgccgccccgccgatcgacttccacgtgtccgactcgtacttcgtgatcgcgcacttccactacgtgctgttcggcacgatcgtgttcgcggtcttctccggcatctacttctggttccccaagatgttcggccggtacctcgacgagcggctcgccaaggtgcacttctggctgaccttcgtcggcttccacaccaccttcctggtgcagcactggctcggcaccaagggcatgccccggcgctacgccgactacctgcccaccgacggcttcaccacgctgaacacgatctccacgatcggctcgttcatcctgggcctggccacgctgccgttcctctacaacatctggaagtcctacaaggtcgggcgggtcgccaccgccgacgacccgtggggccacggcaactccctggagtgggccaccagcagcccgccgccgctgcgcaacttcgaccggatgccgcggatccgctccgagcggcccgccttcgacctgaagttcccggagctcgcggccggcgagtacggtgccctcgccggtccgccggagggcggcgcccgcccgctgacccacgagtcggacggcggcgccagctacgccgaggacatccagcacgactga

SEQ ID NO: 1900 - DNA, 1107 bp, Actinoplanes utahensis
atgaccttgcgcatcctcgtggtgggcgccggcatcgccggtctggcggccgctcggggcctgcgagtggcgggcttccggccggacgtggtggaggccctgccggccaccatgagccccggcgccgggatctacctgcccggcaacgcctcgcgtgcgctgcgcctgctcggcctcgacgtcccgctgcgcccgctgggtgacctgatcttccggcaggtcttcctcgacgcgcgcggccgcgacctgttcgagatggatgtggccgggctctgggccggggtcggcgagtcccgtgcgctgtcccgcgccgacctgcagcaggtgctgctcaccggggtcggcggcgaggtgcgctacgacaccgaggtgcgcgacgtcgagatcgtcgacggggccgccaaggtggcgttctccaccggcgccatggccgagtacgacctggtgatcggcgccgacggccgccgctcgcagatccgcgagcggatcggcctgggcggccccgcggtgcccaccggccagatcgtctaccgcgcggtggtctccggcgggccaccgctcaccgactggaccgcggtgctgggccggcgcgcccagttcgtcgcgatgccgatgggcggtcgccggatctactgctacgccgacgagaccgcgcccgacacccctgacccggccgacccgatcgagcggctgcgcgaggtgttcggccagttcggcggtccggtcccggcgatcctcgaccggatcgagaaggtgtcggtcgcccgcaccgacgaggtggtcctgccgtcctggtcccgcggcccggtggtgctggtcggcgacgcggcgcacgccaccgcgccgaccctggcccagggtgccgcgatgtccttcgaggacggcttcgtgctgggccgggagctgcgccgggcggagggggacatcccggtcgcgctgcgtgcctatgaggatcgccgccgcccccgatgcgccgaggtgcgcgaccggacccgcgagcgggaccggaccagggacgtgccgccgtcgctgcgcgacccgatgctgcgccgtcgcggcctgcggatcttcaccgaccactaccggggtctcgtccccgccgtatag

SEQ ID NO: 1901 - DNA, 1302 bp, Actinoplanes utahensis
atggacacgcgtcggagccagaacactaccgcgcgcaacggtcacgggaaacccacgatcaacatcgacaccccgccccggcgtcccccggccgggtgtttctccggcggcgaaggcgcgaccggcgcgggccggcgcgaccgcccggcggaccccgatcgcctggcgggacggacgcggctcaacagtcatgcgacacccgaccatcggggtacgacgattccgtgcgggcgggccggacggcagaatcggaccatgccggaccgcctggacgaataccgccgcaagcgggatcccgcccgcacccccgaaccggtgccgcagtcgccaccggcgccgcgcgagccgggccgacgcttcgtcatccagcagcaccatgcccggagcctgcactgggatgtccggctggagcgggacggcgtgctcgtctcgttcgccgtcccgcgcggcctgccccgcgatcaggcccgcaaccacctggccaaacacaccgaagaccacccgttggagtatctggacttcgccggcgagatcccggccggcgagtacggcggcggccggatgaccatcttcgacgcgggcacatacgagaccggcaagtggcggtccgacgagatcagtgtcacgtttcacggtgaccgcacgaaggggcgatacgtcttcttccagaccgacggggcggactggatggtccgccggatggatccgccggagccgggctgggagccgatgcccgccgacctgagtccgatgctggccacccgggccggcacgctgccgcccgacgacgccgactggggctatgagctggcctggggcggccagcgcgtactgacgtacctgagcggcggaagagtgcggctgagcggacccggcggcaaagagctgatctcgctgtttcccgaggtccgggccttgggcccggccctcgctccggtcgaggcgatcttcgacggcgagctggtggccttcgacggcacccgtccggcggccgaccagaccgctcgcacggccaggaccagaaacccccgacccgttcaattgctgctgtacgaccttctctggctggacggtcatcgcaccaccgagctgctccgctacgccgagcggcgggaactcctggacgatctggccccggccggcccgcactggcagaccccgccgtacttcccgggcggcggtcgattcgccctggacgcggcacgttcgcaaggcttgtccggggtcgtggcgaagcggctcgattcgccctaccttcccggacgcacgacccgattgtggctggatatcgaggtgagttga

SEQ ID NO: 1902 - DNA, 1416 bp, Actinoplanes utahensis
atggcgggggttgccggcgaccgcagtggaaagggcctcgacttcacgatgcatccgtccccgtcgtcatccccggtcgccgatccgtccgccgagctgtggcagtccgcggtccgcgtgctggacaccaactggtccggcgaccacaccgtgccgtcgcgccgcctctacccgcatcagtggagctgggacgccgcgttcatcgcggtcgggctggcctacgtcaaccccacccgggcctggcgggacctgcgcagcctgttcgaggcacaatggccggacgggcgggtgccgcacatcgtgttcgacccggcgaccgccgaggacgactacttcccggggccgggtttctggaacgtgccggtctacgccggccggccggcgcggcgcagcaccggcctggtccagccgccgctgcacgcgctggccgcatgggaggtctaccgccacgcggcggcgcacggcgcggcctgcgtcagcgcggcccgcaccgagctggcctggctctacccgcggctggtggcccagcaggagtatctgaccgagcggcgcgacgccggcgggaccgggctggcctccatcgtgcacccgtgggagtccgggctggacaacagcccggcgtgggaccaggcgctggccgcggtgccggccgaccacaccctgctggctcgctatcagcggcgggatctggccgtgtcggacgccgcgcaccggccgaccgacgaggattacgcccgctatgtcgggctggtgctcagctaccgggactccggctattcggacagcgagctgatcgagcggcacccgttcgtggccgagtgcccggcgtacaacagcatcctggccgtcgccgaactcgccctggcgcagatcgccggagtgctgggccggccggccgacgccgggcggcaccgggaccgggcccgggagatcaccacggccctgtcccgccggctgtgggatccggcgagcgcctcgttccgggtccgggacgcacggaccgggcggctcagcccggcgcactgcgtgagcggcctgctgccgctgatgctgccggacctgccggccgagcaggtgcaggcgatcatggcggatgtccgctcggagcgtttccggctgccggtgccgagcgtggaccggacgtcgccggccttcgacccgcaccggtactggcgcggaccggtctgggtgaacgtgaactggctgctgcgccgcggcatgctggtgcacggtttccgcggtgcggccgaggagctgcgccgggcgctgctgcggctggtgcacgagcacggccactacgagtacttccacccggagaccggagagggactgggggcgccgaccttcggctggaccgcggcactctgcctggacctgctcgccgaccgctcggcgcccgcgtactcccggacctag

SEQ ID NO: 1903 - DNA, 1086 bp, Actinoplanes utahensis
atgagtcagcgggtgcggggcgtgatcgcccgggcgaaggggaagccggtcgaggtgaccaccatcgtggtgcccgatccgggaccgggcgaggccgtggtccaggtgaagacgtgcggggtctgccacaccgacctgcactaccgcgagggcgggatcaacgacgacttcccgttcctgctcggccacgaggcggccggcgtggtggaggcggtcggcgccggggtgaccgacgtggcgcccggtgacttcgtgatcctcaactggcgcgcggtctgcggcacctgccgggcctgcgccaagggcaagccgtggtactgcttcgccacccacaacgccacccggaggatgaccctggaggacggcaccgagctcgccccggccctgggcatcggcgccttcgccgagaagacgctggtccacgcgggccagtgcaccaaggtcgacccgcaggcccgggccgccgcggtcggcctgctgggctgcggcgtgatggccggcctgggcgcggcgatcaacaccggcggggtgacccgcggcgactcggtcgcggtgatcggctgtggcggggtcggcgacggcgcggtggccggcgcggcgctggccggggccaccacgatcatcgcgatcgacaccgacgaccggaagctggagtgggcgcgcggtttcggcgccacccacacgatcaacgcccgggaccacgacgtggtcgagcgggtgcgggagctgaccggcggtttcggcgccgacgtggtggtcgaggcggtcggccgccccgagacgtaccggcaagcgttctatgcccgtgatctggccgggacggtggtgctggtcggcgtgccgaccccggacatgacgatcgagctgccgctgctcgacgtgttcggccgcggtggcgcgctgaagtccagctggtacggcgactgcctgcccagccgggacttcccgatgctgaccgagctctaccggcagggccggctcgacctggacgcgttcgtcaccgaggagatcccgttggacggggtcgagcaggcgttcgccaagatgcacaccggtgaggtgctgcggtcggtggtcgtcttctag

SEQ ID NO: 1904 - DNA, 450 bp, Actinoplanes utahensis
atggacgagccccgctggttgaccgacgagcagcaggcggtctggcggagcctggtcgaggtgctggtcaaggtccccgcggcgctggaggcgcagctgcagcgcgacgccggcctgacccacatgggctatctggtgatgatgacgctctccgaggatccggatcgccggctcccgatgagtcacctggccaagcgggcctccgcgtcgctgtcccggctctcgcacgtggtcgcccggctggaggagcggggctgggtgcggcgcgagcggcatgccggcgacggccgggtccagctcgccgtgctcaccgacgaggggttcgcgaaggtggccgccacggcgcccgggcacgccgcggcggtgcagcacctggtcttcgaccggctcaccccggcgcaggcacggcagctcggcaagcttgctgaagcactgctgaaaagaccgtag

SEQ ID NO: 1905 - DNA, 1659 bp, Actinoplanes utahensis
atgaccgtgcccgaagaacgcgagcgttgggcgcctccgaccgcctcgctgcccgagccgcgcccgccggtcgaggaccgcgccgcgtggttctcctacaccgcggccagtgatcagatcgtctggtccgcgccgctgtccgcgatgctcggccgggtgcccgccgaccgggagcggacccgcgagctgctgacccgctacgtgcaccgggacgacctggccaccgcgctcggcgcgatcaccgaggcgtggaccacccggacgccggtgcgggccacggtgcggttgatgcgcgccgacggcggctggttcgatgtggactgccggctggagccgatgatgagcccggacggcacggtccgcggcatccgcggcacgatccgcgacgtcaccgaccgggaacgcgcccgccgcgaggacgtccggctcacccgtcgcggggagaccgtccagtcctcgctggtcgaccccgacccggtgaccgggctgctgacccgggcccggttcgccgacgagatcgaccgggcgctgcgccgggcggccggtgcgttgctggtgctgcgggtgcagggcgagggcacgggggaggagctgctgcgcggcgccgcccggctgctggagtgccgggtcgggccggaccggctgctcggccgggtcggcaccgccgagatcgcggtgctgctggccggtaccccttggtcggcggcccgcaagcaggcggccgcgctggtcgacacgatgcgcgcggagtccggggcgctggtctggggcggtctggtccggttccggccggacgccgaggcgggcagccacgatctgctgatcgacgcggagcaggcctggcggcagtcccgcgaggcggaacggccactcaccctgatcgcgcacccggtgccggcccgcgaccggcagggctcctaccgcacccgggtggccgacgcgctcggcaccgaccggttcaccctctactcgcagccgatcctggagctgcagagcaaccgggtgacccgacacgagctgctgctgcgggtgctggacgaggcggagggcccgcagtcgccgatccacgtgctggacaccgcggaacgcctcgacgcggtcttcgacatcgacctgtgggtggtcgagcgggccatgcggctcgccgccgagcagcccgggatgggcctgcagatcaacctgtccggccgctcggtcggcgacccgcggctcaccgacgaggtggaacgcctgctcgcgcagtaccgggtgaacccggagcagctcaccttcgagatcaccgagaccgcgctgatcgggaatctgagcgaggcccgccggttcgccgaccggatccgtgacctgggctgctcgctggcgctcgacgacttcggctcgggctacgcgtcgttccgctacctgcggctcttcccgatcgacctcgtcaagatcgacggggagtacgtggtggatctggtcggcaacccgcaggaccaggtgctggtccgggcgctggtgcaggtctgccaggcgtacggcatccacaccgtcgccgagttcgtccaggacgacgccaccctgcggatgctgcgcgagctgggtgtcgattacgtccagggatatctgatcggccgcccctccccggtgatcccgggtgagctgcccgacgccgccctgtag

SEQ ID NO: 1906 - DNA, 669 bp, Actinoplanes utahensis
atgcgtccagacgttctcgtcggtcccagcgattggctggtcgagcagttcggcgacaagatcgccgacgagctgtggactcgcgtgcccgaggcgctgagcacggcaatcgatcgtgaggtgcacgcgcacccggccatgacacagaccgtggagcgcgtgttgggcaatccgcgttggccgctgccgtacgaggagctggtgctcttcctcggcacgctacccggagccgagatcatcagcgtgccgcggtcggtctatcagctggtgctgatcaacgggcacatcgtggtcccgtggtgctacgggcagtccgcacgcctgtcgatggccgacgcggaggtgggccggtcgttcggccggctcgcacgggagctgctcgggcggttcgggccaccctggcgccgctcgcccatcgagtcgccgctgccactggacgcggtcgacgaacgcgaggtggccaagatctgcgccgccatcgcccagatcgacccgaagcccgaggtggtcatcgccgggtacgccggggcgcccaacctcggcctgctccgcgcctgcctcggcgaggtcaaatccaccgacaacggcacgctcaactggagccacctcgacgacctgccgctcccaccgccggtcatcccgcgcccccggcgcatgcagttcccctga

SEQ ID NO: 1907 - DNA, 267 bp, Actinoplanes utahensis
atgaatgacgcgtacgacatggacgacgtgcggtttctgatcggtgagtggcggtcggaggcggcccagcgggcccgctcggcacgcgagctgtccgcccggatccatcggccggccggtacggcgcgcagcccggacgggctggtcagcgtcaccgtcgggccgcgtgatgagctgctcggatgggagctggggacgagatccgacgacggacgccggcggacaccgccgcggtcgtcccgacgaccgtgcgggcggcgcgggtga

SEQ ID NO: 1908 - DNA, 369 bp, Actinoplanes utahensis
atggatcatcgtgaatggcactggccggctccgaagctggcggccttgcgactcggccgccggctggcgatgctggtcccggcctcgcagccgcatcgctggtcgttcgtgcacatcgttccgagcggccgttccgcggacgaggacgcccttcgcgcgggcgcggcgcgcagtgacaccggccgcagcttcctggtcacgcagtgggagtacgaagcggaccggctggagggttacgacccgccgggcgccgtccggctgcgctgcgcgcaggccgccgacgagtccgaactcctcactgtgctgcgcgaatggcggctcccgccggacggcttcgactactcctgggacaccgtcgacccgggctga

SEQ ID NO: 1909 - DNA, 1746 bp, Actinoplanes utahensis
atgacagcccgcagcgtacccaggaaaggtttcgacaatgcatgccggcccgccgcgggacggatcgacaccctttcgagggatcccgggcgcggcgtgccgcggcgcccggcagaccattccggcgcgcgatccgcggtccgctcccgcgccgccgaagatgtccgccgtacggccatttccgctgccccgagggccgatgcagtttcggtatggccgaatgtccgcccgccacgcgagacgaaccgttcccgcgtgcacccccaccgccccaggcaccggctcccacaggggccacccgcgtccccgcgaagtgctcagcgccgcccgtccgcccaggcagcggccgatgccaccggtccggccggcgtcggcaccgacgggcggcagccggccgagcgctgtccacaccccggattttcggtcggccgatcgcgctaccgtgcccgggtgagttacatcagcccggccgaggaggccgccaccgtgatcgccgcggtgctccgggatctgcggtcccaccggcaccggggcgtcgtcgtcgactcgccgcccggcgccggcaagtcgactctggtggtgcgcgcggccggggagctggccgccaccggcgagcccctgatgatcgtcgcgcagaccaacgagcaggtcgacgacctgatcgagcggctgggtgcgcgctcccccgacatcaccgtcggccgcctctccgcggtcgactacgagcgctccgaccgggtcaaggagcatccgcactgccgtgtcgcggccaaggtggccgacctggccggtcctgcggtcaccatcggcacggcggccaagtgggccaccgtcgccgagggcagctggccgtgggcgatcgtcgacgaggcctatcagatgcggtccgacgcgctgctccgggtcgcgccccggttcgagcgggcgctgttcgtgggcgaccccggccagctcgacccgttctccactgtcgaggtcgagcgctggaccgggctgtcctgggatccgatgcagagcgccgtcgcggtgctgctgcgacacaaccccgagttgccggtgcaccgactgccggtctcctggcggctgccggcgtccgccgcgccggtggtggccgaggcgttctatccgttcaccggtttccgctccggcaccggcccgggcgaccgcaccctgcatttcgaggcgcccggcgagactccgctggaccaggtgctggacaccgcggcgaaaagcggctggggcctgcacgagctgcccgcccggttcaccctgcgcaccgacgcggaggcggcggcggcctgcgcccagctcgccgcccgggcgctcgcccgtggcggcgtcaccgagtccgaggccgggtcgggtccgctcaccccgggtcggatcgcgatcggcgccgcgcaccgcgaccaggccgcggcgatccgcgcactgctgcccccggaggcggccggcatcaccgtcgacacggcgaaccggctccagggccgggagtacgacctcaccgtggtcctgcatccactgtccggccggcgggacgccaccgccttccacctggaatccgggcggctctgcgtgctgacctcccgacatcggcacgcctgcgtggtggtggcccgggccggcatcccggagctgctcgacgcgcacccgtccaccgagccggtgcacctgaacgttccggtcaagttccccgatggatgggaggcgaatcaatcgatgctggcgcatttgtaccgtcggtaa

SEQ ID NO: 1910 - DNA, 1011 bp, Actinoplanes utahensis
atgacgcccaacggggcttatcgaccgattctccggccacgtcgcggcgagttcacggcgctggcacacctgtccgcggacgaggctgcccggatcacgccgatcgtcgagttggatcccgaagtcagcatcatcccgctgctccgggaactacgaccacggaccggggaactggcgctcgacttcgggcacgtgccggagccgacggcgaccgcggagcagccactcgccctggcggagcgactgttccggctcggggtggccacggtgccggtgctgcggccgtacgaaagcggtcgtcgcctggtgtcgcacggcctggccgcgcggatgcaccggcggcgcgcggtcctgcggatccaaccgcacgtcgacgcggggaatccggcccgggccgacgcgatcgccgaccgggtgctggccatcaccgcactcgacccgaacgaggtcgacctgctgatcgacctggccgagacgccctgcctggcgcacgccgacgaggtcgaggaacgggcccgccgggtgctgcgctgggcccggttgatgccgtggcggtcggttagcgtgggttccggtgcgatgccgcccaacctggacgacctgcccaccgaccggccggtggcggtcggtcgactggacgcccgggtatgggaacggctcggcgaccccggggtgggctacgcggactacggggtcacctcaccggtgcgccggctcggcgtgcagcatcaccggcagttgccgacgttgcggtacaccaccgagtcggactggtggatctaccggtgggcacggcgcggcggccgcagcgacgaccgctgccacgacctgtgccgcaccctggtcacctcaccgcagtggccatccgcgggcgcccgattttcgtggggcgacgccgagatcgcccgccgcgcccgcaccgcgcgcggggcgggcagctcggcgagctggatcgcctggagcacgtcccaccacatctcccacgtcctacgcaccctccccacgggctga

SEQ ID NO: 1911 - DNA, 1788 bp, Actinoplanes utahensis
atggtgctgcagtgggacgtcatcggcgacaccgagcagagtgtgctcgccgatccggtgcgcctgcgttcggtgcggcggctcggtgagcccgggcccgacgaggcgttcgaccgggtcgcgatgctggtccgcaagctcgtcgacgcgccgctcggagtggtcagcctggtcggcgccgagcgtcagcatctggccgggcaggtcggcatgccggagccgttcgccagcgggcgcagcatgccgctgacccactcgttcagccggcacgtcgtcgtcaacggccgcctcgtggtcatccccgatgtccgcgtcgacctgcgcacccgcggcaacccgtcgatcgagcagctgggtgcgatcgccttcgccggcgccccgatcaccgacccggacggcctggtcgtcggcgccctgtgcgcggccgaccacgaaccccggaattggacgcagagtgagatcaccctgctcaccgagctggctgcggtctgttcgtcggaggtctgcctgcggatcgcccgggccgccgccgaggacgcccggcgcgccgccgagtccgcgcaccaccagttggagctgctcaccgacctgaccgagtcactggccgccaccatggacctggacgaggcgatgcaccgcctcgggagcctcgtcacggcccggctcgccgactggtgtgtgatcacctatggtgaccagccgcgggtcgtcgccgcccatcgcgacccgacccggaacgccgacatgtcccggctcgccgagctgaccgcccggtcccgcaccgacctgcgcaccctggcgaccgcggcccgccgcccaccccgccgcgccgaaggcaccgacctgctccgcggcaaggtcagcgacaccgagatcgccgagctcgccaccgtcgccggcctcggctcgtcggtcgtggccccgatcatctccccggtccgccgccgcgtcgtcggctccgtcctgctggtcaacggtcccgaccaggccccgttcaccgccgccgacgaacgcgtcgccgccgagatcggccgccgcgccgggctggccgtcgagaacagccggctgtaccgcgagcagcgccacgtcgccgaggtcctgcagcgcagcctgctcaccgagctgcccgacctgcccggcgtcgaactgcacgcccggtacctgcccgcccaggacggcgccgcggtcggcggcgactggtatgacgcgttcgcccagccggatggcagcgtgatggtcgcggtcggcgacgtctccggccacgacatcgaagccgccgccaccatgggccagctgcgcaacctggtccgcggcgacgcctacggccgccctgacgagccgggcgccctgctcacccagctcgaccaggccctgcacggcctgcgcgtgccggccgccgccaccgccgtgctggcccgggtccgccagtcctggtccgggtacgcgatcagcttcgccaacgccggccacccgccaccgctgctcctgctgcccgacggccgggtacaggtgtggtgggtcccgccggaaccactgctcggtctccccgttcccagcgaccgcaccaccaccatccgttacgtgccgcccggctccaccctggtcctgtacaccgacggcctggtcgaggaccgcgaccagctcctcgacgacggcgtcgcccgcctggccgaacggctgcgggaaagctccgccttccccggggacgaactgtgcgcccggctgctggaggtcgccccgcgccgcaccgatgacatagccctcctgctggtccggctcaccggctga

SEQ ID NO: 1912 - DNA, 132 bp, Actinoplanes utahensis
atggcgatcctgcagttgatcctgaaaggggtcgccttccggatgatcggccgctctgtcgaccgatcgggtgaccggaaacggatgatcgggtcgggtgcacgacggcgccggcgggcctcgcgccggtag

SEQ ID NO: 1913 - DNA, 1626 bp, Actinoplanes utahensis
atgcctgtccacctgcgaactctccgtctactgtcggcacgaggcgaacgggacgacggcggcgctcggccggccggtgcgcgaggcgctcggcggggtcgagaccatcggcgaggtgctggcgctcgcctccggcgcgcaggcgcccaccgcggagcaggaggaggcggccgccctcctgcgggccgccctccggctccgcgaagaagccctttcttgagtacgctcaccgcgctcgcccgggcacaggcggtcgccgccgggcgcgcccagcccatcgccaccgtgcggcacctgcacgtccacgagcatccgctggtgctgatcccgctcgcgatggccggcgaagccaacgcgccgctggccgccctggtcggcaccgacccggctacgccggaactcctggtggtcagccagccgcgcgaccgcgacgagcggttccggttcgccgaccgtctcggtcagatcattgcggcgtacgtcgattccttcgccgacgtgaccgaggacgtgcccgtcgaccggggcaaggacgtgcgcacccggtacgccgacgcgccccagatctgggtgccgaacccggccggcgtcgacttcctgcgcctgttcgggcgctccacccggttccgcaccgtcgacggcgaacacccggtgccggccaccgtgccgctgctcggtcggtggctcaccttcttcgccaacagcgccgaagtgcccgggtcggcgctgctggtcaacgccgtgcaggcgctcgggctgcactgggcgaccgggcagagcggcaccgaggacgcgcaactcgcggtgctgatggcgtggatcgaggagggcgccgcggcggcccgggcggtcgagaacgggccgatcgccgggccggccaccgacccggacttcgacaaccgggtgctggcgccactgatcgagcgacgcgcgccggagatgtccgacgtgctccgtgacctgatgacgcccacctgggaacggatgtggcgggtgccgaacctgctgcgccggctgccggtgggggagcgggtcgggctgcggtgggacgcggacaaggacgcgtacaccgcgttcgcgcagcacctggccgagggcggggcgccgcagccccggcgggacggcgcggtcgcggcggccgcccggctgcagcggctggagacggcggcgtcccggtacgcggtgcagcgggccttcgacgatccgctggtgctggcggagtaccggctggccggggccgcgttcgccggggtggtgacgctggccgcgccggatcggatcgacgacagcgggaaacggccggtgctgcggccgcggatcatggtgcggaccggggagccggtccgggtggcggcgggcacgtcgctgacctcaccggcgcggccgtcccagaaggcccgggtgatctcggtgacggcggtcgggccggagttcgacgtgctgctggagctgtccggggggatggggcgcaagctggtggccgagccgggcagtgtgccggtggtcggcgagcggctcatcctgaccaccctcagcgaggagttccgccggggcggcgcgctgcctgatccgtccgaaacgccgtggacccacggcggtccacccaccgtcgaggtgcccatctga

SEQ ID NO: 1914 - DNA, 285 bp, Actinoplanes utahensis
atgccgaaggccatctggaacgacgaagtgatcgcggagagcgacgacaccgtggtgctcgaggggaactattacttcccgctcacctcggtccgtgaggacgtgctcatcccctccgacacgcacaccgtctgcccgtggaagggcaaggcgtcgtactactcgctgcgcgccgacggacggaccgccgccgacgccgcctggtactaccccgatccgaaaccggacgccgcggccgtccgggaccgcgtcgccttccgcaaagacgtgcaggtggagatctag

SEQ ID NO: 1915 - DNA, 393 bp, Actinoplanes utahensis
gtgcacgctgagccgagtccccgcctgccgcgccgcggtccggccccggcggtcgaccagatggacaacgccgagctggcccggatggtcgaggccgagcacccgtaccggggcaaggcgcttttcgagctctgtgaccggctggccggtgacgacgacgcggtggcgaaggtggcgatgctgacccggctcacctcgctgcgtcgggcgcgcctgttcgaccgggtgtcgctggcctggtcggcgatcatcgcgctgctggccgcggagaccgagaacgcccgggccgaggcgtatgccgccttccgggcgctggatcccgccgagcagcgggacatgctggactacctggaggtgtccgcgatcgaggaggcccacccgcgcatcgcgtga

SEQ ID NO: 1916 - DNA, 474 bp, Actinoplanes utahensis
gtgctgggtggagagctgggcgtcggtgacggcgcatcccgctccgggggtgcggccgccgcgctggccgaccgggtggcgacgctgcgtgcgtcggcggccggggccggcggtgcggtgcgggtcaccgtggcgagttcgggtaacgtgaccgggctggagctggacgagcggtcgctgggtctgggcgcgccggggctggccgccgagatcctgttgaccattcaccgggcgcaggcggcgctggccggccgggtggccgaggcggtcgcgtcgacggtgggcgcggagaccgagacgggtcgtgccgtgctggacggtttcgcgtcccggttcccggctccggacgaggtgccgccggccccggtgatgccgtcggcgccgccgttcccgtcgttcagcgccgtgccgacgttgccgcatcagtcgccgggcaacggctacgagggtgggcgggacagtcgtgcacgctga

SEQ ID NO: 1917 - DNA, 1674 bp, Actinoplanes utahensis
gtggcactccgcgatgatcgacgtctccgaatcctccctggccgagctcgtcgtccgcgacgattccgccctggaccgctgcctgcgccggctggccgccacccgatccgggccgagcgaacagatcgccggcttcaactcggcgctctgaccaccaggatcccgttgcgccagttccgcctcgccgacgccgccctcgccgacctcggcgccggacggccgtcccccgccaccctcggcctgctgcgccgagcgcagctcagccgcaatctgctcctcctgcggcagctgcggcgatctgtcaccgaaaagccgatctggtacgcgcgactggccgccctgtcgccccaggacgcccgcacccgcatcgtcgatccgatgaccggcctgtgggccgcccacgccctcaccacacccccacacggcctggacgcgccgctggagccggtcgggcacctactcacggtcacctgcgccgggcgggaattgaccgtgcggctggacgaccggagtcccctgcggcacctgctcggcctgccaccggccgacccgttgaccgccgccgaggtcactcactggcaggagtgcctcgaagcggcatggcggattctggtcacccggcacccggccgccgcggacaccctcgccgccgtgctgcgggtgatcgtcccggcccgtcctgatccactcgccgaaggcgtgagcgcgacgtcggccgaggcgttcggcgcggtcgccatgtccaccccgatcaccggcaccgggatggccctggccctgctgcacgagacccagcacagcgtgctgaacgcggtgaacggcctcttcgacctggtcgaacccggcggcgcacccggctactcgccgtggcgggaggacccacgcccggcgtccgggattctgcacggggtctatgcgttcctggcggtgacccgcttctggcgcaccgcgatccgcgcgggtggggctccggccggcagcgaggcggagttcgagttcgcccgctggcgcaccgcggtccacgaaaccgccggccgcctcctacgcgccggcgagccgacgacgggcatagcacggcaggctgccggcgagccgacgacgggcacagcaccgcaggctgccggcgagccgatcaccggcgaagcacgaccggctgccggcgagccgaccgcggtcgggacccgaccggctgccggcgagctgaccgcggcggggcggcggctggtcggtgcgttgcgggacgaggtggagccgtggctggcggagccgctcgaccccgaggtgacccggctcgccgacctggcccggaccgatcatcacgcgcgctggcgtctgcggaacctcgctattccggcagagggactgaaagcgctcgtcagcgcgtgggcggcggaacgtcccgcaccggccgtcgagtccacggtggccgaacgaccgcgacgggaggagccccaccaccggctgcgactgatccgggcccggctgcgaggggatcaccggttcccggcggaggcgcgggagaccacgacagcggccgcggacgacgcctgcctggatgggcgatggcaggacgcgctcacggcgtacgcaacaattcttggccaggaccgcgacgacgccgcggcctggagcgggctcgccctcgtctcgccgctgcccgccctgcgccgctag

SEQ ID NO: 1918 - DNA, 1680 bp, Actinoplanes utahensis
gtggctcgcaaggctctgttggaccggacgcggcgcgtcgtcgacgacggcgtggtgctcgcttcgctgctgctgctggtgtggccggcagcggacgctacggatgtgacgttgacgggtcggctggtgccgctggccgcggccctctgtctggggctggccatgctgctggtggcgccggaccggccggtgctgcggttcgccccgacggcggcggcgctcgcggtcagcgggatccggcacgtgcagggggagctcgccccgggagcggtgtggctgctgctgggcatggccgtggcggtgctgttccgccgctgggcggtggccggctcggacaacgcgctgatccgggagatgacttcccagcgggcgctgctggcccggcaggcgtaccgggatccgctgaccggggtcggcaaccgcaagatgttcctggagcgggccgatcatgagttgtccgcggccagccggacgatgaccgcggtgatcgtggtggacctggacggtttccgggagctgaacgacgagttcgggcacgaggtcggcgacggtctgttgcgggccgcggcggaccggctggccgcgaacgtccgggccaacgacgtggtggcccgcctcgacggcgacgagttcgtggtgctgctccccggggtggaggacgagcaggccgccgtcgcggtggccgagcgggtgctgaccgagctgcaccggccgctggaggtggacggcatcaagctgaccgtacgggccagcgccggggtggcgatcacggccggcggcgagaccatcgaccatgtgctgcgcgaggccgatcaggcgctgcaccgggcgaagctggacggcggcggcgcggcccggcggttcgacccggcgctgttcgccctggaggagcagcgtcgcaaggccgagggtgacatcatccgggcgttggacctgggcgagttcgaggtgcactaccagccgatcgtcgacctggacggggagcacacggtcggtgtcgaggcgctgatccgctggcagcacccggagaaggggctggtgccgcccgggctgttcctggagctggccgagcagctgggtctgctgccgcggctgggcggctgggtgctggaggaggcctgccggcaggcggtcaactggcagcggcagttcccgggtttcgagatgaacgtgaacctgtccgcctcgcagctgagcaacccgaatctggtcggcgaggtccgcgcggtgctggagcgcaccggtctggagccggagcacctggtgctggagctgaccgagtcggtggcactggtggacctggtcgagtcggcgcggatcctgaccgagctgaaggagctgggggtgcggatcgcgctggacgacttcggcaccgggttctcctcgctcagccacctgagcgcgctgccggtggacgtggtgaagatcgaccggtcgttcgtgcaggcgatgccggagagcggcggggcgtcggtggccgaggcggtgctgcacatcgcccgcaccttcaacctggcgccggtggccgagggggtggaggacgcggcccaggcggagtggctgcgggacctggcgtgcggccgggcccagggttaccacttcgcccgcccgatgccggccctgggcgtcaccgagctcctcgacaagcaggccgacaaggacgtcccgctcgcctcctga

SEQ ID NO: 1919 - DNA, 2421 bp, Actinoplanes utahensis
gtgccgatccgtggcggtctgccgccgcgcaatccccgtttcgtgggccgtgaggaactcctgacccgcgtgcgcggcctgctcggcaacggtccggtggtgctgctgccgagtcccgaccatcaactcggcgggacaggacgtacccaattggcgatcgaatatgcctatcgccacgcggactcgtacgagctggtctggtggatcccggccgagcagggcgccgggatgcgcgccgcgctggccgggctcgcccggaaactgggactgccggaaacccgcgatctcaaccgcaccctcggcgccgtccgggacgcgctgagccggggcgagccgttccggcactggctggtcgtcttcgagaacgcgaaccggcccgaggacatcatgccgtacctgccctccggcgccggccacgtgctggtgaccagccgcaacccgcgctggacggccgaggtggcgcaggccctgccggtcccggtgctggaccgggccgacgccaccgacctgctgcgcggccgtgccccggagctgtctccggaggacgccgatcggctcgcggcccggctcggcgacgtgccgatcgcgctggacctggccgccgcggtacgcacggccaccggctggccggtcgccgaatacctggagcggtacgagcgtcgggccgccgaactcgccttccccaccccgatccgggtgacctggggcctggccgccgacgcgctgggcgaggcgtccccggccgaccgggtgctgctggagctgtgcaccttcctggccagcgcgccgatctcctggcagctgctctgggcggcccgcacctgcccgctggacccggaggtggcccgcaccgtccgggtcgagcgccggctgcgcgcggcgatgcggcggatcgcccggttcgggctggccgggctggatccgtccggggaacggctcaccgtgcacccgctgatccgcggcatgttcggccaggaactgagctccgagcggcacgccgagctgctgcgcacggtccgcgcgatgctgtccgcggccgaccccggcgacccggacaacccggccggctggtaccggtacgccgagctggccccccacctgatccactccgacctgctgggcggtgacgccgaggaggtccgccagctggtgatcaactgcatccggttccactacgcgcgcggcgactacgactccagccgggaactcgccggctcggcggtggcccgctggcgcgacgccctcggcgaatccgccgagcagaccctgctcgcctccttccacctggcgaacgcgttgcgcgcggtgggtcggccggccgacgcgcgggcgctgaacctgcagacgctgcgcacccagcgggaggtgttcggcgccgacgacgaggcgaccctggcgaccgccaacagcgtcggcggcgacctgcgaatgcagggacacttcgggcaggcgcggcagctcgacgcggacaacctggtccgctaccgccgactgttcggggagagcttcccgaccgcgctgcgctgcgccaacaacctcgccatcgacctgcggctgctcggcgacttccggggcgcccgggcgctcgacgagcagaccctgcggcatcggcatgccatcttcgtcgacgggcacccggaaaccctggcgtcccgggcggcgctcgcctacgacctgttcggcctcggcgactacgccggggtcggcacggtgctggccgggcaggccgaacaggtcgccgaagaccacccgttcgcgctctgggccggccggctcaccgcgatggccgcgcaccgccggggcgtcgccgcggcccgcgagatggcgaccgagaacctggccgcctgccgtcgccgattcggcgacctcaacgtcgacaccctggccaccgcggtgtcgctggccaactgcgtgcgcgcggccggcgacctggccggtgcccacgaactactggaacgcgcggtgatccggttccacgcggtgctcggcgacgaacatccgttcaccctcgccgcctccgccgggctggccggggtggtgcgggcggccggccggtacgccgaggcgcggaccatcgacgaggaggtgctcggcggcctgcggcgcagcgtcggtgccgaccatccgttcacgctcagctgcgccaacggcctggccggggacctgttcgcggccggcgaggcgcagcaggcccgggaactggccgccgacacgctgcgccggtcccgggtggtgcgcggcgccgaccacccggacacggtggcctgcgcgtggaacctcgccctcgccgacgccgacgagacggcacagcagcaggcgctgaccgggctggccaaagcgtacggcgacggccacccgatcttccgggtgaccgccgccgggcaacgcctggagacggacatcgacctgccgccgttgtag

SEQ ID NO: 1920 - DNA, 303 bp, Actinoplanes utahensis
gtgacgagcctggatgccgacggcaacacgaccaccgtttcgctgcgcggtgagatcgacgtgctgaccgtggagcaggtccgggtcgctctgggcgaggcggtcaccggccgcccgcggcagatcgtggtggacatggccgcggtcgcgttcatcgactcgaccggcctcggcgcgctgatctccggcttccagcgggcccgtgaccagggcatcgccttccagctcgcgcacccgagccccaacgtccgtcagattctggtgctcagcgggttcctggaggtcgttcaggtcaccccgtga

SEQ ID NO: 1921 - DNA, 1284 bp, Actinoplanes utahensis
gtgaaagcacgcctccaccccgcctggtcggtcgccgccgtcgcgttcatcgccctgatcggcgcggccggcttccgctccaccccgtccgtcatgctgcagccgctgcacgccgagttcggctggtcgctgggcaccatctcggccgccgtctcggtcaacctgatgctctacggtctgaccgcaccgttcgccgccgccctgatggcccggttcggcatccgccgggtcgccgccgccgcgctcggcctggtcgcgctcggctccgggctgaccgtgctgatgcaccacagctggcagctgatgctctgctggggcgtgctggtcggcctcggcaccggctcactcgccctcgggttcgtcgccaccatcaccggccgctggttcgtcagacatcgcggcctggtcaccggcatcctcacggccggcggggcgaccggcaacctgatcttcctgccggtgctgtcccggctcgtcgagtcgcacggctggcgcaccgcggccctcaccgtgtcggcgatcgcgctgctggtcgtaccgttgatcctggggcggctgcgggaccacccgcaggatctcgggacgaccgcgctcggcggcatcaccgaaccgcccgccccgcccgcgggcaacgccgtccggaccgcgctcaccgccctccgcgacgccggccggacccgcgcgttctggctgctcgccggcggcttcgcgatctgcggggcgaccaccaacgggctggtcggaacacatttcatcccggccgcccacgaccacggcatgccgaacaccacggccgcgagcctgctcgccctggtcggcgtcttcgacgtggtgggcacgatcgcgtccggctggctcaccgaccgggtcgacagccgcgtcctgctcggcgcctactacgccctgcgcggcctgtcgctgctcgtgctgccgtcgatcctggccgccaccgcgcaccccggcatgctggtcttcatcctgttctacggcctcgactgggtcgccaccgtcccgcccacggtcaccctgtgccgggagtacttcggcgccgccggcccggtcgtcttcggctgggtcttcgcctcccaccagatcggcgcggcgatcgccgccaccaccgccggcctggtccgcgaccagctcggcgcgtacacctgggcctggtacggcgcgggcgccctcgccctcctggcgtccctgctcagcctgatgctcttcgccggcaaacacctcaagccactcgcccccggcctcggcctcgccgttcccgccgccaaggcctga

SEQ ID NO: 1922 - DNA, 972 bp, Actinoplanes utahensis
atgcgcaagaatcgagccatgccccacgtgatcgcggtcctggtcctcgacggtgtcgtcccgttcgatctcggcgtgcccgcgcaggtcttcggcgcggcccgggacggcgcccgcaaccggttctacgagctgctgttctgcggcgaggggccggtccgggccgaggccggtttcaccgtcacccccgaccacgacctgagcgtcgtggcccgcgccgacaccgtgctgatccccggcatccacctcggcggcccggtcaccgacggcagcctgcccgacgcggttcgggaggtgctgctggcggcggcccggcgcggcgcccggatcgtgtcgatctgcaccggcgcctcggtgctggccgccgccgggctgctggacggtcgcccggccgccacccactgggcctgggccagccggatcggtggcctgtatccgcgggtcgactgggacttcgacgtgctgttcgtggacgacggcgacgtgctcacctcggccggggtcggcgccggggtcgacctctgcctgcacatcgtgcgctccgatcacggcgccgaggtggcgaaccgggcggcccgccgctgcgtggtgccgccgtggcgggacggtggccaggcgcagtacatcgagcgcccggttccggccgccgcgaacagcggcaccgaaccgacccggacctgggtgctggaccggctggccgacccggtcaccctggaggagatggccgcgcacgcccggatgagcgtgcgcaccttcacccggcggttccgcgacgagaccggctccagcccgcggcggtggctgctgcgccagcgggtcgagcacgcccggctgctgctggagtcgaccgacctcggggtggacgtggtggcccgccgggccgggctgggcagtgccacggccctgcggcagcacctgcacgcgacgatcggcgtggccccgtccgcgtatcgacggacatttcgccactaa

SEQ ID NO: 1923 - DNA, 1707 bp, Actinoplanes utahensis
atggaggggtgtataccctgtgccgcgcctgaggactccatggaccaaaccttccgcccgctgctcgatgccctgaagcagatcggggtcgacccgcacgcggtcgactcggctgccgaggaggcccagcgcagcgggcgtccggtgcgggccgtcctgatcaacgaccaggtggtcaccgaggagcagctgacccaggcggccgccgcggcgttcgggatcaacaccctcgacctggtcggcttcaccccggacccgaccgcgctgaagcgcatcccgctgcccgtggtgctccggcaccgggtgctgggcctggcgatcaacgacggcgagctggtggtcggggtgaccgacccggccgacgtggtggcgctcgacgacgtacgcgcggcgaccggcatgacggtgcgccccgtggtggtggcccgctccgaggtccgtcgaatcatcgagaagctgcagcgcgacgacagcgacctgggtgacctggccggcgccgggatggacgactcggccgggatggccgcgcagcagaccagcaccgaggacgccccgatcgtccggtacgtgaacagcctgatcgagcaggccgtcatgaaccgcgcctcggacctgcacctggagccgaccgaggacgagatgcgggtgcggtaccggatcgacggcgtgctgcacgaggtggacatcgtgccgcgcggcgtgatggcggcgctgacctcacgtatcaagatcatgtcgggcgtcgacatcaccgagaagcgggtgccgcagaacggccggatcaccgcactgatccgggaccgcacggtcgatctgcgcaccgccaccctgcccacggtctggggcgagaagatcgtgctccgcgtgctcgacaccggtggcatcgacctggatctgcgcaaactcggcttcaccgagcacaacctgagccggttcgaggcgtcgttcaccaaaccgcacggcatggtcctggtcaccggcccgaccgggtccggcaagtcgaccacgctgtacgccacgctgggccggatcagcaagcccgaggtcaacgtgatcaccatcgaggacccggtcgagtaccgcctgcgcgggatcaaccaggtgcaggtgaacgtcaaggccgggctgaccttcgccgcggtgctgccggccatcctgcgctccgacccggacgtggtgctgatcggtgagatccgcgacggcaccaccgcgcagatcgccgtcgaggccgccctcaccggtcacctgctgctctccacgctgcacaccaacgacgcgccgggcgcggtcacccggctcaccgagatgggcatcgagccgttcctggtcggctcgtcgctggactgcgtgctggcccagcggctggcccggcggctctgcgactggtgcaaggaggcgtacgcgccgaccgaggaggaggtgctgggcgctcgctggccgctggaggacctcgccttcccgcaggtgctctaccgcccggtgggctgccgcaactgcgcgaacaccgggtacaagggccggatcgcgctgcacgaggtgatgccggtcagtccggagatcgagtcgctgaccatccgccgggcaccggccggtgagctgcgcgaggtggcgctcgcccaggggatgtacgacctgcggtcggacggtctggccaaggccgcgggcggtctgacctcgattcgggaagtttcccgggtcgctgtctga

SEQ ID NO: 1924 - DNA, 1122 bp, Actinoplanes utahensis
gtgaacacgatcgagcacgggacgcggcagccggagacggcggtcaaccccgacgacctcgccgtgctcgaccagatgttgatcaccctggtcgagtcgcgcggctcggacctgcacctgacggtgggctcgccgccgatgatgcgggtggacggatcgctgcgggcggttccgggttacggcaagctcaacgccgcggacaccgaactgctggcccgcgcggcggtcaccccggcgcagtggcagacgttccaggccgagcaggagatggacttcgcgcacagcatcgtcggcgtctcccggttccgcggcaacctctaccggcagcgcacctcgtgcggcgcggtcttccgggccatcccgcacaagatcaagccgctggacgagctgggcatgccggagtcggtggcccgtttcgcccacctgccgcgcggcctggtgctggtgaccggcccgaccgggtcgggcaagaccaccaccctggcctcgctgctcgacctggcgaaccgcagccgcgccgaccacatcatcaccatcgaggacccgatcgagttcctccacccgcacaagcgcagcatcgtcaaccagcgcgaggtgggtgccgacaccgacaccttcgccagcgcgctcaagcacgcgctgcgccaggacccggacatcatcctggtcggcgagctgcgcgacctgaccaccacggcgacggcgctgaccgccgccgagaccggtcacctggtgatggcgacgctgcacacgcagagcgccacccagaccatcgaccgggtcatcgacatcttcccaccgcaccagcagttgcagatccgcgcgcagctggcggccagtctccagggtgtgatcacccaggcgctggcgccccgcgcggacggcaagggccgggcggtgatctgcgagatcctgagcgcgacgccggccatccggagcctgatccgggagggcaagtcgcaccagatcccctcgttcatgcaggccggcagcaacgagggaatgctcgccttcgaccagcatctggccgaaaaggtgcgggagggcatcatcaccatgcagacggccaccgagatcagccactcgccggaagagctcaagcggcttgtcgggaggtcctga

SEQ ID NO: 1925 - DNA, 1236 bp, Actinoplanes utahensis
atgagcggcacgaacaagacgttcgcctacagcaccatcgacgcctcgggcaagaagtccaagggcaccatcgaggctcccaacgaggcggccgccacgcacatgctccagcagcggggcgaggtgccgctgggcctggtcgaggccggccagggtctgcagcgcgagctgaagatccccgggctgggcaaccgggtcaagctcaaggacctggcggtcttcgcccggcagttcgccaccatgacctcgtccggcatgtcgctgctgcgctctctgtcgatcatggaggagcagacctcgtcgccgccgctgaagaaggcgatcggtgaggtgcgctcggacgtggccgccggtggcgggctgtcggcgtcgatggccaagcacgaccgggtcttcccgcgactgatggtcgcgatgatccgggccggcgagacgggcggcatgatcgaccgggcgttggagcagatcgccgacagcctggagaaggacaccgcgctccgcggcaagatcaaaagtgcgctgacctatccggcgatcgtgctcggcttcacgttcctgctgatcgcggcgatgctgatcttcatcgtcccgatcttcgaggcgatgttcaagaacctcggcggcgaactcccggcgatcacccagttcctcgtcacgaccagccacaacatgtggtggatcgggccgctggtgctgggcatcgggatcggggcggccgcggcgtacaagcaccagcaccggaccagcgccgagttccgcctcaaggtcgacaagctcaagctgcgcatgccggtcttcggctcgctgttccagaagctggcgatgagccggttctcccggaacctcggcctgctgctcaacgtcggcgtgccggtcatgcaggcgctcgccgtggtcggcgagaccaccggcaacgaagtgatcaacattgccatgcaggacatccaggcgacggtccgcgacggccagccgatgtccggtgcgatgcgcaaccacaaggtcttccccgagatggtcaaccagatgatcgaggtcggggaagagagcggccagatcagtcagatgctcgacaaggttgccgacttctacgacagagaggtcgacgccgcggccgagtcactggccgcgtcgatcgaaccgatcatggtgctcgtcatgggcgcggtggtcggcggcatggtggtctgtctctacctgccgatgttcaccatttaccagaacattcagtccagctga

SEQ ID NO: 1926 - DNA, 507 bp, Actinoplanes utahensis
atgcagaacgtcatcgaccgaatgatcgccaagcaggccgagatccgcgccaagaaggacgacgagggcttcaccctcatcgagctcctggtcgtcgtggtcatcatcggtgtcctcgtcgcgatcgccgtgccggtgtacctgaactaccgccagggcgcggccgacaagtcggcgcagtcggacgtccgcggcgcgatcagcgcggtggagcagtactacaccggcaacggcaacacctacccgacgaacgcggcgaccagcatcgtggccaacagcacgccggccagctcgatcacgctcccggcgcagaccggcggcacggccggcaccatcaccgtgtcggacaagaccgagctgacctacgtcccgccgtccggcacgtccagctacaagatctgtgccaagaacaccggcggcagcggcaaggtctacctgtacgacgcctcggtcggtggctcggtcaagaccgcctcgggcatcacccccaccgcgaccggctgctga

SEQ ID NO: 1927 - DNA, 786 bp, Actinoplanes utahensis
atgccactgagccccctgctgctcgtcgtcggccttctcggcctcgcggtcggctccttcctgaacgtggtgatccaccgggtgccccgcgacgagtcgctggtacaccccggctcgcactgcccgaactgcggccacgccgtgcgcaaccggcacaacgtcccggtgctcggctggctgatgctgcgcggccggtgcgccgactgcgccaccccgatcagcgcccgctacccgctcgtcgaagccggcaccgccgccctgttcgtcgcggtggccgcccggttcggctggtcctgggccctgcccggctatctctacctggccgcggtcgcgatcgccctggcgctgatcgacctcgacgtgatgcggcttccggacaagatcgtcttgccgtcgtacgcggtggctgccgccctgctgatcccacccgccctgctggccggtgacccgaccgccctgctccggggcgccgccgctgcgggtctgctctacgtgctctaccgggtgctggccaccttcggcatgggccggggggacgtgaagctggccccgctgctcggcttccacctcggctggctcggctggggcgcggtggcggtcggcgcgttcgccgccttcctgctcggcggggtggtcggcgcgatcctgctcgccacccgggtcgccgggcgcaagagtcgcatcccgttcggcccctacatgctggccggtgcgttcctcgcggtgttcgccgcggccccgatcgcggaatggtacgcccagctcctcatccccgcgtcgttctga

SEQ ID NO: 1928 - DNA, 1023 bp, Actinoplanes utahensis
atggctggcgcaacaccgatcgggctggacatcggctcgtcctcgatccgggctgtcgaggtccgtcgcaccaaggacggacacacgctgaccaacttcgggcagatcccgctcgacccgggcgcggtgcacggcggcgtggtgcaggacccgctcggcgtcaccacggcgctcaagcagctctgggcggcctcccggttcggcaccaagcgggtcagcctcggcgtcaccaacccgcagctggtggtccgcgagatgtcgatcgcgaacctgccggcctcgcagatgcgccaggcgctgcccttccaggtcaaggatgcgctgccgctggcggtggagcgctcgctgctcgacttctatcccctggagcagccgggcgacaatccgaccgtccgcggcctgctgatcgccatgcccaaggaggccgtggtcgggatggtccaggcggtggagaaggccggcctgcacgtgaccggggtcgacctggcctcgttcgccctgctgcgcgccgcctcccggctggacgcccaggtcgaggcgatcgtcgacatcggcgccgacatcaccagcgtggtggtgcacgccgacggcgaaccgctgttcgtgcggaccctgccgcgcggcggctcggagatcaccgacagcatcgccacccggctcgggttgccggccgatcaggccgaggagatcaagtgccggtacgggttgcacggcgacggcaacccggacaccgtcaccgcggtcgccgacgcggtccgcccgctggccagcgagctgcgcagctcgttcacctacctggcctccggtgagcggcagaagcaggtcacccggctgtcgctgtgcggcggcggcgcgctgatgcccgggctcgccgaacacctgcagaaccagctgggcatcgcggtgatgtacgcggacagcgcggcccggctgcgcgacacccgccgcgcccgggagcgtgggttcgacagtttcgtgccgtcggccgccgtgtcgatcggcctcaccctgggaggggcctga

SEQ ID NO: 1929 - DNA, 684 bp, Actinoplanes utahensis
atgaccacgaccgcgttgatgccggtggacccgtcggtcaccccgcagcaggcggcccgcgtcctgagcatccgggccaacctgctcccgcaggacatcagtgacggccggcgggcgcggcgcacccgcaccgccgtgctggtcgccgtggtactggtcctcaacgggctgggctactggtactggcaggcggccgcggagcgcaaggacgccgacgccgagtacgcggcgatcaccaagcaggtggccgacgtccagcggggccagaacaagtaccaggaagtcgtcaagatcaggaaccggaacacgctggtcgagggccagctcgccaagctgatggccgacgacctgtcctggcaggccatgctcgacctggtacggaccaccggcaccgcgtccaagacgaccgtcacccagatcagcggcagcctgaacgcggccgcgctgaagagcgacggcgtcgggctgctctcggtcagcggcacggcgccggacaagaaggcggtcgccgactacgtcaaggcgctcgccgcactcggcaagaagggcctggccgacccgttcgtcagcaacgtggcgacggccgccggcggcggcgtgaacttcaacctgaccgtctcgatcaccgacccggcgctctgcggcaagtacagcgtcaagaagtgcccgtccggagggaactag

SEQ ID NO: 1930 - DNA, 582 bp, Actinoplanes utahensis
atgaacctgctccgctccgaccgcgtctggctgttcggcggcatcggtttgatcgcactgctggtggccgccgcctggttcctgccgatcaagagccagtacaccgacgcggccaccgcccgggaccaggtcggggacgccaccgcgcagctcgccaagctgcgcaagaccctggccgacctcaacgtcgaacaggcgaagatggacacctacaaggccaacgaggcccggtacaagctggcgctgccgaccggggacgccatcccggccttcctcacccagctgcagacgatgggcctggacctcaacgtcgcggtcgacgcgtactcggcctccggtcacgacaagtcccaggtggtgccgaccgtcgaggagctgccgatcacgatcagcgcgaccggcagcatcgcgaacctgagcacgttcgtgaaccagctgcagtacacccagccccgcgcggtgctgatccagaccgcgaacctgcaggtctccaccaagccggacaagtcgacgctggacctgaccatgtcggccttccgcaacatcgctccggccagcaccgccgcggtgaacaccaactga

SEQ ID NO: 1931 - DNA, 1209 bp, Actinoplanes utahensis
atgtcccgcaccgacggggtgctgcgggccagctggcacagctccatcccgttcatggccggcatccggacgtcggtgatcatgccgatcggcttggccacggtgaggatccgggccgcggtgtgcccgtccttggcgcccacggcccggaagccggccgcctccaggctcaccgacagcaggtcacggacgtcggcgtcgtcgtcggcgatcaggatcaggttctcgttcatgcggctcctcctcgtggaccctcctgatcggccgcggtccggccgcggccaggaaagccggggttgccgtccgggagcggtctgccgtcggcagaagaatgcggcgtccggtccgggcggtgggcagaatccggccatggccaccttctcgctgcaggctcagccggccgatgccgccgactggctcgacctcgcccgccgggccgaagccgccggtttccacgccctctacgccgccgaccacccgggcagcggcgcgtcgccgttcgtggcgctggccgcggccgccgccgtcaccagccggatcgagcttggaccgtacgtggtgaacgccggcatccgcgagccgctgctgatcgcctcggacgtggccaccctggacgtggtctccggtggccgggccatcctcggcatcggcgccgggcacacgccggccgagtggaccgcggtcggccgggtgcgcccggacgtggccggccgggtccgccactgcatcgcggtggccgaggcgaccgtgcggatgctggccggcgacgggctggaccggccccggccggtgcgcgagcgggtgccggtgctgttcggtggtgggaacaccgagctgctgcgctgggcggccacgaacgccgacgtgatcggcctctccggcctgggccgcaccctcgcggacgggcacacgcacaccgcgcggttccacccggatcaggtggacgcgcaggtggagctggccgggggcacgccggtcgaggcgctggtgcactacttcgcgatcggtgacgacgcgggccgcaggtacgcgacctgggccgccgacgccgggatcagtccggcggcggcggccgagtcgccctatctgctggccgggacggcggcggagatccgcgcgaagctccagcggtgtgagcgccgctggggcctgacccggtacgtggtgcgacgcccggccttcgagtcgatggcgccgctgctgcggtga

SEQ ID NO: 1932 - DNA, 807 bp, Actinoplanes utahensis
atgaacccgtcacccccattcgcggagatcggcgtcatcggcggatccggcctgtacgcactgctcgacggcgccattgaacacgaggtcgagacgccgtacggtccgccatccgacaagatcacggtggccgaggtgggtgggcgccgggtggccttcctgccgcggcacggacgcgatcaccggttcccgccgcacaagattccctatcgggcgaatctgtgggccctgcggtcgctgggtgtacgccagatcgtcgccccgtgtgcggtcggtggcctgcgcccggagctggggccgggcacgttcgtggtgccggatcagttgatcgatcggaccagcgggcgggtgcagacgttcttcgacgagggcgcggcgcacgtctcgttcgccgatccgtactgtccggccggccgggccgtggtgctgaattccgccgccagggtgaacgcggtggacggcggcaccatggtggtggtggagggtccgcggttctcgacccgggccgagtcgcgctggttcacctcgatcggcggcacgatcgtgaacatgaccggtcacccggaagcggtcctggcccgcgagctggctctctgctataccgcgatcgccctggtaaccgacctggacgcaggcgtggagggcgaccacggggtgacccacgaggaggtcttcgcggtgttcgcgcagaacaccgaccgcctgcgtggcgtgctcctggacgcggtggccaagctgcccaccgagcgcgagtgcccctgcggcgacgcgctgcagggcatcaaactgcccttcgcgctgccgtag

SEQ ID NO: 1933 - DNA, 558 bp, Actinoplanes utahensis
atggagtcgatgaccggtcagctcctggtcgccacccccaccctcaaagatcccaacttcgaccgtacggtcgtgctgctcgtcgcccacgagccgggcggtgccctcggcgtcgtcctcaaccgggccaccgaggtccccgtcgccgaggtcctcggcaactggggggagctggccggcgaccccgccgtcctcttcgagggcggcccggtccaacccgagtcggccatctgcctggcccgcacccgccccgaggtgaaaaagcgcctgaccggcttccacccggtcgccggcgccctcggcaccctggacctctccgccgacccggaacacctcaaggagaacgtggccggcatccgcgtcttcgccggctactccggctggtccgccggccaactggaggaggagatcaccgccggctcctggttcgtcttcgacgccctccccggcgacccgttcgtcgaacgccccgacgacctgtgggccatggtcctgcgccgccagggcgacatcctggcagctgtcgcgcacttccccccggacgtctcgctgaactga

SEQ ID NO: 1934 - DNA, 342 bp, Actinoplanes utahensis
atggacgacgcccgcatcgtgttctcccgcggaggccgggagttcctgcatgggcggatcacggtgatcggcagcgtcgatcacgcccagcagacctggctgtggtcgtgggccaacgattctctgccgcaggcggtgctcggcgacatcgccggcgtgcgcgacttcggggagcgacatggcttccccctgctggtccggcccggcttccacgcggagcagaagccggtggcgcaagccaagacggtcgccgcggatgtgctcgatgccgagggactgtggttccagccgggcgacgagatcgacctgcacttcgccatccacggtctgcggccggtctga

SEQ ID NO: 1935 - DNA, 408 bp, Actinoplanes utahensis
gtggttcgcctctactccctgttcgggctgatcgacctcgtgctgatcgtagtcgccctgatcgactgtctctcggtcgacgaatacgccgtccgcgccctgccacgcggcctctgggtcctcctgatcctgctgttctccccgatcggcccgatcgcctggttcgtcgccggccgcccggcccgcccgatccacctcagcaacggcacggtgtggcgccccggcgccggcttcccggagaacgaacgccccacccgccgtgccccggccgccccggacgacgacccggagttcctccgcggcctggccgcctcccgccgcgaggacgaaaacctgatgcgccggtgggaggcggacctccgccgccgcgaggaggaactccgccgccgcgaatccggcgaagcctga

SEQ ID NO: 1936 - DNA, 1419 bp, Actinoplanes utahensis
atgactctcgcaacgtccgcccaggccgcgtacctcgtcgccgccctgctgttcatcctggctctggccggcctgtcccggcacgagagcgccaagcgcggcaacgccttcggcgtcgccggcatggcactcgcgctggtcgccacgatcgctctggctgtcgaaggcgatctgagcggtacggggttggccctgctcctggtcgccaccgcgatcggtgccgcgatcggcctgtaccgcgccgccaaggtcgagatgaccgggatgccggagctgatcgccctgctgcacagcttcgtcggcctggccgcggtgctcgtcggctggaacggttatctgcacgtcgaaggagacccggacggcggcgagtcggctgcactctccgcccagggcctgctcggcatccaccacgccgaggtgttcatcggcgtcttcatcggcgcggtcaccttcaccggctcgatcgtcgcgttcctcaaactgtccgcgcggatcaactcgcgcccgctggtgctgcccggcaagaacctgctgaacgtcggcgcgctggtcgccttcgtggcgctcaccgtctggttcgtgatcgatccccggctgtggctgctgatcgcggtcaccgcggtcgcgctgctgctcggctggcacctggtggcctcgatcggcggcggtgacatgccggtcgtcgtttccatgctgaacagctactccggctgggcggcggcggccagcggcttcctgctctccaacgacctgctgatcgtcaccggggcgctggtcggatcgtccggcgcctatctgtcgtacatcatgtgcaaggccatgaaccgctccttcttctcggtgatcgccggcggtttcggcatcgaggccggcccgtccggcgacgtcgactacggcgagcaccgggagatccaggccgacgcggtcgccaagatgctgaccagcgccgaatcggtgatcatcacgccggggtacggcatggcggtggcccaggcgcagtacggcgtggccgagttgacccgcaagctgcgggagaagggtgtcgacgtcaagttcggcatccacccggtcgccggtcgcctgcccgggcatatgaacgtgctgctcgccgaggcgaaggtgccctatgacgtcgtgctggagatggatgagatcaacgacgatttcgcccgtacgtcggtggtcctggtcatcggcgccaacgacaccgtgaatccggcggcgaccgaggacccgtccagcccgatcgccggcatgccggtcctgaaggtgtgggaggccgccgaagtgatcatcttcaagcggtcgatggcgtccggttacgccggcgtgcagaacccgctcttcttccgggagaacagcgcgatgctcttcggtgacgccaaggaccgggtcaacgacatcctgaaagctttctga

SEQ ID NO: 1937 - DNA, 1518 bp, Actinoplanes utahensis
atgatcattggtgttctgggggagtccagccccggcgagaagcgggtcgcggcgacccccgcgaccgtcgcccagctgctcaaactcggttatgaagtggtggtcgagccgggtgccggccgtcgcgcgtcgttcgccgacgaggcgtacgcggaggccggggcgaccgtcggcgacccgtacgccgcggatgtcgtcttcaccatcaacgcgccggaaccggcgcggctggaccggctcaagccgggtgccacgctggtcggggtgttcagcccgcggctgaacgaggccttggtcgccgagttcgccggccggccgatcaccgtgctgtcgatggacgcggtgccgcgcatctcgcgggcgcagtcgctggacgtgctctcctcgatggcgaacatcgccggctatcgggccgtggtggaggccgcgcacgcgttcggccggttcttcaccgggcaggtgaccgcggcgggcaaggtgccgccggcgaaggtgctggtcgccggggtcggcgtggccggcctggcggcgatcggcgcggccggcagcctgggggcgatcgtccgggcgaccgacccgcggcccgaggtcgccgaccaggtcaagtcgctgggcggggagtacctcgcggtccaggcggcggacgtcgaggtctcgtcgaccgggtacgccaaagagatgtcggacgactacaacgagcgggcggcccggttgtacgccgagcagtgcgccgaggtggacatcgtcatcaccaccgcgctgatcccggggcgacccgccccgcgcctgatcaccgagcgcatggtggccagcatgaagccgggcagcgtgatcgtcgacatggcggccgccaacggcgggaacgtcgagggcacggtggccggcgaggtcgtcaccaccgccaacggcgtgaccatcatcggatacaccgacctggccggccggctgcccgcgcaggcgtcccagctgtacggcaccaacctggtgaacctgatgaagctgatgaccccggaacgggacggccacctggtcctggacttcgaggacgtcgtccagcgatcgatcaccgtcgtacggcaaggggaattgacctggccgccaccggccgtgtcggtctcggccgcgccggccccggagacgaaggaggtggcggcgccgaaggcggcgaccgcgaccaggaatcggacgctgcccctggccggcgtcggcgcagccgcgctgttcctgctgacggccctggcgccgacgacgttgcgcgggcatctgacggtcttcgcgctggccatcgtgatcggctactacgtcatcgggcacgtgcaccacgcgctgcacaccccgctgatgtcggtcaccaacgcgatctccgggatcatcgtggtcggcgcgctgctgcagctcggacacggcggcgccgtggtcaccgtgctgtcgttcgcggcgatcctgctggccagcatcaacgtcttcggtggcttcgcggtgacccgccgcatgctcgccatgttcaccaggagctga

SEQ ID NO: 1938 - DNA, 435 bp, Actinoplanes utahensis
gtggccggcggtccgccgcccagtgccgccgcgctgcactgctccctcgccctgccggacgatcccgtcgaggtacggatccgggtgctggacggcggcgcgtccaccgcgctgatcgacgcgaccgccgcccacctgcgggagcgtcgtttcaccgtgctgaacggcgccaccggatcccccctggagggcgccgcctcggtgagctacggcccggccgggatcggctcggccgccctggtccgggcctatctgcaggacggtgcgacgatgctgttcgaccccggcatccgggacgacatcatcgcggtgaccctcggcccggccttcacccggctcgccacccccaccgaggccaaccggaacctcgtcgcggtcggcgagccgaccgccccaccgcagtgtgcgaccgtgggggcgcccgcgaagcgctga

SEQ ID NO: 1939 - DNA, 192 bp, Actinoplanes utahensis
atgtcacgtcccgttcctgaccgactgcgtgagcttgcggccgaggtcggtgacctgccggtgccgccggccgccgaggttcgcgcccgcggccggcagcggtcgcggcgccggctggccgtggtgaccgcggccggcttggcgctggtggccacggccggtgtcaccgtcatctggccgctagctagctag

SEQ ID NO: 1940 - DNA, 573 bp, Actinoplanes utahensis
gtggcggggtgcggtgtgtattcaagtgtgcgggcaccgacggaagcgggaaccatggcgggcgacgacagcgccgacttcgacaccttctacgcggctacggtccggcgggtgctcctctacgcctacgccagctgcggtgatcgggccgaggcgcaggacgtcgcccatgaggctttcgcgcgggcctggcagcactggtcgcgggtgtcgcggtatgacgacccggagggctgggtgcgcgtcgtcgcctcgcgcctgctgatcaaccggtggcgggggctgcggcggtgggtggccgcccgggcccgactcggcccgcccgacgacgtcgccggcggaccgtcgccggatcgggtggcggtggccgccgcgctgcagcggttgccgaaggcgcagcgggaggtcgtcaccctctactacctactggacatgccggtgcgggacatcgccgagagcctcggcgttccggaggggacggtcaaggtgcggctctcccgcgcccgtgccgccctggcccagctgctcggcgacaacgatcaggagatcagcgatgtcacgtcccgttcctga

SEQ ID NO: 1941 - DNA, 1284 bp, Actinoplanes utahensis
atgcagagcagcgtcggcgagcgcatccggcgcctgcgcaccgagcgcggcctgacccagcgcgagctcgccgagccgcgcttcagccgcgcgctgctcgcggccgtcgagtccgggacgcgccagcctagtccgtcgttcatcgggtatgccgcgagccgcctcggcgtcgacgccgacgagcttcgccacgggcgtcccccgggcacggccgaggacctcgccgcccgattgacggccgcccgccgtgacctgtcgcaggggcgcatcgacgccgcggtggccgcgttcgaccaggtccgggccgacgccgtccggtacgcgttgccggcgcccgcagcctgggccgcgtactggcggggcgaggccgcgctgcagagcggggagctgtccgccgccgaggacgcgttcgcaccggccctcgactgtcccggcccggtcgagccgcgcgccgccgccatcgcccgatgggcctattgccggttcgccgggggtgacacctcgggcgcggtcgacgtactggagaaacacttggccgtgctgcaggaatcgccacagtccccggcggacgcgctggtgcggctgggcaccgcgctgatctacgcctacatcgagttggactggcgtgaacgggcccgcaacttggaagacgagtcgcgggcgctgctgccacgggtgcgcactacggaatgggtcgcccagttcctcgtcacggcgggccaggcacggcgtacggcggccgagctgcccggcgcgcagcgcatgttcaccgaggccggccggatctatgccgagctggggctgacccgcgagatcgggctctgccactgggcacacggctatgtgctgcgccgggccggaagcctggaacccgccgcgggcgagttcaccgccgcgtgcacggtgctcgactcggtcggcgcgcggcaggacagtgcgggcgccgcgctggagctggccgaggtacggcgcctgcaggggcggctcgacgaggccgacgcgctcgccgacggtgccgcgcgggtctgcgccgagttcggccatcaggagtgctcggccgaggcggaccgggtgcgcggcctggtcgcagcaggtcagggccggccggaggcggcgcgggaactgctggcgcgggcggccgaccgctacgcgcgcatgggcctcgcggccgagctggcgaccacctgccgcgagctgggcgacgtgctgctggccggcggtgagcctgcgcaggccgcgctggtgttccgccgtggtctgcgcgcagccgagacgatccggtga

SEQ ID NO: 1942 - DNA, 1206 bp, Actinoplanes utahensis
gtgaccgcggctttcggcgggcggctgcgcgagctgcggaaggcccgcgggttcagccagcgcgaacttgcggcgccgcgctacaccgccgcattcgtatcctcggtggagtcgggccgccgcgcgccgtcgacggatgccgtcgcgtacttcgctgagcggctgggtgtcacgccgcgcgcgctgaccacaggcgaggatccggatcatagggtacgcgcccggttggcgctcgccgatgcggacgcgcaggacggggcggcggacgcggcgtaccggaaattggcttctgaagggattttcgagccgcaatgccggctcggcctcgggcggctcgcgctacgacggggcgagatcgccgacgccgcgcgcgagttcgccgcagccgcccggctgctcgccggggaaccggcacacgtccgtgctcacgcggtcgccggtcaggccgcctgcctgcgcgcccagggcgacccgcggtacgccgcccacctgctgcaccgggtactgaccgaaatggacctcgcggctctgccggatccggccgccctcgtggcgatccacgcgcaactcgccctctgccacgccgacctggaggacgagacggcagcggcggcctcggcgtcggccgcactctccctggccgggccgcgcgaggcgggctcgcttgccgacctgcacctcaccgtggcccgcacgctgctgtccacgaacgatctcgccggcgccgacctcgccctgcaccgggccgggcaggctcggcagcaggcgaccctggcgccggaactggcggcctgccgattgatcaggggccgggcccgccgtaccgccggcgacctgccgggcgcgctgcgcgacctctcgccggtggacggtccggtatcggctgaggcggcggtggagctcgccgccgtctatgcggacctggggctgcgcgaccaggctcacgacctgctgcccgagcggttgccggctgccgaccggctgcgcgcccgactcgccgaggaagtgggcgaccacgaggcggccgagcaccacctgcgcgtcgccgccgacggctaccgcacccggggcccccgccgcgaactggccacgacgatcctcgctctcgccgatctcctcgaccgccggaaccgcccggaagacgccctcactgccctgcgcgatggcctcaccgacgtgctcggacctggcatcggcaaggcgtga

SEQ ID NO: 1943 - DNA, 2340 bp, Actinoplanes utahensis
gtgagaagcagaaccgtgctggcggggacggtggcgttcgctaccggcgccgccctggcggtgggcatcacgagcgcccacgccgcatcacccccgcaaccggccgcggcgagcggcacccccgtcaccgaacaggtgcgattggcggcggccgacaaagccgcggcgagtggtttcgacgccctcggcaaggggcccgacgacgcgttcctgcgccgccaggcgatcaccggactcggcggctactcctacctgacctatgaccgtacgtaccgcggcctgcccgtagtcggcggggacgccaccgtcgtcgtcgacgcggcgggccacgtgcgtgacacgttcgccgcggaccacggtcgggtgtcgctcgggaatctgcggcccgcgatccccgcgaagcaggcggtcggcaccgctcgccggcagctcgactccgtcgcgacggcggggcaggcgcagctcgtcgtgtatgccctgggcgcgaagccgctgctcgcgtaccaggtgctggtctcgggcgttcgccacgacgcgccgagcaggctgcacgtctgggtggacgcgggcaccggcaaggtgctgttcaccagggaagacgtcgtgtccgaggcggcgcgcggttacgtcaacggggcggtgcagatcgacacgaacggcggcgtgctgcaggacccggcccgcccgggcctgtcgtgcggcaactacagcaccagacagacctaccgcaacggcggcacgggcaccggcaccgacctgcagacggcgtgcgtcgacgcgtactacggcgtcgagcaggagtggaacatgctgcgcgattggctgggacgcagcggcatcagcggcaacggcagcgccttcccgctctacgtcgggctcaacgacgtcaacgcgtactggggcggctcgtcgggcacgttcggacacaactcgtcgaacaccgcgcaggccaccagcatggacgtggtcggccacgagatgggccacgcgatcgaccagtacaccggtgcgggcacggccgccgagaacgggctcggcgagggcaccggcgacatcttcggcgccctgaccgagcactacgccgacaacccgagcgacccgccggactacaccgtcggcgaggagatcaacctggtcgggtccgggccgatccgctacatgtacaacccgtcgaccaacggtgaccccaactgctactcgtcgtccatcccgggcaccgaggtgcactccgccgccgggccgctcaaccactggttctacctgctggccgagggcagccgcccggccaacggcaacccggcgagcccgacctgtgacggcagcaccgtcaacggcgtcagcatccagaaggcgggccagatcttcatgtccgcgatgaacatgaagacgtccggctggagctacgccaagtaccgcggcgcgaccgtcaaggcggccgtcaacctgttcggcgcgagctcggcggagtgcgcgagcaccaaggcggcgtggagcgcggtgagcgtcggcccccagtcgggcgagccgtcctgcacgaccgtgccggccggcgacttctcgctcgccgtcaacccgtcgtccggctcgctgcagcagggcggctcgacgaccaccacggtgtccacccaggtcaccggtggcaccgcgcagagtgtcacgctgaccgcgtccggcctgccgtccggggtcaccgcgacgttcagccccgccacggtcaccgccgggcagtcggccacactgaccctgcgggcgtcggccaccgcgaccaccggcagcaaggcgatcaccatcaccggcacggccccgtccggctcgcacaccgccacctacaccacgaccgtgacgaccgggcagcccccggcgaacgacttctcggtctcggtgaacccggcctcggccacggtcgctccgggcaactcggttaccgcgtcggtcgtcacggccaccgccggcggctcggcacagacggtgaacctcgcggtctccggtgctcccacgggcgtgaccgcggcgatcagcccggcttcggtcacctccggcggctccgcgaccctcacggtgtcggtctcctcgacggcggcggcgggcaccttcccgttgaccgtcaccggcaccggcaccgcggccacccgcacggcgacctacacgctcacggtctcgggcggcaccccgccgcagggctgcggcggcgtcgcggcgtggagcgccacccgcccgtacgtcccgggtgacaaggcctcctacaacggccacctctggaactccacctggtactccaccggcgccgaaccgggcgcgccgggctcctgggcggtctggaccgacgccggtccctgctga

SEQ ID NO: 1944 - DNA, 240 bp, Actinoplanes utahensis
gtggcctccaggtcggccgaacacctcgggcgtcaccggcgttcggcggcgaccctggaactcccggcccggtactccacccggtcgaggtggcagcggtcgcagcacttcgcccatgccgggcacggataccacgatgccgccgggatggccggggccggctcgatgcgcagttcgtcgttctgcggaagtgctgcatggaccgccgaccccaccagaacatcgactgatggctattga

SEQ ID NO: 1945 - DNA, 474 bp, Actinoplanes utahensis
atgacgtttcgtggcaggacccagatggtcaccctgtggctggccccttccgtactgattctctccgcctgctcaggagccggcgtggacaagcagtccgagtccgacgtgaacgcagtcgttcagcaacacgcggaacagatcgccactgcggtgggcatgccactgttcaatccgaaactgagctccggcgggtgcaccgaccgggccggcgaaagcagcgacagaatcttcactgttcagggcgtctacaacgtcaacccgccacagaaggaccagcatctcgcctcgctggccaggatcaaagccggatggcaggccaagagttaccgcatcaccgacgaccgcacggtagggccggacgacggtctggtcgccgctgaaaccccagacggctaccgactcgaggtcgaccgcgccatccccgacggcttggtggtcctcatccactcgccctgctacgcgaaaccgtga

SEQ ID NO: 1946 - DNA, 93 bp, Actinoplanes utahensis
gtggcggtggccgccgcctacttggacctcggcgaccaggtccggcacctcgaagacgctgtcagtaatcgaggtccgactgacaagccatga

SEQ ID NO: 1947 - DNA, 990 bp, Actinoplanes utahensis
atggacggcgtgccggccaccgaccgcgacaaggccaaccggatcggcctggcgcagcagaagcagtacctgcaggaccggctgcacaaccccgacatgaccctggaagcgcacgacacctacgacgagttgcaacgcctggagacgatcgagaagggcctggacaaactgggcccgcgaggcttgctgctcggcttcgacactgcggcgttcgacggcgatggcaaggtcatcatggcgatgggcaaccccgacaccgcccggcacaccggcgtctgggtgcccggcatgggcacgacgctcggcggcagcacgctggacaacctcgaccgaatcatgaagatgaacgatgtggccgactcaataacccgggatcggtcaggtgacatctctaccatctactggctcggctacgacgcgccagagttcccaccggccaacttgtcagtcgtggcgaacttccgctcgatcgcgggcagggacccgtacatcgacttcatgcagggcctgcgcgctacccatgagagcggtgacgggcatctggtggcaatgggacactcgtacggcaccacggtgctcggcgaggcggccaagacgcatcggcttcccgtcgacgacatcgtcaccgccggcagcccaggcatgcacgtcggttccgccaatgacctgatggccgacccccgccacctatgggccggcgcctccgactccgacccggtcgcccgactcgaggcgtacacggtgtccggcgactcgacagtagacagctcgccgctgaccgaactcgccaacaagatcgcagacgatgaccacggcctggcacccagcgatccgagcttcggcggcaacgtctggaaggctgacacgtccgggcacacacactactgggacgacaacagtgaaagtctcaacaaccagtcgcgggtgctcgctggcgcctacgaccaggtgacgtacaacagcggctcgattccggagaattggcgatga

SEQ ID NO: 1948 - DNA, 480 bp, Actinoplanes utahensis
atgacccgaaacggaactgtccgcaccgtggtggcctctgcagcggccgccttgtctttgacattgttcgcctgttcaggagcgcacgtggaaaccaagtcagagaaagatgtcaactccgcggtgcaacagcacgcggacaacatcactaaggttgccgccaagccgctggaggacccgaagatgcggtccggcccgtgtaccgacccgatgggccgggacagcgacacggtctacaccgtgcagggcgtctacaacctcgcaccgcccgccaccggcacgcacctcgatatcctcgccaaggtccgcaccgattggacgagcaagggatacaccatcaccgatgaccgcaccgtagctgccgaccgaggggtactggccgccaagaccaaggacggctacaacctcgacatcgagacagcaaccccggacggattcgccatcatcatccactccccctgcttcgagcgccctgactga

SEQ ID NO: 1949 - DNA, 477 bp, Actinoplanes utahensis
atgaccggtcgtagcaccgtcacggccgtgacggccctgctcgccgccgtggcattcaccctgtccgcctgttcaggagatcaggtggaaaccaagcccgaggctgacgtgaacgcggccgtgcagaagcacgccaacgccatcgccgcggtcgccggtcaggcgctgcagaacccgaaggttcgggccggcgggtgcaccgacccgaacgagaacgtcagcgacagcgtctacaccgtccagggcgtctacaccctgcccgccccggccgccggcgagaagcacttggacgtcatcgccaaagtccgcgacgactggaaggccaagggctacacgatcaccgacgaccgcaccgtcgccgcggaccgcggagtcgctgccgcccggaccccggacggctacaagctcgacatcgaaaccggcgacccgcgcgggttcgcggtcttcgtcgactccccctgctacgcacgcccctga

SEQ ID NO: 1950 - DNA, 345 bp, Actinoplanes utahensis
atgcagccgaacgtggagatcgacgtcgagggcctggttcgtacgggaacacaggtgcaggactcatcggggtcggtgcgcgacgccatcaccaaggagagcggctggctgacagtcgccggcgccgccgcaccctgggctgccgtcgccaccatggcggatcgcgcccacggctgggcgacgtatctacaggacctggcggaacggatccggctcagcggtgccgggatggtcggcgcggcgatcgactaccagaccaccgaccacgattccggcaccgacatcgccgggacctatccggcacccggcccgcaccacggcccgcacatgggatacgccgaatga

SEQ ID NO: 1951 - DNA, 435 bp, Actinoplanes utahensis
atgagcacgatcaccttgcaggacgtcgccgagaccaacgtggccgccttctcgtcagcctccgacgcgtgggatcgggtagctgcgaacctcgacgccggcttggagaagttcatcgccgccggccagcttttgcctcatgtgtggcagaccgggtacgcggcccaagaccgggtgtcggctttgcaggcggagttgagcggcacgtacgacccgtgcaagatgatcagccgagctctgcgcacccatgccgacacggtgctgagccttcagagcatgctcagcgacatccaacgcgaatgcgccgcggccgggctgaccgtcaacctgacgaccgcaaccgtctcctcgaaaggtcacctcacggacacgtcgcaggtgctcagatggccggactggtgcagagctacaccaggcagctgggcgagttgctga

SEQ ID NO: 1952 - DNA, 474 bp, Actinoplanes utahensis
atgacatcaagtggcaggacccagagggttgccctgtggttggccccttccgtactgattctctccgcctgttcaggagctgacgtggacaagaagtccgaagccgacgtgaatgcagtcgttcagcagcacgcggaacagatcgccaccgccgtaggcatgccgttgttcaacccgaagctgagctccggcgagtgcaccggaagggccggcgaaagcagcgaaaaaatcttcaccattcaaggtgtctataacctcaacccgccacagaaggatcagcatctcgcctcactgggcaagatcaaggctgagtggaaagcgaagaacttccgtatcaccgacgaccgcacggtagggccggatgacggcctggtcgccgctgaaacccccgatggctacaaactcgaagtcgaccgcgccatccccgacggcttcgtcatcctcatccactcgccctgctacgagaaaccctga

SEQ ID NO: 1953 - DNA, 813 bp, Actinoplanes utahensis
atgctggccggaactccactccagcggagggacgtgatgaagcaacctctgtctcgggcgctgcgcgccaccggacttgatgccgtggacgtggctgcgcggctcagcgtcgatcccaagaccgtcgagcggtggctgacgggcaggttgccgtacccgcggcaccgcgcggcactggctgggctcacaggctgggcggaacccgatctctggcccggcatcgacgctcgggagcaggccccccctgataccggcgacatccttatgacgtacgcgcagcgctgctccgtgccgccggatgcctggcgaaggctgttcgctggtgccgagcaggagatcggcgtacttgcttacagcggtctttttctcgcggaggacgcaggcgccgtggcgatactgcgcgacaaggcccgagccggcgtgcgggtgcgtatcgcgcttggtgatgtcaacggcgtccaggtggcccagcgcggagtcgaagagcagatcggggcgataatgccggcccggatcaacaacgctttggccctgctccgaccgctgatcgaagaagccggcgtggcggttcggacgcatgacaccgtgctctacacctcgatctaccgggccgatgaccagttgatggtcaacacccatgcctacgggtgcgccgcatcgcggtcgcccgtcttgcacctgcgacgggcgaccgacgatgggatcgcggccacctacctcgactcgttcgagagggtgtgggcggtggctcaggatctacaggcccagccgacgacgcggtcgaagaggtcggccggtttagcgtctggctga

SEQ ID NO: 1954 - DNA, 555 bp, Actinoplanes utahensis
gtgggagacgtctcgtgggcgcgtgagctggcggaaaagcttctagtcgatacgttgccgcgccgctgggcacattcgcagggcgtcggtcgcaaggctgaatcgatcgcccacctgctcggagacgacgctgacacggtcgtgtgcgccgcatggttgcacgacatcggctacgccccggacctcgttcacagcggctcccacgccctcgacggcgcgcggtatctgcgggacgtcgcagaagccgacgagacgatctgccgccttgtcgcccaccactcctacgcgatcgtcgaggccggccgccgcgggctcgccacggagctcgccgaggagttccctgcggtgaacgggctgatggccgatgcgctggtgtactgcgacatgaccacgagcccagacggcgaccccgtagacgtggaaaagcgtctcaaggagatcgcctcgcgatacgccccgggaagcatcgtcgcggactccatccttgaagtcagcccacgcatcgttcagtcggtgcgggtcattaccggcatgcccggcttccaagccgattag

SEQ ID NO: 1955 - DNA, 465 bp, Actinoplanes utahensis
ttggctgacggaggatggatcggcgacgctgccgacagcttctcggccgtcggcaccgtaggcgcgttcctggtcggttttctgttgctccgtaaggagcagcgacgggaagcggggcggtccgacgacgagcggcgggctcaagccgcgaagatcagcgcttgggtcgagctgcaccgcaaggcggatggcactcgtgagctggcctttcatatccacaacgccagtgacatgccgatctatgaggttgagctgccgctgcccagcccggacggcccggaggtcaccgagttcgtcggcctggtgccgccgggccagaccatccggcggccggcgcccgcagactggctgcgctcctatgtcgaaccggagccgatccagatcgagtttcaggacagcgcggggcggcgctggacacgtgatgagcagggcacccttgcgcaggcggataaacctgctggctaa

SEQ ID NO: 1956 - DNA, 477 bp, Actinoplanes utahensis
atgtcacgccgtatcgactacttcgatgatcccgaagcgcccgccgcgaactcgatcgtcccgtccgtcaacgtcgtggtgaccgacgaccggggtcgacttctgttgatacaccgcacggacaacgacaactgggcgttgccgggtggtgcgatggacttcggcgagtcgctgcccgaggccgcgatccgggagacggtggaggagaccgggatcaaggtcgagatcaccggactcgtcggcatctacaccgatcctcggcacatcatcctctacaccagcgacaacgaggcgcgtcaagagttctccgtggtcttcaccgcccgcgctgtcagcggagagcccacgaccagctcggagtcccgcgaggtggagtgggtggagccggacgccattcccggtctgacgatgcaccggtcgatgcggatgcgcatcgaccggtacctggcgcaggaggagcagccgtaccttggctga

SEQ ID NO: 1957 - DNA, 735 bp, Actinoplanes utahensis
atgccgaacgatcgcctgcgcaccgccctcctcgaacggggagtaaccccggccgatctcgccgaggaactgaaggtcgacccgaagagcgtcgaacgatggatctccggccggacgccttaccgtcgccaccgctacgcggtcgccgcgaaactcggagtcgacgaggcttatctctggccggacgcgctgtcacgcagccaggtcgcagacgcttcagagagcgagatcgtcaacatctacccgcaccgctgggctgtcccgtccgaaatgtggcggaacttcttcgacacggctgaggccgagatcggtgtcttggcctacggcgggctgttcctctcggaggacgccggcgtacgcaaagtttttcgagagaaagccgatgccggcgtgctggtgcggatcctgctcggcgatccgaacagcgaatcggtcgcccagcgtggagcggatgaaggcgtagacgacgccatggccgcgaagatccgcaatgccctggtgctgtaccggccgttgcggaacctcgacggcatcgagttccggctacacgacaccgtgctctacaactcgatctaccgcgctgacgatcaggtcctggtcaacacgcatatctacggcttccctgcggcagaggcccccgttctccacctgcgcaaggtcgccggtggcaccatggtcagcagctacctggacagcttcgagcgcgtctgggacggcgcgaccccgttggaatga

SEQ ID NO: 1958 - DNA, 186 bp, Actinoplanes utahensis
atgcccacccccgccaacgagcccacctgcacctgcggcgcccagctcgacgccgaccaccccaaccagtgctgcaagtgctccgcccggagccgctggcagcggcgccacgccaacctcgcccggcgcaccggcccgggccggaaggccagcggccggggcaaggacgggcggcgccccgcatga

SEQ ID NO: 1959 - DNA, 195 bp, Actinoplanes utahensis
atgaccgtgaccgtctccgccgtgctcctgctcgccgtcttcgtctacctgctctggcggttcgccggcctgccgctctggcaagcggcgatctgcgctgtcttcggctatctgctcgccgcgtcctcgatcggcccgaacatcggggacgccctgcacagcctcgttcggatcatcgccaaggcccagctctga

SEQ ID NO: 1960 - DNA, 1734 bp, Actinoplanes utahensis
atgagggcgtacgggcggcggcaccgccgctggcgtcgtcacgggcaaccactgcttctggtctcggacgagtcctggttgtcggcgatcctcgccggtatcggccggctcgcccaccgctaccgttctgaactcgcccccgccacggtcgccgtcgtcttcgacctagtggccgtctggctccattcagcgcaaccaggagcatgctggtgggtacttgccggcaccggggcggcgactctccgggcagcactccgaggggcgccgtggggtgccaccagggccgaggaacgtgcctacgccgcgatcactactgcggttgccggtgtctggctcgccgccgcaacggcgctcggaccgggccacgcacacctgcaatcggtcctcctggtcgccatgttcgcgtgcgggaccccgtggtggcgccaccgacgacgccgggcacgggtgaaggtcgaccgcacgatccaggcctggcccaatctggccgaacagatcgggctcgccggttcccgggtgctgtcggcggcggtggacgtgtggggatggcgcgcccggatgacgctgcgaggcggtcagaccgtggcggacgtcatcgcccaggtacccgcgatcgaatccggactcggcacccggcccggagcggtccgagtcgaggccgacccggctcacgccggtcggttcgtcatgcgggtgcttgccgaggatccgcacgccaacgccgtcccatggcgcggcccggccgcaagatcggtagccgatccgatccccctcggcgtgttcgaggacgcgaccgacgtggcggtgccgatgttgcgccggcacgtcctcgtcggcggcatcgcgggcgctggcaagagcggagttctcaacgtcataatcggcaacctggtcgcgtgccccgatgtggtgctctggggtatcgatctcaagggcggcatggagctacagccatgggcgccctgcctcgcccggctggccaccaccccagccgcagcggagacgatgttgcgggacgcggtcagggtgctcgacgcacgtgctcgtgcgatggcagagtccgcgtcacggctctggattcccaccgagcgcaagcccgcgctggtcatcgtcgtagacgagtacgcggagcttgccgagcagtcgcccgcagccgtcgagtacgcggactcgatcgcccgtcgtggccgcgcagtcgctgagaccctgctcgcggcgacccagcgtccaactcagcaagccatgggcaagggcgccatccgttctcagatggacgtgcgggtctgcctgcgcgtccgggaacgtcgggacaccgatctcatcctcggtcagggcatggtcaccgccgggtggcatgcgcacgacctggacgcacccggcaaattcctcgtctccgccgagggcttcaaccacccacgccgagcccgcgcctacctggtgaccgacgacgacgtccgagccacggtcgagcgatacgcagcagatcgcccggtcctggaccacctgtccgccgacgcgctgcacgacgaagctgacgcgctgcacgacgaagtagatgaggccgaccccgagaaagtcctctgggcggcgctcagcgaggcacccgagcacggcctgtccgtccccgatctcatgcgaatgaccggaatgaggcgcacatggatctacgaccgcctgcaagccaacgccacgcaggtcagccgtggacgctggcgactgccaaacggtggatag

SEQ ID NO: 1961 - DNA, 1800 bp, Actinoplanes utahensis
atggcgcagattccgcgccagcacgaccggccggcgagcacgcacaagcgagcattcagctacctgcgcgtctcgtcggccgggcaggtcaacaccgactacgaccccgaaggcatctcgctccccgcccagcggtcggccatccagcggcgcgccgccgagctgggcgctgagatcgtcgccgagttcgtcgagcccggccgctccgcgacgaccgtggacggccgaccggtcttccgggagatgatggctcggctcaaggccgagaagagcgtcgactacgtgctcgtctacgcccggtcccggctgcaccggaacagcatcgacgcggcgatcaccaagcgggacctccgcagcgcgggcgtcacgctgatctcggtcatggactacaccgaggactcagcgatcggtgacctcgtcgccacggtgctggacggggtcaacgaataccagtcccgcgcctccggagcggacatcgcgtacaagatgggtcagaagatcatccggggtggctcggtcggccgggctccgatcggttacctcaacgtccgcgagaccttcgagggccgagaggttcgcacggttgccgtcgacccggtgcgcggcccgctggtccggatggcgttcgagctgtacgccaccgggacgtacggattccacgcgttgatcgcggccttgagcgatgcgggcctgcgcaccaggccgaccaagcgcttcccgatcggtacctcgatctcgctgaactcgctcggcaacctgctccgcgaccggtactacctcgggttggtctcgctccgcggggttgaataccaggggcgacacgagccgctggtctcccccgaggtcttcgatcgcgtacagcagatgctggaatcccgacgggcaggtggggtccgggagcgcacgcacaaccactacctcaaaggcgtcgtctggtgtcacagatgcaaacggcggctcatggtcatgcgcggtaagagccacaccggcgacctgcacttctactacttctgccgcggacggcagcagcacgcctgcgacctgccctacctgccaatcgccagggtggaggcggccgtcatcgacaactacgccaccatcgcgctgcctgccgacctgcgcgacaacctcaccagccgggtcggtgagctgctagccgagtcggctggcatgagcgccgagctgcgtacccaggttaaagatcagctcgccacgctagatcggcaggaagatcgttttctggacctcgtcggtgatcccgactggccgcaggacaagatcgcggcacggctccggaaggtccgggacgagcgggaccggctcgcccggcagctcaacgactcagacgctccgcgactcgacgaggccgccgagacgatgctctacctcctcggcttgctcgccgatccgcaggagttgtaccgccgggccggacagcagggccggagagcactcgatcaggccttcttcgcgaagatttacttcgacagcgacgacgacggcccatatgtcgccgctgacgagctgtcagatcttgtatttccgctggtcaacgaggtccgaaacgacagcggcggcgccatgggcgccgccgctgcgggtgaaccgtcacccgctctcgcgggttcaagtaagcctccacttgtggaggtgccgggaatcgaacccgggtccttcgttgttttgtcagggcttctccgagcgcagctcactatgtccctactcggccctccgactcacgtgagcaagttcggacgacgggcccagtcactgattaatctcgccgcgcggtccccgtga

SEQ ID NO: 1962 - DNA, 660 bp, Actinoplanes utahensis
ttgtccaccaatcccccacaccgtgaccggcagttcttcatcgcccgtggcgtcttcggcctggccggcgccatcctgatcagcctcgtcgcctggatcgccctgcgcgccggcggctcctccgcctcggccgccgacaccccgctgctggtccagccgtccaccggcctgcgcgccgcggagtccaccgtcgtcccgtccgccaccgggaccgcgccggtctccagcggcccggcggtcgccgccacctcgccctcggcgtccccctccccgtccaggacgtcggcctcgccgaaaccgtcgaagacctcggcgagccccaagccctccgtcaccaggaccaccaccccgccggtctcccgcgacctgagcctcagctgcggcatcaacgcgtggaacggcggcttcgtcgccaacgccacggtcaccaacaacggctcgcaggctcacagcttccgggtcaccttcaccttctccggtagcgtccgggtgctcaacaacccctggaactcccgcgccaccagcaccagcggccagacgatcaccctggtcggcagctccgcgctcgccccgcacagcaacgtgatggtcggcttctccggctccgccgacgacccccgccgcctccgggtcgggtgctcggtggcggtcaccggatag

SEQ ID NO: 1963 - DNA, 477 bp, Actinoplanes utahensis
atgccacgcgaacaggggcgcaagctcgtcgcctccaaccgcaaggcgcaccacgactacaccatcctcgacacgtacgaggccggcatggtgctcaccggcaccgaggtgaaatcgctgcggctcggccgcgcctccctggtcgacgcgttcggccacgagaacaacggcgagatcttcctgcacggcctgcacatcccggagtacacgcagggcacctggaccaaccacgagccccgccgggtccgcaagctgctgctcaagcgcgacgagatccacaaggtgatgggcaagctccgcgacgacggcgtcacgctggtcccgctctcggtctacttccagaacgggtatgcgaaggtcgagatcggcgtcgccaagggcaagaagagctacgacaagcgtcaggacatggccgagcgggatgccaagcgcgagatcaaccgcgccgtgggccgccgtgccaaaggcatggcctga

SEQ ID NO: 1964 - DNA, 885 bp, Actinoplanes utahensis
gtggccggcgcccgggagcgggtcgcccagatcgcccgcaacagctacatgggcagcccgatcacccggctcaacctgctggtctcggcgcacggaccggtcgacctgatggaccggatgagcatggtcgacgagatggtccgccaggagaacgacgacgtgcggaggctgatcggcgcccgccgggaggcccgggccgcccaggaccgcgccggcgcggcgaaacgggccgccgaggtggccgaggccgaggccgccgccaagctccaggaggcgcagaccgcccaggtcgacgcggtccgcgccaaacgcgacgtgtaccagctggtgctggcccggcgggcggcgctgagcgcggccaacgcccagcgggccacggtgctcgcccagtaccgggccgcggtcgccgaggaacgcaagatccggtccagcatggccggctgggaggtccgctccggatactccgggcagtatcacgggcggctgctgatgccggtgcacggctggaagagcagcgactacggcaaccgctacgacccgtactaccgggtctggcagttgcacgccggaaccgacttcgcggccgggtccggaacccccatccgggccgcggccgccggccgggtgatccaggccgggtggcacggtggctacggcaactacacgtgcgtcaaccacggccgggtcatggggatcggcttctccacctgttacggccatcaatcccggatctacgtccatgtcggggagtacgtccggcagggcgagatcatcggtctggtcggcagcaccggcgcgtccaccggctcgcacctgcacttcgagacccgattcggcggtgcgccccgcaatccgctcaattacctgccgccctgcctctgctag

SEQ ID NO: 1965 - DNA, 171 bp, Actinoplanes utahensis
gtgaggtaccgccgactcgacccgctgctgaccgcctgtctctgcctgctggccgccgtcggcctcaccctggccgtccccgcaccggcatcggccgatcagaatgacgcggccgaggccgcccagtccgtccggcgggccgaggcactgctggagaacgccgctagctag

SEQ ID NO: 1966 - DNA, 882 bp, Actinoplanes utahensis
atgcgcgtgaagtatgtcctcaacgaggtcctggtgggcctgtggcggaacgtcacgatgacggtcgccatgatcatcaccatgtcggtctcattgaccatgctgggcgccagcgtgttgatgtacctgcaggtcgaccggatgaagaacttctactacggcgagatcgaggtgtcgatcttcctggcggacaacgtctcggacggtcagatccaggctctccaggcgaagctgagcggcgacccgctggtcaagaaggccgagctggagaccaaggcgcaggccctggagcggttcaaggtcctctacgccgactcgcccgacttcgtggccgcggtgaacgaggacagcctgccgcagtcgttccgggtcaagctgaagaacccggaggactacaacaagttcactcaggctctcggcgaccaggctagccagggcatccagcgggtgatcgaccagcgcgagctgctgcagaaggtgttcaacatcttcaactcggtccagctgatgtccctcgtggtggcggcggtgatggctttcgccgcgttgctgctggtcggcaacaccatccaggtcgccgcgtacagcaagcgccgagaggtcgcggtgatgaagctggtcggcgcgtccaactggttcatccaggcgccgttcgtcctggaggcggtggtcgccggcctgatcggctcgatcctcggcttcgtcgcgctgttcatcggcaagatcgtgctgctggacaacaagctgcaggcgttgaccgcgatcctgacgccggtgcccgccgggaacgtctggctgatgctgccgctgctggccggggtcggcgcggtcgtcagtgccgggaccgcctgggtgacgctccggttctacctgaaggtctga

SEQ ID NO: 1967 - DNA, 681 bp, Actinoplanes utahensis
gtgattcagctcgagaacgtgacgaagacgtatccgaaggcgtctcggccgtcgttggacaatgtcagcgtcgggatcgagaagggtgagttcgtcttcttcatcggcccctccggttccggtaagtcgacgatcatcaagctgctgttgaaggaggtccaggcgacacgcggcaaggttgtcgtgaacgccaaggacgtcacttcactgcgctcctggaagatcccgcacttccgccgctcgatcggctgcgtgttccaggacttccgcctgctgcccaaccgcaccgcgtacgagaatgtcgctttcgcccttgaggtgatcggcaagacgaaggcggtcgctcggcgggtggtacccgaggttctcgagctggtcggcctcggcggtaaggagcaccgctacccgcacgagctctcgggtggtgagcagcagcgtgtcgcggtggcccgcgccttcgtgaaccggccgttgatcctgctcgccgacgagcccacgggtaacctcgacccggacacctcgatcgagatcatgcgactgctggaccggatcaaccggaccggcacgacggtcgtgatggtcacccacgactccaacatcgtcaaccagatgcgccggcgggtcatcgagatcgaaagcggacggatcgtccgtgaccaggcccgcggtgtctacggctga

SEQ ID NO: 1968 - DNA, 1146 bp, Actinoplanes utahensis
gtgatctggccggacggcgtattcttgagtgtcgtgaccgctgccgacttccctgagcaactcaaagcgctcgacgccaccctccgcaacatcgagaacgtcctggacgtcgacaagctgcgccgtaacaaggcggagctcgaggagcaggcatccgctccggacctctgggacgaccaggcacgggcgcaggacgtcaacagccgtctgtcgtacgtctccggtgagatctccaagctggagcggctgcgcacccggctcgacgacgccggcctgctgctggagatggccgaggccgagggcgacgccggctcggtcgccgaggtcggtgacgagatcaccgcgctgaccaaggcgatcgaggagatggaggtccgcaccctgctctccggggagtacgattcccgcgaggcgctggtcgcgatccgggccggcgccggcggggtggacgccgccgacttcgccgagatgctgatgcggatgtatctgcgctgggcggagcggcacggctacccgaccgaggtctacgacacgtcgtacgcggaggaggccggtctcaagtcggccaccttcacggtcaaggtcccctacgcctacggcacgctcagcgtcgagtccggcacccaccgcctggtccggatcagtccgttcgacaaccagggccgccggcagaccagcttcgccggcgtcgaggtgatgccggtcgtggaacagaccgaccacatcgacattccggacaacgagctccggaccgatgtgtaccggtcgtccggcccgggtgggcagagcgtcaacaccaccgactcggcggtccggctgacgcacattccgaccggcatcgtcgtcacctgtcagaacgagaagtcccagctgcagaacaaagcgtccgctctgcgggtgctgcaggcccgactgctggagcgtaagcgccaggaggaggaggccaagatggccggactgaagcaggacaccaccggatcgtggggcgaccagatgcgttcgtacgtcctgcacccgtaccagatggtgaaagacctgcgcaccgagttcgaaaccggtaacccgatgtcggtcttcgacggcgacgtggacgggttcatcgaggccggcatccgctggcgcaagcagaaccagagcgcggcctaa

SEQ ID NO: 1969 - DNA, 762 bp, Actinoplanes utahensis
atgggaagactgtccgaatgtgctcgacaatttcggaccgatttggggctttcctgcccggcacggcctgtctggccgattcaatgcgccatcttacctggtcaaccgcctatcgacggacgaaacgcccggtctgcgcgctcgttgtcggactgtctgtgcgggacagtcgtttgtggaggcgcaaactggacggatcgtgcgaaatcctggacggcggaccgacaaagtggcagcttagaaggcatgcccgacttccagatcaatcccacggctgccgccctgctcggcctgcttcacgaggggccgatgaccggcggacagctcatggcggctgccgaacgccgcctcgggccctactggtcgatgacgcggagccaggtctaccgcgaactgcccgtactggccgaaatggggtatgtccgcctcggcaagccgggtccgcgttccagtcagccctatgcgatcaccgcctccgggaagcgcgccttcgggcgctggctgaccgagacgcccggccgggacgccctgcgcaacccggtcgcgctgcgagtcgccttcggtcagcaacacagcaccgagcagctgcagaccctctacaccaacgccaaccagtaccacgccgaggcgctggcgatggcgaaggagcaggccaaggaggcgaagaagaacgacgactcgtacggtgcggccgcgctggagttcgccgtggcgtaccacaaggcggcgctcagctggctgaagaccgttccgtccgaatga

SEQ ID NO: 1970 - DNA, 1302 bp, Actinoplanes utahensis
atggaacgctcagtgaccgccggtcgggcccctccaggtcggcctattaccctgacccccatgaccgacgcccaggccacgacggccgcaccggagaccatcgaggagtcccggctcaccgtggccctgctcacggccgccagcctcgcctggaccgtcgcgatgctgtattccgcccgggccagcatcaccggacgcgcggacgtcgccatggaggtcacctccacggcgtacgcgatgcccggcgcggtcgccgcggccatggtcaccggcgcggccgtggcgctgctggtccttaccctgatcaacgggcggcgggcactcggcgccaccgcgaggttcgcagtggccacggtcagcgggctggtcaccggagtgctgtgcgcactgccgatcatcacgatcaacatcgacggcacgatgtacgccgcggtgggcgggacggtcgcagcggcggcgacgatcggcggggcgctggccggcttccggatcccgccggtgatcgcggcagccggggcggccaccgtcggggtgttcctgatcggcttcgtgctcaacaacaaacacgtgcagaacccggtgctcgacctgctcggctcgggttcgaccgaatcggcggtcaaggcgaaccagtacttctcgtacgggcagtcggcgatcagtgggctcgccgccgggctgatcgccttccgggtgctccggcggcaccggcagcgggccggcggggcggacctgcggtggccgttctacctgatcgccggggccggggccggggtgctgtcggtgctctccgagatactgacccggacggcgggggcgcaggtcctcgaactcgccgggaaggtcagcgaactggagaagtcggtccagcagatcctcagcaccaaccggctcaacagtgggctgatcgtgctgttcgtcggggcgttcacggcgatggtcgcgatcggccgcaccctctcccccgctgacgacgaggacgactacgaggaccatccgggcgccaccgacaccgcgcccggtgccaccgcaccggctcccgacgccgccgcgcgcactcccgaagccgccgcccctcaaaccgccccgaccgctcctgaggcccccgcatccgtggccgccaccggctccgctcctgcggcgacgacagcgggcggcaagtctgacatcgtcgggacgaccgctgttgcgaagtccgacgtcgcggatgccgcgacccggccccagcaggccgagccgatcgaggcttcgtcggcccccggggcgagcgccacggacgcggcggtcggcgaccgaaactga

SEQ ID NO: 1971 - DNA, 534 bp, Actinoplanes utahensis
atggcgaagctggaggagaacgtgccgatcaccgagctggtccgggtctacgtgccggccaccctgccgatgttggcggcgctgcggaaggcgggccggctcggcgacggggcgacggtcgcgcacgcggtcacccccgcgctccgggagtggtatgcggagggtgacgaggaggagttggagtacgtcgccttcacccgggccgcccaggacgcgctgcggctgctccgtcaggacgccggggcggcccgccgccgggtcgtggtctccgccgacgtgccggcgtctgcgctggtccgggaggatgcggagctcggttcgagcacggtccggctgcccgaggcgcttcgtctggagcagatcgcgagcatccacgtggacggggccgaggcgtccgaggcggtcgccgcggccgccgtcgtcgtggaggaggctctggccggcgacccggacgcccagttcaccgtcgacgaggcggaggatcacgagctggagtggtacgcggtgacagaactggacgagatcggcgagtga

SEQ ID NO: 1972 - DNA, 1038 bp, Actinoplanes utahensis
atgcggtcggctgtcgacagcgcgccagccgggaccagggcggttcggttacgtccggttccgcgctacgaacccccgttcgacgacgagctggcgcctcagctgtggtcgccggagcagcagctggcgctcacgtggccgcgcccggtcgtcacgggggcggccgggcgggcggggccaccgccgatagcggcgccggaacgggagcgggggccggggtcttcgccggaatgtggtgggggcgggtcccgggtcggccgggcggtcgtctcgggcgatcagcgcaaggcgggaagcagccgggacaggccggcgggcggcggcgagcatcgcggcgccgaccagggcggcggggaccagtgcggcggcgagcagtgcggcggcgagcacggcggcggcgagcacggcggcggcgttcacagcggtagcgaccacagcggcggcgttcacagtggcagcgaccacagcggcggcgttcacagcggcaaggaccagggcggcagcgttcccggcggcagcgaccagggcgggtgggcgagcggtggcggtaacggcgagccggcgggcggtggccgtaccgggctgttggggtgtcatccgtggcgggaggggacgccgtgggttgatccggggcggatcgcggcgctggcggcggtgccggtggtggcggggccgtccggggaggcgaagctggcggtcaaacggttcgtgcatctgtgcgtcgaggtgctcaacgggtatcgcccggcgacccacctccgtcgactgtcgctgccggccgaggccgccgaggtggtcgcgcaggggctcgcgggcgctcgccgggtgtcggccatgcggcgggccaggcggcccggtgatcggcgcccgcagcggccgtcaccggtcgcggtcatcaaggtgaacctctgccagccccggggcggcgcggtcgaggccgccatcgccctggtcaccggcgagcgcacctgggccatggcgctacggctggaactccaccaggacacctggttcgccaccgcgctccgcctgatctga

SEQ ID NO: 1973 - DNA, 2913 bp, Actinoplanes utahensis
gtgtcgatattggaaaagatcctccgtgccggcgaaggccgcatggtacgccggctcaaggcgatcgcggacgcggtcaactcgatcgaggatgactacgtcgacctcaccgacgacgagttgcgcgagtgcaccgagcagttcaagcagcggtatcaggacggcgagtcgctcgactcgctgcttccggaggcgttcgcggtggcccgcgagggtgccaagcgcgtgctcggccagcgggcgtacgacgtccagctgatgggcggcgccgcgctgcacttcggcaacatcccggagatgaagaccggtgagggcaagaccctgaccggcgtgttcccggcatacctgaacgccctgagcggcgacggcgtgcacatcatcacggtgaacgactacctcgcccagcgggacgccgagtgggtcggtcgggtgcacgtgttcctcggcctcaccgtcggcgtgatcctgccgaaccggccggccgccgagcaccgcgcggcctaccagtgcgacatcacgtacggcaccaacaacgagttcggtttcgactacctgcgcgacaacatggcgtggtcgagggacgagctggtgcagcgtgggcacaacttcgcgatcgtcgacgaggtcgactcgatcctgatcgacgaggcccgcaccccgctgatcatctccggcccggccgagcactcccagcgctggtacgcggagttcgccgccatcgtcaagcggctggagaagggcaaggacggcgccggcgactacgaggtcgacgaggccaagcgcaccgtcgcgatcaccgagcgcggtgtgtcccgggtcgaggaccggatcggcatcgacaacctgtacgaatcggtgaacaccccgctggtcggctacctgaacaacgccatcaaggccaaggagctgtacaagcgcgacaaggactacatcgtcagccccgagggcgaggtcctgatcgtcgacgagttcaccggccgcatcctgcacggccgccgctacaacgagggcatgcaccaggccatcgaggcgaaggagggggtggaggtcaagcaggagaaccagaccctggcgaccgtcaccctgcagaactacttccgcctctacaacaagctcggcggcatgaccggtacggcgcagaccgaggccggcgagttcaacagcgtctacaaggtcggcgtcgtgtccatcccgacgcaccgcccgatgatccgggtcgatcaccccgacgtcatctacaagaccgagaaagccaagttcagcgcggtcatcgaggacatcgccgagcgccacgcgaccggtcagccggtcctggtcggcaccgtctcggtggagaactcggagatcctctccaccctgctgcgccgccgcggcatcccgcacagcgtgctgaacgcgaagttccacgcgcaggaagccacgatcatcgcgcaggccggccgcaagggcgcggtcacggtcgccaccaacatggccggccgtggcaccgacatcctgctcggcggcaacgccgacttcctcgccgcccaggagctggcgcagcgcggcctcgacccggcggaaaacccggaggagtacgcgaaggccctcgaagaggtgcttccgcaggtcaaggaggcctgcgaggccgagcaggccgaggtgcaggcggccggcggcctgtacgtactgggcaccgagcggcacgactcccggcgcatcgacaaccagctccgcggccgctccggccggcagggtgacccgggcgagtcccggttctacctgtcgctgcaggacgatctgatgaagcggttccgggccggcgcggtcgaggcggtcatggagcgcttcaacatccccgaggacgtgccgatcgagtccaagatggtgacccggcagatccgcagcgcgcagacccagatcgaggcgcagaacgccgagatccgcaagaacgtgctgaagtacgacgaggtgatgaacaagcagcggcaggtcgtctacgccgagcgcaagcgggtgctcgacggcgaggacatgcacgagcaggtcacccacatgatcgacgacgtgatcacggatgtcgtgcacgccgccacctcggacggctacgccgaggactgggacctggagcagctctggacgaacctgcggcgcctgttcccggtcaccctcaccatcgaggacctgatcgaggagtccggcggcgagcgcaacgcgatcgaccaggagttcctggtcgagcagctcaagcaggacgcgcaggcggcgtacgcggcccgcgaggaggagctgggcagcgaggccgtccgcgagctggagcgccaggtgctgctcgcggtcatcgaccgcaagtggcgtgagcacctctacgagatggactacctgcaggagggcatcagcctgcgggcctacgcgcagcgcgacccggtcgtggagtaccagcgcgagggcttcgacatgttcaaccagatgatggagggcatcaaggaggaggccgtcggcttcgtcttcaacctggaggtccaggtcgaggagcagcccaccgtcaacgtcgacccgtcccaggccttcgagctgcccaaggtcggcgaggtgccggacgacgccccggtcgacgagccgcacgagcacgtcgaggtccgcgcgaagggtctcggcggcggcaaccgtccgcagaacctgcagtacaccgcccccgccatcgacggcgaggcgggcggcggcagcccggtgatccagccgcaggcggagccgccggtcgccttcggcccgggcggcgccccgtccccggtcccggcgaacccggcccacaccaccgccggccgccacgccgccaaggaagccgactcgaacggcccgtcccgcaacgccccgtgctactgcggctccggaaagaagtacaagcgctgccacggcgcccccggcgccgtctga

SEQ ID NO: 1974 - DNA, 1092 bp, Actinoplanes utahensis
gtggatcacgacgacggggtgctgctgcgcgcccgcggcccgcaggacgaggccgcggtcacggcggcccgcgaggaccggcacggccggcggttcctgccccgcggcgggtcttcgaccagcgatttctcgtacgccgtcatccgcctcagcaccgggttcccggtcggcggcatcgatctggaccggcagcgggccgatccgggcgccgcccgggtcaccttctggatcgggtcgccggcccggggcctcgggctcgggaccgccgcgctgcgcaccctcggcgaccacattttcggcgacacgcccgaaatcaccggtctgcaccggctggagctgctgatccaccaggacaacccgatcgcccagcgggtcgcgctggcggccggcttcacgcgcgagggcgagcggcgcggcgccctgccgaacgacaccggcggctacgacgacgtgctcgtctacgcccggctggccggcgaccccgggacgcccgccgagcggctgctgcccgacctgcccggcggcgacctgaccgacggggtggtgacgctgcgcccactcggcgaggacgacatcgccttctacgccgacctgcacagccggccggacgtggtggcgaccagcgtgccgccgatcccgccggagccggacgaggtgcgccggcggtgcctctgggcgcccgcgcactggctggccggcagccgcgccgacatggtgatcgtggacaccgccaccggcgccccggccggcgaggtctcgctgtattaccaggagccgcggaccgggcaggcgatgatcggttacagcatgctgccggagttccgcgggcgcggcatgaccacccgggcggcgaaactggtcgcactctgggcgttcgccgagaccgggatcgcccggctgatcgccggcacactgccggacaaccgggggtcgcaacgggtgctggagaaggccggcttccagcgggaagcatacctgcgctcccggctgccgggcccggccggcacccgccacgacgacgtccaattcgtgctgttcgccgaagacctgctggcgcaggtctccggcggggaactcacacagccaggctga

SEQ ID NO: 1975 - DNA, 618 bp, Actinoplanes utahensis
gtggacattgtcgtcaagggccgcaacgtagaggttcccgaccactatcgagagcatgtcgccgacaagctgagcaaggtcgagcggtacgaccagaagctgatgcgggtcgacgtggagctgttccacgagcgcaatccgcgccagtcggacacctgccagcgcgtcgagatcaccgtcatgaccaagggaccggtggtccgcgccgaggctcaggcacaggatttctacgcagctctggactgcgccatcaacaaactggacgcccggttgcgccgttccgccgaccggcgccgcgtccaccgcggacggcatgcaccggtctcggtcgccgccgccaccgcgaacctgcccaccgatctgacccggggcggcgccgccacgctgaccgccgagcccgaggtcgacgagctgaccgagcacgacgacggccagccgtggcggatcgtccgggagaaggagcactccggcgagccgatgaccgtcgacgacgcgctcttccagatggaactcgtcgggcacgacttctatctgttccacgacaaggagagcggccgccccagcgtcgtctatcgccgtcgaggctacgactacgggattctcagcctggctgtgtga

SEQ ID NO: 1976 - DNA, 390 bp, Actinoplanes utahensis
gtgccgtccacccgggcggcccgccgggaccgctacggcgaccacatggcgcgcctggccgggcacgcggcgaaccggttgcgggcggccggctggacggtcgcggtcgtccagccgctgaccgcgctgccccgccctgactccacgtcactgggccctgccgcaaggtccacggcggctgtcaattccctgcgaatcaatcccgcccgaatcggcgttctgcgacgcggcgacgcgatgcgaggcacgctggtggtagccgacgacatcgtcaccaccggggccacgctggccgccgcggtacgtcgtctagaggaggcgggcatgcaggtcacgggcgccgcggtactggcagctacacaacttcgccgatcctgtcccgggatttga

SEQ ID NO: 1977 - DNA, 213 bp, Actinoplanes utahensis
gtgagcccggtcctggccgatctggccgatctggtgctgccggggtcctgcgccggctgcggggtcgagcgcacccggctgcgccggggcgcctgcccggcctgtgtgaccgagctggaggcgctggccccctacgcctgtgccccgagcccgcccccgcccggcttcccgccctgcgtggcggtcggcccgtacgccggaaccctgcgctag

SEQ ID NO: 1978 - DNA, 1830 bp, Actinoplanes utahensis
atgtctcgccgcctgatcgcgctgccgctggccggcctgctggcggtgctggtgaccggatcctgcgggattccggacgactcgggcgtgaccgtggtcgggcccggcccgtcggcgggcatcaaccccggcgactacggcggctcgacccaggtcacccggggaagcgagtccaccgaccacgcggccttcgtggagaactatctgaaggccgcgtccggcgatctggacaccgcgaccgaccggttgcgcgccttcatgtcccgcgacgcggcgaccgccttcaaacccaacacgaccggtctgaaggtgatccggctggtccagccgccactgcccaccccgggcagcgaggtggtcgaggtgaaatatcagacggtcggcacgctggacaagttcggcctgctgaccccggaggcggagagccgcaccgacgtctaccgattccgggtcggtccggtgggcggccaggacgggctgttcgtcaaggacgccccgccgaacctgctgatcagcaccgacgcgctgagcgtctactaccgcgagcacgccatctacttctggaacaccgactacaccgccctggtcccggacgtgcgctacatgccgaacgcggtgccggtcgagcagcggcccaccacgatcctgaactggatggcgaacggtccggcctcctggctgtcggtgtccgacctggccgacggcttcggcctgatcggcaaggtggtgcccgcgatcaacggcaccaggctgcagatcacgctgaacgagaagtcgctgccggccaccgacaccgcgctggcgctggaccggctgcgcaaacagctgcagtggtcgctgcggccgctgctgccggacggcggcgagctggatatcaagatcagcttcaaggacgtcgggtcgtacaccggcggcgactacctggcgagcaatccggcgtaccggttggtccccgacaacccggacaagttcgtggtgtacgacggccggatccaccgggtgaccggcgcggccaacaccccggaccaggtgccggtgctgcggccggaggacaacaaggacatccgcgccgccgcgatgagctcctccggctcgcacgtgttcgccgccgtggtggccggcaagggcgacaccctgcaggtggcctccgcggagaccggggcgcaggccgcgctgcagccgatcagcggaatgccgggcccgctcggtcagccggcctgggcgatcacctaccgggacgacgtggccgagggtgcgatcgggctgatcccggcgggcggccgcctctactcgttctccgcggtcaagggagaggcgcagctgatcccgtggaccgggcagggcacccggatcaccgcggtcgcggtggcgccggacggtcgccgggtggtgctggtggtcgacggcaagctctaccgcgcctcgctgaccaccggcggggacactccggcgctcggctccccgcagcagatccggccggtcggcctggacgcggtgaccgcggtcggcttcagcagcgagggctggctgtcggtggccggtccccgggcgtccgacaagcgggccacgatcatcgacatgtcgatcgacggcgcgttcagctccagcgccggtcccgacctcggcgagcagccggtcgacgcgatcagcgtgtacccggccaatccgacgatcctcagccgctcgcgatgggtgtcctacaccgccggcggcaaggcatgggagctgctctccaaggcgaccctgatcggtgtggaccggctcagcggcctcccgtcgtcgggcgcggcgccggacaagacgccgaccgcgcccttctacctggagtga

SEQ ID NO: 1979 - DNA, 1650 bp, Actinoplanes utahensis
atgcgtgctccggcctggcttccccaacccgtgcgccgcccccttcgggtgatgcggcgttcctggcgcgtggtcgcgcaccggctggagcggtataccgcgccggtgcgccgctcctggcgccgctcgctgcaggtccgcgtggtcaccctgacgctcgtcgcgtccagcctgctggtcggcacgttcggctggttcatcgcggaccgcagcgccaagatcctgttgaaccgcgcgcaggacgaggtctccgcgtccctgcagcgcaaggtgcgctacgcgtccgagcagctgaccgtgcacccgcagccctacgacccggagctgccggccacgatcagcgagaccgtcaccgagctgtacgacggtgaccaggccggcgacagcggcacggtggtgtcgatccgcgccgagtcctacccggagatcgtcccgcagaccgtgccgccggccaccgacacccgttcgctgatcaccccgaaactgatcaccgaggtcgccaccaacggccgggtggcccagcagatccgcaccgtcgacgtgaagggccggccgaccaagttcctggtctacggctccccggtgacgtcgaagttcggtcacgtcgagctgtactacgcggtgccgctgaccaccgaggaccgggccgccaaccagatccgcaacaccgtgctggtcaccggcctggccctggtgatcctgctgggtgtggtggccggcctggtcacccggctggtggtcaccccggtccgggtcgccgcgcggaccgcccagcggctctcggccggcctgctcgaccagcggatgaaggtggacggcgaggacgacctggccctgctcgccgccgcgttcaaccagatggcggccaacctgcagcggcagatcgtccggctggaggagatgtcccggctgcagcgccggttcacctccgacgtctcgcacgagctgcgcaccccgctgaccaccgtgcggatggccgccgacctgatcttctccgagcgggaggacttcgacccggccgtggcgcgcagcgccgagctgctgcaggccgagctggaccggttcgagggcctgctcaccgatctgctggagatcagccgcttcgacgccgggttcgccgcgctggatgccgagcacaccgacctggtgccgatcgtggagcgggtcaccgagcggctggccggtctggccgagcgggtcggcgtcgagctggagctgcacctcccggacggcccggtgatcgccgaggtggatccacggcgggtcgagcgggtgctgcgcaacctggtcggcaacgcggtcgagcacggcgaggccaagcccgtgcagatcaccatggccaccgacgacgcggcggtcgcgatcaccgtgcgggaccacggcatcgggttgaaggcgggggaggagcgcctggtcttcaaccggttctggcgggccgacccgtcccgggcccggcagaccggcggcaccggtctgggcctgtcgatcagcgccgaggacgcccggctgcacggcggctggctggaggcgtggggtgcccccggcgagggcgcccagttccggctcaccctgccggtccgcggtggcgaccggctggtggcggctccgctgccactgatcccccgggaccgtacggcggaggtgtcctga

SEQ ID NO: 1980 - DNA, 699 bp, Actinoplanes utahensis
ttggaccgcatgagagcccgggtactggtcgtcgacgacgatcccgcgttggccgagatgctcggcatcgtcctgcgcagtgagggattcctgccctcgttcgtggcggacggcgaacgcgcgctcgccgctttccgggagaatcgcccggacatcgttctgctggatctgatgctccccgggatgagcggcatcgacgtcgcgcgcgcgatccgtgccgagtccggcattccgatcgtcatgctcaccgccaagagcgacaccgtggacgtggtgctcggcctggagtccggcgccgacgactacgtggtgaaaccgttcaagcccaaggagctggtcgcccggatgcgggcccggttgcgccggggcgaggacgcggcgcccgagatgctcaccatcgggccgcccggcaaccagataaccatcgacgtgccggcgcacaccgtgtcccgggacggcgaggaggtcaagctcacgccgctcgagttcgacctgctggtggccctggcccgcaagccgcgccaggtgttcacccgcgaggtgctgctggagcaggtctggggttatcggcacgccgcggacacccgactggtcaacgtccacgtgcagcggctccgggcgaagatcgagccggatccggagcgaccggagatcatcctgacggtccggggtgtcggctacaaggcgggcaccggctag

SEQ ID NO: 1981 - DNA, 204 bp, Actinoplanes utahensis
atgcaggacgccacgatcacttggcgtaagagcagccggagtggcgctgctgggcattgcgtcgaggtcgccaacacggcggcggcggttctggtgcgcgattccaaggacgccaccggcccggtgctgaccttcgacgctcaggactggaccggcttcctcgccggggtccgtgccggacagttcgaccggcccggcgcgtaa

SEQ ID NO: 1982 - DNA, 849 bp, Actinoplanes utahensis
gtggcgaggccgacatcgacagcgcgccgggaactcggcggtgaattgcgccggctccgtggggagcgccgggcggtggatgtggctaccgcgctgggctggtccgagtcgaagctgagccggatcgagaccgcgcacaccggcatctccgagccggacctggaccgtctgctcacgctctacggcctgcgggtcgaggaccggggccggctgcgtgacctgtcccggcgcggccgcgcccgggtctggtggacgtcgtaccgctcgttcgtcaccgacccgtacgacgaatatctcgccctggagggcgaagccatctcgatctcccagtgggaggcccaggtgatgccgggcctgctgcagaccgaggagtacgcccaggcggtgatcgagaccggggccggcatcgaggacggcgaggtgatcgagcgccgggtcgccgtgcggatggaccggcagcgcgtcttcacccgggaaccacccgccaccctgcgggtggttctcgacgagggggtgctgctgcgcgaggtcggcggccgcgacgtcctggcccgccagctcacccggctgtacgaggcgaccgagcaacccggcgtggaggtgttgatcctgccgttcgaggcgggcgcgcacgccggcctcaccgaatcgttcctggtgctggagtttccggacggcacccgtaacccggtcgtgcactccgaagggctgaccggtggtcacttccgggtgaagccggaggagctcctggtctaccgcgatgcctttgatgacctgcacgaacgcgctttgtcgaaagaagcgagccgaacggtcatcgctgagacgagggatcgtttggctcgttga

SEQ ID NO: 1983 - DNA, 1179 bp, Actinoplanes utahensis
gtgtacccgctgaccggagtcatccggccgtatgcctggggctccaagaccgcgatcgccgagctgcagggccgtcccacccccaccgaggggccggaggcggaactgtggctcggcgcgcacccgggcgacccgtccaccgtgccgggcccggacgggccggtcaccctcaccgcgctgatcgacaccgacccggccggtcagctcggcgccggcgtcgccgaacgcttcgggcaccgcctgccctacctgatgaaggtgctggcggccggcgccccgctgtcgctgcaggcgcaccccgacctgaaatacgcggccgaggcgttcgcccgtcaggaggccgacccgtccctgccgaagaattacaccgacgccaaccacaagccggagatactggtcgcgctgacgccgttcgacgcgctctgcggcttccggccggcggtggtgtcggcccaggtgctggccgggctgcagatgccccggctggagccggtggtggcggcgctgcgcgccggtgacctgtccgaggcggtccggctgctgctcagctggccaggggaggaccggggcgctctgatcgacgcggtggtggccgcggcggccgcgcggggtgacaccgagccgtacgccgagtcgtaccggctggcgatcgacctggccgcccactacccgggcgaccccggcgtgctggtggcgctgctgctgaaccaggtgcacctggcgcccggcgaggcgatctggatgccggccggcaacctgcacgcctacctgcacgggctcggcgtcgagttgatggcggccagcgacaacgtgctccgcggcggcctcacgccgaaacgcgtcgacgtgaccgagctgctcaaggtgctacgtttcgacaccctggaggacccgctgctgcacggcgcggaggtggcgcccggggtgacgtcgtggcgggtgccggtccgcgacttcgagatgtaccgggtggagctgaccgggaaccggccgccggtgaaactgcccggtgcggggccgcggatcctgctcggcgtggccggggacgtgcacgtcggcgaggatcacgggattccggtgagcctggggccgggggcggccgcctacgcgccggccggcgcgggtcagctgacggctgccggtctcgggaccctcttcatcgccgccgtcccggactga

SEQ ID NO: 1984 - DNA, 963 bp, Actinoplanes utahensis
gtgagcgccgagggcggcaccaaagcgatcatcgcggcgctcagcgccaacctgggcatcgcggtcaccaagttcggtgcctggctgctcaccggctcgtcgtcgatgctcgccgaggcgatccactcggtcgccgactccggcaaccagctgctgctgctgatcgggggcaagcgctcggagaagaaggccacccccgagcaccccttcgggtacgggcgggagcgctacatctacgcgttcatcgtctcgatcgtgctgttcagcgtcggtggcctcttcgcgctctacgaggcatggcacaagatccagcacccgcagaagatcgacagctggcagtgggtgccgatcgtggtcctggtggtggcgatcgggctggagggctattccttctggaccgcgatcaccgagtcgaaccggacccggggcaccacctcgtggatcgactacatccgccgggccaaggccccggagctgccggtggtgctcctggaggacgccggcgccctggtcggtctggtgctggcgctgttcggcgtcgggatgaccctgatcaccggcaacggccggtgggacgggatcggcaccggggcgatcggcgtcctgctggtggtcatcgccggggtgctggcggtcgagaccaagagcctgctgctcggcgagggcgccaacccggaggcgatccgcaggatcgagcgggcggtgctcgccggcgacggcgtcgagcggatcatccacatgaagacgttgcacctcggcccggaggagctgctggtcgcgctgaagatcgcggtgccgcggtcggagacggcggccgaggtggcccggcacatcgacgagaccgaggtgcggattcgtgaggcggtgccgatcgcccgggtgatctacatcgagccggacatctaccggccgcgggagatcgccgatgacgcggtgacctccgcaccacccgtcaccgcctga

SEQ ID NO: 1985 - DNA, 1224 bp, Actinoplanes utahensis
atggtcaatccgctggagggttcggccggggtcaacgggcaccgggtcgccgacgagtcgctgctcaacgacgagaagtcgatgctggacaacgacccgggcgggatgctgcgggccaccgcgtcggccggcgcccaggtccgggagaccgcggcgctggccgccgaggtcgacctgaccatgctggccgacgagggccgcccgcgcgccgtcgtggtcgccggcatcggcaccgccggtctgaccggcaacatcctgtccaccgtcgccggcccgcgctgcccggtgccgatcatcgggcaccgcagcgccggcatccccggctgggtcggcgcggccgacgtggtgatcgccgtctccgcctccgggcgcagccccgaggcgctggccgcggccgaggcggcggcccgccgcggcgcccgcctggtcgccatcggcaaccccgactccgagctggaggcgatggccgagcgggcccgcgccccgttcatcggcgtgccgcgccgcgccccggcccgcgccaccctctggggcctggccgtgccggtgctgctggccggccgcgcgctgggcctggtcaaggtcaccgaggccgacatcgccgagaccgcgacccggctggacgcggacgccgagcgctgccgtccgggcgccgactccttcgtcaacccggccaaggcgctggctctcggcctggccggctcggtgccgatcgtctggggctcctccccgctggccaccgtcgccgcccgccggttcgccgacacactcgccgcgaatgcgcgctacccggtgatggccggtgcgctgggcgaggccggccggggccgggtcggcctgctcgacggcgtcttcggtggcctcgccgagggctcccgggacatcttcgccgacccggaggacgccgacgaggcggtcacccggctgcgcctggtggtgctccgcgacggtgggctgaacccggaggacgacgccgacgagccggtcgccgtcgaggagcgccgggcggacgccatccagactctcgccgatcgccgtggcgtacgctgcgacgtgctcaccgccgagggtggttcgaccctggagcggctcgcgtccctggtcgcggtgcccgacttcgcgtcgctctacctggccctggcccacggcctggacccgatggcggtgccggccatcagcgagatgaaggagctgtccaacccgatgccagagggactctcgtga

SEQ ID NO: 1986 - DNA, 186 bp, Actinoplanes utahensis
gtggcgctcgatccgcagttgctggacatcctggcctgcccggacacccatcacgcgccactggactacgacgccggcgggcagacattgacgtgcaccgagtgcgggcggatcttcgacatcaaggacgacatcccgatcctccttctcgacgaagctcgtgttgttgagaagggggatcagtga

SEQ ID NO: 1987 - DNA, 1380 bp, Actinoplanes utahensis
gtgctcgatctgtcccagatcatcaaggcgtacgacgtccggggcgtcgtcccggaccagttcaacgagccggtggcccgggcgatcggcaccgccttcgtcgagatgctgcgggagtccggtgacgagccggaacggatcgtggtggcgcacgacatgcgcgagtccggtcccgggctggccgccgcgttcgcccgcggggtgaacgcggccggtgccggcgtgctcaacatcgggctggcctccaccgaccagctgtactacgcctccggctcgctgggcctgcccggcgcgatgttcaccgccagccacaaccccgcgcagtacaacgggatcaagctgtgccgggccggtgcccgcccggtcggccaggacagcggcctggtcgtggtccgggtgcgtgcccaggaactgctcgccgacctgaacgcggaggccgacggcccggcccgggtcgagcaccgggacctgctcggcgactacgccgcgcacctgcgctcgctggtcgacctgagcggcatccgtccgctcaaggtgatcgtggacgccggtaacgggatgggcggctacaccgtgccggccgtcctcggcgaccaggtgctcagcccgctgccgctgaccatcgtgccgctcttcttcgagctggacggctccttccccaaccacgaggccaacccgctcgacccgaagaacctggtcgacctgcaggccgcggtgcgcgagcagggcgccgacatcggcctggccttcgacggcgacgcggaccgctgtttcgtcgtcgacgagaacggcgacccggtctcgccgtccgccatcaccgggctggtggccgcccgtgagctggccaagttcccgaacagcacgatcatccacaacctgatcacctcggccgcggtgccggagatcatcctggagaacggcggcaagccggtgcgcagccgggtcggccactcgttcatcaaggccgagatggcgcagtccaacgcggtcttcggcggcgagcactcggcgcactactacttccgcgacttctggttcgccgacaccggcatgctggccgcgatgcacgtgctggccgcgctcggcggccaggacctgccgctgtccgagttcgccgcggagtacgagcggtacgtcgcgtccggtgagatcaactccacggtggccgacgcggccgccaagagtgccgaggtgcgcgccgcgttcccggacgcccaggtggacgatctggacggactgaccttcgggttcgaggacgggtcgtggttcaacctgcgggcgtccaacaccgagccgctgctgcggctgaacgtggaggcgccggacgcctcgacgatggcgtcgctcagggatcgcgtgctcgccatcgttcgcggatag

SEQ ID NO: 1988 - DNA, 648 bp, Actinoplanes utahensis
gtgcacccttggccccgtaccgaagaagaagctctcgccgtccaggacctcctgcgcgcccgggtcgtcgccgcgccgggcccggcgtccccggagaccgtcgccggcctcgacgtcgcctacgacggtgaccggctcggcgcggccgtcgtcgtgctcggcacggcggacctcgcggtccgcgacgtcgcgctgatcaaaggccagaccactttcccgtacgtcccgggcctgttcgccttccgcgaagtccccgccctgatggccgcgctggagaagctgaccgtgcgcccggacgtgctgatctgtgacggtcccgggctggcgcatccgcgccggttcgggctcgcctcgcacctcggcgtgctgaccgatcttccctcgttcggggtcggcaagacccgtcttgtgggtgagtgggcgccgctcggcgagtcgcgggggagccgctcggcgctggtcgacgcgggtgagacggtcggcgcggtgctgcgcacgcagtccggggtgaagccggtgttcgtgtccgccgggcaccgcatcgatctggacaacgcctgctcgttgacgctgcggctggccgcccggtaccggctgccggagaccacccgggccgccgaccgggcctgccgtgatctcgtccgttaa

SEQ ID NO: 1989 - DNA, 1263 bp, Actinoplanes utahensis
gtgctgccggtgaatccgtggcttgccctgacccctggtgacgatccggccgagcggatccggcaggtggggcgcgcccacgagcggttcctggccgggcagcggcggccggagctgatgcgcgcggtggtggccgagtcctgggcccgatcggcggcctgggtcggagcggacagcacgccgccggtcgagctctgcgacgacgagctgcaggcgtatcgggccgcgcatccgctggcccgggtgatgccgatcttccgggatctgctgggcgggctggccgaggacggcgatcacatcctggccgtctgcgacgcgcacgggcggctgctctgggtggagggcaatgccgggacgctgcgcggggtggcgtcgatgaacttcgtgccgggcgcccgctgggacgaggcgcacgccggcaccaacgcgccggggaccgctctcgcggtcgaccacgcgctgcagatcttcgcgaccgagcacttcaaccggtcggtgcagcggtggacgtgcacggcggcgccgatccacgacccgggcaccgggcggctgctcggggcgatcgacgtgaccggcggcgaccacctggccaatccgcacagtctggcgctggtcagagccacggcgctggctgccgaggcgtacctgtacgagccgccgcgggcgacgagcggaccggcggtgacggcgctcggccgggatgaggcggtcctggtgtccgggaattcccggacgaagctcagccgccggcactccgagctgctgatcctgttggccgcccaccccgagggccgcaccggcgaccagctgaccctggacctctacggcgacgacctcaatccggtcaccgtccgggccgagatgtcccggctgcggcgcatcctcggcccggagctgctccgctcccgcccctaccgcctccagaagcccatgaagacggacttgggcgagatgtctgaagcactcgccggcggcaacctcgccgaagcactgaggaactaccccggccccctgctccccggctccgacgccccgggcatcgtccgcctgaggcgcctgctcgacgaccgcctcagaaccgccctgctgcactccgccgacccccacctgctgcgggaatggctgagcaccccgcacggcgccgacgacctggcgctgtgggaggcctatgccgtcctgacccccggcgacccgctcaccagccgccgcatcaccgagctctcccgcgaatacgcgtgcaacgtttctgcaacgtactcgtga

SEQ ID NO: 1990 - DNA, 1524 bp, Actinoplanes utahensis
atgaccacgtatgttccgcccggctccgaaggcgcgatcgtcagctaccagtcccgttacgaccactacatcggcggcgaatacgttccgccggccaagggccagtacttcgagaatcccaccccggtcaccgggagtgcgttcaccgaggtcgcccgcggcaccgccgacgacgtcgagcgggccctggacgccgcgcacggcgccgccgacgcgtggggccgcacctcggtcgccgaacgcgccaccatcctcaaccggatcgccgaccggatcgagcagaatctggagaagctcgccgtcgccgaatcctgggagaacggcaaaccggtccgcgagacgctcgccgccgacctgccgctcgcggtcgaccacttccgctacttcgccggggcgatccgcgcccaggagggcaccgcgggccagatcgacgaggacaccgtggcgtaccacttccacgagccgctcggcgtggtcggtcagatcatcccgtggaacttcccgatcctgatggcggtctggaagctggcgcccgcgctggccgccggcaacaccgtggtgctcaaaccggccgagcagacccccgcctcgatccactacctgttctcgctgatcggcgacctgctcccggccggcgtggtgaacatcgtgaacggcttcggcgtcgaggccggcaaaccgctggccagctcgaaccgggtcgccaaggtggctttcaccggggagaccaccaccgggcggctgatcatgcagtacgcctcggagaacctgatcccggtgaccctggaactcggtggcaagagccccaacatcttcttcgacgacgtgagcggcgccgacgacgacttcttcgacaaggccctcgaaggcttcgcgatgttcgcgctcaaccagggcgaggtgtgcacctgcccgagccgcgcgctgatccagcagggtcactacgccgacttcctgtccgcgggcgtcaagcgggtcgagaacctgcggcagggcaacccgctggacaccgacacgatggtcggcgcgcaggcgtccaacgaccagttcgagaagatcctgtcgtacctcgacatcggccggaaagagggcgcgaaggcgctggtcggcggcgcgaaggcggacctcggcggcgacctgtccggcggcttctacatccagccgacgatcttcgagggccgcaacgcgatgcggatcttccaggaggagatcttcgggccggtggtctcggtgacgccgttcgccgacttcgacgacgcgatcaagatcgccaatgacacgttgtacgggttgggagccggcgtgtggacccgggacatcaaccgggcgtaccgggccggtcgggcgatcaaggccggccgggtctggaccaactgctaccacctgtacccggcgcacgccgcgttcggcggatacaagcagtccggaatcggccgggagaaccacaagatgatgctcgaccactatcagcagaccaagaatctgctcgtcagctactcccccaaggccatgggattcttctag

SEQ ID NO: 1991 - DNA, 378 bp, Actinoplanes utahensis
atggcgacccgcgtcgacgtgactcccgcggccgccgccatgatgcggcggctgcgggagcagcacggcccactgatgttccaccagtccggcggctgctgcgacggcagttcaccgatgtgcttcccggagggtgaattccgcaccggcggcagcgacgtgctgctgcagtcgctggcgatcgagggggtgccggagccgatcacgttctggatgtcggccgcgcagttcgaactctggaaacacacccatctgacggtcgacgtggtgccggggcgcggcgccggcttctcgctggaagcgccggaaggcgtccgcttcctgatccgctcacgattgctgaccgacgcggagcaggaggagctgaaaacccgttga

SEQ ID NO: 1992 - DNA, 840 bp, Actinoplanes utahensis
atgcggctgtccagcacccggagagccctgctgatcagcatgtcgctgatcctggcgggtcttctcggccaggcggccgccgcggaatcgacacacagctcggcctccgccgcggcgcccgccgtctccgcgtcaccggtctccacccccacggtggcgactccaccggtggtgaagcccaccaaaccgcgcaccgagagcacccggattccggaacggcccaagggacacagcgggccggccggcagcctgctcaccaccggcagccgcggcgtcgccctgaccttcgacgacgggcccgacccggcgaacaccccggcgctgctgcgcatactcgccaagaatcacgtgaaggcgacgttctgcgtggtcggtgagaacgtcaaaaaccaccctgacatgatccgcaagatcgtggccggcgggcacgccctctgcaaccacacctgggatcacgacctcaagctcggcaagaagagcccggcggcgatccgggccgacatgcagaggaccaacgacgccatccgggccgcggtgccccaggcgcagatcaaatacttccgggcgcccggcggcaacttcacgccgcagatcgtgaaaatcgccaaggaactcgggatggcctcgatctactggaaggtcgacccgcgggactgggaacacggccgcgaggaatcggacggcgcgcacaccaaccgggtcatcaccacggtgaaaagccacaccgggccgggagcgatcgtgctgtcccacgactacgcccagccggacaccatccgggcgtacgccacgctcatcccgtggctgcgcagtcgcttccgcctcatcgccctgccgtga

SEQ ID NO: 1993 - DNA, 366 bp, Actinoplanes utahensis
gtgaggtcaccacggcgctgctcccggaacggctgtccccgacaggcggtcgccactttgacctacgtctacagcgattcgaccgctgtcgtcgggccgttggcggcgttcgccgagccgcacacgtacgacctgtgcgagccgcacgcccgcagcctcaccgccccccgaggctgggagctcgtccggcacgacggcgatttcgccccgccgccccccaccaccgacgatctggtcgctctggccgaggcggtccgcgaggccgcccgcccggcgcccccgccgcgtccagatgtgccggagcagccgccgggccaccagaccggccgccgcggtcacctgcgggtcattcccccgtcccactga

SEQ ID NO: 1994 - DNA, 477 bp, Actinoplanes utahensis
gtgaccaccagccccgaacgccgccgcaccgacccgaaagcggcgcgcagcaccggtccgggccatccggcgcgccgcgaccggcacgggcgcggcctgcgcggccgcctggtgccggcgaccgtgccgctcgcccgcaccaaggcggagatcttcgacgatctggtgctggacaccgtcgaaagcttggaacggcggtatgcgaaagagctggccggcgtcgagttcgcggtcgaggacgtgccgcccgagctgaacgtgtacgactcggacgtgctcgaggacggcgaggtgcccctggcccggctgctgcccggccgcccggggcggcacgagctgccgccgcggatcgtgctgtaccgccgcccgctggaattccgggcgatggaccgggaggacctcgccgacctcgtccacgacgtgatcatcgagcaggttgccaacctgctcggcgtcgacccggacgagctggcctga

SEQ ID NO: 1995 - DNA, 258 bp, Actinoplanes utahensis
atggaagcgcaggttgaaggggtagacctgcttggggacgcgcccgagtggcaggagcgggcgctgtgttcgcagaccgatccggaggccttcttcccggagaagggtggatcgacgcgcgaggccaagcgcatctgcggtcgctgcgaggtcaaagccgaatgtctggagtacgcactcggccacgacgagcggttcgggatctggggtggactgtccgaacgtgaacgtcgcaagctgaagcgacgcgtcgcctga

SEQ ID NO: 1996 - DNA, 2748 bp, Actinoplanes utahensis
gtggcagaggtcaacgagggcgtttcctcagcagtggcggcagccggttccagcgcgacggccgggtccggtgcggccgccgttttccttccggcgcccgtcttccttccggcgctcggctccggtgcggagcccggttcggtcgcggtgcccggctcggttgcggtggccggttcgggttcggcgcccggcgcggttgcggcggccgatgtggccgcgcccaccgaggcgagcatccggcgggcgctgcgccgggccgccgacggcaaggcgatcgacgtcgacgaggcgaccgcgctgttggcggcgaccggcgagcagttcgacgagctgctgacgatcgccggcggcatccgggacgcgggcctgcgggaggccggacggcccggtgtcgtgacgtactcgaaaaaggtcttcatcccactcacccggctctgtcaggaccgatgtcactactgcacgttcgccaccgtgccgcaccgcctgccggccgcgttcctggagcgcgacgaggtattggagatcgcccggcagggtgccgcccagggctgcaaggaggcgctgttcacgctcggcgaccggcccgaggagcgctggccggccgcccggcagtggctcgacgagcggggctacgactccaccctcgactatgtgcgggcctgcgccatcgcggtgctggaggagaccggtctgctgccacacctcaacccgggcgtgatgagctgggccgagctgcagcggctcaagccggtcgcgccgagcatggggatgatgctggagaccaccgccacccggctctggtccgagcccggcggcccacactacggttcgcccgacaaggagcccgcggtccggctccgggtgctcgacgacgccggccgggtcggcgtgccgttcaccaccggcatcctgatcggcatcggcgagacgccggccgagcgcgccgagtcgctgttcgcgatccgccgcaccgcgcgcgagttcgggcacatccaggagatcatcattcagaatttccgcgccaagccggacacggcgatgcgcgggatgcccgacgccgagctgcgcgagctggccgccacggtcgccgtcggccggatcatcatgggcccgcgggcccgtgtccaggccccgcccaacctgatcgacgacgagttcgcgctgctgctgcgggccggcatcgacgactggggtggcgtctccccggtcaccccggaccacgtgaacccggagcgcccctggccgcagatctcgctgctcgccgagaaatccgcggcgtccggcttcaccctgcgcgagcgcctcacgatctacccggagtatgtgcggcgcggcgccgagggctggctcgacccgcgcctggccgcacacgtgaccgcgctcgccgacccggccggcctggcccgcgaggacgcgttccccgccggcctgccctggcaggagccggacgaggcgttcggcaccggtcgcaccgacctgcacgccgcgatcgacaccgagggccgcagtggtgaccgccgctccgacttcgactccgtctacggcgactgggacgaggtggccgcccacctcaggaccccgcagtccgcgcccgccgggagcgatccgcggtcggtgcccgccggggatgtcccccgcaccgtgccggccgacctgctcgccggtctcaagctcgcctccaccgacccggcggcgctgctgctgccgcagcacgaggacgcggcgatggcgctgttcaccgccgacggcccggcgctcgacgagatcgcccggatcgccgacgacctgcgccgcgacgtcaacggcgacgacatcacctacgtggtgaaccggaacatcaacttctcgaacgtctgctacgtcgggtgccggttctgcgcgttcgcccagcgggagaaggacgccgacgcctaccgcctctccgtcgagcaggtcgccgaccgcgccgagcaggcctggcgcgacggtgcctccgaggtctgcatgcagggcggcatcgacccgaagatgccggtcacggcatatgcggacctggtccgcgcggtcaagcagcgggtccccggcatgcacgtccacgcgtattcgccgatggagatcgtcaccgccgccgccaaggccggtgtctccctccgggagtggctcaccgatctgcgcgacgccggcctcggcaccatccccggcaccgccgccgagatcctcgacgacgacgtgcgctgggtgctgaccaagggcaaactccccaccgccacctgggtcgacgtggtcaccaccgcgcaccaggtcggcatccgctccagctccacgatgatgtacgggcacgtcgaccacccccgtcagtggctgggccacttccgggtgctggccggcatccaggacgtgaccggcggtttcaccgagttcgtcgcgctgccgttcatccacaccaacgcgccgatctacctggccggcatcgcccgccccggccccacctggcgggagaacagggtcgtccacgccatggcccgcatcctcctgcacggccgcatcccgaacatccagtgctcctgggtcaaactcggcgacgagggcacccgcatcatgctcaacagcggctgcaacgacctgggcggcaccctgatggaggagaccatctcccggatggccggctccgaacacggctccgcccgcaccgtcgccgagctcaaggaactcgccgcggccgccggccgtcccgccgtcgaacgcaccaccgtgtacgcccgccgctga

SEQ ID NO: 1997 - DNA, 861 bp, Actinoplanes utahensis
gtgaccagtgcaccgcctgagggcaaaccgatcggccagtacctgacgccgctgcgtgacctcgccgcgtacgtcttggtcggcgccccggccgtgttcctcctcgccaccgtgctgaacctgttcggcgacggcttcggcgctcgcgcggcggccagcttcggcgggttcatcagcctggagacgatcggcatgccgctggccgcggtgctgctggcgctcggcatcaagccggtccaccccagagcccggctgatcacgctggccgcggtcatcgagtacgcggtgatggcgttcttcggggtgatcttcggcctgctgttcggtgtgatcaacatcgcgtcgtacgacgcgggggcggccttcagcgcgctcctcgcccgggtcgcctggctggcggtgttcggcgtggcggggtacgcggtgctgcagatctggcggggcgtctacatggtgccgaaaccgcagatgccgccgggggtgtacgggcagccgcagtcgtacgggcagccttacgggcagccggcggcctatccggcttcggggatctacggacaggcgccgtcctacccgccgggcacctatggtcagccgccgcagccgcagccgccgcacgctcagccggttccgccgccggcgccgccggtcgtctcgcggactcagccgccggtcgcgtcgcaggctcagccgccggcctggaatcagccgccggtggtcgcaccgccggtcgccccgccgccgttggccgagcccacccaggtggtgccgcgcggcgaaccggagccgatcgaccgcaccagcgtgctgccggaggagcgtcccggcttcgggccggccgacgccgacccgccccgacagtaa

SEQ ID NO: 1998 - DNA, 951 bp, Actinoplanes utahensis
atgcggatcgtggtcctcaccgggggtatcggcggcgcccggttcctcgtcggcgtgcgtcagcacgcccgtgccatcggcgccgaggtcacagcggtggtcaacgtcggcgacgacgtccggatgcacgggctgcagatctgcccggatctggacagcgtgatgtacacgctgggcggggcggccgacccggagcgcggctggggccgggtcggcgagagctgggtcgtcaaggaggaactggcgaaatacggcgtcgagccgtcctggttcggcctcggcgacaaagacaccgccacccacctggtgcgcaccacgatgctgaccgccggatacccgctctcccaggtcaccgccgcgttgtgtgagcgctggcagcccgggatcacgatgctgccggccaccgacgaccggctggagacgcacgtggtcgtcgatgtcgacggcgagcgcaaggcgatccacttccaggagtggtgggtgcgctaccgcggggcggtgccgacccaccggttcatcttcgtcggcgcggagaaggcgaggccggcggccggggtgctggacgcgatcggcgcggccgatgtgatcctgatcgccccgagcaacccggtggtcagcatcgcgccgatcctggccgtgccggagctgcgcgaggcggtgatcggcgcggcggcgccggtggtcggggtctcaccgatcatcggaggttcacccgtccggggtatggccgacaggtgcctggccaccctggaggtggaggtgagcgcggccggcgtcggccggatgtacgggccgcgcgccgagggcgggctgctcgacggctggctggtcgacacctcggacgcgggcgtcgagatccccggcgtggtgacccgcgcggtgccgctgtggatgaaggacgagaccctcaccgcgcagatggtcgcggacgcgctggagctggcccgatga

SEQ ID NO: 1999 - DNA, 555 bp, Actinoplanes utahensis
atgagtttgtacgaggatgccgtccgcgtcctgaccggctggccggccacctccgacgtggccgaggtgaaccgcaagcgcaccctcggcctgctcgccgacggtccggtggcgatgacccgggcgcaccgggccgggcacgtcacagccagcgcgctgatcgtcgacgacgccggccgggtgctgctctgcctgcacggccggctcgggctgtggatgcagctcggcgggcactgcgaggacggcgacgcgaccctggcggccgcggcactgcgcgaggcgaccgaggagtccggcatcgacggcctgctcctcgacccggagccgatcgacatcgacatccacgaggtgcgctgcggcgcgacggacggcgctccggccgaggcttcgatccattacgacgtacgttttctgctgcgcgcgccggccggagccgtggagcggatcagcgcggagtcgtccgacctggcctggttcgcgccggacgcgctgcccagcccgctcgcctcgggcgtcgtccagcagatcggtccggcgcaggcccggctgggctga

SEQ ID NO: 2000 - DNA, 660 bp, Actinoplanes utahensis
atgcgcgacctccgcacccgcgccctctgcgccgccgccgccgccctgctcgtgctcggctcggtaaccggctgttccgggaccgccgagccggccgccccgaccgccggcaccactgcgagcagcgccggcggaaccaccggaaacgccgcaaccgccggcacgggcaggaccacggccgcccacccggtgaccgcgaagaagccggccgcctgccacgacgcggacctcgccatcacgatcaccgcacagccggacgacccgggcaccggcgccaccctgcgcgccatggtcaccctgaccaacaagagcaggcacacctgcaccctgaacggctggccgtcggtcgcgccgtacgacatggccggcgaagtgatcaaagtggcgaccgtgcgcaaggtggcccaacccggcccggtcgcgccgttcaccgtcgacccgggcgtctccgccttcgccgggctcaagtgggccacctgcggcgacgacgagaactgcggctggggcaacgcgctgcgggccagcgtgcaggggccggccacccagggtcagtgggcggaactggagggtttcggcgacgccgagcacaacaacatccggatcaagtcactgcagatcggcacgctgcagccgagccaccagggcgtcgtcgcctggtga

SEQ ID NO: 2001 - DNA, 1122 bp, Actinoplanes utahensis
atgagcgacgaacagagtgcgctgtacggagtggttctggcgggtggcaccggaacccggctatggccactgtcccgcgccggtcatcccaagttcctgcaccccctgaccggcaccgaggcctccctgctgcaggccacggtcgaccggctggacacgctgaccacgcccgacaaggtgttcgtcgtcaccggggtggcccacgcggccgcggtctcccgccagctcaccgcgatgcccgacgagaacgtgctggtcgagccgtcgccgcgggactcctgtgcggcgatcgcgctggccgccgcggtgatcgcccggcgcgaacccgaagcgatcatgggctcgttcgcgtccgaccacctgatcgccgacaaggccgagttcaccagcgtgatccgtaaggcgatggtcggtgcccgggacggcctgctgatgacgctcggcatcaccccgacccgcccggagaccgggtacggctacctgcagtgcggcggcgagctgcacgaggacggcccggtgctgcaggtcgaggagttcaaggagaagccgtcgtacgacgtcgccgagtcgtacgtgaaatccgggaactatctgtggaacgccgggatgttcgtctggcgggtcgacgtgttcctggccgagctcgcccgccagcaaccgcagctggccgccggggtgagccggatcgcccaggcgtggggcaccgccgagcaggaggaggtgctcggcgaggtgtggccgaccctgccacgcatctcggtggattacgcggtgatggagggcgcggccaccgtcggccgggtcgccaccgtccccggtgacttcgggtggaacgacgtcggtgacttccacaccctgggcgaggtgctgaccgccgacccggccggcaacgtggtggtcggccacgagcgggacggcgaacgccccacggtgctgctgcgggacaccgagaacctggtggtggtgcccgggtcggggcggctggtggccgcgatgggcgtccgcgatctcgtcatcgtcgacaccgcggacgccgtgctgatctgcccgcgggagcgcgcgcaggaggtcaagcacctggtcgaccagctcaaggagctgggtcagcacggctacatctga

SEQ ID NO: 2002 - DNA, 1194 bp, Actinoplanes utahensis
atgccccaccgcagcatcggtacgtcgaaaccgccaaggagatgcctcgtgacccccggtcgccccccgcgagtgctggtcgacgccactagtgtccccgcggacagaggtggagtcggcagatatgtcgacggattgctcggcgccctcgggcagctgggcccggaacgtgtggacctggccgttgtcgcccagcgttcggatgcggagcgttaccgccggatgctgccggaggcacaggtgctgcccggtccggcggcgatcgcgcaccggccggcccggctggcctgggagcagaccggcctgccgctgctcgcccagcaggtcggcgcccacgtgctgcactcgccgttctacacgtgcccgctgcggaccggcgccccggtcacggtgaccgtgcacgacgcgaccttcttcaccgagccggagcactacgacaacaccaagcggaccttcttccgcagcgcgatcaagacgtcgctgcgccgggccgcccgggtgatcgtgcccagcaaggccacccgggacgagctgatccgtctgctcgacgccgaccccaccaagatcgacgtggcgtatcacggcgtcgaccaggccgccttccacatgccgaccgaggaggagaaggcccgtgtccgggcccgcctcggcctgggtgacgccggctacgtcgccttcctcggcgccaaggagccgcggaagaacgtgccgaacctgatccgtggctgggcccgcgcggtcgccgactggccgcgcccgccggccctggtgatcgccggcggccagggccacgacgacgacatcgaccgggcggtcgccgaggtcccgtcgcacctgcggctgctgcgccccggctacctgcgctacgccgacctgcccggtttcctgggtggcgcgctggtcgcctgctatccctcgttcggtgagggtttcggcctgccgatcctggaggcgatggcctgcggcgccccggtgctgaccactccgcggctgtcgctgcccgaagtgggcggtgacgcggtcgcctacacgaccgaggcaccggagcggatcgccgaggatctggccgacctgatgcacgatgagcagcgacgacaggcgcttgccaaagcggggttcgatcgggcgaaagaattcacctgggcgtccagcgcggaggtgcatgtaacaacgtggaatcgggttgcgaactga

SEQ ID NO: 2003 - DNA, 738 bp, Actinoplanes utahensis
atgaacaccacgattccgcaggcgttcgcggaggcggtccggcgggacccggccgcacccctgctcacctggtatgacgacgccaccggcgaccgtgccgaactctccggcgccaccctggacaactgggtgtccaaaacggcgaacctgctggtcgacggggtcggcctgggccacggcgacagcgtcgcactgctgctgccgccgcactggcagaccgcggccatcctgctcggcgtgtcggccgccgggctcgccgccgacctggccgacctgggcggcgacccgcagccggtggaggcgctgttcaccacccccgatcgggtcgagcgggcggccacctggtccaccgcggaccggtacgccaccggcctgctgccgctcgccatgccgctgcgcgaggtcccggccggatacgccgacttcgtcaccgaggtgcgcaaccacggcgaccacttccgcggccagccggtggcgccggccgaccgggcgttcgccggcccgatcgaactcagccacgcggacgtgctggccgccgccgaagaccgggccacccagctcggcttcggcgccggcgaccgggtgctgatcgacgtcaccatccaccccgatccggtggactggctgctcgcgccgctggtggccggggcctccgcggtgctctgcgccaacctggacgagagccggctggacgcccgggccaccgcggagaaggtcagtctcgtcctggcggtgtga

SEQ ID NO: 2004 - DNA, 543 bp, Actinoplanes utahensis
gtggaagatcagctaccggggcgccccgtggaactcagccgggtgacgctcagcaggatcatgaccgcggtggacgtcaatctctacggcaccgtgcacggcggcgtgctgatgaagttcgtcgacgacgtggccggcgcggcggcggcccggcacagcggcgggaccgcggtgaccgccgcgatcgacgagatcgtcttcctggagccggtccgggtcggtgacctggtgcacgcgtacgcgcaggtgaactggaccggcaagagttcgatggaggtcggcgtgaaggtgaccgccgagcgctgggacgtggtcggcgccaccccgctgccggtcgccaccgcctatctggtgttcgtggcggtcgatgtggccggcaagccgcgggccgtgccgccggtactgtccgaggatccggacgaccggcgccgcttccgggaggcggaaatccgtcgcgatcaccgcctcgcccgccgcaccgcgatccagaaggcccgcctgacggagagccaggacccggtcacaccgccaggacgagactga

SEQ ID NO: 2005 - DNA, 1245 bp, Actinoplanes utahensis
atgcgccacctccggtcgatcgtttacgcactcgtgctcgcccccgccgcctggatcctcgccggcgtcggcttcacccacgacctgaccagccgtggccgggatttcttcaccgccgagtcgctgagcggcctgttgctgctgatcttcgccggagtcctctacggcatcatgatcctgtccccgatctccccggccggccccaccctcgccggcgccgcctacatgggcaccacctggtgggcctggactgccccgaagtcctacgccggaatctggccggccgccgtcgtcaaggacggcttcgacctgagccgcccggcctacggcctcgccgccctgctcgccgtgccactgctgtgcaccgcgctgagcgcccggcgatgggcccgctacgagccgccggtgctgccgatcatcggcgagatcggccggttccgcggctcggccagggtcgccggcgacaacgtcgcggccatcgagacgaccgtgctgcgcaccagcgggccggcgccgtcccgccacccggccccgccggccgccgccacccagatcatcccgcccccggcggccgtttccgcacggcctgccgcaccgcagaccgcggcaccgcagaccgccatccccaagatcgttccttcgccgcggaccgtcgcccctcaggacgacaaaacccgattgctgggtacgccgtcagccaccccgcagctccccacccccgccggcgagcctgcggtccccgcgaccgccggcgacccgacgactccttcagtcggcagcgttcgcgcggcctcggacgacgcgaccgtgacctttgccgcggccaccaccgcgcctaaatctaataaatccggtattaccactaattcggctattaccgccggggccgaaaaatcggacgctcgaccgcccgtcagtgacctctctgacgagaaaaccgtcaccctgactgccgctgccaagcccgccgccacaccggccgccgccgccaagcccgccgctgccgccacaccggccgcggccgcaaacccgtccaccaccccagccgccgcaatggtgaagcccctgccggccgccaccccaaactcggcaaccacgccgggtggcacgactgcgccgagctcgtccgccgcaaagagcgagccggactcggatgacaggacggtgctgttctccgccaagaacgtcgaggacgaagagaccgaagtcctgtcctcgaccggactcgccccggcgaaggactaa

SEQ ID NO: 2006 - DNA, 636 bp, Actinoplanes utahensis
ttgactgagaccccgttgtggctgcagggccgcgctgctgtcatcgaggccgccgacccgtcggagttccggcacggcacccctgactaccacctgtcggctgtcgtgatgcccgggcagcgcaccacggagcacgcccccggttccctcgaggccatcgtcgagacgatcgtccaggtcttcgagatggaggtctcgcacaagaaggacccgaagacgtgggtctcgatggtgtccgagcacttccgcaccaacgtcaacggcggcggctgggcctcgtcccaggacatcgcggaccagggcagctacaacatcctgatcggcgacagcgtcttctacaagccggagtccttcgacggccagcacgacgtcttccacggcgccttcccgaacggcttctactgggaggtcctcgaggtcctcagccccccgccggtggtcaccttcaaatggcgccactggggttctttcgacggcgagtacaacggccaccagccgaacggcaagaccatcgagatgttcggcatgagcgtcgccaaggtcaacgacgacctgaaactcctcgaggtcgagcactactacgacccgaacgccttcctcggcaagctgacgggcggctgcccggtcgtccactga

SEQ ID NO: 2007 - DNA, 1164 bp, Actinoplanes utahensis
atgcatccggaaacccgcttgatccacctcaaggcaccggttccgcagggcagcaccccgctggccgtgccgatctaccagacctcctcgttcgccttcgacgacccggagctgatcgccgacgggctgcaccatcccgatcgcgcctacgcgtactcccgcttcgcgaacccgaccgtccgcgccctggagaacgcgatcaccgacctggagggcggcgccgccgcgatcgccaccagctccgggatgggtgcgatcaccctgctgctgcacggcctgctgagtgcgggcgaccacgtgatcgtccagcgcgacgtctacggcggcacgcacgcgcagctcggtgatctggccgcgcgcttcggcatcgaggtgacccggatcggcggccacgacccggcggaactgcgggccgcgctgacgccgcggacccgggtgctctacctggagacgatcgcgaaccccaccggccacgtcagcgacctgcccacgctggccccgatcgcccgggacgccggggtgctgaccgtggtcgacaacacgttcgcctcgccgatcttctgccgtccgatcgagcacggcgccgacgtcgtggtccactcggtcaccaagttcctgggcggtcactcggacgtcaccggtggcctggccgtcttcgccgaccgggcgctgtacgagcgggtctgggagcagtcggtcgagttcggcgccaccgccgacccgttcgccgcctggctgaccctgcgtggcctgcacaccctcggtctgcggatggaccggcacgccgccaacaccgcccgggtcgccacctggctcgccgcccaccccgccgtcgaggcggtccgctggaccggcgacccgtcgcaccccagtcacgccgtcgccagccggttcgtgcagggcttcaccggtgccttctgcttcgacctggacggtggccacgacgccggcgtccggctgatgagccgcctgacggtgatccgggcggccgcctcgctgggcagcacccaatcgctgatcctgcacccggccagcaccacgcaccgccaattgaccccggatcaattgcgggaatcacacctaagccccggaaccgtccgaatcgccatcggtatcgaacatccggacgacctggtggccgacctggaacaggcgctcggatga

SEQ ID NO: 2008 - DNA, 1464 bp, Actinoplanes utahensis
atgagtccaatcgtgccggccgagcttgcggcgcgcctcggccgatggtccgccgggcgcgggccgctctacctgctgctcgccgggcggctgcgggccctcatcgacgacggcgacctgccgcccggcgccgcgctgccgaccgaccgggccctcgcgaccgcgctgtcggccggccggacgacggtcgtggccgcatacgatctgctccgccaggagggccggctggtccgccggcagggcagcggcacctgggtcgccggcgccggagccgagccgccgaacaccaccgaacccaccgtcaacccggtcttcctgcacctgctcgatccgccggaccatgtggcgcagttcgcctgcgccgggccgttggcggcgccgccggaggtcatcgcggcctaccgcggggcgctggaggcactcggtgggccggatctcggctatcacccggccgggcatccgcggcttcgggcggcgctggccgagcggtacacggcgcgcggggtgcccacctcaccgggccggatcctgatcaccaccggcggtcagcaggggttggcactgctggccagggcgctggtggcaccgggggcggaggtgctggtgcaggcgccgacctatccgggggcgctggagatcttccgagagtcggcggcggcgctggtgccgatcagaaacacgatcgaggggtacgccgcggcactggcccgcaagcccgccctggcctatctgatccccgccaaccacaacccgaccggccacaccctgcccgaaagtaatcgccgcgcgatcgtcgcggcggccctggcgcacggcgtcccgctgatcgtcgacgacgtgacggcagacctgacgttcccggaccggcgagcgcggaccgcgccggacgccagggctgcgccggacgccgcggccgcgccggacgccgatgagttgatcacggtggggtcgctcagcaaagtcgtgtggggcggcctgcggatcggctgggtgcgggcacagccggccctgatcggacgcctcgcccggctcaaggcggtcatcgacctgggcagcggcgtgctggaccagctggcggccgtggaactcctggagaatctggacgacctggccggacagcggatccggacactcgccgcccggcacgatcacctctgcgctgagctgcggagacacctgccggagtggcagttcgagccggcccggggcgggcagacgatctgggtgcggctgccccacggggacgcggcctcgtatgcgcaggcggccctccgggaaggcgtcgcggtcctgcccggcggatcgctcgatccgtccggtgcgagcacggatcacctgcggattccgttcgtcgccgagccggcggcgctgaccgccggcgtccgggcgatggccgccgcgtggcgcggcttcaccggccgcgcggcgatcagcccgccaccgctacccgccatcgcggtctga

SEQ ID NO: 2009 - DNA, 2151 bp, Actinoplanes utahensis
atgttgctcaagatggcgatggcggtggtggtcgctgccacgcccgctgtgccctgcccgcggccggcggtcaccggcacctattcggtcggtgcggcccattggcagcccgctcacgtcgcgcaaacgggacaatctgccgctacggtggtgatcgacccgagccggaccgaacagcgatacgagggcgtcggcttctcgatcgacgagaccgccgtcgccaacctgtggaagctcactcccgaccggcgggaacaggcgatcaagctgctggtcgacccgcgcaccggcgccggcctggaccgcttccgcctcaccatcggcagccccgacctgatcgagcacctgccgttctggtcctacgacgacctgcccgccggggtcaccgaggacccggagctgaagtacttctccgtccagcgcgacctggatctgcacatcgtcgacacgatcaagctgatccagaagtacaacccgcgggccaccttcttcgcctccgcgtggagcgccccggcctggatgaagaccaacaacaggttcctcggcgaggtcgccctcaagccgggcagcaccaccgactactaccaggccggcaagctgcgcgacgaccggatcgacgtgttcgcccggtactacgtcaggtatctgcaggagtacgcccggctgggcatcagggtcgacgcgatcacgctgctcaacgagccgggcatggacgtcgtctaccccgccatggacatcagcgtcgagcagcagcagagactcgccgtcgcgatcaagcgcgagttccgccgggccgggctgcgcaccagcctctacgtccacgacttcaacttctgggactggcgcgacccgaacagcacggccaccaagaactactaccggatcctgaacgacccgcaggccgcgcgggctgccgacgcgatcgcgttccacccgtactggggtgacccgcaggtgatgcgcgacgcgtaccggcagaccggcaaaccggtgcagatgaccgagaccagcgacctgtccccgtcgaccgtgctgtcctacttccggctcgacgccagcagttacatcctctgggcgcagaccaccgaccaggacggcggcaccctgcactggaccggcgagcgcaacaacaacgtcgactgggacgaggtcgcccggaccagtaggtggcccgatcggctggtcaaggtcaacaccatcaccaaggattattcggtacgcgatgagctctaccaactgggccagttcgccaggtacctgacgcccgcgcatgtgcgcgtcgagtccagcaccacgggccacgggatcagcaacgtcgtctaccgggacgggcgggactacgtcgcggtgctgggcaacgccaacgccacggacaccgccgtgcgggtggtggccggcgacgactccttcgtcaccacggtgcccgccggggcgtacgccacctatcgatggaccggcagccggacggactcgcggcacaaccgcgccccgctgctgcccggcgtgcccccggtgaccgccgaccagtacgccaccacccggatcgccctgcatgcgaccgatcctgatcatgacaggctgcactactacgcggtcgatctgccggccggtgcgagcgtcgatccggacaccggggtcctgacgctggacccggcagtgcccggcgagcagcaggtcaccgtcgcggtcaccgacggcaaggcgtacgccgagaccaccgtgcacgtcaccgtcgtcccgcacggcgccccggtcggcgcgatcgtcgaggccgaggcgtacaccgcacagcacggctggaccgagggcggcgccgacttcgtcgagagcaacggcgcggccagcggcggcaaggacgtcggctggaccgcgcccgggaactggctcgcctaccgcttcgacgtgccggccggcccgcaccggctggagctgcgggtcgccaacggcaccggggcggtggccaccggcgcgatctcgatccgggacgcgtccggcgccgtgctggccggcgtctcggtgccggacaccggcggctgggcggcataccaaacggtggacgtgccggtctcgctggctgatggtgatcagacgcttacggtttactgtgaaagcggtgggttcaacctggactacctacggctggccgtgtag

SEQ ID NO: 2010 - DNA, 1848 bp, Actinoplanes utahensis
atgcggaagaccctgttcgccgcggcgatactgggcggcagcctgctctacgcccccgccgcgcaggccgccggcgagaccgtcagcgtctatctcaccaccacgtcggacagtgccgggcgcacggtcacccgcgggctgcagcagcagacgaacatcgcgttcggcccggccggtggcagcgccggcaccacgatcaacgtcgacgagggcaccacctaccagaccttcgagggcggtggcgcgtcgatcaccgacaccaccgcctacctgctgcggggcggggcggtcagcgcggccacccgggacgccgtgatgacgaaactgttcagtcccacgggcgggatcgggctgtccttcgtacgcaacccgatcggtgcttctgatctttcgaggccgggcaacgtgtcgctggacgacacgtgttgcgacctcgctgatttcggcgccaacggctacgacacgaacgtgcggctgctcacccagcaggcgaagcagctcaacccgagcctgcgggtgatggcggtgccgtggagcgcaccgggctggatgaaggacaacggccggatggaccagatgggctggctcaaggccgggtactacccgatgtacgcgcagtatctggtcaagtacctgcagagctaccaggcggcgggcgtgccggtcgactacctgtcggtgcagaacgagccgaactgctgccaggcatccaacccgaccgcgatgacctacccggggatgagctggaacccgtccgggctggttgagttcaccaagaacaacgtgtacccggcgctgcacgcggccgggctgaacaccagggtgctggtgcacgactggaactacggcgactacgcgagtttcggctcggggatcctgggcgacgcggggatccgcaccgacccggcattcggcgggatcgcctggcacggctactcgggcagcgcctccaccggcagcgacgtgcacgccacgtacccggccgtgaagcagttcgagaccgagcactccggcggcacctggatcggtgaccagcacaacgaggacctgaacaacatcatcgactacacccggaactggggcgcttcggtggtgaagtggagcctcggcgtggatcagaacatgggcccgcacaacggcggctgcggcacctgcaccggcttcatcaccgtgcagaacggcggctcccgggccggtcaggtcgactacaccgtcgagtactacacgatgggtcacctcaccaggttcgtgaagccgggggcggtccggatcgacagcaacgacggctccgcggtccgcaacgtggcctggcgcaacccggacggctccaaggcgctgatcgcgcacaacggcggcacgtccagccagtcggtgcgggtcaactggggcgggcagtcgttcatctacaccctcccggcccggacgacggcgaccttcacctggtcgggcaccgccgcaccggatccgtccgggacgatcaccgggctggccggcaagtgcgtggacgtggccggggcggcgaccgccaacggcacggccgtgcagctctacacctgcaactcctcggccgcgcagcggtggacccgggcgtcggacgggacgctgcgggcactcggcaagtgcctggacatcgtggggccgagcacggcggacggcacgctcgcgcatctctgggactgccacaccggtgcgtcgcagaagtggacctacgacggtgccggtcagcacctcatcaactcgtattccggcaaatgtctcgatgtgaaggacaacagctccgcggacgcgacccggctgcaggtgtggacctgcacctccggcgccaaccagaagtgggtgctcaactga

SEQ ID NO: 2011 - DNA, 1128 bp, Actinoplanes utahensis
ttggcggagaacgtcaatccgtggcgggaggtcacgcgtagtaccggggggctacccggtcactgcccggtatgcacggcagcgaggagcatctatgattcgccgatgaaacacggcgatgaaacaagagtcacggtacgtgatctggcggcccgcaccggtctgtccatcgccaccgtctcccgggtcctcaacgaccgggcgaacgtcgctccggacacccgcgaccgggtgctgcgcgcgatgggcacgctgggcgagcgcgccccgcgtcggcggggcgtccgggcccgggccgccggcgtcttcgtccgctgtccgtacgtgctgaccgactacttcgggctgatcgtctccgcggtcgccgaggcgtgcgagccgcacggcctgcatgtgatcctgaacgccggcacctccgcccagcagacccgggtgctgcccaccctgccggagcgccgggacgtggccggcgccgtgctgatcctgccgccggagccgggcgccgagctggtccggctgcgcgaccgcggtttcccgttcgtactggtcgatccgcggatctcgcccccgcgggacgtggccgcggtgtccgccgcgcacttcgccggggcccgggcgctgaccgcccacctgatcggcctggggcatcgccggatcggcatcatcggtgggccgcgtgactggctggccagcgacaaccgcttccacggctatctcgcgccgctggccgacgccggcgtgctggccgatccggcgctgacccggttcgtcgccgagccgaacaccgggctgggctaccgggccgcggtggagctgctggacctgccggagcggccgaccgcgctgctggcgttcaacgacaagatggcgatcggggcgctgcgggcggccgccgagcggggcctcaaggtgccgcacgacctgtcggtggccggcttcgacgacatcgacctcggctcggcctgcgacccgatgctgaccaccgtgcgccagccgctcggcgagatgggccggatggcggtccacctgctgctgcgcatgctgggcgggcaccggctggacgcgttgcacctggagctgggcaccgagctggtggtgcgtggctcgaccgggccggtcccggcctga

SEQ ID NO: 2012 - DNA, 1020 bp, Actinoplanes utahensis
atgactcgctggtggatcgtggcagtggcgctgctcctggtgccggcactcgggctcttcgggccgacgtcggcgaccgccgagcagcctgaccggatcgccgactggcgggcggacgcccggcatctcccggacccggcgagcaccgcgccggaccggatcgccgccttcttcgccggtctcccggccgccgcggcggacgacctggcccgcgagtaccccacagtggtcggcaacctggacggcgcgccgccgggcctgcgctacgcggcgaaccggacgcccggatacgccgggcggcagatcctcgccctggaccggcgcggcgacgggcggatcgccgaggtcttcggcgacctggacaccgtcgaccgggtggtgatcctgatccccggggtcgacaacacgctcgccgacttcgacaccgggctcggcggcgtgcgccggcgctccccctcttggcaggcgcaccagctgtaccagcggatcggtaccggggaacgggtcgcggtgatcgcttggctgggctacgacccgccggagggcatccgccgggcggcgctgcgcgaggaccgggcggccagcggggccctcgccctcgaacggttcgtcggcgggctggtggcgcggcaccccggtcagcggatcacggtggtcgggcacagctacgggtcgatcgtcgccgggtgggccgtggcccacctgccggcccaggtcggcgacgtcgtggtgatcggcagcccgggaatgggcgtcagcggccgcgaccagctgggcgggaccgcccggatctgggcgggcagcgcgcccgacgactggacccgcaagctgcccggcatccggatcttcggactggggcacgggcgactgccgatcgaccccggcttcggggcgctgccgctgccggccgggaacgtgtgcggccacgacggctacttcgtggcgggcagcgcggcgctggacgcgatggccgagatcagcgtcggcgacatccggctgacgccgctgccggtcgcctga

SEQ ID NO: 2013 - DNA, 825 bp, Actinoplanes utahensis
gtgagcgacaacgagctgggcgccttcctgcgcgcccggcgggccgaggtcaccccggccgaggtgggcctgccgcccggttcccggcgccggacgcccgggctgcgccgggccgaggtggcgatgctcgccggggtcagcgtggaatatctgatccgcctggaacaggggcgggaccgccggccgtcgccgcaggtgctggccgcgctcgccgggccgctgcggctgaccgccgccgagcgcgcccgcctctaccggctgaccaagtcggcgagcggattcacctgcggggcgggggagcgggcgccgtcccggaccgtccggcccggcctgcgcgcggtgctcgaccagctggagcccgccgccgcggcgctgctcaaccaggtgggtgacgtgctggcgcacaccgccgggttcgcccggctggccgccccgatcgggctgctcgacggcgccgaacccaatctgacccggtacgtcttcaccgacccccgggcacgcaccgcgtacccggactgggctcaggtggccgacgagcgggtggccgcgctcaagaacgggccgccccggccggacttcaccgacgagatgctgctgctggccggcgcggagttcgccgagcgggccgagcgggtgcccggggtgccgcgcccgcacggggtgctgcgcctggagcatccggcggccggcccgctgcggctcgcctacgagatcctggagttgcccggcgacgagggtctgcggctgctgatccagctcccggccgacgaggccaccgctgaggcgctgcgggcgctggccccgctgcgactggtggccggctga

SEQ ID NO: 2014 - DNA, 1080 bp, Actinoplanes utahensis
atgaaacctgaagtgatcgtggtgggtggcggttacgccggcatcgtcgcggcggccgcgctggacgacgtggccgacgtgacgctggtcgagcccaccgagacgttcgtgcaccacgtggccgcgctgcgcgccgcggtcgacccggactggaccgaccggatcttcatccggtacgacggactgctcccccgtggcagggtgatccggtcccgcgccatccgggtcacgccggagacggtggagctggcctccggggagcggctgcacgccgactacctggtgctggccaccgggtcgagcagcccgttcccgtcccggatggacagcccggacaccgccgtcgcgcgggaacggctgggggcggtccgggacgccctgtcccgggcgtcgcacgtgctgctggtcggggccgggccgatcgggctggagttcgccggcgagatcgcggccgcctggccgacgacccggatcaccgtgctggaccgggcgccggacctggtcggcggccggttcccggacgcgttccgggccgagctgcgccggcagctggacgcgctcggcgtccggctgctgctcgggacggccctgaccgcgccaccggcagtggagccgggcacggtccgcccgttcaccgtcaccacggcggccggggagatcatcgcggccgacctgtggttcccctgccacgggaccggggtccggtcggagtacgccgacgggtcgctggccggggcgcggcgggccgacgggcggctcgcggtcaccgagcacctgcgggtggccggacacgaccgggtcttcgcggtcggggacctggccgggaccgacgagctgaagatggcccgggccgcggcccggcacggtgaggtggtggccgccaacatccgggcgctgatcggcggcgggccgctgaccgcgtacgagccggcgccggacgggatcgtgctgccgctcgggccgcacggcggggtcacctacgatgcggacgccggcctgctcggcccggagacgaccgccaggatcaaggccaccttccacatcgagagattcctcgatgtgctgggcgcgcaggtctag

SEQ ID NO: 2015 - DNA, 2073 bp, Actinoplanes utahensis
atgccgaccacggcgagcagctcgggcgactcctcgtccttgccgcccagctcgtgcatcagctcgccggagacggcgaaccgggccgcgtcggtgcggtccaggacgtcccggctccaccgggacaggcgacgggcgtcgtcgagcaggaccgcgtgcaccggccagccgtggtcgacggcgagcgtgatcgggcggacgccctgcaccacgaactcgccggcccggtgccgtttggtgcggttggtgagcagcgcctgccactgctggaaggtcgcgttccgcgtggagacccgcattgtcctggacattcccactatccaagcagtccggtcgtggcctctgcgcgtcgggtatggtcccgatcgtgacgcatttcgtggcgctgcttctcagccgccacggcggggcctgatccgacgaccggctccccgccgtgggggctgttcgtgctttgccggtcgatgtccgtttcccggcaaacccgttctggagccccgtcatgatcacctggaatccgcagcagcccagcccgatgccgttccaccgttaccgccccgcccacgagcgggtcgacgtgccgatcaccgaccgcacctggcccacccggcggccgaccgccgccccctgtgggtcccggtcgacctgcgcgacggcaaccaggcgctggccgaaccgatggacgccgaccgcaaactgcgcgccttcaccatgatggtcgcgatgggtttcaaggagatcgaggtcggctacccgtcggcgagcgggttggacttcgacttcgtccggttactggccgagcgtgacgacctggtcccggacgacgtcaccgtggtcgtcttcaccgccgcccgggacgacctgatcaggcggaccgtggcatcgatcgacggcctggccagggcggtcgtgcacatgtacacggcgaccgcaccgacctggcgcgacgtggtgctgcgggcgtcccgggccgggctcaggacaaggatcctgcacgcggccggggtggtgctgtccgaaactgatcgactggctcacacgtacacccgcttcgagttcagtcctgaggtcttcaacctgaccgaaccggagttcgtgctggacgtctgcaacgcggtcaccgggcggtgggacgccgccccggaccggccggtgatccacaacctgccggccacggtcgaatgcgccaccccgaacgtgtacgccgaccagatcgaatggatgagccggcacctggaccggcgcaacgacgtgatcctgtcggtgcacccgcacaacgaccgcggcaccggggtggcctgcgccgaactggccgtgctggccggcgcgcaacgggtcgagggctgcctgttcggcaacggtgaacgcaccggcaacgtcgacctggtcacgctggcgatgaacctgtacacccagggcatcgacccgaagctggacttctcggacatcgatgcggtgcgccggaccgtcgagcactacaaccggatgcccgtgccggatcgccacccgtacgccggcgacctggtctacaccgcgttctccggcacccaccaggacgccatcgacaaaggcatgatcttccacgccaaacgcgccgccgcgctgggcgtgcccgagtccgaggcgccgtgggaggtgccgtacctgccggtcgacccggccgacgtgggccgctcctacgaggcggtgatccgggtgaacagccagtccggcaagggtggggtggcctacctgctgcgcaccgggcacggcctggacctgccgcccggcctgcgggtcgaggtcggcgcgctggcccaggccgcgagcgagggacgggccggcggcggcgagctgaccccggccgaactgtggtcgctgttccgcgacgaatacctggtccaccccggattcccggtcgacctggacggcgtcgaggtgatcgaggaggtcaccggaaacttccgggaggcgatcatttcgtacgttcgttgccggatcgccgaggtggaacgctggggtgccggcgtcgggtcgaccccggaagccgcccggcacgccgcgatgagcagcgccgcccgtcgcgccgtctga

SEQ ID NO: 2016 - DNA, 1200 bp, Actinoplanes utahensis
atgcaacgggcgggtgacgagggggtcgggatgagcgccgagcaggcgcggtggccggagttgtcgctggacgtcgccgcgctgcggcgcgccgggcatcgggcggtgccgttccgcgacgtggtgctgaaggtgcatcagcggtgcaatctggcctgcgactactgctacgtctacacgatggccgaccagtcctggcaggatcggccgcgggtgatggaccgggcgacgtggcgactcgccgcgcggcggatggccgagcacgccgacacgcacgacctgccggagatgcggctggtgctgcacggcggcgaaccgatgctggccgggaccgcgctgctggatgagctgatcggggatttccgggcggtgttcccggccgggcggcgtctggaggtgctgatccagacgaacgggacgctgctcgacgaggccgcggtcgcgatgttccgccggcatcgggtccgggtcggggtgagcctggacggcgccgcggagagcaacgacctgcgccggcggcgacccgacgggctgggcagctcggccgccgtcgaccgtgggttgcggctgctcaccggggacgtcttcggcggcctgctgtgcacgatcgatccggccaccgatccggtcgccggctacgaggcgctgctgcggtatcgaccccccgccatcgacctgctgctgccgcacgcgaactgggagacgccgccgccggcctcgtgcgccggctggctgatcgcggtcttcgaccggtggtacgacgcaccccgccaggagacctcgatccggctgttcgaggacgtgatggcgctgctgctgggtggttccggccggtccgagcagatcgggctgagcccggtggcggtggtggtgatcgagagcgacggggcgatcgagctgaccgactccctcaaatcggcgtatccgggggcgtgcgcgaccggccggaccatcgccgccgacccgctggacgcggtcctcgaccatcccggcgtggtggcccggcagatcggcgccgacgccctgtccgacgcctgccgggcctgtgacctgcaccgggtgtgcggtgccgggcactacgcgcaccgttaccgcgcgcccggcggtttccgcaatccgtcggtgtactgcgccgacctggccgccctgatccggcacgtgcgccggcggctgaccgccgatctggctcagcgggtgtag

SEQ ID NO: 2017 - DNA, 1071 bp, Actinoplanes utahensis
gtgaacgaggacctgcggcagtcgctctccggcatcgccgacgacgtgcacttcgtcgacctgcacgcccgggcgctggggcggtcccggcagatccgccgcaaccggatcaccgcggtcaccgcgtccgcgctggcggtgctgggcctggccggcttcggggtggcgaacctcgacgcgttccggacccgaccgggcccgccggccgtggtcgcggcgagcgtcagcccgtcgcccggcgcgacggtccgcaagccggcgccgagcggcccggccacggtcaccatggcggtgcccgcgtcgaagtcgctgaccgcgctgaccggcgagctgttctaccggtccaagtccggcacggtggtccggttcaccggcgacggcacccggaccacggtgctggacagggcgaaccaggcggtcgcgatctccccggacggccggcaggtcgcgtacgtgtcggccggcaagctccggctggccggtgccgcccagccgctgctcagcggcacggtcgacatcgccaaacagctgccgtcctggtcgccggacggcacccggctgctggtcgcggcgccgtcgccggccgtgctcaccgtcgccaccggcaagctcggcccgatcccgggtggtctgaagggacagaatttccactggtccggggacggcagcaagctgttctacacggccggccagcggatccgggtgggcgccgccaccgtcccggtcttcggggaccccgatgtcggccgcaaccccgagcagctctccggtgacctggtgctgagcgtggaccggaccggcgcgcggttcgccctgcggctgagcaactcgttcgacgtggatcagcgccccgacacggtggccgacgcgagcaccggcgccctcgacccgatcccggtgcccggcacggtcgagtcggcgctcttcgacaccgacggcaacctgatggtccgggccaccgacggggaccgcagggtgctctcgctgttctcggccaccgggacgctgctggtccaggccaccgaaccggcctcgctgcgcgacctggacctgatcgcctacacccgctga

SEQ ID NO: 2018 - DNA, 516 bp, Actinoplanes utahensis
atggatcaagccgacgcggacttcgccgagttcgtccggtcccgcacgcactcactgctgcgcgccgcgttcctgctcaccggtgaccagcacctcgccgaggacctggtccaggaggccctggcccgtacccaccggtcgtggaaccgcctggatcgggccgggaacgccgaggcgtacgctcgaaagatcatgtaccacacccaggtctccttctggcggcgcggccgggtcgccgaggtcatgcccggggaactaccggaccgcgccggcggcgacggctccgacgagtccgacgcgaccactcggcggctggtgctgcgcaacgccttgctccagctcagcgccaagcagcgggcggtgatcgtgctgcggttcttcgaggaccactccgagagcgaggccgccgagctgctcggggtgtcggtcaacacggtcaagacccaatgcgcccgggggctggcgaagctgcgcaccctgctgccggacatgcgggcattggaggcgcaggcgtga

SEQ ID NO: 2019 - DNA, 1029 bp, Actinoplanes utahensis
atgcgtgccatcaagaccggactcgtcgccaccgccaccgtcgccgccctgttgatctccggctgcaccggcggcgggaaggaggggacggccggcaccgtggcgcctccggtcgtcgcgccgagcagtacaccggctgcggtcccgagcagtccgccggccgagagtacgagggcggccaccatcgacggcacccttctctacgcgaatctcgacaaggtctacggggtgcgggacggcaaaccgagtgtcctgcaccggtcgcccgggcggatgctgaccctgccgagcgtctcgccggacggcaggcacctcgcctacgtcgaggacgaactcaccgtctccggcgtcgacggcaagaaccggcggacctacaagttcgacatcgacatcagtgacggttcgaccaatctcggccccgcgtggaccgcggacagcgccggcctcctcgtgcggcgcatcgacgcccagacgaaaaaccggatcaccaaggtcacggagggcatcttccggatcgccgacggctcgttccaggcgctgcccaagtccctgcagggtttcgagaactacctgatgtccggcgatggcaagcggatcttcttcatcgacaagggtgtgatctgctccaccgcggtggacgggtccgacctgcgcaaggtgccggtcatcggcgccgagagcagcgcgcagaacccgagccggctgcaggcgaacgtcctcggcacggtgaatgccgacggcagccggatcaccgccatcctgttccggatgaccgacgggaacgacgaggcggggggaaccccggaccggttgatcgacacggcgaccggcaaggtcgtgccgaccgtggtgaaggacggtccgggctccctgctgatcctgcgcgacggctcggtgctggccggcaccggtgacgtggcgggtacgcagacgctcacgctgttctccgcggccggccgggtgctcaccagcaggtccttctcgatgaagctcgacttcgacgcccgcctcagcggctacgccgagtga

SEQ ID NO: 2020 - DNA, 3177 bp, Actinoplanes utahensis
atgcggttaccgttgtcggccggacagatgggcatctggctcgggcacgaactcgatccgaccgggcacgcctacaacatcgcggagtacaccgaggtggacggcgatctcgaccaggacgccttcgagcaggcctgggcgcgggtgctggaggaggcgccgaccttcaaggcgaccgcgatccgccgcgacgacagcggcgagctctaccagatcatcgacgaggcgcccgcccggatcacccgggtcgacctgcgcaccgagcccgacccggacgcggccgcccagcgctggatccgtgccgacctggaccgccggatcgacctggaggtcggtgggctgttcaccttcgccctgctgcgggtcggcgacgcacggttcgtctactacggccgcggccaccacatcgcctgcgacgggtacgccgcggcgctgctgttccgcaagatcggcgcgtactacaccgagatcgtcaccggggcgccgctcgccgacgcgccgccgcccgccgagtcgttggccgccaccctgaccgccgacgcggagtaccgggccggcgaggagttccaggccgacctgcgtttctggcgcgagcatgcgtcctcggccagcccggtgaagctgagcgaccactgggcgacccgcggcccggacacccccgacccgggcgccgtgcacatccgccgctcgacgagcgtcccggccgggcgcaccgccgcgatcgccgaggtggcccgcgagctgcggacccgctggccggtgctgctgatggcggccaccgccgcgttcctgcaccgctgcaccggccgtaccgacgtggtgctcggcgtcccggtcaccggccggaccaccaggcagctgcgggccaccccgaaccattcgtccaacgtggtcccgctgcggatcgaggtgcggcccggtgacacgctgcgcgacctggtgccgcgggtctccggagcgctgcgtctcgcgctgcggcaccagcgttgccggttcgaggattggcagccggcgcacgccggcgcggccggcaccggctggggcaccgtggtcaacgtgatggccttcgactaccaggtgaccctcgccgggctgcccacggtcacccgcaacctcaccctcgggccggtcgacgacctgtcgttgggcttctacgaccggggtgacggcagcggctggcggctcgacgtggacggcaacccggaccgctgggcgcgcgccgacctcgccgtgatcgagaacctgtacctgcgcttcctcgaggaggtcagcaccctgccggacacgccgctcggcgagttcgagctgacctcggcgaccgagcgcgagctgctcctgcacgactggaacggcaccccggccccggcgccccggggcgacctggccgacgccttcgcggcgcgggccgcccgcacacccggggcggtcgcggtgaccgagggggcgcgggagatcacgtacgccgagctggacgccgccgcggacgccctcgccgccgaactcctcgaccagggcctgcgggccgaggagccggtcgccatcctggccgagcggtcggcgctggtggtgctcgccaccctcgcgatcatcaaggccggtggggcctatctgccgctgcggcccaccgacccggccgcccggcagcgcgccatgctcgccgacgccggggtgcggctgctgctcaccgacgtgccggccgaccacccggtcgaggcgctgctgctgtccgcggccgatctgagcgccgcggcgccggccaccgccccgcaccgcggcggcgacccggaccggctggcctatgtcatgtacacctccggctccaccggtcggcccaagggcgtcgcggtcacccacggcaacgtgctcgccttcgccgcgcaccaccggtggtcggacggcgaccacgagcgggtgctgatgcactcctcgcacgccttcgacgcctccacctacgagatctgggcgccactgctgaccggcggccggatcgtggtcgccccgcccggccaggtgaccgccgacgagctggccgcggtgatcgcggcgcacggggtgaccgcggccttcctcaccacgtcgctgttcaacctgatcgccggcacccgcccggccgcgttcgccggcctgcgcaccgtgtcgtgcggcggcgaggcggcctccggcgaggcgatccggctggttcgcgcggcctgcccggggatccgggtgatgaacggctacggcccgaccgagaccaccacgttcgccaccaccatggaggtcgaggagtccggcggcaccccgccgatcggtgtcccgctggacgccacccgggtctatgtgctcggcccggacctgcgcccggtgccgatcggggtgtccggcgagctgtacgtcgccggctggcagaacgcccgcggctacctgaaccgaccggcgctgaccgcggaacgcttcgtggccgccccgttcggcccgcccggctcccggatgtaccggaccggcgacgtggtccgctggcgcgaggacggcgtgctcgaatacgtcggccgcggcgaccagcaggtgaagatccgcggcttccggatcgagctgggcgaggtcgaggcggcgctgctgcgcctgccggagatcgcccaggcgtacgccaccgcccaggagaccgccccgggcgcccgccgcctggtcgcctacgtggtcggcgccgccggcgagaccccggaaccgacccggatccgggagtcgctgcgcgagagcatgcccgacttcatggtcccggccgtggtgacggtgctgccggcgctcccgctcaacgccaacggcaaggtcgaccgcgccgccctgcccgacccggaggtgaccgtgaccgccggccgcgaggcctccggcgcggtggagagcgccctggcggtcgcgttcgccgaggccctctcggtttcccgggtcggtgcctcggactccttcttcgacctgggcggcgacagcatccgggcgatccaggtggtcacccgggtccgcaacgccggctggctgatcggggtcggcgacgtgttgaccctgcacacggtggagaagatcgccgaacgggcggtgccggccaccccggccccggccgagcccgccccggacgacctgctgtcgctggacgacgacgacctggcggcgctggtctcggccctcgccgaggacgccggctga

SEQ ID NO: 2021 - DNA, 276 bp, Actinoplanes utahensis
atggtgagtgcgttgggttccaatggcgacgatgtggtgagcctgctggccgccgcggggatcttcgtcgtgctcatcgtgatcgtgtggcagctcgccgccacctggcgggcgcgtctggccaccgcccgcgaggcgcagtaccgggagctcgccgagcggtgcgcccagctgctggcggagaacgcggagttgcagaaacgcacggtcgccgagctcacgcacgtccgcgaggccaccgcggcgatggagaagatgatgcgcgaggtcggctga

SEQ ID NO: 2022 - DNA, 318 bp, Actinoplanes utahensis
atggatgtcacaggtgatgacctgctgaagatgttgacggcgctgagcaatccgcaccgtctccggatcgtgggggtgctctccgccgagcgcgactacgtcagccggttggccgtccggctgggcatgagcaggccgttgctgcacatgcacctcgcccggctggaggccgccggcctgatcgagggcagtctcgagctgtccgcggacggtaaggcgatgaagttcttcgaggtcacgccgttcgcgttgcaactgacaccgcagacggtggccgaggcggtcaagacgctgaccgacgcggccaccgagaagtga

SEQ ID NO: 2023 - DNA, 2439 bp, Actinoplanes utahensis
gtggtggtcgagacaccggccgggctggacgacgcgacactggccgccgcgctgcgcgacgtggtcggtcaccacccggtactggcggcccggctgaccgcggacggcgacctcgagatccccgccgctgcggccgtggagcttctgactttcgagggagccgctttcgaggcggccgagttcgccgcccggcgtctggaccccacggcggggatcaacgtcctggcggtccgggtggatcaccgcaggctcgtgctcgtcgcgcaccacctggtcgtcgacgcggtctcctggcaggtgctgctgcccgacctggcgacggccgccgaggcccgtggccggggcgtcgcgccggtcctggagccggtgccggtctcctaccgcacctgggcacgcggcctgccggaggtcgcccggcagccccggcgcacctacggcttcgcccgggacgcccggcacaccgaggtcaccgtgccggccgaggtggtcacccgcctcggcacggtggccgagaagttccacggccgcctggacgacctgctgatcaccgcatactcccgggcgctgacccaggaggcggtgatcgacatcgaggggcacggccgggactcggacgccgacctgtcccgcaccgtcggctggctgaccgcggtccgcccggtccgggtgaccgggatcggcgccgacccgcgagccgccgtgctgcgggtcaaggagcaactgcgggccccggccgcggacgacctggacccggcgccgttcctgttcaactacctgggcggtacggccggcgcggtggccggggcctggccgctgctggccggtgagccgctgccctccggggtcgacccgggcatgccgctcggctaccacctggaggtgcacgtcgcgggccgcccggacgggaccctgcgggcgctgtggatcaccgcggacgggttcgaggcgccggccgagcgctggcgcgacgccctggtggcgctggccgagctggccgacccggcggtgcccggcggccgcaccccggccgacctgccgctggcggcgctcggccaggccgaggtcaccgcgctggagtcgctggtgccggacctgtccgacgtgctgccggccagcccgctacaggagggcttcctgttccacgcggcggaggcacgtgacggcggcaccgacgtctacaccacccaggtgcgcctcgatctgtccggccgggtcgatccgacccggatccgggcggccgggcagcggctgatcgaccggcactcggccctgcggaccggcttccaccagctggagagcggggccgcggtgcaggtggtgcggtccggcggggtcgcgctgtggcgggacgtcgacttcaccgtgctgcccgcgagcgagcgggaggcggctgccgagcggctcaccgaggccgagcgcgacgacttcgacctggaccgtccaccgctgctgcgactggcgctgatgcggctggccgaccgggagtggcggctcgcggtcaccgcgcaccacatcgccgtcgacggctggtcgctgccgatcctggtgcaggagctgcgggcgatgtggtcggaccgggccgcgctcacggacgacaccgcgccgtcgcaccgcgaccacgtcgcgtggctggtcggccgggacccggcggccgccgtccgagcctgggcggagaacctgcgcgacctcgacggcccgctgctggtggcgccggagacgccgggcgcggcggtgaccgcccagcggcagatcagccgggagctgcccggtgccacggtgcgccggctgctggacgcggcccggccgctcggggtcaccctcaacaccgcggtcgagttcgcctgggcgctggtgctggcccggatcaccggccgggacgacgtggtgttcggcaccaccgtctccgggcggccggccgacctgccgggcgccgaccggatggtcgggctgttcgtgaacaccgtgccggtgcgggtgcggctgcacgccgggacgacgctcggcgaggcgcttaccgtgctgcagggcgagcagaccgatctgctcgaccaccagcacctcgggctcggccggatccaccggctgaccggctgcacccagctgttcgacaccaccacgatgctggtcaactatcccttcgacgtggaggtgctggccgagccggacggcgccgggtaccgggtgaccggcctgggcctggacgacgccacgcactatccgctgcggctggtcgcggtcccggggccggacgaccggctcaccgtgcggctcggcttccggcccgacctggtggccccggccgacgcggaggcgcacctggaccggatgatgctggccctggagagcctggccggtgacctggacgtgggagttcgggagatcgacctgatcaccgcggcggagcgggagacgatcgtggcgcaatggggcggctactga

SEQ ID NO: 2024 - DNA, 3123 bp, Actinoplanes utahensis
atgagcggcgcgcggctgcccgagggcatcgaagcggcctggccgctcaccccgctgcaggagggcttcctgctgcacgctctccaggagcaggtcgacgtctacgccacccagctccggctcgacctggacggcgagatcgacgccgcccggctgcggacggccgccgacgcgctgctcgcccggcacgggtcgctgcgcgcggcattccaccacgccgggctcaagcgcccggttcagctgatccaccgcgacgtgccggccgcgtggagcgagcacgacctgaccggtctcgccggcccggagtccgaggccgaggcggcccggatcgcgggcgtcgagcgggccgccgggttcgtcccgcaccggccgccgctgctgcggttcgccctgctccggctccgaccgggacgccagcggctcgtgctcaccgtgcaccacctgctctgggacggctggtcggtaccggtggcgctgggtgagctgttcgccctctacgccgccgggccggcggacgtgctgccgcccgcgccgcagttccgcgacttcctcgcctggctgcgccggcacccgaccgccccgagcgagcaggcgtgggccgcggcgctgtccggactggacagtccgacgctgtatgccccacaggccgccgacctgccggccaccctgcagcacgaggtccgcgcggtgctgccggccgaggtcaccgaccggctggccgacctgggccgccggcacggcgtcacgctcggcaccgtggtccagttcggctggggggtgctgctgtcccggctgctcgactccgccgacgtggtcttcggcaccaccgtctccggccgcccgccgctgctgcccggcgccgaccggatcgtcggtctgctgctcaacaccgtgccggtgcggttgcggctgcgcgccggtgagtccgccgcggcctgcctggtccggctgcaggccgagcaggccgcgatgatcgaacaccaccacgccccgctggccgccgtgcagcgggccaccgggcaccccgcgctgttcgacaccaccacggtgttccagaacttcccgctcgaccacgaggcggtcacggcgccgctgaccgcggccggggtgcgcgtcgccggggtgcacatcgaggattccacgcactacccgctgcggctggcggtcaccgccggcgacgggctggagatgcgcctcggccaccggcccgacgtggtcgacgcggaccaggccggcatcctgctcgaccggctggtccgggtgctgaccgcggtcgcggccgacccggggatcgcggtcgacgacctggacccgctcagcccggccgagcgcgccgacgtgctgcaccggtggaacgacaccgccgccggggtgcccggcggcaccctggtctcggccttcgaggagcaggccggccggacgccggaggcggtcgcgctgcgtcacgacggcgccgccctgacctaccgggagctggacgagcgggcgaaccggctggcccgccggctgctcgccgagggcgccgggccgggccggctggtcggtgtcgcgctgccccgctcgttcgatctggtcgtcgcgctgtacgcggtgctcaagacgggcgccgcctacctgccgatcgacccggagtacccggccgcccggatcgccgcgatgatcgaggacggccggccggcctgcgtgctcaccgacggccccggggtgcccggcccggcgctgcggctggacaccctggacctggacgcggtgccggcgcacccgctgagcgcggcggagcggcggccggtgacagcggacgacaccgcgtacgtcatcttcacctccggctccaccggccgcccgaagggcgtggccgtcccgcaccgcggcatcgtcaaccggctgcgctggatgcaggaccgttacggcctgcgccccggcgagcgggtgctgcagaagacgccggccggattcgacgtgtcggtctgggagttcttctggccgctgcaggtgggcgccaccctggtggtcgcccgcccggaggggcaccgggatccggcctacctggccgagctgatccggcaggagcggatcaccacgctccacttcgtcccgtcgatgctcggcgagttcctgcgcgagccggccgcggccgggtgcaccgggctgcaccgggtgatctgcagcggcgaggcgctcccggtcgacctggagcaccgcttcctcggtctgctgcccggcgtcgagctgcacaatctctacggtccgacggaggcctcggtcgacgtcaccgcgtggcagtgccgggccgaacccggcgcggtgaccgtgccgatcggtgccccgatcaccaacatccaggtgtacgtgctggaccgcctgctgcgcccggtcgcccccggcgccaccggcgagctctacctggccggggtggggctggcgctcggctacgtgggccgggccgggctgaccgcggaacggttcgtggcctgcccgtacggcgcccccggcgagcgcatgtaccgcaccggcgacctggtccgctggcgcgccgacggggtactggaatatctgggacgcagtgaccatcaggtgaaactgcacggtcagcggatcgagccgggcgagatcgaggccgcgttcgccgcctgcccgggggtgtcacagtcgctggtgctggtccgcgaggaccggcccggggtgcagcgcctggtggcctacgtgatcgccgatccgggccgcaccctggtcgcggacgacctgctgaccgcggtgtccggcacgctgccggcgcacatggtcccgtccgcggtgctgctgctcgacgcgttcccggtcaccccgaacggcaaggtcgaccgggccgcgctgcccgcacctgaggtgccggtgaccgccggcgcggcgggcggcgagccgcgcacggcggccgagaccgcgttcgccgatgccttcgccgtggtgctcgggcacgaccgggtcggggtcaccgacagcttcttcgatctgggcggtgacagcatcctggcgatgcgggtggtgtcgctggcccggcaggccggctgggtcgccaccgccaaggacgtgttccggctgcgtaccgcggcggcgctggcggcggtcgcccgtctagctagctag

SEQ ID NO: 2025 - DNA, 192 bp, Actinoplanes utahensis
atgagcaacccgttcgacgacgaagaggcccgcttcctggtcctggtcaacgaccgcgggcagcactcgctctggccggccgcggtgaccaccccggccggctggtcggtggcgctggccccgtccgatcgggccgactgcgtccgctatgtcgagcagcactggaccgacctgcgggtggggtcgaaatga

SEQ ID NO: 2026 - DNA, 777 bp, Actinoplanes utahensis
atgactgttgccaagcacatagcggcgcgtgactgcttccgtgtgatcgcgccccgacccgccgcacggctcaccctcttctgtttcccgcacgcgggcggtgcggccagctcgttccaccagctcgccgcgctgctcccggacgacctggaactggtcgcggtgcagtatccgggccgccaggaccgctacggcgagccgctgccccggacgatggccgagctggtcgacgagatcaccggcgcgatgctggaccgcctggaccgcccggccgcgttcctcgggcacagcatgggcgccaccgtggcgtacgaggtggcccgccggctgcgcgcccgccgcccgaacgcgctgcgccggttcttcgcctcggcccgccgcgccccgcaccgcaccaaccagtcgctgcgcttcccggacgacgcgtcggtgttgcgctacgtcgactcgctcggcggcaccggcgccgggatgctggccgaccccgacctgcgcgagctggcgatgccggtgctgcgcggcgacttccggctgatcgccgactaccagtacgccaccggcgccccgctgacctgcccgatcaccgtgatcgcgggggacagcgacgcctcgttcaccaccgaccacgccggcgagtgggcccggcacacggtggccggctgctcgacccgcaccatcccgggcggccacttctacaccgagaccgcgccggcccagctggcccggctgatcgtggcggagctgtccgccgagctgaccgcgggaggaacgcgatga

SEQ ID NO: 2027 - DNA, 633 bp, Actinoplanes utahensis
atgaggaacatcaaggtggccgccggcctgctggcgatcgcgacgggggcgctgttcgccgccgggtgcgacccgaaggcgagcggatccgaccagagcgcggacaacacgtacgacatcagtgacaaggtcagcacgctgtcgctgagcggccggggcggcaacgtgacgctcaccgcctcggacggcgcctcggtcaaggtctccgaggagctgaagtacgacgacgccaagccgaagacctcgcacagtgtggacggtggcacgctcaacctggtcgacagcggctgcggcaaggacaactgccacgtcgactaccggatcgaactaccggccggcaccgtggtgaagatcaagaccgacggcggcgacatcaccggcagcggcctcggtgccgacgccacggtcaacaccaacggcggaaacatcgatctgtcgtacgcgacgccggccccgctggtcgacgtgaccagctccggcggcgacgtgaaggtcaaggtcccggccgggccgtacgaggtggacgcgtccaccgacggcggcaacaagacggtgtcggtgcaggcggtggccggctccgcccacaagatcaaggccaagtccggtggcggcgacgtctccgtggtgagctga

SEQ ID NO: 2028 - DNA, 2241 bp, Actinoplanes utahensis
atgctgctgttggagcggatggtgggctggtcagcccgtcaccccaaaaaggtcatcgtcggctggattcttctggtggccgtcgcggtgctggtcggcgggtcggccggctcgggcgccaagaccaccgacgccggcgaggccggccaggcgcagagcatgatccgcgcccagaaggtcacctcgtcctacaccgaaaacgtgctgatcgaggcccagggccgggacaagtcgttcctcggcactcccgatctggagagcgccgccaccgatctgagcgcccggatcaaggcgctgcccggcgccaccagctccgtggtcaccccgctcgacaacgagcagacccgggccgcgctggtctccaaggacgggaagtccggcctggtcagcttcaccatcccgggtccgggcaaggacgcggacaagcacttcgccgacatcaagaaggagatcaccgcggtccagggcgcgcaccccggcgtccggctcgcgatggccggcgacatctcgctgacctcggcggtcaacaaggcggccgacgaggacctgtcccgggccgagcagctctccctgccggtcaccctgatcatcctgatcgtggtcttcggcgcgctggtcgcggcgaccgtcccggtcttcctggcggccaccgcggtgctcgccgggctcggcgtcctcgacctggtcggcacgatcatcccggccaacagcacggtctcctcggtggtgctgctgatcggcatggcggtcggcaccgactactccctgttctacctgcgccgcgagcgtgaggagcgggccgccggcaagagcgccaccgaggccctgaagatcagcgcgcgcacctccgggcacgccgtggtggtctccggcctcaccgtgatcctctcgctggccgggctgttcctggcccaggtcgacacgttcaacgggatggcgatcggcacgatcatcgtggtcggcctggccgtgctcggctcggtcaccgtgctgccggccctgctgagcgtgctcggccgccgggtcgactcgctgcgggtgcccttcctgggccgctcgcgcaccacggcgaccaactcccgcggctggtcggcgatcgccggcggggtgtcccggcacccgctgatctacggtggcctggccctgatcgcgctggtcgcgctggccctgccggccttcggcatgaagctcagcgagcccggtcagctcgactcgctgccgcgcagcatcccggcggtcgacgccggcgtgcggctgcagcaggccttcccgggcggcgccgacccggcgcaggtggtggtctggggcaccggcgccaccagcggcgcggccgaccaggccgtcgccgagctgcgccgcgaggcggccgccagcgatctgctcggcgaccagatctcggccaccccggtgggcagcgtgctcagcatcaaggtcccgctggccggcagcggcaccgacgacacctcggtgaaggcgctggagaccctgcgcaccgacgtcctgccgaaggccttcgcgaacacgcccggattgaagtacgcggtgggcggccgcaccgccggcctgcacgacttcgccgacgtgctccagcagcgcaccgcctgggtggtcgccttcgtcctggtgctggcgttcatcgtgctggtcgtcgcgttccgggcgccgctggtcgccgcggtctcgatggtgctcaacctgctggcgatcggggccgcgatgggcatcgtggtgctcggcttccagaagggcggcttcgccggactgctgggcttctcgtccttcggcggcgtggtcaactggctgccgctgttcatgttcgtgatcctgttcggcctgagcatggattaccacgtcttcatcctgagccgggtccgggagcgctgggcccgcggcgagtccgccaaggactcggtcgtgcacggcgtcggcagcagcgccggcgtggtgaccagcgcggcggtcgtgatgatcgcggtgttcgcgatgttcgcgacgctctccggcatcgagtacaagatgctcggcgtcgggatggccgtcgccatcctgatcgacgccaccatcgtccggggcgtgctgctccccgcgacgctgtccctgctcggcgaccgggcctggagcctgcgcggccgcccggccgtggtgaccgggtccgacccggtggccgagtccgcccacgccgagcccaccgaggaagccgtgctggtcagccacgcggccgccaccgcacgaggagagtga

SEQ ID NO: 2029 - DNA, 264 bp, Actinoplanes utahensis
atgacttacggcaacgacctcaccagcctgctggccgtggccgggatcatcctggtcctggtcctgatcgtcacccaggccgccgccacctggcgggcccggatcgtcgcccagcgcggcgacgagcactaccgcgagctcaaccacaaatacgccgagctgctcctcgagcacgaggacatgcgcgagcgggtggcgagcgagctcaccggcgtccgccagtccgtgacctcgatggagcgcatgatgcgcgagctgagctga

SEQ ID NO: 2030 - DNA, 1230 bp, Actinoplanes utahensis
atgaccgcactctccgagaaaccaaccacgccactacgccggaaccgcgatttccggatgctctggaccggggccggcgcctcgctgctcggcacccgggtcgccaccgcggccttcccgctgctgatcatctggggcggcggctcacccgcggacgcctccctggtcgccttcgccaccctgctgccccagctgctgttcgtgctgccggccggcgccctggtggaccgctgggaccggcgccgcaccatgctgacctgcgacgtgatcgggctggccgcgatgggcagcctggtcgccgcgatgctgctcggccgggtctggctgccgcacgtgatggccgccgcctttctggacggcagcgcggtgatcgtctaccggctggccgagcgggcctcggtgcggcacgtcgtggagcccgagcacctgggcgccgcgctgtcccagaacgaggcccgcggccagtccaccgggctggtcgggcagccgctcgggacggcgctgtactcggctctccggtggctgccgttcgcgttcgccaccctcacccacgcggtggccttcgtgaccctgctggccgtgcgcaggaacctgcaggacgaccggccgcaggcgcggcggatgctgaccaccgagatcgccgagggcttcgcctgggtgtggcggcaccgcttcatgcgctcggcgatcctgctggtgggcgggagcaacctggccttccaggtgatcaacctgaccctggtgctgatcgtcaagcacggggggagcccgccgtacatggtcggcctgatcggtctgctcggcggcgccggcggcctgatcggcgcgctgggtgcggcgcgggtgatgcgccggctgccgatcccggcgatcctgatcggcgtcctggcactgtgggcggtgctgatcgcgctggtcgcggtgatcaccctgccggccgggctgggtgcgctgatgggcggcatggcggcgctcggcgcactgctcaacgtggccgccgcgacctatcaggtgcgggtcaccccggatcacatgcagggccgggtgaccagtgttttcgcgctgatcggctcgggcctgaactcggtcggcgcgctgctcggcggggtgctgctgagcgccgtgagcacgtccgacgcggccctggtcaccgccgccgggatgggcctgctggcgctgctggcggtgtgtctgccggccatccgccaggcacctgtcagttccctttga

SEQ ID NO: 2031 - DNA, 1134 bp, Actinoplanes utahensis
gtgatcaaggcggtcgcggcggcccagcgcagggggcttccactcaccctgttcgcgatgtaccagcaccgcaccctggcggcggtcgccgaggaggtggacgcgcagctggcggccaccgcggcgaccaaggccgcaccgccggtcaccgcgcccggtctggtctcccgccaggactggcaggacgccatggagcggcaccacgtgccggggctgagcgtcgcggtgctggccggtggcgagttggtcgaggtggagaccttcgggcaggctgcggccggagtgccggtcaccgggcgtaccccgttccaggccgggtcgctgagcaagcacctcaccgcgctggccgtgctgcggctggtcgacgagggcctgctcgacctggaccgggacgtcaaccggtatctggccggctggcgggtgcccgccggggaccgtccggtcaccctgcggcacctgctggcgcaccggtccggcctgtcctccacccccggtggcggcttcgtcccgggtgagccggcgccgtcgctgaccgggctgctcgacggcgcggccggagcggtcagccggatcgccgaggcgggcgcgtcgttccgcaaggccaacgtccactacgtggtgatcgagcaggtgctgcgggacgtcaccggggagccgttcgacgcgctgatgggccggctggtgctggagccgctgaacatggcggacagcagtttcgaccaggactacccggcccgggcggcgagcccggtggcgcacggtcacgacaccgccggtgagccgatcgcggggggctggcggatccggcccgacgccgccgcggccggtctctggtcgaccccggccgacctggcccgggtggcgatcgagctgcggcgctcggcgctgggccggccgctcgccctgctccggcggcagaccgcggaactgatgctcacgccgtacccggacagcctttacgggctcggcacggtggtggacagcaccgagttcgggcacgccggcaccccggtgggctaccacagcctgtcggtcatctcgctgaactccggtgacgggctgtgcgtgatgaccaacggcgaggcgggggagcaggtggtgaaggccgtcgtggcacggctgcgccgccactag

SEQ ID NO: 2032 - DNA, 5658 bp, Actinoplanes utahensis
atgaccgcggtcgagaccgccgtcgccgaggcctgggagcgggcgttgaacaccgccccgatccgccgcgacgaccgcttcttcgagcggggcggcgactcgatccgggcggtcgcggtggtcggcgcgctgcgcggccgcggctacgacctgaccgtgcgcgacgtcttcgcgcagcgtacggtcgccgacctggccgcggtgctggagaccaggggtatcacggcggaggcgccggcccccggggtcgccccgttcgcactgatcagcgcggccgaccgggcactgctgccggccggcacggcggacgcctacccgctgggcgaggtccagctgggcatggtggccgagcactacgccagcggtgacaagcgggtctaccacaacgtcgcggcccggcggatcagggacgaccggccgttcgacgaggccgccttccggcgggccgtcgaggtgatcaccgcacggcacgagaatgtgcggacgtcggtgcacctcaccggctactccaccccgctgcagatcgtgcacgccgcggccaccgttccggtgcgggtggtcgacgcccgcggcgtggcccgggccgagggggagcggctgctcaccgccgaggtcgaggccgagcgcgccgacgtgctcgacttccgggccgcgccgctgatgcggctggccgccctggtggagagcgacacctcgtggtggctgctgatcacctactcgcacgtgatcaccgacggctggagcagcgccaccttcgagatggagctggcgaacgcctaccgggagatccgggacagcggcgcgccggccggatacgagccgccggcggtccggtacgccgacgtcatcgcaggcgagctggcgtcgctgcgcgacccggcggacgccgcgttctggcggcgcgtcgtcgaccggcatgcccgcttcgacctgccggtcggatgggccgggacggccggggcggacgccgagccgtacagcgtgggagttccgatcgacgacctcgccaccgacctgcgggcccgcgcggccgaggccggggtgccgttcaagaccctgctgctcgccgcccacctcgaggtgctctcccggatcaccgacgcgccggccttccacaccggcgtggtgttccacgggcggccggaggcggtcggcgcggaccgggtgctcggcatgcacctcaactcgctgccgttcccgcaccgggccggcgccggcacctggcgcgagctgctcaccgcggtcttcgagcaggagaccgaggtgtgggcgcaccggcagtacccgctctcccggatccagcgggacgcggccaccgggggtcggctgatcgacgtgctcttcaactacatcgacttccaccaggtcgacggcgaggtcgtcgaccagggcgtggcggtcaaccagcgggccaacgacttcggtctctcggtgcacgcgcacggcgaccgccggctcggcatcgcgaccgacagcgggctgctcgccccgcggtacgcggaacaactcgcggcgatgtaccggtcggtcctgaccgcgatcgccgccggactcgacgaggagacgaccgtgccggtcgccgcagaggaacctgaccagggaacgctcgcccatgagctcttcgaggcccgggtggccgcgcaaccggacacggtcgcggtcgtcgcgggggacatcgagctgtcgtacgacgaggtcaacacccgcgccaaccggctggcctggcggctgcgcgacgccggggcgggcccggaggacctgatcggcgtgcacctggagcgggacgtggacctggtcccgaccctgctcggggtgctcaagtcgggtgccggttacctgccgctggacccggcgaacccgcgggagcggctcggatacgtgctggcggacgccggcgcgcggatcgtggtcacctcggcggagctcgcgcccgggctggccgaggtctaccagggccgggtgatcctggtcgacgaggcgggcgagggccggaccgacaacccgccgcgggtgtccactccggacaacgtgatctacacgatctacacgtccgggtcgaccggccggcccaagggtgtggtgctgacccaccgcaacgtgacccggctgctggacaccgcgcaggagcactacgcgttcgacgacgcggacgtctggtcgatggcccactcgtacgccttcgacgtgtcggtcttcgagatgtggggcgcgctggccttcggcggccgcctggtcgtggtgccgcgggacgtgtcccgctcacccgaggacttcctgaacctgctggtcgaccagcaggtgacggtgttgtcccagacgcccaccgcgttccgctcggtgatcaccgcggcggccgccaaggaccgccggatcaagctgctcagcctgcgggcggtggtgttcgccggggagaggctggaggtcgccgagctcaagccgtgggtcgagcaggtcggcctgggccgggtggcgctggtcaacatgtacgggatcaccgagaccaccgtgcataccacgtaccaccggctcaccaagcgggacctggccgccggcgccggcaacccgatcggccgccccctctccgacctggtcatccacctgctcgacgaggacgggcggccggtgccggccggggtcaccggcgagatccacgtggccgggcccggcgtggcccgcggctacctgggccgggcggcgctgaccgcgcaacggttcgtgcccgacccgctcggcgccccgggcagccgcatgtaccgcagcggcgacctggctcagcagcgtccggacggcacgtacgacttcgtcgggcgggccgacgaccaggtcaagatccggggcttccggatcgagctcggcgagatcagcgcggcggcggccgcctgcgacggggtccgcgaggcggtcaccgtggtggccaccgacggccgcctggtcggctacctggtcccggacggggaagcggcgccggacgtgcgggtggtgcgcgagaccctcgcccggacgttgccggagtacatggtgccggccgcgttcgtcgcgatcgcggcgatcccgctgaccaccaacggcaagctggacaagcgggcgctgcccgagccggccgccgagcagtggcgcggcgcggcggagtacgtcgccccgcgcagcccgctggaggcctcggtctcgcagatgtggcaggcggtgctcggcatcgaccgggccggcgtcaccgacggcttcttcgacatcggcggcgactcgatccgggccgtggtgctggtcggcacgctccgggaccacggcttcgcggtcgaggtcaaggacctgatgcggtatccggtgctgggtgacctgtgcgcgctgctgagccggcgggcgggcggcccgacgccgcccccgccggtgcggccgttcgcgctgctcggcgaggccgaccgggctctgctgccggccgggctggacgacgcgtacccgctgctcatggcgcagaccgggatgcaggtggagatgctggtcggcggcgagcacccgccgtaccacgtggtgaccagcgtgcggatccgcgacgaccggccgttcgacgcggagcgtttccgggccgccgcggcccggctcgcccagcgccacgacgtgctgcgcagcagcgtcagcctggaccgctactcggtgccgatgcagctggtgcacaccgaggtgccggtacacgtgccggtcgaggatctgaccgcgctcaccgaggcgcaggcggcggccgcgatcgagcggttcgtgaccgaggccgggcgcctgccgctcgacccggacggcccgccgctgctcaagctggccgtgcaccactgcgcggacggctggcagctgaccgcgatcaactcgcacgtggtgctcgacgggtggagccggcggacgctgttcgtcgagctcttcgagctctaccacggccgggacgactgggccccgccgtcggtgcgcttcgccgacacggtcgccgccgagctcgcggccctggcctccccgcaggagcaggagttctggcgctcgcaggtggccgactgcccacggttcgcgcttccggcgaactggggcgcgccggccgaggagccgggcgggacgatcgtgctggacatcccgttcgcggacctgaccgacgggctgcgcgcggtggccgcccgggccggcgccccgatgaagagcacgctgctggccgcacacctgaccgtgctcggcggactgactccggagcgctccttcctgtccgggctgacccatcacgtccggcccgagtcggccgacgcggaccgggtgcacggcatgttcctcaacgtgctgccgctgcgccacgaccggggcgcgcggacctggcgggagctggtcgcggccaccttcgcccgggaacgggaggtgtgggcgcaccggcacttcccgatgccgcagatcgaacgcagctacggcgagggcggccggatgatcgaggcctacttcagcttccacgacttcaccgggatgggctccagcctggatggtggggtggcggtcggcgacagcctgggccacagcagcaacgagttcgggctgtccatctccaccgggccgggcctgctgcatttgcgctgcaacctggggctggtgtcccgggagcacgcctcgcggctggcctcgatgtaccgcgcggtgctggaggcgatggccgccgacgccgagggcgacgccaccggggtgttcctgccggtcggcgaggccgaggtggtggccggctgggaacgcccggccgaggaggcggtgaccgcgcgaccggtgccggtgctgctggccgagcaggcccggcggacgcccggcgcgctggccgtccgcggcgagggcttcgagctgtcgttccgtgagctggtcggccgggccggtgcggttgccgtggcgttgcgggcccagggggtcgggcggggtgaccgggtcggtgtgcgggtcgagcggggaccgtggctgcatgccgcgctgctcggggtgtggttcaccggtgcggcctacatcccgatcgacccgggcttcccggactcccgggtggagtccatgctggcgggcgccaaggcgctgctcaccgacgagtcggtggcgtcgctggaggaggcgagcttcaccccggccgagatcgacccggacgagctggcgtacgtcatcttcacctccggctcgaccggaaagcccaagggcgtcgcggtcacccaccgcggactggccaaccacgtcggctgggcggtccgcgacctggcggtggccggctccctggtcggcggcggccggggcggcgcggtcttctcctcggtcgccttcgacctggtggtgcccaacgtctgggcgccgctgctggccgggcagccggtggagatgctgccccccgatctggacctgtccgagctgggcgggcgcctgcactcggcgggaccgttcgccttcctcaagctgaccccgggtcacctcgaggtgctctcccagcagctgaccccggagcaggtgagcgacctggccggcgtgatggtggtggccggcgaggcgctgcccggttcgctcgccgggcgttactcgcccgccgggcgcctggtcaacgagtacgggccgaccgaggccagcgtcggcacctgcgtgcaccgggtgccggccgagccgggcaccgggctagctagctag

SEQ ID NO: 2033 - DNA, 11811 bp, Actinoplanes utahensis
atgagcgagcagtccaccctgagcacctccgaactgcgggcggagctgctgcgcaagcggctcgccgggcagtcgggcggcgtccgccgggacgggatcccgcgcgccgatcgcagtgcgacgctgccgctgagccacggccagcagcagatgtggttcctcagccggctcgacccgaacagcaccgagtacctggtgccgctgatgatgcggctcctcggcccgctcgacgtggacgtgctgcgccaggcctggcagcacgtctgcgcccggcacgaggtgctgcgcacccggatcgagctgcgcggcgtcgagccggtccaggtgatcgacgacccacggccggtcgggctgcccgagatcgacctgcgtgacgtgccggacgggctgcgcgacgacgaggcgatggcgttgatccgccgggacctgcaggcgccgttcgacctggccgccgaatggccggtccgcggagcgctgctgcgcctcggcgaggaccaccacgtgctggccgtggtcttccaccacgtggcctgtgacgcctggtcgacccggatgttcggggccgagctgagcgccgcgtacaacggcctgctccgcggggacgggctgttcctgccggacgtcccggtgcagtacgccgactacgcccagtggcagagcggtcagatcgccggcgaccgcggcgagcgggacctggcctactggcggagccggctgtccggcctggagccgatcacgctgccgaccgaccggccgcgtccgccggtgcgcacccacgacggcgccgacgtggtcttcgacgtaccggccgcgctcggcgaccgggtccgggagcgggcccgtgagttcgacaccacgccgttcaccgtgctgctcagcgcgtaccaggtgatgctggccaagttcagcggcagcgacgacgtcgcggtcggcaccgtggtgtccggccgggcgcacgccgacctgcagcgggtcttcggctactgcatcaacaccctggtgatgcgggccgagtgcgacggcgagagctccttcgccgacctgctgcgccgcggccgggccaccgtgctggacgccttcgaccaccacgcggtgccgttcgcccgcctggtcgacgagctgcagccggaccgcgaccagtcccgcacgccgatcttccagaccgcgttcaccctgcacgagtaccgcctggacgtgctgcagttcgccggcctgaccgccgagccgttcggcgccgaggacggcatcgccaagtacgacctgaccctgcagatgcaggagcggccggacggcaccatccacggccgcctgcagtacgccaccgcgctgttcgacccggccaccgccgcccggctggccaccgcgttccagcgggtgctgagcgcggcggtgaccgacccgtcggtcccggtcgcgcacatcgaggtgatgtccccggccgagcgggccacggtcgtggtcccgccggtggccagccccgaggtcgacgtgctggcgcacgagttgttcgagacgttcgcggaacgcacccccgacgcggttgccgtcgtggcgggggactcccgattgtcgtacgccgaggtcaacgcccgggcgaaccgcctggcatggctgctgcgcgacgccggggtgggcgccgaggacctggtcggcgtccacctggagcggggcgccgacctggtcccggttctgctcggggtgctcaagtcgggggccggctatctgccgctcgacccggcgaacccgatggagcgcctcggttacgtggtcaacgacgcgggcgcgcacatcgtggtcacgtcggccgagttggcgcccggcctggccgaggtgttccacgggcggctgatcattctggacgagctggccgaggacggccgggtggacaacccgcccgtggtcgccaccccggcgaacctgatctacaccatctacacctccggatcgaccggacgacccaagggctgcatgctcacgcatgccaacgtcgtccggctgatgcgggtctgcgagtccgaactggacatcaccgccgatgacgtgtggtcgatggtgcactcgtacgcgttcgacttctcggtgttcgagctgtggggcgcgctgatgttcggcggcacggtcgtcctcgtcgagaaagaggtcgcccgctcgccggaggacctgctgcggctgctggtcgacgagcaggtcacggtcctgtcgcagacgccgaccgcgttccggggcctgacccaggcgccgcggccggcggatctggcgctgcgctcggtcgtcttcggtggcgagaagctggaggtcggcgagatcacctcgtgggccggccaggtggcgctggtcaacatgtacgggatcaccgagaccacggtccacgtcacggtgcacgagctcaccgcggccgacctggccacgccggcgatcagtccggccggggtggctctgcccgacctcgcggtctacctgctggaccgctcgggtcagccggtcccggccggcgtgcccggcgagatccacgtggccggcccgggcgtggcccgcggctacctgggccgggcggcgctgaccgcgcaacggttcgtcccggacccgttcggcgctcccggcacccggatgtaccgcagtggtgacctggcccgctggaactcccagggtcgcctggagttcctcggccgggccgacgaccaggtcaagatccgtggtttccggatcgagctgggtgagatcagcgccgccctttccgcctgcgccggcgtccacgacgcggtcgcggtgctgcgcgcggaacggatcgtcggctacctggtgaccgaggacgccgtggaccgcgccgcgatccgcgccgagctgggccgcaccctgcccgactacatgatcccggccgccctggtcgagatcgacgcgatcccgctgaccgccaacggcaagctggacaagcgcgcgctgcccgccccggacggcgcccagctccggtccgccggcgagtacgtcgcgccgcgcaccgccaccgagcaggacgtcgccggtgtctggaaggcggtgctgggcgtcgacacggtcggcgtcaccgacagcttcttcgagctgggcggcgactcgatgcgcgcggtcgccctggtcggcgcgctgcgcgaggccggctaccaggtcagcgtccgggacgtgttcgagcaccgcacggtggcccggctgatcgagttcgccggtgaggccggcgccgacgcggtggaccggccggtgcggccgttcgagctgatcgacgaggccgaccgggcgctgctgccggagggcgtcgtggacgcctacccgctgggccagaaccagctcggcatggtcatcgagatgctggccgacgacgggcagaacaactaccacaacgtctcggcgtactggatccacgacgagcggccgttctcgccggaggcgttcaccgaggccggccggatcgtggtggcccggcacgaggcgctgcgcacctcgatcgagctgaccgcgtactcccggccgatgcagctggtgcacgcgcacgcggagatgaccacggacgtctgggcgaccaccgggacgaccgccgagcaggtccgcgaggaggtggcggcgttcggcgcgcgggagcgcacgcacccgttcgacctgagcgtgcccggcctcatgcgcttccacgcccaccccaccgacctgggcggctggtggatctcgctggtcgagtgccatccgatcctggagggctggagctaccactcgctgctgatggagttcgtcaccacctacctgacgctcagcgccggggaggtcccggagacgcccgaggcgccgcgggttcggttcgccgacgcgatcgccggtgagctggccgccctggagtcggccggcgaccgggagtactggcgtggtgtggtgcgcgcgcacgccccactgaccctgccggtcagctggggtgacccggaggcggtggccggatcgccgtacaagaccggcttctcctggcgggacctggagtccgggctgcgcgcgctggccgccgcgaccgacacctcgctgaaggcgatcatgctggccacccatctcaaggtgatgagccagctgaccgaggaggagtcgttccacagtggcctggtctgcgacgtccggcccgaggtgaccggcgccgaccgggtgtacggcatgttcctcaacaccctgccgttcccgcacacccggggcgcccgcacctggggcgacctggtccgcggggtgttcgccgccgaggtggacctgtggggtcaccgccggttcccgctgcccgcggtgctgcgcgagtggccgggcagcggccggctgatggacgtgtacttcaactaccaggacttccgccaggtggacaccgaggtggtcgacgcggcgtcgggcatggacgacagcccgaccgagttcccgctgaccgtcgcctcccgcggcggatacgtgatcctgaccgcgaaccgccgccacctgaccccggcggccgccgacaacctggccgcgatgtaccgcgcggtgctgcagagcatggccgccgagggggagcgcggcgacgcgctcaaggcgtacctgtcgccgaccgagcgggccgcggtcaccgcgccgccggccccgcgggactcggccgatctgctggcgcacgagctgttcgaggcgcgggtcgcggccaacccgggggcgatcgcggtcgtcgcgggggacgtcgagctgtcgtacgccgcggtcaacgcccgggccaaccggctggcctggcggctgcgcgacgccggggtgggtccggaggacctggtcggcatccacctggagcgcggcccggacctgctgccgacgatcctcggcgtgctcaagtcgggcgccggttacctgccgctggacccggcgaacccgctggagcggctcggttacgtgctggcggacgccggcgcgcggctcgtggtcacctccgaggcgctcgcgtccgggctggccgacgtctacccgggggacgtgatcctggccggcgaaatcgacgggaccagggtcgacaacccgccgcgggcgtccacaccggacaacgtgatctacacgatctacacgtccgggtcgaccggccggcccaagggtgtggtgctgacccaccgcaacgtgacccggctgctggacaccgcgcaggaccactaccggttcaccgacgcggacgtctggtcgatggcccactcgtacgccttcgacgtgtcggtcttcgagatgtggggcgcgctggccttcggcggccgcctggtcgtggtgccgcgcagcgtggcccgctcacccgaggacttcctgcagctcctactcgaccagcgggtcaccgtgctgtcgcagaccccgaccgcgttccgttcggtggtcaccgcggccgccgagggcgacccgcggatcgaccggctggccctgcgcgcggtggtcttcgccggcgagaagctggaggtcgccgagctcaagccgtgggtcgaccgggtcggcctgcagcgggtggcgctggtcaacatgtacgggatcaccgagaccaccgtgcacaccacctaccaccggctggacgcgcaggacatcgccgaccccgggatgaaccgggtcggcgacccgctcgccgacctcgccgtctacctgctggacgcggccgggcacccggccccgtccggggtgaccggcgagatccacgtggccgggcccggcgtggcccgcggctacctgggccgcccggcgctgacggcgcaacggttcgtgccggacccgttcggcccggccggcagccggatgtaccgcagcggcgacctggcccgccgccgcccggacggcaccctggaattcctcggccgcgccgacgaccaggtgaagatccgcggtttccggatcgagctgggcgagatcagcgcggtgctggccggctgcgacggggtccgcgaggcggtcaccgtggtggccgccgacggccggctggccggctacctggtgccggccgagggcgcgacgctggacacccgggcgatccgcgaggccatctcccggacgctgcccgagtacatggtgccgtcggcgttcgtcgagatcgacgcgatcccgctgaccaccaacggcaagctggaccgtcgggcgctgcccgcccccggcgagcagacgtacgaccaggaccgctacgtcgccccgcgcaccccggacgaggagcggatggcggccgtctgggcgcacgcgctcaagctggagcgggtcggcgtcgaggacgacttcttcgagctgggcggcgactcgatccgggcggtcagcctggtcggcgcgctgcgctcggccgggttcgcggtcggcgtgctggacgtcttcgagcacaccacggtcgcggcgctgtgcgcgtcggcgaccggcgccccggtgccggtgaccccggtccgctcggtggcgccgttcgcactgatcgacgcggtggaccgggcgcggctcccggaggggctggacgacgcgtacccgctgctgcagtcgcagaccggcatgctggtcgagacgctcgcctccggcgcgcaggccaactaccacgacttcacgtcgttcctggtccgcgacgacgcgccgttcgacgccggcctgttccggcaggcggtcgagctggtcgggcgccgccacgacatcctgcgcacctcggtcgacctgaccggataccgggtgccgatgcagctggtgcatcacgaggtcaccatcccggtggcggtgcacgacctgcgcgacgtggcgccggccgacctgcacgagcggctggtggcgttcgccgcatccgagcgggccaacccgttcgacctggcctcgccgctgccgctgctgcggatcaccgtgcacctgcagaccgaccgggcgtggcggctgtcgttcaccaagagccacgcgctgttggagggctggagttaccaccagctgctcaaggagctggtggaggtggtgcgggcgctgcgcgacggcgccgagatccggtacgacgcgccgccggtccggttcgccgacacggtcgccgccgaggtggcctcgctcgcctccgacgccgaccgggacttctggcacggcctggtcggcgagtacgagccgctggccctgcccgaggactggcacggcgacctgggcgcgccggccgagcggatcgacgccgggttctccttcgcggacctggagccgggcctgcgcgacctggccgccgccaccggggtgccgttcaaggcggtgctgctcggcgcccacctgaaggtgctcagccagctgaccggcgcggagaggttcttcaccggcctggtcgggcacgtgcggcccgaggtgaccggcgcggagcggctgatcggcatgtacatcaccacgctgccgcacccgttcgcccgggacgccgccacctggggcgacctggtccgccgggtgttcgccgacgagaccgcggcgtggccgcaccgggcgtatccgatgccggcgatcgcgtcggccggctcccgcctgatcgacacgttcttcagctacctcgacttccacctgctcgacgacggcgacgtggtggacgagggcaacgggatcaaccgcaccgcgatggagttcgggctggcggtgaccgccatcggcggcgtcctcggcctgcgcagcaacacccacctgctgtcccgggagaacatcgaccggatcgccgccatgtaccgggccgtgctggagagcatggccgccgacggcgaccggggcgacgcccgggccacctatctgtccgcggccgagcgcgccaccgtggtgatcccaccggtgcccggtcccggggccgaggcgctcgcacacgagctgttcgaggcccgggtcgcggagacccccgacgcgatcgccgtcgtggcgggggcgtcccggctgtcgtacgccgaggtcaacgcccgggcgaaccgcctggcgtggctgctgcgcgacgcggggacgggtcccgaggacctggtcggcgtccacctggagcggggcgccgacctggtcccggccctgctgggggtgctcaagtcgggggccggctacctgccgttggatccggcgaacccgatggagcggctcggttatgtggtgaacgacgcgggcgcggacatcgtggtgaccacggccgagctggccccggccctggccgaggtgttcgacggccgcctgatcatcctcgacgagatcgccggcgacgaccgggtggacaacccgcccacggtggcgacgccggacaacgtgatctacacgatctacacgtccgggtcgaccggacggcccaagggctgcgtcctgacccatgccaacgtcgtccggctgatgcgggtctgcgagtccgaactggacatcaccgcggacgacgtgtggtcgatgatgcactcgtacgcgttcgacttctcggtgttcgagctgtggggcgcgctgatgttcggcggcacggtggtcgtggtgccgcgcggtgtggcccgctcgccggaagacttcctgcggctcctggcggacgagcgggtcaccgtgctgtcccagacgccgaccgcgttccgggcgctcacccaggcgccgcggccggcggatctggcgctgcgctcggtcgtcttcggtggcgagaagctggaggtcggcgaggtcgcctcgtgggccggccaggtggcgctggtcaacatgtacgggatcaccgagaccacggtccacgtcacggtgcacgaggtggactccggcgacctggcgaacccctcggtcagcccggccggggtggcgctcgccgacctggccgtctacctgctcgacccggccggtcagccggtcccggtcggcgtgccgggcgagatccacgtggccggcccgggcgtggcccgtggctatctgggccgggcggcgctgaccgcgcagcggttcgtgccggacccgttcggcgcgccgggcacccggatgtatcgcagtggtgacctggcccgctggacctcagagggtcgcctggagttcgtcggccgggccgacgaccaggtgaagatccgcggcttccggatcgagctgggtgagatcagcgcggcgctctccgcctgcgacggggtcgcccaggcggtcaccgtgctgcgcgaggacacccccggcgacaagcggctggtcggctacctggtgccggccgccgggcagcggaccgacccgcgggcgatccgcgccgagctggcccgcaccctgcccgactacatggtcccggccgccctggtggagatcgacgcgatcccgctgaccaccaacggcaagctggacaagcgggtgctgccggccccggacagcacctcggcggcgatcgccacggtggccccgcggaccccgctcgagcagcagctcgggctgatctgggggcaggtgctgggtctggaccaggtcggtgtcgaggactcgttcttcgacctgggcggcgactcgatccgggcggtgtcgctggtcggcgcggtccgggcggccgggcacgacgtctcggtcaccgacgtgttcgagcggcgcacggtcgccgggctggccgagctgatcggcagccgcaccgcgccggcccggccgcaccgggcggtcgagccgttcgcgctgatcggcgcggccgaccgggcactggtgccggccggggtgagcgacgcgtacccgatgctccaggcgcaggccggcatgctcttcgagctggaggccggcgaggtggcgcactaccacagcaccggtggctacaaggtgatcgacgacgcgccgttcgaccccgaggccctgcaggcggcggtacgcgtcgtctgcggccgtcacgaggcgctgcgcacgtcgttcgacctgtccaccttctcgatcccgctgcagctggtgcacgagcgggccgagccgccggtcggcgtggtcgacctgcgtgggttggacgccgaggcgctcgacgccgcgctgcgtgagcacgtggcgggcgagcaggcccggccgatcgacccggccgcggtgccgcagctgcggctcggcgcactggtcgccgacgacggctggtggctcgcgctgtcccggtcgcacatgatcaccgagggctggagtcagcacgagatgctgatggagctggtcgagtgctaccgcgcggtccgtgacgggcgtgccccggcccggccggagtcggtcgaggtccggttcgccgacaccgtcgcggccgagctcgccgccctggagtcgcccgcggaccgggccttctggcagggcgtggtggacgaccgggcgccgttccggctgcccgccacctggggtgacgccgacgggccggacgaggcctaccagctcaccgtgccggccatggacctggaggtcccgctgcgcgcgctggccacccaggcccgggcgtcggtcaagagcgtgctgttcgccgcccacctcaaggtgctcagccagctcaccaacgagccggccttccacgccgggctggtctgcgacacccggctggaggtactcggcgccgaccgggtgcacgggatgttcctcaacaccctgccggtcccgtacgaccggtccgcggccacctggtcgggcctggtccgcgcggtcttcgacgccgaggtggcgctctggccgcaccgccggttcccgatggccggggtgtcccggctggccggcggctccggacgcctcgtcgacgtgatcttcaactaccaggacttccacaacctggacgccgagaagatcgacctgagcgccgggttcggctccggctccaacgagttcgggctgaccgtcaccacctccaacggcggtctcaccctgaagacccgcacctcgctgctgtcccgggcgaacgcggaacggctcggcgcgatgtaccgcgcggtgctggaggcgatggccgccgacccggcgggcgacgccaccggggtgttcctgccggccggcgacgacgagcgaatcaccgcctgggaaccggccaccgacggtacggtcaccgacgtgccggtgccggtgctgctcgccgagcaggcggcccggacgccgcacgccccggcggtgcgcggcgacggcttcgagctgaccttcgccgagctggtcggccgggccggtgcggttgccgcggcgctgcgggccgacggggtcgggcggggtgaccgggtcggtgtgcgggtcgagcggggaccgtggctgcatgccgcgctgctcggggtgtggttcaccggtgcggcctacatcccgatcgacccgggcttcccggactcccgggtggagtccatgctggcgggcgccagggcgctgctcaccgacgagtcggtggcggccctgggcgaggcggcggtcacgccggccgagatcgaccccgatgagctggcgtacgtcatcttcacctccggctcgaccggaaagcccaagggcgtcgcggtgtcgcatcgcggactggccaaccacgtcggctgggcggtgcgggacctcgcgtcggccggtgacggcggcggcgcggtcttctcctcggtcgccttcgacctggtggtgccgaacgtctgggcgccgctgctggccggccagccgatcctgctcctcccgccggacctggacctgtccgagctgggcgcgcggctgcaggcggccgggccgttcagcttcctcaagctgaccccgggccacctcgaggtgctctcccaccagctgagcccggagcaggtgcgtgacctaaccggccggatggtggtcgcgggtgaggcactgcccggcgcgctggccggccggtactccggctccggccggctgatcaacgagtacgggccgaccgaggccagcgtcggcacctgcatttatccggtcccggccgacccgggcaccggcctagctagctag

SEQ ID NO: 2034 - DNA, 4956 bp, Actinoplanes utahensis
atgcaccagaactcgccgaccagcacccaggccactacggcgctcacgcctgagctcatcggctcccaggcagtgctcacgccggacgccgtagccgtcgtcgacggcgtccggcggctgacctaccgggagctggacacccgttccgcacaattcgcccatcacctgcgggagcggggcgccggcccgggcacccacgtcggggtgctgctcggccgtggcctcgacctgatcgccggactgctcggcatctggcgggccggcgccgcctacctcccgctcgacccgacgcacccgcagggccggctgaccggcatcctgaccgcctccggctgcgggctcgtgctctgcgacccggcggacgccgtccgggtgaccacggccggcgccgagccggtgcacctgagcgcggcggccgggcacccggccaccgcgcccgcggtcgaccgtggcgccgacgacatcgcgtacgtcgagcacacctccggctcgaccggcgtcccgaagggcgtcgtggtcacccacggcggcctggccaacctgctcggctgggcgaccggggacgtcgggatcggggcgggcgaccgggtgctgcagcgcacctcactggtctacgacgcgcacgccttcgagatcttcgccccgctgacccgcggcggcaccctggtgctcgccccggccggcgacactgccccggccaccctgctgcgggtgatcgccgagcacgcggtcaccgtgctgcaggtcgtcccgtcgatcctgcacacgctggtcgaggaggacggctgggccggctgtggcacgctgcgcaccgtcgtctcgggcggcgagcaactgcacgccgagccggtcgagcggctgcgccggctggtccccggcgtggtggtgtggaacgtctacggacccaccgagaccacgatcaactcgatcgccacccgggtcgatcccgcccagacgaccggcccggtgccgatcggccggccgctgccgcgcacccgggtccaggtggtcgacgagcacggccgggtggtcggcgtcggcgtccccggtgagctgctgatcggcggcgccggcctggcccgcggctacctcggccggccggggctgaccgcggagcggttcctgcccgacccgctggccaaggacggcggccgggtctaccgcaccggcgacggcgtccgctggcgtgccgacgggcagctggagtacctggggcggctcgacgaccaggtgaaggtcaacggggtgcggctggagccggccgagatcgaggcggccctggccacccacccggaggtggtggccgccgcggtcaccacgtaccgcctggcggacggcgcggcccggctggtcgcctacgtcgtgccgcgcggtgcggccggccgcgaactggacgccgcgctgcgtacccacctgctcgacctgctgcccccgtcgcacgtgcccggccgcttcgtccacctggccgcgctgccgcaggtggccagcggcaaggtggaccgtcgcgcgctgccccacccggacgcggccggggccgacgaccgacgcaccggcgcggtcccggccaccccgtccgagctgctggtcaagaacgcctggcagcatctcctcgggtccacagtagagggccgggagctgaccctggaggacgacttcttccggctcggcggcacctcgctgcagctcaccaaactgctgtccgacctgcgcggacagaccggcgccgacctcagcctgcgctcgctgctctacgcacccaccctgctcgcccaggcccgtctgctcgacgacgcccgggtcggcgccgcgctgccccgggtcccgcggggcggcggggtgccgctctccagcggccagcagcgcctgtggttcatggaccggctcaacccggccagcccggagtggatggccggcctgctgttccggctcccggccggcgccgaccggaccctcgccgagcaggccctgaacgtcctggtggcccggcacgagtcgctgcgcacccggtatgccgaggtggccggcgagccgcgtcagttcatccgccccgaggtgctcatcgaggtggccgagcagcaggtcagcccggccggcctggccgacgcgctggccgacctgctgggccgcgggatcgcgctgggcggcgacgagccgctgctgcgcgcggtggtgctggacgtcgccgacggccgccgcctgctcgccgtcgcgatgcaccacatcaccaccgacggctggtcggccgccgtgttggagcgcgagttcgcccaggtgatcggcgcgctggtggccgggcgcagcccggcgctgccggcgctgccggtgcagtacgcggacttcgccgcctggcagcgcgaccggctcaccgacgaggtggtggaggccgagctcagctactggtcgaccgtgctggacgggctgcagccgctgaccctggccaccgaccggccccgcccgcgggtccgcgacggcaggggctcgatcgtcccgatcaccgtcgcgccggcgctggtccgctcgctggacgcgctcgccgccgaggccggcaccacccggttcaccaccatcctggcgctctacgccaccgtgctggcccggttcagcggccagtgggacatcccgatcggcaccgtggtggccgggcgcggccgagccgagctggacggcgtggtcggcttcttcctgaacaacctggtgctgcgctgccggctcgacccggcggccggcgtggccgagtcggtggcccggctcggcacggtcacccgggacgccttcgcccaccaggagctgcccttcgacgtgctggtcgaccggctggtccccgagccggacctgtcccgcaccccgctctaccaggccgccttcgacctgcacggggcggacttcaacgagaccgtcgacgacgacctgggcgcgatccgggagatgtggcgggtcacccacaccgacctgaccctgctgctgcgcccgaccgcggacggcgggctggtcggtggcctggagtacgccaccagcctgttcgacgaggagaccgcggaccggatcgcggccaccctggagcacgcgctgaccgaggcggccgccgccccgggcaccccgctggggctgctggacacgctgaccgaccaggacgcgtacgacctgcggctgtggagccgcggcgagccggcgatcgacggcggactcgtgccggccggcgtggtcgagcaggccggccggacgccggacgccgtcgcggtgcgtggcgacggcttcgcgctgaccttcgccgagctgctggaccgcgccggcgcggtggccggttcgctgcgctccgccggggtgggccggggcgacctggtcggcgtgctggtcgagcgtggcccgtggctgcacgccgcgctgctcggcgtctggctggccggcgccgcgtacgtcccggtggatccggacttcccggtgaccagggcccagtcgatgctggccggcgccgccgcgctggtcaccgacgcgtcccgggccggggtcttcgacgggccggtcaccgtgctcgaggagctggtgccggccgccgtcgcgccggccgccatcgaccccgacgaactggcgtacgtcatctacacctccggttccaccggccgccccaagggcgtcgcggtcacccaccgcggcctggccaaccacgtcaactgggcggtccgtgacctggcccgggccggtgacggcggcggcgcggtgttctcctcggtcgccttcgacctggtcgtcccgaacgtctgggcgccgctgctggccggccggccggtccacctgttgccgcaggacctggacctggccgagctgggctcgcggctgaccgcggccgggccgttcagcttcctcaagctgaccccgggccatctggaggtgttgtcccaccagctgtccccgggcgaggtgcgggatctggccggccgcatcgtggtggccggcgaggcactgcagggcaccctggccgcccgctactcgccgtccggccggctgatcaacgagtacggcccgaccgaggccagcgtgggcacctgcatccacccggtgccggccgatccgggcaccggcgtggtgccgatcggctcgccgctgcccggcatggtgatgcgggtgctcgacgaccggctcctccaggtgccggtcggcgggctcggcgagctctgtgtcggcggcaccggcgtggcccgcggctacgtggaccgcccggcgctgaccgcggcccggttcgtgccggacccgtacggcccggccggctcgcggctctaccgctccggcgacgtggtccgctggcgcggcgacggtgcggtggagttcctcggccgcttcgacgaccaggtcaagatccggggttaccgggtggagatcggcgagatcgaggcggtgctgcgcgagcacgccggggtggccgacgcccggatcctggtcgacgaccagggcggggtgaaacggctggtggcctgctgggtgccggtcgggccggagccggtcggcgacgacgagctgcgcgagcactgcgccggtctgctgcccgacttcatgctcccggccgcgttcctgtcgatcgcggcgatcccgctgaacgccaacggcaaggtcgaccgggccgcgctgcccgacccggccccgcggccggagagccgggacgccgagccgctctccccggtcgccgagttcgtccagcagctctggcgtgaacggtgcgggatcgtggccggtccccgggagaacttcttccacgccggcggcaactcgatcatcgcgatccggttgatcgccgccatccaggacgagttcggcgtcacgctgcccgtccgcgccgtcttcgagggcccgaccgtggtcgagatggcccagctgatcgagaacctgatccgtgacgagatcgagcagatgtccgattccgaggtcgtcgcggacctcaccctgagcgaggagccgcaggcatga

SEQ ID NO: 2035 - DNA, 207 bp, Actinoplanes utahensis
atgtccgagcagaacacgcacctggtcgtcctgaacgacgaggagcagtactcgatctggtgggccgaccgcgacctgccggccggctggaccgccgagggcttcgccggcagccaggagcagtgcctggagcacatcgacgcggtctggaccgacatgcgcccggccagcctgcgccggcgcatggccgaggccagcgccgcctga

SEQ ID NO: 2036 - DNA, 942 bp, Actinoplanes utahensis
atggccggccacagctggaagccgttggacatcacggcagaagacatcggtaccgcggcgaccccggaggccctcgccggccacctcgactcgctcggcaccgccctcgacgacctcctggtgcaggagaaggccctggtcttccggggcttcggggtgacccccgcggagctcgacggcgtgttcgaccggctgctgccgcgccggctcgcgtacgtcaacggcaactcgccgcgcaccaaggtcggctcgaacctgtacacctcgaccgagtatccggccgagttcaccatctccatgcacaacgagatgtcgtacgcgaccagctggcccagtcggctcgcgttctactgccagatcgccgcggcgaccggcggtgccaccccgctggtggacgcgcagctctggctggagtcgctcgaccccggggtgcgcgaggcgttcgccgggggcgtgcggtacacccagaacctgcacggcggccgcgggctcggcaagagctggcagcagaccttcgagaccgaggaccgcgcggccgtcgacgagtacctgaccgctgccggcgccgagtggacctggcgcaacgacgggagcctgcacgtcgagcagccacgcccggccaccacccggcacccggtgaccggcgccgaggtctggttcaaccagtccgaccagtggcacccggccgcgctgggcgacgagaccgccaaggcgctcgcccagatcctgccgcccgaggaactgccgcagtacgtgacgttcgcggacggctccaccatccccgacgagtacgtcatccaggtccgcgaccgtggcctggagaacgccgtcgacgtcgactggcgggtcggcgacgtcatggtcttcgacaacctgctggtcgcgcacgggcggcgctcgttcaccggccagcgccgggtcctcgtcgcgatgaccgactga

SEQ ID NO: 2037 - DNA, 1785 bp, Actinoplanes utahensis
gtgaatgacctggaattccgtgtcctgggaccggtggaggtgtggcggcgtgaccgccgcgtcatgctgcccggctccaagatcactaccgttctcgccgcactcctgctggcccggggaaaggtcgtcccgcacgccgagctgagtgctctgctgtggggctgggacccgcccgcgacggtggacgcgcagatttacacctacgtctcccggctgcgcaagcggctcgacttcgcggtgcgcatcgtccgcgagcacgccggctacacgctcgacatcggcgactcgttcgtcgacctgttcgccttcgaggaactggccgcccgtggcgccgagcgactcgcccagggacaccgggcggcggccgccgacgacctgcgcggcgccctcgcgctgtggcgcggcccggcgctggccaacgtcaccgagccgctgggcgagcggcacctgccctggctggacgaggcgtacgcgctggcctgtgaacgccgcgccgaggccgagttggagctgggcggcagcctggaactggtcccggagctcaccgagctggtcgcccgctacccgctgcgcgagcagttccgggcccagctggtgctggccctgcaccgggccgggcggcgctcggaggcgctggtcgcctacgaccgggcccgccggacgctggccgaccagctcggggtcggccccggcgaggcgctcaccctggcctaccaggaggtgctgatcagcgacacggccgagccggagccggccccggtgcgggctgccgagccggtgctggtcacgctgccgccggacgagcagtacttcgtcggccgggccgacgagctggccgggctggagcggctgctcaccgccgaccggccggccgccaacgggccccggcaggtgctgctcaccggcgcggtcggcaccggcaagaccgcgctggcggtgcgggccgcgcaccggtgcgccggcgccttcggcggacggatcgcgtacgcctcgctgaccgaccagaacggcgcgccgctgcccgccgccgcggtgctcaagcggctgctctacggactcggcgagccggtcgagcccggctgcggcgccgacgagctgggtctgctcttccgggccgccaccgcccgccgcccggtgctggtcatcctggacgacgtgccggccggcgccgacctggccgcgctcaccccgaaccacccggccgccaccctgctgctgatcagccgggccaccctgacggtcgccggccggcgcgacaccgtgctgctggagccgatgcgcccggccgagggcatcgtgctgctggcggcggtcgccggggaggagcggatcctcgccgatctggacgcggcccgggccgtggtcggattctgtgacgcgctgccggccgcgctgcggatctgtggcgcccggctggccgcccgtccactctggtcggtgcgtcgcctcgcgcaccggctgaccgacccggcccgccgtctcgacgagctggccctgggcgacgagtcgctgcgcggccggctgctctccgccttccggtcgctgcccgacgccgcacggcgcggcctgccgatgctccgcgacgtcgggccggacgcgttcacggtgacctcgctgcacctgcccggcggcatctccgaggcggagaaggagcaggtcgtcgacatgttggtgcaggcccgcctggtcgaggaggtggtggccgacgacctcggcggcagccagttccggatgcccgggctgatgcgtctgctgaccctcgacgtgacccgcgcggcgagctga

SEQ ID NO: 2038 - DNA, 693 bp, Actinoplanes utahensis
gtgagaactcgcgcgccgcgcctgcggctgcttctgcgtcacctgcgcccgcaccgccgcggcctgctgaccggcgccggcctgatgttcctcggcggcctggccggcctggccgcgccgctggcggtgaaacgcctgctcgactccctcgccggcggggcgccggccggtggcgcggtggccctgctggccgccctgctggcggccggcgcactgctcggcgcggtcgggatgtatctgctggaggccaccgcggagggggtggtgctgggcgcccggcgcggcctgatcgaccggctgctgcgcctgcgggccggggtgctggaccgggccgcgcccggcgacctgctggcccgggtcaccggcgacaccacccagctgcgcgccgccgccaccaccaacctggtcgacctggccaccgggatcttccaggtgaccggcgcggtggtgctgatggcccggctcgacccggtgctgctcggcgtggtggccgcggtcctggtgctggtgctcgcggtgaccgcggtgctggccgggcggatccgccaggccggggagcggacccaggcggccgtcggcgacctgggcgcgctgctggaacgggcgctcggcgcgctgcgcacgatccaggcgaacggcgccgagcgggcccaggcggcggccgcgcaccgggcggcgacccgggctagctag

SEQ ID NO: 2039 - DNA, 255 bp, Actinoplanes utahensis
atggccggcgggcccggcccggccggcggatccgggggtctccgcgggcagccggagcacctcgtcgatccggccggccgcggccagcccgccctgcaacccggcgatcccgccggccagctgggccaccggcccggccagatagaacaggtagagcaggaaggcgaccagcgacgacacggtcagccggccggccgccaccgaggcgccgccgacgccgagcaccaccacgaaggccacctgctagctagctag

SEQ ID NO: 2040 - DNA, 753 bp, Actinoplanes utahensis
gtggccttccacggggtctcgctgcggcaccgcccggacggtccggaggtgctgcgcgacgtgaccctgcggctcccgccggccgggctgaccgccctcgtcggcccgtccggcgccggcaagagcacgctgctcgcgctggtcgagcggttccgggaaccgaccgccggccgggtcgaggcgggcggccgggacgtgcggcactggccgctgcgcgacctgcgggcccggatcggctacgtcgagcaggaagcgccggtgctggccggcacgctgcgcgacaacctgctgctgggggccccggacgcgtccgacgagcggatcgccgaggtgctcgcccagaccgcgctgaccgcgctggtccgccggctgccgcacggcctggacacggtgctcgggcaccgcgggtcgacgctgtccggcggcgaacgtcagcgcgtggccaccgcccgcgccctgctccgccggcccggcctgctgctgctcgacgagcccacctcgcacctggacgcggtgaacgagcaggcgctgcgcgacctggtcacccgggtggcccggaccaccaccgtgctgatggcggcgcaccggctgtccacggtgacccgcgccgaccgggtggtgttgctggagcagggccggatccgggccgtcggcacccacgacgagctgctcgcccgggacgggctctatcgccggctggccgcgacgcagctgctcgtatcgagtggatatagagccggacccgatgcttga

SEQ ID NO: 2041 - DNA, 132 bp, Actinoplanes utahensis
atggcaccgaccacttaccagcgcccgacgctgaccaagggcggctcgttcgcccgcaagaccgccggcagcctcttcaccagctgccgcgaatcgttcgtgacccagaagccgaaggccgtctgcaactga

SEQ ID NO: 2042 - DNA, 1839 bp, Actinoplanes utahensis
atggcgctgttgccagacctggcgtcacaagtgtcatggttcgtagcggtgccggacaacgatgccggccaccggatggcagggccactcctgcggacgcccaccggcgttccgggtccccgcccgcggacgcccaccggcgtcccggggatggtcgcccacgcgtccggtcgcccctggctggtcggtcgatggcagcccggtgaggcggtgacggccgcgatcggcccgaaccgcctcgccgcgctgggtgagcaccggctcaccgccgacgacctgcggcggctcgcgcgcggcgcgcgcaccgccgaacagctctgcgagagcctgcgcgggcagcccggcagcttccacgtgatcgccgccgggccggacggcctcgccgtgcagggcagcctgtccggcttccggcgcgtgtaccaccacggcccgctggccggcgaccgcgccgacgtcctggccgccgtgatcggcgccggcgtcgacgacgaggcgctcgcggtgcggctgctgagcccgttcgcgccctggccactgttctggaatccggtctttcaccgcattgcggcggtacgcccggacgagcggctcgtggtcgctccggacggcacgccgcgcctccggcgccgctggcagccgcccgcacccaccgtcgacccgggcgaggcggccacgtggctgcgggacgccctcgccgcggcggtcgcggtccgcggcgcccccggtgacgtgctggccagtgacctcagcgggatggattccacctcgctctgcgcgctcgccgtccgggacggccggcacgtgatcgggctgacctgcgtcagccccgacccgctcgacgacgacctgccctgggccgagaccgcggcccgggagctcggcaaggtcacccacgaggtgatcgccggggacgccagcccgctgccctacaccgacctgcaccggccggccgacggcttcgacgagccgaccgccgcggtgatgtaccgggccggtttcctgggcgcctcgcgccgcgccgccgggcacggtgcccgggtacggctcaccggcttcggcggcgacgagttgctcaccgccgatccggccctgcagctcagcctgctgcgcaccgacccccgggcggcgatccgcaacctgcggctgctgcgctcggcgtaccgctggggccgcaccgcgacgctgcgcgcggcgttcgaccgtcgcccgtacggcacctggctggcctcgctgaccggtgacggtgacgcgggcgccggaccgatgctcggctggggtccgccggccgcgctggcgccctgggtcagcccggacgcgcgggccaccgtccggcggatcctgcgggagcaggccgcttcggccactcccctgctcgacgaccgtgggctgcacggccggctggccgggctgcacgccggggcggccgccgcccggcacctggcccaggcctcccgccggaccggggtcaccgtggccctgccctatctggacgacgccgtggtcgaggcggcgctgagcgtgcgcctggccggcgtcgcctcgccccggcagtacaagccgctgctcgccctggccatgcgggacgtgctgccggagccggtgcgccaccgctccaccaaggcggacacctcgatcgccgcgctccggggcgccgacgagcaccgcggcacgctgctcgacctggccgaccggtcccagctcgccgaccgcggcctgatcgacgccgcggcgctgcgggccgccctgacggcgcccggtgaccgcaccttctacgacctcgaccagaccctcgcggccgaggcctggctgcgcgtcccgggaaacggagatgcccgatga

SEQ ID NO: 2043 - DNA, 255 bp, Actinoplanes utahensis
atgaactggaccctgccggcccacgtggcctggaccccgaccgagtacggcggggtactgctggactcggcgatcggcgagtactggacgctgaacgcgaccgccgccaccatgctcgactgcctgctggccggcccgtccccggccaccgaccggctggccgccgacctcggtgccgacccggcgacgatcgccgccgacctggccgagttcctcggtgagctgcgcggcgccggtctggtggtggcgagatga

SEQ ID NO: 2044 - DNA, 423 bp, Actinoplanes utahensis
atgaccaccgagcaggtgctcgcgcaccggccgagccggctgggccggcggctgacggtgctcgccgtggtggccttcgcccgggtgctggcacaccggtcaccggacctgatctgccgggtgctgcgccggatcagccgcggcgcccgaccggccacccgtcaggaggccgccgcggcccgccgggacaccgtggcgaacagcgcgttctgcgccggcccggtcggctgcctgccccggtcgatcgccaccgcgctgctctgccgccagcggggcgcctggccggactgggtggccggggtgcgccggcacccgccgttcggcgcgcacgcctgggtcgaggtcgacggggtggcggtggacgagccgtacccggacgggttccacatcccgatgctcaccgtccggagcccgtcgcgatga

SEQ ID NO: 2045 - DNA, 249 bp, Actinoplanes utahensis
atgaccaccacgctgctctacctctcctggaccggccggggtgccctggccatggtcttcgccgcgtcggtgctggccaagacgcaccgggtggcggcgttcacccgtttccggcaggccaccgccacgctgaccgggcagtccggccggcgcgccggggtgctcgccgtgctgaccgtcgccgccgagaccgcggtcgccgccgggtcggtcgtcgcgcgcaccgcgccgtgggccgcggctagctag

SEQ ID NO: 2046 - DNA, 504 bp, Actinoplanes utahensis
atgagtgccctgatcgccgccgtcgtcgtgctcgccctggtcgtcgcgttccacaccgcgctgatcgtggcgctgatccgccgcctgcggtaccacgccgaactgctggtcgacatcgaggagcggggtgtgccggcccgggccctgccccgcggcgcggtcctggccgcggggctcggtctgctcgccccggacaccgacaccctggtcgcgttcttctcccccacctgcgaccggtgccgccgggaccgcgccgcgttcggccgggtcgcggccggctgggatcgggcggtcgcggtggtctccgggccggacgcgtccgccggcttcctcgccggggccgtcccggccgcccgggtggtggtggacgccgacgggtcgctgcgtcacgcgttcgggatccggcacttcccggccctgttcgtggtctccccggacgggcggctggcctggaccgggatgcacgcctccgcgattccccccagttcctccgagaagaagtga

SEQ ID NO: 2047 - DNA, 1002 bp, Actinoplanes utahensis
atgacgagcgagagcatccgtttcctcaaccgcgccgacgtcgcggcctgtctgtccaagatggatgcggccgaggtggtcgcgcagaccctgcgggatcacacgtcgggccgcaccgagctaccccccgaagggtatctgagctggtcgaacagtgccggtgcgtacagccgggcgatcgccatgctgggagccgtgccggacggtgcggccatggcgtacggaatgaaattgatcaacgcctcggtcggcaacccgggccgcggcctggagcgggccggggggctgagcttcgccttcgacccggagaccgcgcgcccggcggtggttgccgaggccgggctgctcagcgcggtccggaccgcgacctacaccgtggtcagcctgcgggagctcgggccggaatcgttcgacacggtcagcctgatcggcaccggcacgctggcccgggtgcacctggaggcgatcgccgacgccttccccgcggtgcgccgggccgtcgtcttcgacctcgacccggcacgcgccgccgcgttccgggacgatttcgccgcccgccgcccggagctgacggtcaccgtcgcggacagcgcccgccacgcggccggcgccgccccggtgctgatcaccgtgaccaccagcaacgacccgtacatcccggcgtcctggctggccggcggctcgttcgtggcgcacgtgtccctcgacgacctgaccggggaggcgttccgcggcgccgaggcggtcttcgtcgacgacctcgaactgatccgggacaacccccgccggatcatgggccggctcctccaggagggcgtgctcaccggcggcgacggcagcctcggcgaggtgctgaccggccgccggccggcccggcggcccggttccggatacgtcatcagcaacccgttcggcatggccgtcctggacgtcgccctgatccacgccgtcgcgcaggtggcgcgggaaaccggcgccgggcagctcctcgacctgctctga

SEQ ID NO: 2048 - DNA, 993 bp, Actinoplanes utahensis
ttgatcatcgaatccgcgctggatctccgatttcccgacgtcttcctcgaactctccgggttcctcccggacagccgcctctacctcaagatcgaggcgatgaacctggccggctcgatcaagttcaagccggccctcgccatgatcgacgacctggagcagcgcgggctgctccggcccggcagccgggtgatcgaatcgtcctccggcaacctcggcatcgcgctgagcatcgtctgcaacgcccgcggctaccagttcacctgcgtcaccgacaagaacaccgcgccggccaccatcgagctgatgcgggcgtacggcgcccgggtcgtggtgatcgacaaacgcgacccgaacggcgggtacctgtcgatgcgcctcgcctacctgcaggaccgcatccgggccgacccgatgctggtctggcccaaccagtacgccaacccgatcaacacgatggcccactaccacaccaccgcggccgagatactccagcagttccccgaggtcgacgcggtgttcgtgggggccggcacgaccggcacgctgaccggttgcgcgcagtacttcgcccggcaccggccacagacccgggtgttcgcggtcgacatcatcggctcgaccaccttcggcaccccgcccggccggcgacacatcccggggctgggcaccagccgcaccccggcgatcgcctccctgcagcacgtcaccgatctggtgatggtctccgagcacgagacggtgaaaacctgccggcggctgcgcgaccggcaccacgtgctggtcggcggctcgaccggcgcggtgctcaccggggtggcggaccgggccgccctgttgcgccccggctcggtggtggtggcgatcagccccgatctgggcgaccgctacgccggctcgctgtacaacccggcctgggtcgccgaacgcgaactggaccgcccgcccgcaccggtggaaccgctcgacattcccgtccccgacctcgtctga

SEQ ID NO: 2049 - DNA, 966 bp, Actinoplanes utahensis
atgtccacatcggaggccttcaccggcctgccgccgcggcgcgagccgggcggcctgctcaccctcgccgacctcaccccggaccggctggccggcctggcgcgccgctcggtcgagctgtaccgcgaccgcaccgcgcaccacgacccgctgcagggcctgctgatcggcatcgtcttcacccgcacctccacccgcacccggaccgccttcaccgccggcgtcgaacggctcggcggccgggcgatcggctacgggccgggcgacctgcagaccaacaccggcgagtcgctggccgacaccgcccggatgttcggtctgatgctcgacgggatcgtcacccgcaccgccggcccgctcgccgacatgcggctgctctccgccgagagcggtctgccggtgatcaacgcgatggccgccgaggagcaccccacccagggcatctgcgacctggccacgatcctgctgcaccgcggatcgctggacggggcccgggtgctctacgtcggcgagggcaacaacaccgcgaccgccctcgcgcagggcctcagcgcgttcgccggcaccgagttgcacctgctcaccccggacggctacgggctgcccgaggacgccctgaaggcggccaccgcgcgggccgccggcaacggcggccacgtcaccgagtcgcacgatccgcgcgacgtgccggccggtgccgagttcgtctacaccacccgctggcagaccaccggcaccagcaagcccgacgcggcgtggcgggagaccttccggccgttccacatcgacgatcaatttctggggcgtacgccggatgccctcttcctgcacgacctgcccgcccaccgtggcgaggaggtctccggcgcggtcctcgacggcccacgctcggtcgcctggtcacaggcgcggatgaagctgtgcagcgcgatggcggtgctcgagtacgcgttcggccgggactga

SEQ ID NO: 2050 - DNA, 168 bp, Actinoplanes utahensis
atgaccgacgatctggcgacccggatcgccggtctgctgcgccgggcgcatcccctgcggatgggctcggcgatccggcaggccgacgaacttctcacggacatcgggccggccggtcgggcagcggtcctggaacgcgcgatccatctggccctgcacggcgaatga

SEQ ID NO: 2051 - DNA, 1398 bp, Actinoplanes utahensis
gtgcgcgacggcggcgttgatgtccccaccggcccgatcgtcaccggcgatccacacgtcgtccgggccctcgacctccgcggcggccggctggaacttcatgcccggcgtcgagtgcgcggtccaggtcgagccgttccagtggtaggcggcgaaggtgaagtccgtcccggtcggcgcgaaggtccactggtcgtcgagcgaggcggcggcgtagatcggccggccgttcgccttgatcgccggagtcgccagttcggaccacacggagccggtccactggaaggtctggaacttggaggtgcactcgaagcagatggtgggctgcgtcaaggcgtagatcaacgcggcgtccgggccgaacgcccggatctccgcggagacgatcttgcggtcggtgccgaccggcaccgggacggccgtccaggcggccgccgcggtggccggcgcctggacggcgagcgagagaccggcggcgaccagcgcgccggcggccacgagggcggttgtacgacgaatcaagacggtggctcctccacgcgaggtgactgggcgcccagtcttcgacggacgtctattgccgccttatatcgcatccggcccgtgcccctaccgaccggtaaaaggtgccgcgccggttccccggtccggggcgcctccgtacgctcgggtcatgtccattgtcgagagggtgcccgccttctcaccgccgcggaggccgcgatgatcgagtccatcctgcccagcgccgtcaccgcggtcgacacgttccaggacccgccggaggccggcctcttccccgaggaggagttgctggtcagcacggcggtggcgaaacgtcgggcggagttcgccaccggtcgctggtgcgcccggcaggcgatgctgcggctcggtcaccggccggccgcgatcctgcccggcccgcgcggcgagccccagtggcccaccggcctggtcggcagcatcacccactgcgccggctaccgcgccgccgtggtcgcgccggccccgcaggtcaccaccgtgggcatcgacgccgaaccgcacgaggcgatgccggccggcgtcctggaggcggtctcccaggcggccgaacgcgaccacctggccgccctgacccggtaccagccgggcgtgcactgggaccggctgctgttcagcgccaaggagtcggtgtacaaggcgtggtatccactgaccgcccgctggctcgacttcgacgacgccaccgtcaccttcgacccggcggcgggcaccttcaatgcccgcctctcggtgaccggcgcgcgcctgcacgggcgcgaactgaccggcttcagcggccgctgggtggtcggcaacggcatcctggtcaccgccatcgccgtcctcgccccggttcccgccctgctctga

SEQ ID NO: 2052 - DNA, 2772 bp, Actinoplanes utahensis
atggaactggtggaacgggacggcgtgatggcggtgctggacagccttctggcagccgccgtcgccggaaagggacgggtcgccatggtcacgggttccgtggccaccggtaagaccgaactgctgaacaccttcgccgaacgggtggtcgacctgaacggcctggccatcaccgcggtcggcgcgcgcagcgaacgggacctcccgctcggcgtcttcggccagctgctgatggacgcgccgctggtcgccgaggacagccggcgggcgatggacctgctgcacgagggcgcccagagcatcccggccggcccggacggcgccgcccggctggacccgcagatcgtgcacgcgctctgcaccatcctgctggacctgtcgcagcgctacccgctggtggtcgtggtcgacgacatcgaccaggccgacccggcatccctgctctgcctctcctacctggcccgccgggtgcggttcgcgccgatgctcgcggtgttcagcctctcctcgtacgcccggccggacgaacccgcggtcgaactcgaggcgctgagccggccgccgcagggcgcgcacctgtcggtcgccgcgctcagccccgaaggcgtgcgccggatggccgccgaggtgctcgacccggagcaggccgaccggatcgcgccgcgctggcaccagctcaccggcggcaacccgctgctggtcaccggcctggtcgccgaccaccggcaggtgctcgccgagggcggcgccgcggacggcgaaccggtcaccgccggccactacgcccgggccgtcgtgtcctgcctgcaccggatcgacccacagctggccgaagtggcccggggcgccgcgatcctgcccgaaaccggactcctggaccagctgctcggcgtcgacgcggcgcacatcggccaggcgctgcgcgccctgaccaccgccggggtgctgcacaacggcgaataccggcacccggtcgcccgggaagcggtgctcgccgagatccccgacacggaacgccgcgagatgcaccggcgggccgcggtgctcgcccactacggtggcgccgccacccgggtggtcgccgaccagctgctcggcgccggtcgcgcggacgacccgtgggccgtcccggtgctggaggaggcggcccggcaggggctgcgggagggccgggtggacaccgccatcggctacctccggctggcctggcagacctgcgccgacggaccgcaccgggcgaagatcatgacgaccatgctgcgggccgcctggcggatcaacccgggcacctccaccgcgtacctgcccgagctgaccgccgccctgcagcgcggattcctgctcggcggcgacgccctggcgctcaccaaagcgctgctctgggacggccagttcagctcggcacgcacggtcttcgaccacctgaacgcggtcaccgacgacctcgaccaggagggcatgaccgaactggcgatcgcccggcccctgctgcgctgcacctacccgccgttcttcgcgctgctgcgccagccgtccgagcggccgccggccgtgtcgacggtcgccgccagccaccggctggaagcggcgaccgcgctggccacggtgctcacccgcggcccgtccgagaagatcgccaccgcggtgcagcggatcctgcacaactcccggctggacgagatgagcctggacacggtggagagcgcgctgctcaccctcacctacggtggctggtgcgaccaggcggcgtcctggtgcgacctgttcgtcgaggaggcggtcacccgccgcgcgccgagccggctggcccggctgtccgcgatccgcgccgaagtatcgctgcgcctcggcgacctgcccgccgccgtccggcacgccaggttcgccctcgacaccatgccgccggccagctggggggtggcgatcggcgccgcggtcgcgccgatgatgctggcggccaccgcgatgggccgctacgacctggtccgtgaacagctcgaccagccggtgccggaggagatgttccacacccgctacggactgcactacctgcaggcccgcggccggtacagcatggcgatcgggcagctccagctggccctgcgcgacttcgaactgtgcggggaactggccggcaaatggcacctcgacgtgcccggcctggtgccgtggcgggtcgacatggccgaggcgctgctgctggccggtctgcccgaccgggcccacgagctgatcgaggaccagctgaaccgttgcgccaagaacaacccgagggtccagggcatggcaatgcggctgtacgcggcgaccagccagccccggcaccgcccgatgttcctgcgccagtccgtcgacctgcaggccggcgacgagtacgagcaggcccgcgctctggtcgacctcaccggggcgtacgaggcggtcggcgagtcccggcgggccggcatgatcgcccggcgggcccgggccctggccgacaagaccgaggccgagccgctgctcgccacgctcagccccgagctgggcggcgacgaggccgagacggcgacggccctgaacctggccgccggggcagtcaccctcagcgacgccgaacgtcgagtcgcgatcctggcggccgacggctacaccaaccgggagatcgccaccaagctgtacatcacggtcagcacggtggagcagcacctgacccgcgtctaccgcaagctggacgtgcaccggcgcaccgaccttccggcccacctcctccgcgaccacgccaccgccaactga

SEQ ID NO: 2053 - DNA, 1686 bp, Actinoplanes utahensis
atggggaacaagtacgtccggccgttcacgccgacgttcccggaacgcacctggcccggacggaccatcacctcggcgccacgctggctctccaccgacctgcgcgacggcaaccagtcgctggtcaacccgatgggcccggaccgcaaactcacgatgttccggctgctcaccgcgatgggctacaaggagatcgaggtcggattcccggtcgccagccgggacgaccacgatttcctgcgcctgctcatcgaggaggacctgatcccggacgacgtccggatctcggtgctggtgcaggcccgcgacgagctgatccggcgcaccgtggacagcctggccggcgcgccgcgggccaccatccacatctacaacgccacctcgccgcagtttcgccgggtggtcttcggcatggaccgggccgagtgcaaggagctcgcggtgcagagcacccggctgatgctcaagtacgccgaccgcaccctcgccggctgcgacctcggcttccagtactccccggaactgttcaacgacaccgagctggacttctcgctggaggtctgcgaagcggtgatggacgtgtggcagccggcggcggaccgcccgatcatcctgaacttcccgaccactgtggaacgggcgaccccgaacgtcttcgccgaccagatcgagtggctggaccggaacctgagccggcgcgaccacgtctgcctctccgtgcacccgcacaacgaccggggcaccggggtggcgaccgccgagatggcgctgctcgccggcgcgcagcggatcgaaggctgcctgctcggcaacggtgagcgggccggcaacgtcgacctggttaccctcgggctcaacatgttcagccagggcgtcgacccgggcatcgacttctccgacatcaacgaggtccgccgggtcgtcgagtactgcaccgagattccggtgcacccgcgccacccgtacgccggcgacctcgtctacaccgccttctccggctcccatcaggacgccatcaagaagggcttcgacgagcggaaacggaccggcgaccagcgctgggagatcccgtacctgccgatcgacccggacgacgtcgggcgcacctacgagagcgtggtgcggatcaacagtcagtccggcaagggtggcgtcgcgtacgtcatcagctcctgcctgggtctgcatctgccccgcgacctgcagcgcgagttcgccgcactggtgcaggcccgggccgacgcggagggcggcccgatcgacagcgaccggatcgtcgagctcttcacccgggagtacgtgtcccggccgctgctgtccgtgccactgccgctgcgcgaggcggtgccggtcaccctgcacgtcgacggtcacgcgttcgaggtcggcgcggtgcgggcggacgcggtcgagcgggtcaagcagagcctcgccgcctggcggatcgacctgcgcgcggtgcaccgcaccggcaccgggctggccgacggcaccgcgaccggcgtctacgccgagctgcgcgccggggaacggacgctctggggcgtcgccgccgacgacgacgtggagtcggcgatcctggccgccgtccgctccgccgcggcccgcctgggccggcccgccgagcggccgcggggcgcctatcgaatcgacgaaactccctatccgatggcccgcgccagctga

SEQ ID NO: 2054 - DNA, 357 bp, Actinoplanes utahensis
atgagtatctccgcgcaagcagtggacgtcgtgtacggccggccggccgcgggtgtgcaggtccggctccagcggaagatctccgacctggggcacgaactggacgactgggtgaccgtggatcacgccgagaccgaccacgagggatacgtgcgcgcctggaccgagaagcgtctcggccgcggcccgtaccaactcgtcttcgacagcaacgcctacttcgcgacgctcggcctgagcaccgcgtacaaggaggtctcggtcgtcgtgcgattgaccggggaatccgacagctgtcaggtccaggtacggctcgcgccctactcctactcgatgtatttcggcttccgggactga

SEQ ID NO: 2055 - DNA, 195 bp, Actinoplanes utahensis
atgcgtaagttcacccgccgcagcgcccgtttcgtcgtcgccgccgtcgccgccgccgtgctcgccgtcctcggcgccgccactgccgacagcaacgacacgacgcctgcgcagcccggcacgccggccggcaccagcgtggccaccggcgccgacgacaccacgatcagcggcacctggccctgggaagggtga

SEQ ID NO: 2056 - DNA, 3057 bp, Actinoplanes utahensis
gtgaccgtggaattccgggtattgggaccgctggacgcgctcatcgacggtcagcgcatcgatgtcggcggtaatcgtcaacagatcgtcctggccagcctggtgctcgaagccggctcggtgatctcgatcgaccgcctgatgcgagcggtctacggcgagagcctcccgtccagcgcccgcgttcaagtacagatctgcgtctccgcgctgcggaggcttttcggccagcacggccatcccaaggcgatcgtcacccgcaaccagggttacgtgctggcgcccaccgagatcgacgtggatctccaacgatacgagagcctggtcatgcaggcgcgggcggcgggcaacgccggacgcaaggaggagtcgaccgctcgctaccgcgaggcgctcgccctctggcgcggaccggccctggaggggctcgacagcgagccgctgcggatggtcgccgaccggctcgccgaacgccggctcaccgtcaccgaggactgcatcgagtacgacctggagctgggccgccaccgcgaggtgatcgccgagctggtcggcctggtcggcacctacccgctgcgggaacggctgcgcgggcagctgatgctggcgctctaccgctccggccggcaggccgaggcgctggacgcctaccgggcggcccggcgcacgctgatcgacgagctgggcctggagcccagcgagtggctgcagcagctggaacgctcgatcctggcctccgacgccgacctgagcgcgcccgaggcgacgaccgccgcggtcccgctctcgctcctgccggtggtggagccggaggtgccgccgccggatctgctcgtgctggaaccggaagcggcgcgggcggtcgccgacccggccccggcggctcgcgggggccagccggtgccgagcatgctgcccaccgacatcgccgacttcaccggacgcaccgagcagatcgaggccatccaggcgcacctgacggcggccgccggagatccggcgcagctggccgtgccgatcatcgtggtggccggcaagccggggatcggcaagaccgcgctcggcatccacgtctcgcaccggctggcaccgcgctatccggacgggcagctcttcgccgacctgcacgggcggtcgtcggaccgggtcagcccgatgcagatcctggagcggttcctgcgcaccctcggggtgcccggcgcgtccatcccggacgggctggaggagcgcgccgagatgtatcgggggctgctctccgaccggcggatgctggtggtgctggacaacgccggctcggaggcgcaggtgctgccactgctgccgggcaatccgcgcaccgcggtgctgatcaccacccgcagccggctcggcgccctgcccggcgcggtgcacgtcgacatcgacgtgctcgacccgtcgcactgcgtcgcgctgttgtcccggatcgccggggacgaccgggtcctggccgagaccgacgcggtcgccgccctcaccgagctgtgcgggcggctgccgctcgcgctgcggatcgccggcgcccggctgtcggcgcgcccgcactggtcggtcgagcagctcgccgaccggctggagaacgagtcgcgccggctcgacgagctcaaccacggcgcgatgggggtgcgggtcagcatctcgctgacctacgacaacatcagcgacgccgcccggcgactgttccgcctgctcgccgtcgtggacagcccggccttctcggcctgggtctgcgcggcgctgctcgacgaggcgctgccggacgcctacgacctgctggacgacctggtcgacgcccagctggtggagatcgacagcaccgagcccggcccgcaccggcagtaccggttccacgacctgatccgggtcttcgcccgggagcggctggccgccgaggaaccgctggccgatcgcaacgccgcgctgcaacgggtgttcggcggtctgctgttcctgtccgaggaggcgcaccggaagttctacggcgagggcaacaaggaggtgcacagcgcggcgccgcgctggcggatcccacagcggtcggtggaccggatgctgagcgatccgctcggctggttcgagcgggagcggcagtccatcgtggccgcggtgcgtcaggccgccgaggtcggagcggtcgagtactgctgggatctggcggtcaccgcggtcaccctgttcgagacgcgggtctacctcaacgactggcggaccactcacgagatcgcactcgccgcggtgcgccgggccggtgaccggctgggccacggcatggtcctctactcgatgggtgcactcaccatcgcggagcggcggttcgccgaagggcgtcgtcggctggaagacgctctggagatgttcgaggtgctcggcgaggagagcggccacgccatggtcaaccggcacctggcctacctggagcggatggacggcaacctggacgaggcggcccgccggtacgagcaggtgctgcccgtggttcgccgcggcggcaatccggccgcgctggcctatgtgctgcacagcatggcgcagatcgagatggagcgcggcaacgccggcgacgccaaggcgatgctggagcagtcgctggaactcagccgccgggtcggcggccggcgcatcgaggcgcaggtgctgcaccggctgggccaggcccaccttcaggccggcgagccggagtcggcggtgaccgtgttcggcgaggcactgaccgcggcacacgggctgggtgatccgatcggcgaggcgtacgcgacgctcggactgggtgcggcgtatctgagcgccggcgacctcaccgaggccggcgccgcgctggcccgggcccgggaactcgcgtccatcaacggcgagaggttgatcgaggcgcgggtcgagttctgcatgggcgagctgtcgctggccgccgacctgccggacgcggcgaccacccacctggaacgggcgctggtgatgttccgggagatccatgccccgcttttcgaggaacgtgttctggcgatgctgcaacgaacgaaaaatcagtgtcgcgtggcctga

SEQ ID NO: 2057 - DNA, 1284 bp, Actinoplanes utahensis
atgcaggttccgctgctcgccgtccgcgagttccggtcgaactggcggcgcaacgcgatcttcggcgcgatcctgttcgtgtcgatcagcgtgcagctgttcaccgcgatcgcggccaccgccagccggaccgcggtggagtcctacgcgaccgcggtcttcggctatgcggagacgtacagcctgaccatcccggacgagcgcaccggcgccgccctgcacaccctcaacgaccggctggccgacatcacccgcagccacccctggctgcgcccggccaccgcggtgaacgtgaccgcctacgtgcgggcgtcggccacctccgacccgagcgcactggtgccggtcaccctgcggtcggtgacccgggactggcagttgctgaccccggcgctggccgacgacgacctgtggcgcacggtcatcgacgatcgccggctcggcccggccgttctcctcgaccgggacaccgcgggccggctcggcgtggccgccccgatggcggtgaccctgctgctggacgccccggtcgccgaccatccgggagccggcgcgtcacccgggccggagcaggcccggcagcaggcggccggcgacgccccggcccaggtcgcggcgggcgcttcggtgcgtccccggatcgcgctcggcggtgtgccggtcttcggcacctacaccgagctgaacaagtcgctggccgccgacggtttcgtcacccagaacgtgatcgatctggcgcacctcggcccgcagaccgtgcaggtctactggcggtgcgtgcggatccggtgcggcgacgcggcggccctggtgcgcaccgcggtgggcggtcacgtcaccgcggtcgagagccggatcgacgacatcgaccagttccgcccggtgttggatcagcagcgtgaggaggggcagcggttctcggtgatcgtgctggtcctgggcgcgctcgcggtcggcatcgtctccaccgcgttcgtcgaggtgcgggcgccgcagttcgccacgctgcgggcgctcggcgcgtcccgcccggccgtcggggtgctggcgctgctggagaatctgctgaccgcggcggtggtcggcgtgctcgcggtactcgccggggcggccgccagccggctcgatccgaaccggttcaaccagatctcccaggtccgcctcgatcatctcggcgtgccgatcgcgatctacgcacagaccatcgcgatcaccctggcgatcggcctgctcaccggcctggccccggcgatccgcgcgtaccgggcggtccgcacgtcctga

SEQ ID NO: 2058 - DNA, 717 bp, Actinoplanes utahensis
ttgaccgatagccgaccggtcgtcgaggcgcgcggcgcggggaagacgctgcagctgcccaccggcgaccggctccaggtcctgcgcgacgtccacctgacgatcatggcgggtgaggcggtcgcgatccgtggccggtccggttccggcaagacgacactgctgcgcgccctcggcctgttcatcccgttcgacaccggggagcaccgggtgctgggcaccgatgtgcgccgggccggtgaccgtcgctgttcccggctgcgggcccggtcgatcggcttcgtgttccaggatttccgcctgctgcccaatctgaccgcgacgcagaacgtcgagtacgccggcatcctggccggtctgcgcggccggcgccgccgggcggcggcgcgcgaggcgctggaccgggtcgggctcggcgcccggctgcagtcccgtcccgcccagctctccggcggcgagcagcagcgggtcgggatcgcccgtgcgctggtcaagcagccggccctggtgctggccgacgagccgaccggcgcgctggacgcggagaccgccgacgcggtgatgaccctgctgctcgacgcggtccgggatctgaacgccgcgctggtggtggtcacccacgatgacgcggtcgccgagcggtgcgaccggcgggtgctgatcgccggcggtgcggtgcacgagcccggtgccgcggacgtggtggaggcgccctga

SEQ ID NO: 2059 - DNA, 948 bp, Actinoplanes utahensis
atgctccggagtcgggtggtggcgcgtgcggccgtgttcgcgggtgccaccgtgctgctcgcggcctgcaccaccaccggcgacgccggccccggtagcggggcgggggcgggtgacctggtggtcgcgtcggccaccgccgcaccggcgacggtccgggtggagaaacgggagatctatcagacggtgcgtctggagggcctggtcgagccgtatgacgcggttccggtcaaggcggcggtggacggccggttcattccggccgccggggtccggaacgggcgtacggtgccgcggggtttccggctcggtgcggtgcgtcaatgtcccgacgagcagaacgccggcaccgtgaatccggcgccgtcggcctccgcgtccgcgggtggcaccgcggccacccactgcgcctatcggtacaccgcggtgcgggccccggccgcgggccagctgtccgacgtcggcgagcagaacgtcgcccccggtgcggtgatcgccaacatccgtccgcccggattccacatccggctgccggtcgaggacaagtcggtgctgttcaatttcgcccacccgccgtcgtcgggcaaggcgcagatcgtcggcggcccgtccgggctgaccgtccggttcgagcggcggaccttcgaccagagcagcggtacggtcaacgtgttcgtctccgcgccgtcgcatgtggacctcttcgccgggctgcacgcggtggtcgtcttcgtcaccaacgcgctgaaggacgtggacacgctgcccctgtcggcggtgcgtgggcgcgccgagcagggcgaggtggtggtgctggaccaggccgggcacacccggacggtcgacgtcgtcatcggtgcggcggacgacgcctatgtgcaggtgagcggtctggatccggacgccgacgtgctcgtctacccgctggattcgaactttgaccgatag

SEQ ID NO: 2060 - DNA, 552 bp, Actinoplanes utahensis
atggcgtcccgttcacggttgctggcttccgtgcttcttctcggcctgctcgccgccggctgctcgtccggctccggtgacaagtccaccgaccagtccgggtcggctccgggccagggtggcaagcccggggtcaacaacccggccgacgcggcgaagaagccggccggcgcggcgaccggcaccaagaaggacgacttcatgcccaccctgcagcaggcgtacgcgaaggtcagctggccgccgaagcggaagatgaccaccgacaagctgtggggtttcatggccgccggcgcggccgacacccagtatcaggcttccgacgccaccaacatggtgaccatctggaacgcctgcgcgtggaccatgcagctggtcgacgacacgaaggccaacaagccggtcagtgccgacgagtccgcgctcagcggcctcgggaacagcgatctgaaggggttgatcgacaagatcgtgtcggacgcgaagctcggcgagatctccaccgcccgccagttcatcgacgcgaacgactgccagaagggcttcgcatag

SEQ ID NO: 2061 - DNA, 399 bp, Actinoplanes utahensis
atgatcaaacgcactgccggactggccgtggtggctgtcgtggccatcgcgaccctgctgggaatcaccgcggctccggctctcgcctcgtcctacaacaccggtgggacgacgaccagcatcacgaacttcacgaccggcagcaccacctacacccaggaccacgccggcgacgacatcgccttcgatgtcacctccggcccggcgatcgacatgcgctgggtcaagtgctcggattcgagcgtgcacggaagcatcaactacaacatcggtaccgacgggtaccgtgtgctcggcaccgacttcaaggccaccacctgcctgcacctgcagttccgtggcttcaccagcacgggcgccttccggggcgtcacctactgggactacaacttcgcctga

SEQ ID NO: 2062 - DNA, 1782 bp, Actinoplanes utahensis
atggtcgacgaatcagcccggaatgcggtggcccagcggtggttgagcgcgatcgccgcggccggtttcgtgcccggccgacgggcgagggtgctccgggagcttcagcggttgctccggcgcctcgagtcgacggtcgccggtgagccgttcgacccggcggccggctggcggatcggcgcccggctggtcgagctgcggatggccggcccgaaggtgatcggcgcgacgatcaggctgctcagaaccgagctgacggagcttctcgccggggacgtcgcggcgctcggcgtacgggtggacctggtcctcgagcaggtgaacaacgggttcgccgcggcgctgcgggacaccgcgatggcgatcgccgaggacatcaaccggtcgatgcgggtgacctgggaggccgaccggtccgtgctgcatcaccggtggcagcacgcccggctgcacgatccggtcaccgggctgccgaaccgggcccacctccgggacgtgctgcggcgcgtcaccgccgacgggtccggccggatcggggtgtgcctgttgcgggtcgacgacttcgccgatctcagcgatgccctcggccatgcccacggcgacgatctgctggcggcgatcagctggcggctccgggatctcgtccgctcgtggtcggccaccgcccgggaccaggccgcccggccggaggcggacgatcgctatctgctggcgcacctcggtggtgaggaattcgcgctgctggtgatcgggacgacgggcgcgcaccagatggtgaaggtcgccaagcttgccgggctggcgctgcgcaccgtggtgctgccgtcggtggacggctatgcgccccggatgacggccagtgccgggatcgtggaggcgccgatcgccgcgcggccggacccggaggagtggctgcgcgacgcgcgccgggcgttggcgtgggcgcggggggatgacgcgggcggggtgatggtcttcgagccgggccgggcgcgacaggattcccggcggaaccggctggccgcggcgatgccggtcgccctggaccgcggtgagttcgagccgcatttccagccgatcctgcggttggccgaccggagcgtcgtcggggtggaggcgctggcccggtggcggcatccccgggagggcctgctgagcccggccgccttcatcacgctggccgagcagaccggcctgatccggcggctgggccagtcgatcctggagcaggcgtgccggcagggcgcggcctggcgcgcggagggccgccacctgacgatcaacgcgaatctggctcccgcgcagctcgccgacccgggcctcgtcgccggggtcgcggatgtgctctatcggacgaggatgccggccgggtgcctgcagctggagatcaccgagagcgcggtcgtcgaccggtgcgggcggcagctcgacgacctggcggccctcggtgtccggctggcgctcgacgattacggcaccggttatgcgagcctgcggtcgctggcgcggctgccggtgacgacggtgaagctggcggccgagctcgtcgccgatctggcggaccccggcgacgcggccgcggcggcgatcgtgaagcacaccgtccggctgtgtcacagcctcggtctcaccgtcatcgccgagggcatcgaggccgagacgcagcacgcccggctccgggacctggggtgcgacctcggccaaggatttctttacgccaagcccgttgatccacgacatgtcgatccgttcagccgccggatggaacctccgtcagagtag

SEQ ID NO: 2063 - DNA, 1026 bp, Actinoplanes utahensis
atgccaggcctccaggtgcggtgttggggccgaccgaggccgaggccggtgggatgccccgcgggtgggcggacacccccgatcgcgcccggtcgatcgagaaaagcgagagtccctcattggggtgacattgatcgatgcgagcccttcccctcaaccccccggagatacataggatgtggaaacgaccgagcggcgggggtggcggtggagccgaacacgtgggtgccggagggcgcggacatcaccgtgccgaacgcgtcccgggtgtacgactacgcgctgggcggcatgcacaacttcgcggtcgatcgggagttctggcatcacgtccaggattcgtttccggaggcgcacctggtggcccaggccaatcgggcctatctcggccgggcggtccggtggctggtcgaggagcgcggggtcacccagttcctggacatcggctccgggattccgacgctgggcaacgtgcacgaggtggcgcaggaggcggacccggacgcccgggtggtgtatgtcgacatcgatccgatcgcggtcgagcagagccgcagcctgctgcgcgacaacccgaacgcccacgcgatccgcggcgacctgtgcgatcccgacacgatcgtctggcacgaccaggtgatctcgttcctcgacttctcccggccgattgcggtcctcatggtggcggtgctgcatttcgtcccggacgaggcggatccgcggtcgctgatctcccggatcggggcggcgctgatgccgggcagtttcctggtcctgtcgcacgccgggccggaggtgaccgaggacggcctgcggcggcaggagatcgcccgcaagctgtacgagaagaccccgaccccactggtgatccgcgaccgtgagcaattgctgggcctgctggacgagtcgttcgaggtgctggagcccggtgtggtcgccgccgaccagtggcggccggacccggagcaggccgcccagatcccgccgcagccgaccgcgctggtcgtggtggcccgccggaggtag

SEQ ID NO: 2064 - DNA, 672 bp, Actinoplanes utahensis
gtgcattctggcgtcgaccccggattcgaccggcagttcttcgcgcagatgctcggcgcgatcaaccgcttcgacgatcgggacttcatcgcctacgggctcgaagccgaccaggtcgcggcgatgcccgaactgttccggacctggcaggccgacactcaagcatcgccgccactgacgaagctcgggtgcctttcgttcaggcggctcgcggctcagaggcgttgtgtccgcggaccggataagttcgaggaacgcgaactcctcgtcgaagggcccgtccaaggtgtgcagtactacatcgaaaagatgagcgatatggatcgtatcttgctgaccgctcccctcatcgaagcgttcaagaatctcaccacactcaagctcgacgagaggatcggaattcttgacgggctcgagggccatccccttgaagtgacccgagtcgtcccgtcggaggtcgccgacgcatatcaggtgcgaggcgagatagctcgggaggccggcaagaccctgtccggtcacgctgatttcgtcgcggtcctgcaaaatgccacctcgaatgtctacattgggtcggttgacagcggtcggttcatcgttttcgccatcttggatgaagagagccgtcgcccattggcgatgatgttgatggaacacgagccgcgtcgatga

SEQ ID NO: 2065 - DNA, 717 bp, Actinoplanes utahensis
atgctggagggccgggcgaacaacgacggcgcctggacgggagcgtcggccgcactcgggcggatcaacgacgtacgcgtcgagatggcgggctgggaaggtgccttccagagcaacttcatcgaccggttcctgacgccgctggaagcagtcgtcccgaatcagcgcgagctgatccgctactcgcgcaacgccatcgagggcgcgaagatcatccacatccgcttccgcaagtcggtgctgaacatgctggacaacgccatcaaagcaacccagcagctgagcaacagcgcctgtaccggcgccgatgcgatgaagtggggcaccatcgcgatgtgtgcgctcagcaccatcggtggcgcgttgaccgctggcgccggcgtgttcgtgaccgccgtggtcatcgatgtcgccggcaccatcggtggtggcctggtgccgaacggcaaggaggcgaccaagctcgacctggccgcggacaccgccaccgaggtcgccgccaacatcatgagcgcgcagagcgcgctggacaacgacacctacacagccgaggaagacgtcgtgcaatcgcttcgggacctctatcgcggtctcgccgccgagcgactgaaggcgctttcttcgaatgtgtccgggccattcggggtggccgtacccgcgctggccgatgccaccccgagccaggtcaccggaggcatgttcaggccgcggcactga

SEQ ID NO: 2066 - DNA, 435 bp, Actinoplanes utahensis
atggctggcgaagtgaccggcggtgacctgttccacctgtggcgcgtgtcggaggtgcacctgccgcggatcgcggacgttttctacgacgcgaaccgcctgctcggcggatcgacgggcggcggtgattcgttccgggtcaatggccctgcgtatcccggctccagcgtcatgatcagcggaatcggcgccgcatgggaggacctgcggtcggagatgcagctgatgatggaacaggtgggcaccactgtgctggatgccgcgcagggtgtacgcaacgcgacgcaggcctacatcgacgtcgacaacgaaaacgcgaacctgttgcgggactacctgaacgaccccgacaacgtcgacagggcggacgcggcctccaaccctcccgtgcccggttcggacgaggaccccggcaagccgtacccggctgcgtga

SEQ ID NO: 2067 - DNA, 1137 bp, Actinoplanes utahensis
atgccgctgtggtacacctccgacgtgacgaggaaatctgtcgccgccctcgcggttctggccatgtcggcggctgcgatgcccgcgccggccttggcgcaacccgacggagccacgccgaccctcgtagcgggcgcgggggcgcccgggttcagcggtgatggggggccggctgccgaggcgaagctgaatcggccgttgggggccgccgtggcggccgacggcagtgtgtacatagccgacaccctcaaccgtcgggttcgggttgtcggcaaggacggcatcatccggacggtcgccggaaacggccggcagaccgtgccagcttcggtgccggctggtacgaagggcacaggtatcgccctcagctcaccgaacgccgtcgcggccggctccgacggcaccgtcttcatcgccgacagcgcggcttcccgggtgtatgccttggcagctgacgggtccatcacggtccgggtcgacgcggacgtgctcggtgggtcgatcgccacgatcaacgcgatcgcagttgcgcccagcggcaccctgtaccttgcggatcgggagaacaatcgcgtcgtcgagatcgcgcccggtgctggcagccggccgctgtcgacgccggtcaacctgccgaccggtctcgccgccgacgcggcgggagacctctggataaccagcgcgagctcggtgctgagtcggctgcacgatgggaagctggcgacgatcatcgacaccgccggcggtggctggcgggctgacgagaaccgggcggcgttgtcgccgttcaacgcgtccacggttagcgccggcacggacggcgtttacctcgtcgacaaccagcagcgaaccgtacgccgcctcggcaccgacgccagcgcggccactgttgccgggcttccggcagaccctttcggtacgcgggatcccatcggactggccgcaggaactgcttcagccggcccgctctatgtcgttgacacggtgggcagccggatcttctcgatgccggtcaccgtgtccgctggtgacagcgctgacggcgatccgaagccggtctggccgtgggcgctcggcggtgccgcggtactcgtgctcggagcagtgtttttcctggtctctcgccgcaggcgagcctga

SEQ ID NO: 2068 - DNA, 582 bp, Actinoplanes utahensis
gtgtggtacggcgacgttgatctgggcgagcagttacgcacgatgacggtgaccgccacctcgccggacggcgccatccgggccacggtcaccggcgagaaccggctggagttgcgcttccaaccgcggacctaccagtggtacgacgaccacggcctggcccgcgaactcaccgcgctcggcaccacgacgtgggtcgcctggacccgccagcgcgcggaggtcacccggctgtcccttggacagagcaggggcgaagctgagcagagtcaacggcgagacggcgacccgcgacacgaccgcttcatcgaagccctgcgccgcctcgaatgcgacggggtctcccgtgaccggtcgatacacttacgactcgccggcgctactcgctggcaggtggagatcgccgacggcaccgctcgcaacacacccgagcggacgttcgtggagcaggcggtgtcggctgttgactcggtgatccaggaccgatcgatgaagatggcacttctccgagccgagcacttcgacatcggcgtcccgagcagctggctcgatcgggtgcgatcacttcgcttccgatactga

SEQ ID NO: 2069 - DNA, 1152 bp, Actinoplanes utahensis
atgactgatttcgacgtctaccggctgccggaggatcacgagaccatccgtgccgccgtgcgcgaggtctgtgacgcccgggtggctccgaacgcggccgaggccgacgagaccgcagagttccccaaggcgtcgtacgacgccctgcgctcgtccgatttccacgccccgcacatcccggtcgaatacggcggcgccggcgcggacgccctggccaccgccatcgtgatcgaggaagtggcccgggcctgcgccgcgtcctcgctgatcccggcggtcaacaagctcggctcgctgccggtcatcctggccgggtcggaggacctcaagcgccgctacctcaccaaggtcgccgccggcgagggcatgttctcctactgcctgtccgagcccgaggccggctccgacgccgcctcgatgaccacccgcgccgtccgcgacggcgaccactgggtgctcaacggcgtcaagcggtggatcaccaacgccggcgtcagcgagttctacacggtcttcgcggtcaccgacccggccgcccggtcccgcggcatctccgcgttcgtggtggagaagtccgaccagggcgtcagcttcggcgccccggagaagaaactcggcatcaagggctcgccgacccgcgaggtctacttcgacaacgtacgcatcccggccgaccggatgatcggcgccgagggcaccggcttcgccaccgcgatgaagaccctggaccacacccgggtcaccatcgcggcccaggccatcgggatcgcgcagggtgcgctcgacttcgccttggcgtacgcgaaggagcgcaagcagttcggcaaggcgatcgccgagttccagggcctgcagttcatgctcgccgacatgggcatgaagctggaggcggcccgccagttgacctacaccgccgccggcaagagcgagcgcggcgatgccgacctgacctacttcggggcggcggccaagtgcttcgcctcggacgtggccatggagatcaccacggacgcggtgcagatcctgggcggttatgggtacacccgcgactacccggtcgagcgcatgatgcgcgacgccaagatcacccaaatctatgagggcaccaaccaggtccagcgcatcgtgatggcgcggcagctcctcaaatag

SEQ ID NO: 2070 - DNA, 240 bp, Actinoplanes utahensis
gtggcgaaggctgaggagcctgactacggcgagcaactgtctcgcatcgacgcctcgatcgcggcgctcaaacagcaggacatggaggccgcctccacgcgcaccaagatcgcgagcaagatccaggccgcccagttccagcgggacatcctggcgcacgcgcagaagcagaagaccgcccggccgcggggccgccgcccggccgaggagttcccgcccccgccgccgctagctagctag

SEQ ID NO: 2071 - DNA, 4563 bp, Actinoplanes utahensis
atggcgccgatggagcacggccccgaggcgtccacccagtcggtgcagaacatcctgctcggcctcggcgcgctgctgatcggcggcgccgcggtggtcttcgccggggtggccttctccaacccggtggcccgcgcggtgatcctggcgctgttcaccgcgatcgcgctgtcggtcgctccgggcgtggcccggcgcacgctgacctcgaccgccgagacgatcgcggcgatcggcctgatcgtgctgccgatgaccctctacgcgctgcacggcagtgcgctgggcggcggacccgccgtggccaccccgctctatctcggcatcaccttcgcgatcaccgcgatcgccggcttcctgtacgcgggcgccaccaaactggccatcccgcgctatgccaccgtgatcgccacccagcccgtcgcaccgctgctcgcgtacccgtggatccacagcccggccggctggggcctggccctgaccgcggtggcggtgctcgacctgctgctgctcacccgggtgctgcggcgcgggcggctggtgccgcgctggccgctgggccgaccgaccgccgccgaccgggccgccgagagcgagccggagtggccggagccgcgcccggagtcacagccggaagagcccgacctgatcatccccggcctcaggccgcgccgcagccgctggatcccgacccggatcttccccgggccgcggccggagggcgccccgccggccgggtccgtcccgctggccccgccggccaccccgccgtccgccgagtggctgcgcgagctcaccttcttcctgctctgcgtggcctgtgcgggggcgctgctctactcctcggtggcgctgctgcaggcgcaggtcgtgccggacgcgctgcgctccggcctgatcctggtcgccgccgcgctcaccgcggtcgccgccgcccagctgctggaccagccgctggcccggcacatcgccggcggcgtgctcaccctcgcggtgatcggcgcggcggcccgggtcgccgcggtggtcgacccacgctggacgctggtcgtcgcggccgccacggtggcgatcaccggcgccctcgtcggcatgctgccggcgcaggtcaggacaggtccgcagtacgcgtcgacggccgccctcgcgctgatcggcgcccgggtggcgatcgacgcgatccgtgccgccatcgccccggtggccgccgcccggccggtctggcacgccgacaccgcggcctacgcccgcaccctcagcgacgccgtcggcagcgccggctggctgctcgtcttcagtgcgctgctggtcaccgtcgcggccgcgctcgccctgcccggcgggatccggcacgagggcgcggtgatcggcgtcgcggtcaccgccctggcgctgcccgcgtccctcgccctgaactggtcggaggcgccctggccgctggtgctggcggcgatcgcgctgggcggggccggcctctggtcgagcacccggcgggtcgcgatcacgcacatcgccgcggccggggtggtggggctgttcggggccggtgccgcgctcgccgccacctggctcaccgcggcggtgctgaccgcgctcgccggcgccggcgtgatggtgaccatcgcggcccggcagatcccggtccggctgttcgcctggatggtcggcgactgggcgtccggcgcggccgcgctggccatcccgggcgccgcggtgaccgcggtgctggcgatcaccgacaccggccaggggccgccgccgaccgccgcggccaccgtcccggcgctggccgccggtttcctcacggtggccggcacgctcacctacgccgcggtgttccaggtggcccgccgcgagatcagtttcccgctgaccgccggcaccgggctgggcgcgctcgccctggccgccgccgccctgttcgcacccggccgggcgccggccgacatcgccgtcggcgcgctgctgatggccgccgcgctgctgctgttcttcgccaagagcatcgacgagcggggccgcaccgaccggatgatggacgggccggactgggccgcggcagccgccacggtggcgatctgcggggccctggcccgggtcgccgcgctcgccttcccggccgccccgctcgccgtcgccggtgtggtgatcctgctggtcgggatgggcgtcaccattttgcaggaggactggaaacgcgggccgtcccgaggtctgggcctggccgcgctggtggtcgccgggctggccgggttccaggcgatgggcggcagcctgcggatcctcaccgctcccggcccgctctgggccgcggacgtcacgcacctcgccgcggccccgccggccggcgcctggcaggccccgttcgcgctggtgatggtcgcgatcacggcggccatcgcgctgccccgaccgtggtcgcaccacgcctccggggtgtgcgccgcgctggccacgatgggtgcgccgtgggcgctcgggctgccctggtggtcgccgctgctgatcggggcggcagtggccaccgcgtacgcgctggccgctctcgccaccgccgaaccggccgcggcccgggcccgcgccgcggtcgccgccatggtgctgctgcacgcctccgtggtcggcctggcccgcccctggtcgaccgggatggcgctgctcaccgtcgtgctgctgggctctctggtggcggtcgccgcccgggtggccgccggcgaggccgacgtgctgcccgcccaccgggcgcaggtcggcggcgccgccaccgggtcggtgctgctcgccctgcccggcacgttcgccgcgttcgccgccgaccagggtggcagtgcgcaggtggtgctgaccgccgcgctggccggctccagcctcggcctggcgctgctcgcgctgctcggccggcgggtcccgcagtacctgccgtgggcgacgatcgggctggtgctgggcgcgatggtgaccgcgctggtctcggtgcccagttcctatccgacagcgttgtacgcggcggccgccgccctgctcggtgtgctcgccgagatgctgcgcggcgcggtgccggctccgctgcggccgagcgtggtcgaggagttcccggccggcgacatccgctatcagcgggcccgccggatgcgcggcggcggcggcctgttccagcgttggctggccgacccggccaccggtgcggtgatgctcgccctgctgcccaccgtgctggcgctgttctcgctggcgccggccctgcgcgccgccctggtcgacccgctcaagcagctcggctcggtctggaaagggccggtcccggccctgatcaccccggccgccggcaccatcgacgcgaccagcgcgctggccgcggtgctgctcaccggcgcggccgcgctggccgcgctgagcttcggcggccggcccgccgagaccgtcccggtgatcctgcccggggtcgccctgaccctgctgatcacgccgatcgcgctgcacgccgggttcccggcggccaccggcgcggccctggtcgtcttcaccatctcgatgctgggcctggcgctcaccctgcccccggtcgccagccgggcgccgctgctgcgcggcacccggaccgtggtgttcgtggtcggcctgctggccggcggcgccggtctcgccggcagcctggcccggtcccccctgaccctgctcaccctcgggtgcgcggtcttcgtcggggtggccgccgcggtcgccggccgcaccccgtcggcccgactgctgggctggctgttcgccgccctgatgggccagatgttcgtgctggccggggcgatcgcgctggggctgagccggcattgggccgcgttcggcgtgctcgcggtcggcgccggcctgctcgccctggagtcgctgctgccccggctcggtctggcgcagtaccgcgccgaggcggtcaccgtcgagtggagcgggtacgcgtcggcggcgatcgccggtgccctggccttcgactcgccggcccacctggcggcgctgctcgccgcctggggcgcggtgctgggcctgaccgcgtcccgaccggaccgcacgcccggccagcgccggacgatgttctggctggcggtcggcttcgagatcgtcggctggtggctgttcatcgcgctggcccaggtggccctgccggaggcgtacacgctgccgttcgcggcgctggccctggccgtcggcatcgtggaggcgcaccaccgtccggagctgtccagctgggcggcgtacggtccggcgttgctggccgccttcgtcccgtcgatcgcgctggtcctggccggtggcagccacaacgacctgcgtgaggtgctgctgctgctcggcggggtggtcacgctgatcatcgggtcgcgcagccggcagcaggcgccggtggtgatcggcacgatcgcgaccgtcgtggcggccttgaagttcgtcttcagcctgggcgggccgtggctgatgctggtcccggtcggggtgatcctgatcttcctgggtgcgacgagcgagagccgccgccgcaccacggaactgcgcaaccgggtgtcccagatgcgctag

SEQ ID NO: 2072 - DNA, 498 bp, Actinoplanes utahensis
atggcacccgtcgtcggcatcatcatgggcagtgactcggactggccgaccatggaggcggcggccgaggcgctcgccgagttcgaggtgccgttcgaggtcggtgtggtctcggcgcaccggaccgtccgcaagatggtcgactatgccgagtcggcggccgggcgggggatcaaggcgatcatcgcgggcgccggcggggcggcgcacctgcccggcatggtggcggcgctgaccccgctgccggtgatcggggtgccggtgccactgaaacacctggacggcatggactcgctcctgtcgatcgtgcagatgccggccggggtgccggtggcgaccgtgtcgatcggcggggcgcgcaacgcggggctgctcgcggtgcggatcctcggatcctcggacgccggattgcgccagaggatgtcggacttccaggccggcctggaaaagctggtgggcgagaaggacgcggccctgcgggagaaactgctcggctag

SEQ ID NO: 2073 - DNA, 1143 bp, Actinoplanes utahensis
atggatacccgaaccggtctgcccgtggtcggcatggtgggtgggggccagctggcccggatgacccaccaggccgcgatttcccttggccagtcactgcgtgtgctcagtgcgcggcccgacgattccgccgcgctggtcgcggccgatgtgccgatcggcacgcacaccgatctcgccgcgctgcgcgagttcgccaaggggtgcgatgccgtcaccttcgatcatgagcatgtgccgaccgagcatgtcgaggcgctcgaggccgagggtgtgaaaatcttccccgggtcgaaagcgctggtgttcgcgcaggacaagggcatgatgcgggagcggctggcggcgctcggggcgccggtgccgcgctggtcgcgggtgagcacggccgacgagatcgaggcgttcgcgggcggtgcctggccggtggtggccaagtcgacccggggcggctacgacgggcgcggcgtctggatggtcggttctcgcgaggccgcggaggacctggtgtccaccgggatcccgctgatcgtcgaggagaaggtgccgctgcggcgagagctggcggcgctcgtggcgcggtcgccgttcgggcaggtcgcggcgtatccggtggtggagaccgtgcagcgggacgggatctgcgtcgaggtggtcgcgccggcacccgggctgagcgaggagcgggcgctggcggcgcagcagctcgccatcgacctggccaccgagctcggcgtcgtcgggctgctggccgtcgagctcttcgagaccggcgacggcatcgtggtcaacgagctggcgatgcgcccgcacaactccgggcactggaccatcgagggcgcccggacctcgcagttcgagcagcacctgcgggccgtgctggactatccgatgggctccaccgcactggccgccccggtcgtcgtgatggcgaacgtgctgggtggcgaggacggcggcatctccatcgacgagcggctgcaccacctgttcgccgaggacccgggggcgcgggtgcacctctacggcaagcaggtccggcccggccggaaaatcgggcatgtcaccgtgctcggcgatgacctggcatcggtgcgcgcgcgggccgcgcgggccgctcagtggctgcaggaaggtaagtga

SEQ ID NO: 2074 - DNA, 1992 bp, Actinoplanes utahensis
atggccaaccgtctcgcgaatgccacctcgccctacctgcagcagcaccgggacaacccggtggactggtgggagtggtccgcggaggccttcgcggaggcgcggcggcgggaggtgccggtgctgatctcggtgggctacgcggcgtgccactggtgtcatgtgatggcgcacgagtcgttcgaggacgacgcggtggcggcgcagctcaacgcggactttgtggcgatcaaggtggatcgcgaggagcggcccgacgtggacgccgtctacatgacggcgacgcaggcgatgaccggccagggcgggtggccgatgacggtcttcgcgacgccggacggtgacccgttctactgcggcacctattttccgaaacagcagttcacccggctgctcacctcggtgaccgcggcctggcgcgacgagcgcgacggggtgctcaagcagggcgccgcggtggtccaggcggtcggcggggcccaggccgtgggcgggccggtcgcggcggtcaccgcggagatgctcgcggcggcggctgccgggctggcacaggagcatgatcagacgtacggcggattcggtggtgctccgaaattccccccgcacatgaacctgctgttcctgctccgtcaccttgagcggaccgggtcggcggaggcgctggaactggtccggcacaccgcggaacggatggcgcgcggtggcatctacgaccagctggccggcggtttcgcgcggtacgcggtcgacgagcactggacggtgccgcacttcgagaagatgttgtacgacaacgccctgctgctgcgggtctacacccagctgtggcgactcaccggggacgtgccggcccgccgggtcgccgacgagaccgccgagttcctgctccgtgacctggcgactccggccggcgggctggcatcggcgctggacgcggacaccgacggggtcgaggggctcacctacgcgtggacaccggccgagctgaccgaggtgctcgggccggacgacggggcctgggccgccgacctgttccgggtcaccccggacggcaccttcgagcacggcaggagcgtgctggtgctcgcgcgggacatcgacgccgccgacccggcgctcgtcgaccggtggcgcgacgtccgcgcccgactgctcgacgcccgcggcaagcggccgcagccggcccgggacgacaaggtggtcgcctcctggaacggtctggcgatcaccgcgctggccgaacacggggcgctgaccggctcgacggcgtcccgcgaggcggccgtcgcgctggccggggtgctggccgaccggcacctgatcgacggacggctgcggcgggtgtcccgggacggcgtcgtcggggacccggccggggtgctggaagactacggctgcgtcgccgaggcgttcctcgccgtgcatcagatcaccgcggatccgcggtggtcccggttggccggccggttgctggacgtcgccctggcccgtttcggtacggggtccggcggcttctacgacacggctgacgacgccgagaaactggtgacccgcccggccgaccccaccgacaacgcgaccccgtccgggctggccgcggtgtgcgcggcgctggtgacgtacgccgcgctgaccggcgagacccggtatcgggacgcggcggacgcggcgctggcgacggccgggccgctgatcggggagcatccacggttcgccggttactccgcgatggtggccgaggcggcgctgaccgggccgtacgagatcgcggtggccaccgacgacctggacgacccgctggtgatcgaggcggtccgggaggcgccggccggttcggtggtcgtcgccgggccgcccgatctggccggggtgccgctgctcgccgaccggccgatgatcgacggcagacccacggcgtacatctgccgcggcttcgtctgcgaccgtccggtcaccacgccgaaagacctcctcgcgcgcctccgctcgtga

SEQ ID NO: 2075 - DNA, 939 bp, Actinoplanes utahensis
atgaggaccggacatgttcccgggcggtttctcgccgcactgaccgcggccaccggtgggctcggagccggactgctggccgtcgggccggcgcaggccgccccgctgcccgacctcaaggtgacggtggccatcacgccgggcaaggcggcgtactcggtcggtgacacgatcacggcggtctacacgatcaggaacgtgagtgccgtcgccgcgaccggcatccggtccggcggcacctacgacggcctgacctggatcggcgacatgccctggagcgcggcgttcgatctggcgcccggcgccagccggaccttcacctgggctgccaaggtcagcgacgccggatcccgcggcgggtacgcggccggccgcttcgagttcgaggccgcggcgggcgacgccgacccggctgacgacctgggcaccttccggctgccggtgccgggcggcaaggggaccatgcggctcaaggtcttcgtggacgccaagggggactccagcagtgagcagccgggcctggccggcgccgaggtggtgctcagccagccgaagccgggcggcgcgcgggtggccggcggccggaccgacgccaagggctgggtgtccttcaccgggctggcgacgcaggattaccgggtcagcgtgcccggacgcaaactggcgggcgacaacccggacagcacctcggtggaggtgatggcggatcagacggccaccgcgttcgtcgggttgctgcccggggccgccgcgtccggcagtcccggcgcgtccagcgatgtcgccgccccggccggcgcgtcgccgtccgggacgcccgcgctcgcggtgaccgggagcaacagcggaacggtcgccgttgtgggcgggatcgtcgtcctcgccggcgccggcctgttcctgatggcgcgtcaccgtcgccggcggttcgtggcctga

SEQ ID NO: 2076 - DNA, 2529 bp, Actinoplanes utahensis
atgaccggtcgctccgcggcgcaccgtcgggcgtggacccggctcgccggccgctcccgcccggtgcgggtcctcaccgtgaccgtcgtggtggcggccctggcggccgtcctgctcggcgcgctgcaaccggcccacctgcgcgccgacagcccgctcacgccgttcgacggcggctgcgtggcggccgtcctggcggccatcgcccagctggccggcctgcgtttccggctcggcccggacgcggtctcggtgagctgggccgaggcggccgtcgtggtcgggctggtggtctgcccggccggctggctcccggccgccaccctggtcggcatcggcgccgcctggctcctgctcgcctggctgaccggcctgcgcaacgtcgccgaggtggtccacctggtcgcctcgatgaccctgggcgtctccgccgccgccctggtcacctcgctgctggccggcgacgccggggtgcgcagcgggcggctggtgccggccctggccgccggcgcggccacctacctgctgatcaccttcggcctggtggtgctcaccctcaccctgcagcgcgacgccgcaccggcgcagctcgccaccagggtgctgtacgccaaggtgccgatgtccaccggcaacgtgatcgtcggcgtgtgcgcggtctacgccctggtccgcgagccgctctggctgctcgccttcggcccggtgctctggttgctgcaccgcacctaccggttccacctgcgtgccgccgaggaacgccggatgtgggaggcgttcgcggcggccaccgcccggctccccggcaccaccgaggccgaggtcgcccgggccgggctgcgcggcgccctcgacgtgttcggcgcccggcgggccgaactggagctgcgctccgagcagggcagccggcggtacgcggaggacggcccgggacagaacccggacgtggcccgctccggcccggcggtcacccggggcatggcggtcgccggccgcccggtcggcgagctcaccgtctggctgggcgagccgaccctgccggccgcccgggacgaggcggcgatcacggcgtacggcgaggctctggccggggcgctgcacgacgcggccgcccatcagcggatcaccgagctggacgcgctggtcgcccacgaccgggtgcacgacccgctgaccgggctgagcaaccggcccgcgctgaccgccgacggcgacaccgtgctgcgctccggcgaacgcggccgcccggtcgccctgctgctgctcgacgtggtcggtttccgtgaggtgaacagcaccctcgggcaccgcggcggcgacgaggtgctccgggtgatcgccgagcggctcaccggccaggcccgggccggcgagctcgtcgcccggatcggtgacgacgagttcgccctgctgatgccggcgctgaccgcgctggccgggccggacggctgggcccgcggcgccccgcacatcctctcccaggcgctgcgccgggcccgcgagctggtcgagcagctgcggctgccgatgcaggtggccggggtgcggctggccgtcgaggtgaccgtcggcgcggtggtcgcccaagccggtcacgtcgaggtgaccgagctgctgcggcgcgcgtcgctggccgccgggcgggccaaggagcaggggctcaccgtcggcacctacgacagcggtcaggacgccagcagcaccgaccaactggccctgctcgccgagctgcaggacgcgttcgccgccgacgaccagatcgtgctgcacctgcagcccgcggtcgatctgatcaccggcgcgccgaccggctgcgaggccctggtccgctggcggcacccgcggcgcgggcagctgtccccggccgagttcctgcccgcggtggaacgcagcgagctgctcatcccgttcacccggcgggttctcgacctggcgctggcggccgcggcggactggacggcggccggcatcgacgtgcccgtctcggtgaacgtctcggcccgcagcctgaccgacccgaccttcccggcgcaggtcaccgaggcgctgcggcggcatcgcacgcccgcctcccggctggtcctggagatcaccgagtcggtcgcggtcagcgaacgcgacatcgtcgacgaggtgctggcccggctgcgcgccaccggcgtgcagatgtcgctggacgacttcggcaccggcttctcctcactcgcctcggtcacccgggtcccggtcgacgaaatcaagatcgaccgctcgttcgtcgacgagatgatcgattccgtcgcggccggcgccgtcgtccgcggtgcggtcgagctcggcgcccggctcggcgtccgggtcgtcgccgagggcatcgagacgatcgaacagcgggccgcgctgatcgccctcggctgcccgtccgcccagggctaccacttctgcaaaccgatgcccgccgacaagatcgtccaagcgctcacccagctgcgccgatcctccaccggcgaggccacgatcaccccactgcgcgccgacggcgcgtcctga

SEQ ID NO: 2077 - DNA, 951 bp, Actinoplanes utahensis
atggcagagtccatcttcgcagccggtcccggcccgccgacggcaggcctggtcgagagggtaatcaacgtggcagagcaactgcgtctcatgactgtgcacgcgcacccggacgacgagtccagcaagggtgccgccacgatggcgaaatatgtcgccgagggcgcccaggtgctcgtcgccacctgtaccgggggagagcgcggcagcgtgctcaacccgaagatggaccggcccgaggtgctggccgacatcaccaacatccgccgccgggagatggaccgggcccgcgagatcctcggcgtggaccaggcctggctcggcttcgtcgactccgggctgcccgagggcgacccgctgcccccgctgccggacggctgcttcggcctgcaggacccgcacgaggcggcgaaaccgctgatcaagctgatccgcgagttccgcccgcacgtgatgaccacctacgacgagaacggcggttatccgcaccccgaccacatcatgtgccacaaggtcgcggtgatcgccttcgaccaggccggcgacccggagctctacccggagctgggcgagccgtggcagccgctgaagctgtactacaactccggctggacccgggcgcggatgctcgcgctgcacgaggggatgctcgccgcggggctggactcgccgtacgccgagtggctggagaaatggtccgaccggcaggaccggggtgacaagatcaccactcgggtcgagtgcggcgagtatttcgcggtccgcgacgacgcgctgcgcgcgcacgccacccaggtcgacccggacggcttctggttccacatcccgctggagatgcagcagaaggtgtggcccaccgaggacttcgagctggcccgctcgctggtcgacagcccggtgccggagtccgacctgttcgccggcatccgggagaaggtcgacgccgcctga

SEQ ID NO: 2078 - DNA, 480 bp, Actinoplanes utahensis
atggactctgccattctggccgatcccccggacaacaaacgcatgagaggccgtcaggtgagcgagacgcgcgccacaaccccggttttcccgcccggccggtacggccgtcgtcgggagcccggccggcgccgcccgctcggactggtggtggccgcggtcgtgtgcggtgtcctggcccttgggctgacctgggcttattatcagaaattcggccgtacggactacagcccggagatcgtcggttggaacgagccgaccgacaccgagatggtgatcaagttccgggtccgggtgccggccggcgagagcgccgcctgcatgctgcgcgcccgtgactaccagggctatgagctgggtacccggacggtcaccgtgcccgcgagaccgggcggcggcgagatcgtggtgaccgggtcggtgccgacgaccgcgcgcggctcggtcggtgacgtgatgagttgccgccccgccggctga

SEQ ID NO: 2079 - DNA, 495 bp, Actinoplanes utahensis
gtgtccagttccgaggcgccgaagacctggctctcccaggacgcatacgaccggctgcaggccgagctcgacgagttgatcgctggccgcccggcgatagcggcggagatcaacgctcggcgtgaggaaggcgacctccgggagaacggtggctaccacgcggcccgcgaggagcagagccgccaggagggccggatcctgtacttgaaggagttcctgcgcaactccgaggtcggcgaggtgcaggccgccgacagcgtggtgcccggctcggtcgtgacgatctacttcgacgacgaccaggccgacaccgagacgttcctgctcggctcgcgcgagatctcctcgaccaccgacctcaccgtgtactccccggagtcggcgctcggcaaggcgatcctcggcgcccgccccggccagaccgtgacctacaccgcgcccagcggtgccgacatcaaggtcaccgtggtcaagttcggcgccttcgagggctga

SEQ ID NO: 2080 - DNA, 1335 bp, Actinoplanes utahensis
gtgtcagtggtgtcgatcggggcgggctgcccgaagtgcgggacggaaacgatcagccggcggtcggccgagccgtggtgcccggcttgtgaatggaacctggactgcttcgatcccgggcagcgctcgccggagatgggctggcggtggctggaccggcggttgttccgggccgcgtaccgactgaccgagagccagtacgccgagctgcgggaggcgccggccctcgcccgggcggcgacgtcggcccggatcgccaccatcgctctcgcggtgcccctgctcgccgtcgtcgcggccctgctggtgatcggtgtcgggttgctcgtccacgacttcttcgagccgctcaacctgatcggcgcgctgctgatcctgatcgccgtggtgctgcggccccggctgggccggctgtccgggctgatccgagacggctggcagctcgaccgtgacaccgcgcccacgctgttcgcggtgatcgagcgggtggccgcggcggccggcacgccgatgccccacgtggtggtgttcactcccgagttcaacgcgtccaccaccacggtggggctgcgtcgccggcgggtgctgcgcctgggcgccccgctgtgggccgtgctcgatccccaggagcgggtcgcgctgctcggtcacgagctcggccacttcgtgaacggggacgtccgccgaggcctgctcacccaggctgtggagagcacgctgggtcaggtggcctacctgctgcggccggacctgcagcggacccggctgcgcccggacgcgcggcgcggcatggtgcgaccggcccgcggcagcgccgggacctccaacctgatcggcatgatcgcggagtcggtggtcgacgtggtggccggcatcctcgccgagctgatcgggctgctgcacctgctgctggtctcgatcagccgccgggactcacagcgggctgagtacctggcggacgagctggcggcgaaggtggccggcagcgcggcggtgatccggatgatcgacgtgttcctgctggccgacggcatcgacaccgtcacccggcgggaggcccgggccggtaacggcgcggcggcctggcgggcggcggccgatcaggcacgggtcaaccaggccaccggactggcggcgtaccggcagctgagcaggcgggccggggtgtcggtgttcgccacccacccgccggacgggctgcgggccgggctgctcgcggcgcgcccggcgcaaccggccgcggtcgtgatgaccgagccggagcaggcgcggatggacgacgaactcgcggcgagttacgaatcggtgcgccgcgagctcgtcgccacctggtga

SEQ ID NO: 2081 - DNA, 1236 bp, Actinoplanes utahensis
atgaccgacctgctctccctggccgacgtcgaagcggcccgggacctgctcgccggcgtcgtgaaaaccacgccgctggtgacctcccggccgctcaccgagatcaccggggtgccggtctggctcaagtgtgagaatcaacagcgggccggctcctacaaggtccgtggcgcgtacacccggatctcccggctctccgaggcggaccgggcccgcggcgtggtcgcggccagcgccggcaaccacgcccagggggtggcgctcgccgccgggctgctcggcatcaaggccaccgtcttcatgccggagggcgcgccgctgcccaaggtcagcgccaccaaggggtacggcgccgccgtggagtacgccgggaccagcgtcgacgacgcgctcgccgcggccggcgacttcgcccggcggaccggggcggtgctgatccacccgttcgaccaccccgacgtgatcgccgggcagggcacgctggcgctggagatcctggaacagtgcccggaggcgagcacgatcatcaccgcggtcggcggcggtgggctgatctccggtctcgcggtcgccgccaaggcgctgcgccccgacctgcgggtgatcggcgtgcaggcgagcggggcggccgcgttcccgccctcgctggcggccggcgcgccgcggaaactggagtcgtgcgccaccatcgccgacggcatcgccgtgctccgccccggcgacctgaccttcgcgcacgtggcgaaactggtcgacgaggtggtcacggtcaccgacgaggacctgtcggcggccctgctggtgctgctggagcggcacaagatggtggtggagccggccggtgcggccgccgtcgccgccctgctcaccggggcgtacaccccaccgcgcggcggcggcccggtggtggccatcctgtccggcggcaacatcgacccgatgctgctgctcaaggtgatcgagcacgggctcgcctcggccgggcgttacctgcggctcgcggtccgctgcaccgaccggcccgggcagctggcccggatgctgcgggagatcgccgagcagcgcgccaacatcgtcgacgtggtgcactcccggcagagcccgcggctgagcttcggcgaggtggaggtggcactgtcggtggagacccgcggcccggcccactcggcggcgctgatcagcgccctgcgcgacgccggatatcgggtggcgctgctggccgacgccaccccctga

SEQ ID NO: 2082 - DNA, 1362 bp, Actinoplanes utahensis
atggacacgacgacctgggtgggcgccaccgccaagcagatcgcccgggcggtgcggcgcggggacaccaacgccacccaggtcgtggccgaccatctggaacagatcgccatctccgacccggcactcggcgcgttccgggtggtccgcggcggtgaggcgatcaccgaggcggagaaggtcgacgaccaggaggacctggcgaaccttccgctggccggggtgccggtcgcggtcaaggagaacaccgcggtggccggcctgccgacctggcacggctcggccgcggcccgcaccggcgaggtggccgaggtggaccacgaggtggtccgccggctgcgcggggcgggcgcggtggtcgtcggggtcaccaagatgccggagatgggcctctgggcggtcaccgacgacgcggaggggcccacccgcaacccgtgggatctggatcgtacgccgggcgggtcgtccgggggctcggccgccgcggtggcggccgggctggtcccgatcgcccagggcaacgacgggctcggctcgatccggatcccggcggcctgctgcggcctggtcgggctcaagccgggccgcggcgtggtgccggtcgacttcggggccaacgactggttcggcctggtggagaacggggtgctgaccaccacggtggccgacgcggcgctcggcttcagcgtgctggccggtcaggcccccgcgaaactggtcgagccggcccggctgcggatcggggtgtcgctgcgctccccggtggccggggtcaaacccgacgagccgaacgtgtcggccgtgaccaaggcgtccaagctgctggtcgacgccgggcacgacacggtgcacgccgatccgcgataccccaccggggtggcgctgggggtactggccacgtggttcgccggcgcgtacaagaactccgaaggtcttgatctgaagtccctgcaaccccgcacgcagcggcacatccggctgggccgtgcggtgaccagggccgggctggtgcgggcgagccagcgggcggcctggcgcgagcggtcgatccggttcttcgccgaccgcaacgtggatctgctgctcaccccggcgctggccgccacgccgccgcgggcgctctccttctcgtcgctgtcctgggtgcagaacatgcaggccaacgcccggtacgcgccgtatcaggcaccgtggaacttcgccgggttgccggccatcgtggtgccggtcggcttccgcccggatgacgggctgccgctggccgtccagctggtcggcccgcccgactcggagttgctgctgctctcggtggccggccagttcgagctgcagaacccctggcagcgtcacgccctggtgtga

SEQ ID NO: 2083 - DNA, 1290 bp, Actinoplanes utahensis
gtgccccttgaacaccggcctggtgtcgagaaacgccaccccggccgcctcgtcggcgaccttgaatgccgggacatcgcccgccacgatcccacagaacacgcagtcggccacggactgagactagccttgcgttacatgactaccgatcactatgggttcgacaccctcgccatccacgcggggcaggacccggatccccgcaccggcgcggtggttccgccgatctaccagaccagcacgtacgcgcaggacgcggtcggcgcgccgcgcctcggctacgagtacagccgttccggcaacccgacccgggacgccctccaggagtgcctggccgcgatcgagggcggccggcgcggcctggccttcgccagcgggctcgccgcggaggacaccctgctgcgcgcggtctgccggcccggtgaccacgtcgtcatcccgaacgacgcgtacggcggcacgtaccgcctgttctccaaggtcgccgagcgctggggcctggactggactgccgtcccgctggacgacttcgacgcggtgcgggccgccttccgtcccgggcacacccggctgatctgggccgagacgccgaccaacccgctgctcaacatcgccgacgtgaccaccctggcgacgctggcccacgagtacgacgcgatgctcgccgtggacaacaccttcgcctcgccgtacctgcagcagccgctcgcgctcggcgccgacgtggtgatccactcgaccacgaagtacctgggcgggcactccgacgtggtcggcggcgcgctggtggtggccgacccggggctcggcgacgagctggccttccaccagaacgcgatgggcgcggtgaacggcccgttcgacgcctggctgacgctgcgggggatcaagaccctgggtgtacgcatggaccggcactgtgacaacgccgagcggatcgtcgggttcctcagcgagcacgagaaggtggcgagcgtgctctacccggggctggagagccaccccggccacgagaccgcggccaagcagatgagccggttcggcggcatggtgtcgttccgcgcggccggcggcccggagcaggcggtggagatctgcaaccggacgaagctgttcgtgctcgccgagtcgctcggcggagtcgagtcgctgatcgagcaccctgggcagatgacacatctgtcggctgcgggctcagcgcttgaagttcccgccgatctcgtgcgactgtctgtcggcatcgaaaccgttgacgatctgctcgccgacctcgagcaggcgctcggctaa

SEQ ID NO: 2084 - DNA, 663 bp, Actinoplanes utahensis
gtgttcctgcggcacaagaagctggacctgcccaccgccgagaccgccctgccgggccggctgatctcgatgccggtcgccgacaggcacgaggttctcggcaccccgctggagggcccgtggccggccggctacgaggtcgccgtcttcggactgggctgtttctggggcgccgagcggatcttctggcggctgccgggcgtccactccacctcggccgggtacgccggcggtttcaccgcgaacccgacctacgaggaggtgtgctccggcaccaccggccacgccgaggtcgtgcaggtggtctacgaccccagcaagatcagttacgcggagttgctgaagaccttctgggagaaccacgacccgacccagggcatgcgccagggcaacgacgtcggcacccagtaccggtcgacgatctacaccaccacggacgcccaggcggaggccgcgcgcgcctcgctggccgccttccagccggtggtcaccaaggccggcctcggcgagatcaccaccgagatcaagccgctcggcgactactactacgccgaggactaccaccagcagtacctggccccgaccaagaaccccaacggatattgcaaccacggccccaacggcctgtcctgcccgatcggggtcgccaagaccgaaggctag

SEQ ID NO: 2085 - DNA, 375 bp, Actinoplanes utahensis
atgtcaccgagttcggcgaacgaggcacgttattccggatatcgcgatgccggcgagcgcttccggaaccccgacgagcacgacgcctgggcgcaggccgaggtcatgatggaacaggcccgggccatgatgcgcgaggccgaggacgcgctggagacctggaagaccggcaaggagatgaaccggctgcgctgcgagcggcgggggatcagccagaccgacgcggagatccggtggtcggcgacgacgaccgcgaagaacgcgatcacgaacaacaacttctacgtttcgctggcgtcgatgtattacggggcggcgtccgcgaattactcacgggcgctctatctccgcagccacggcagcgcccggttctga

SEQ ID NO: 2086 - DNA, 198 bp, Actinoplanes utahensis
atgggggtacgccgtgagccgctcgccgcgctcagccgtttcccggccggcgccgagccgctcgccgcgctcagccgtttcccggccggcgccgagccgctcgccatgctcagccgtttcccggtctgcaccggatcgtgggccgcccgccgcgcccgggcggttcagaaccgggcgctgccgtggctgcggagatag

SEQ ID NO: 2087 - DNA, 1572 bp, Actinoplanes utahensis
atgagccgcagacccgcgagcgacaccgggcgacgttccgacttctccatgaacaaactcctcacgaccgggtaccgaccaccaccgtgccaccggaacctgagggatcgctgtgtcaaaaccgtgcggacgggcaccattgatcgggtggagaccgcgaccgagaccgagcgcaaatatgacgttcccgagaccttcgagcttccggacctgaccggcgccgcgggcatcgcccgggtcggcggcgccgagacgcatgatctcgacgccacgtatttcgacaccgaggacctccggttgatgaaaaatcgtcggacgcttcggcggcggtccggcgggcacgacgccggctggcatctgaagacgcccggcgacggcgacggccgtcgagagcaccggatgccgggcgacggcgatcaggtgccggacgagttgcgcgccctggtccggacactggtgcggcgacgtgcgctggaaccggtggcgcggctgcgcacgcatcgggtggagacgccgttgcgcgatgcggaagggcgcacgctggcgctgatcgcccaggatcgggtgcgggccgattccggcgacgagcacagcgcctggcaggaggtcgaggtcgaactcgtcgacggcgacgagcgcattctcgacgtggtcgagaaggccctgctcaaggcgggcgccacgcatgccgcgggaccgtccaaggtgacccgtgccctgtccgggcggctttccggaaagccacgtcccggcaagatcaaccccatttcccggtacgtcgccgagcagcgcgacgccattctggaacacgacccggcggcccggcggggtgaccaggacgccgtgcacaggatgcgggtggccacccggcggctgcgcagcaccctgaaaagcttccgccgctggttcccggatcgggagaccgccgggctcagcgacgagcttcgctggctcgccgcggcgctcggcgcggtccgcgacccgcaggtgctggagggcaggctgctcgccggtctcgacgacgacgccgcgttcatcccggccgcgcagcggatccgcaccgccctggacgagcgggtcgccaccggccgcgagcagctggccgcggccctcgactcggatcgctacctggacctgctggaccggatcgacgcgctggccgaccacccgccggcgcgcgccggcaacccggcgaaacaggtccgcaaggtgctcggccgggccgacgatcgactggacacggcgctcgccgacggcgtcgacgaggagttgcacgaggcccgcaagaaatacaagcaggcgcggtacgcggtggagctgatcgccgcggattccggcagaccggccaagcggctcgtcaagacgctcaccgccctgcaggacgggctcggcgcgcatcaggactcctcgatcgctcgggaaacactgcgtgaaatcgggccggacagtttccatttcggcgttctctacggtcgacaggaagcagtgggtaaggagacgctcatcgccgtccccgcactggtgcgggcgtcacggcgcaagaaggtccgtcgctggctggtgaaggcgtga

SEQ ID NO: 2088 - DNA, 954 bp, Actinoplanes utahensis
atgagcactgaggtggattcgcagttcgacgaggcggtgacgcacccctatcagggtccgatcgccgagctcaacggttaccgggtggtggacgacgaggatgacgacccgcggctgctgaacgcggacggcagcccggtcgacacctggtgcgaggactatccgtacgacgagcggctcgcccgggccgaatacgaccaccacaaacggctgctgcagatcgagctgttgaaactgcagaattggtgcaaggacaccggggaacggctggtgatcctgttcgaggggcgggacgcggccggcaagggcggcaccatcaaacggttcatggagcacctcaatccgcggggtgcgtcggtggtcgcgctggagaaaccgaaccagcgggagagcacccagtggtattaccagcggtacatcaaacacctgccgtcggccggtgagatcgtgctgttcgaccggtcctggtacaaccgggccggcgtcgagcgggtgatgggtttctgcacccgccaggagtacctggaattcctccggcagaccccggaactggagcggatgctcgtcaactccgggatcaacctggtcaaattctggttctcggtgacccagaaggagcagcacacccgcttcgcgatccggcaggtcgacccggtccggcagtggaagctctccccgatggacctcgaatcgctcgacaagtgggacgactacaccgaggcgaaggaggcgatgttcttctacaccgacaccgccgacgcgccgtggaccgtggtgaagagcaacgacaagaagcgcgcccggctggaggcgatgcggcacgtgctgcaccgcttcgactacgccggcaaggacctcgacgtggtggcccggcccgacccgctgatcgtcggcccggcgtcgctggtggtggagagcgccgagtccggcccccgggtattcccgcgactctag

SEQ ID NO: 2089 - DNA, 936 bp, Actinoplanes utahensis
atgcgtgagctcgtcgtgctgggaacagccagccaggtgccgacccggcatcgcaaccacaacggttacctgctccgcttcgacgacgaggtgatcctcttcgacccgggcgagggcacccagcgacaactcctgctggccgggctcgcggtcaccccgctgcgccggatctgcgtcacgcacttccacggcgatcacagcctcgggctgcccggcatcctgcagcgcatctcgctggaccgggtgccacacccggtggcggtccactatccggccggtggccaggagttctacgaccggctgcggcacgccacgagctactgggacaacgccgagatcgtcgcttcgccggtcggcgccgggttcgcggtggagacgtccgcggggcgcctcacggcgctgccactccggcattcggtggagtcgtacggctaccgcctgaccgagtccgacagtcgccggatggtgcccgccctgctcgccgcgcacggcgtgaccgggccggccgtcggcgagctgcagcgggccggtcgcctcggtgacgtgacactcgaccaggtcagcgtggtgcgaccggggcagagcatggcgttcgtgatggacaccggcctgtgcgacagcgtgtacgagctggcccgcggggtggacctgctggtgatcgagtcgacgttcctggcggaggatgccgcgatggcggcccaggtcgggcatctgaccgcggggcaggccggggcggtggcccgggagtgcggggtgcggcacctggtgctgacccacttctcgcagcggtatccggatccgtcgcggttcctcgacgaggcccgggacgagttcgccgggccgatcacgatcgccgaggacctgatgcgggtcccgttcccggcgcgccgggacgcgccggtcgccgacaccgggttgtcacccggcggtcgctaa

SEQ ID NO: 2090 - DNA, 504 bp, Actinoplanes utahensis
atgaagcttcagctgcgggccgcgggggccgacgatcagttccgggtcggggcgctgcaccagcggtcccgggtggcggcgtatgcggggttcatcccggtggaggtgctcacggcgcggtccgccgagtcgttcggcgagtggtgggccgagcgctggaaatgggagcaggacacgcaccggatgacactggccgaggtggacggcgagctggccggattcagctacatcgggcccagcgagactccgcgggcggctgaactctatgcgatccacgtcgatccggcccgggtcgggaccggggtcggccgggagctgatggtccgcgcgctggccgacctgccggcgatcggcgaggctcgggcggtcctgtgggtgctgaccgagaatcatccggcccgtcggttctacgagcgcggcggctggacgaccgacggagcgacccgcaccgagccggtcaacgatgtcccggtcccgcaggtgcgatacgaacacccgctctga

SEQ ID NO: 2091 - DNA, 297 bp, Actinoplanes utahensis
atggtcgacgtcgacgaggcggcgccagccgacatcgtggaccgcctgctgtggcgggacgcgcagcagatgctcggccggcatatggccgccgggcgggacggcaactgcgtctggtgtggatggcactggccgtgctcggcccgccgcctggcagaacgcgccgacgcggtgtcccgccgaccctggcgcgaggcctggaccctgcgacacgacttgaacagcctgcccgccgcgatgaccgacaggggtcgcgcggaccgcggcaaccacaaccatcggaggtacgccgactga

SEQ ID NO: 2092 - DNA, 930 bp, Actinoplanes utahensis
atggacaccgaagaatccgaggcgctcgatgcctacagccgcatcgtcaccggtgtggccagccgtctcctgccctcggtggcggcactcacgatccgttctccgcgtggcggcgccggatccgcggtgaccttcaccgacgacgggttcctgctcaccaacgcgcacgtggtggccggccccaccaccggctcggccgcgttcgccgagggggtggagacgccgttcgacgtggtcggcgccgacccgctgtccgacctggcggtggtccgggtgcatcaccccggcgcgccggccgcaccgctgggcgacgccgacaccctgcggatcggtcagctcgtggtcgcggtcggcaatccgatgggcctggccgggtcggtgaccgccggcgtggtctccgggctgggccggtccctgccggcccgggacggccaccggatgcgggtcatcgacaacgtcatccagaccgacgcggcgctgaatccgggcaactccggcggcgcgctggccgactccgccagccgggtggtcggcgtcaacaccgcggtcgccggatacgggctgggcctggccgtgccgatcaacgacaccacccggtcgatcatcggcgagctggtcgccaccggccgggtccggcgggcctggctcggcgtggccgggctgcccgcgccgctgccgccacacctggccgggcggctggggcagaaacaggggctgcgcgtcgtcgaagtggtgccgggcagtccggccggggtcgccggcgtctacctgggcgacatcctggtgagcgcgggcgggcatccggtcgactcggtccaggccctgcagcgcctgatgctgggcccggccatcggcgtcgacctgccgatcaccctgcttcgccgcaacgccctggtcgacgtcgtcgccgcaccggccgaactgcgctga

SEQ ID NO: 2093 - DNA, 1362 bp, Actinoplanes utahensis
gtgcgctattacgacaacgtggtcgagatcatcggcaacaccccgctggtccgactcaacagcgtgaccgacggcatcagtgccaccgtgctggccaaggtcgagtacatgaatccgggcggttcggtcaaggaccggatcgccctgcggatggtgcaggacgccgaggaggcgggcctgctcaagccgggcggcaccatcgtcgagccgaccagtggcaacaccggggtcggcctggccctggtggcgcagcaacggggctacaagtgcgtcttcgtctgccccgacaaggtcagcgaggacaagcagaacgtgctccgggcgtacggcgccgaggtcgtcgtctgccccaccgcggtcgccccggaggacccgcgctcctactacaacgtctcggacaagctgacccgggacattcccggggcctggaaacccgaccagtacagcaaccccgccaacccgcgctcgcactatgagcagaccggccccgagctctggaaacagaccgagggcaagatcacccacttcgtggcgggggtcggcaccggcggcaccatcaccggcgtcggccgctatctcaaagagcagaatccgggcgtacgggtgatcggggccgacccggaaggctccgtgtactcgggtggtaccggccggccgtacctggtcgagggcgtcggcgaggacttctggcccaccgcgtacgaccgggagatcaccgacgaggtgatcgaggtgagcgactcggactcgttcgagatgacccgccgcctggcccgcgaggagggtctgctggtcggcggctcgtgcgggatggccgtggtcgcggcgctcgacgtggcccgcaaagccggcccggacgacgtcatcgtggtcctgctgccggacggcggccggggctacctttccaagatcttcaacgatcgttggatggcccgctacggtttcctgcgcacccccggcgacgcacccaccgtggccgacgcgctcgccgccaagggcgccgagatcccgccgctggtccacgtccaccccaccgagacggtccgcgacgcgatcgactacatgcgggagtacgcggtcagccagctccccgtcctgaaagccgaacccccggtcgtgaccggcgaggtggccggttcgatctcggagaaggccctgctcgacgccctcttcaccggccaggcccacctgcacgacacgatcgaacgccacatgggcgaccccctgccgatgatcggcggcggcgagtccgtcagcgacgcggtcgccctgctggagaagtccgacgccgccatggtcctggtcgacggcaaacccgccggcgtcctcacccgacaggacctgctcgcccacctgagctga

SEQ ID NO: 2094 - DNA, 390 bp, Actinoplanes utahensis
atggcgtacccaagtcatgctggagttgcggaaaggggaacagagatggcgaaaactctgaaacgtgcggcggcgttcagcgcactgggccgggcgctgatgtccggcgcccgcggtggcccgtcgctgagcaaacggatctcggcgctgcctcgcatggtcaaagcgaccaccaggggggagtacgacggcggcatgcggctcgccctgatggcggcggccaccgcgtacgtcgtctcgccgatcgacgccgtgccggaggccttcctgtgggtcttcgggctgatcgacgacgcggtgatggtgacctggctggccggcaccgtgctcagcgagaccgagcggttcctggagtgggagaggctggcgaagcccgtcgtcgtacgctga

SEQ ID NO: 2095 - DNA, 1116 bp, Actinoplanes utahensis
atggccgcaccgggaggcgactccgggccggttggttcccttcggacgacagcgagggacactgtgaacagcactgttatccacttccgcggcctgaccgccgaggaccggcagcggatccgtacggccggccggatcgccggccaggtcaccggagcactggccggcgtcaccgcgatctcggccggcctactgctgcggcaggccgccgacgcccggcggatcatcccgctggccgaggcaccgccgccccgcggcgacgggatctacggagcgaagttccacggcaggccgatcagtctggccgtcctcggggattcgtcggccgccggttacggcgtgcaccggccccgggagacgcccggcgcgctgttcgccaccgggatctcccgccgcctgcagcggcccgtccagctgcaccggttcgccgtcgtcggatgcgtctcgtcgggcctgccgtggcaggtcgacgcggccctggagcaccaccccgacctggcgatcatcctgatcggcgggaacgacgtcacgcacgtctcggcccgggccgaggcggtccggcacctgggcgacgcggtccgccggctgcgcgaggcgggctgcaaggtggtggtcggcacctgtccggacatcggcgcgatccagccgatcaagccgccgctgcgctggctggcccggcgatggagccggcaactggcggccgcgcagaccgtcgcggtggtcggcgccggtggccgcaccgtctcgctggggaatctgatcggcccgatgttcgaggcggatccggcccggatgttcggttcggaccgtttccacccgtccgcggaggggtacgcgagagcggccgcggtgatgatgccgacggtgatggccgcgctgggcgaggacgaccggcccgcggtgccgctggccgagtcggtgcggacgttgccggaggcggccgtggaggcggttcgggcgccggggaccgaggtcagtccggtgcggtccggcaagcggtgggcgcagttgcggcggcatccctggttcggggagcagcgccactggttcgggtcgttgagcgcccggtcggtgccgcagccgcaggctccgggtccgatccgggcagcgagttag

SEQ ID NO: 2096 - DNA, 789 bp, Actinoplanes utahensis
atggctgggctgccggaacgattgaccagggccgcggccacgagcctgctcgccggcgcgctgggcggggccgccctgctcgccggtgagatgctggccgccaaggcgcgccgctacgccaagcccaccatgggtctggcgctgcgcacctcgatgggcccggtgaccgccccgccgctgcggctggtgctgctcggcgattcggccgcggtgggggtcggcgtggagtggctgtccgacacggtcggcggccaactggcccggctggtcgccgacggcaccccggagaccggcccgcggcacgtgctgctgtccagcgtcggtgtggccggttcccgctcggcggacctgtccacccaggtggcccgggccctgctgggggtgaaaccggacgtggcggtggtgctgatcgggtcgaacgacgcgacgtcgggccgggcgccggaggaggcggccggccatctgggtcaggcggtccgccggctgcgcgccgccggcgtgcaggtcgtcgtcggcacctgccccgatctgggcgcgctgcggtcgatggcgcccccgctgcggcagatcgccggcgtgttcggccggcggatggcgaaagcgcaggccaaggcggtcgccgatgccggtggcgtggtggtcgacctggccggggagaccggcgcggtgttccgggccgatgccgggacgctgtgttacgacggcttccacccgtccgcggacggctatcgggtgtgggctcacgccctctatccggcggtggcgaaagccgccctgagcggcgtgtga

SEQ ID NO: 2097 - DNA, 1245 bp, Actinoplanes utahensis
atgccggaagctgtcatcgtcgccactgcccgctccccgatcggccgcgcccacaagggctcgctgaaggagcttcgccccgacgacctcaccgccaccatcgtcgacgccgcgctcaacaaggtgccccaactcgatcgcgccctgatcgaggatctctacctgggctgtggcctgccgggtggcgagcagggcttcaacatggcccgggtggtcgccaccaagctgggcctggacggtctgccgggcgccaccatcacgcggtactgttcctcctcgctgcagaccacccggatggcgttccacgcgatcaaggccggcgagggcgacatcttcgtctcggccggtgtggagaccgtgtcccggttcgcccggggcagctccgacggcctgccctcggccgcgcaggcgctggtcggcggcggctgggagaacccggcgttcgccgacgcgcaggcccgcaccaaggccaccgcggagagcggcggcacctggcacgacccgcgtgaggacggcctgctgcccgacatctacatcgggatgggctacaccgcggaaaacctggcccagatcaagaacgtctcccgcgaggagatggacgagttcggtgtgcgctcgcagaacctggccgagaaggcgatcgccgacggtttctgggagcgggagatcaccccgatcaccctgccggacggcaccgtcgtgtcgaaggacgacggcccgcgcgccggcgtcaccctggaggcggtcagcggtctgaagccggtgttccgcccggacggccgggtcaccgccggcaactgctgcccgctgaacgacggcgccgccgcggtcgtcatcatgagcgacacgaaggcccgtgagctgggcatcaccccgctcgcccggatcatctcgaccggcgtcaccgccctctccccggagatcatgggcctgggccccgtcgaggcgtcgaagcaggccctccggcgcgccggcatgaccatcgacgacgtcgacctggtcgagatcaacgaggcgttcgccgcccaggtcatcccgtcctacaaggacctgaacatcccgctggacaagctgaacgtcaacggcggcgcgatcgcggtcggccacccgttcggcatgaccggcgcccgcatcaccggcaccctgatcaactcgctgaactggcacgacaagtcgatcggcctggaaaccatgtgcgtcggcggcggccagggcatggccctgctcatcgaacgcctgagctga

SEQ ID NO: 2098 - DNA, 330 bp, Actinoplanes utahensis
atgtccgacttcgccacgtcgatcgagcgtctgctcacccaggtccggcactgggaggagtcccgctggtccgcgcgcgccggcgcggagagcgcggcggggggcgactcggcgagcaaggccgatcaggcattcgcgctggtgcagcgtctcgccgatctggacgcggaggcggcgggccgggcgccgcgcgaggtgccacgactgcacgatctggtgctgccggatcagctgcgggtggtttccgacgatctgctggccgcctcccccggcccggaactgctgacgattgccaccgcggccgtcgacgaattccgtcgtatcgtctga

SEQ ID NO: 2099 - DNA, 855 bp, Actinoplanes utahensis
gtgaagacttccaacccggtgctctcgcgcctcggccaggcggccgagcgggagcggacggccgggtacgggccggccgggcacgcgggttacggtcaacccggctacggctacggtcagccgggttacggctacggtcagcagccctatccgaccgccgagggctacgccgccccgcccgccgtccagccgatgaccatcgacgacgtggtcgtcaagacggtcaccctgctgggcatcaccggtatctcggcggtcgtggcgtggagcgtcgtcccgatctcgatgaccatggtcgcctggatcggcgccgccatggtcggcttcgtgctcggcatggtcctcagcttcatgcggatggcgaacccggcgctggtcgtggcctacgcggtggtcgagggcgtcttcgtcggcatgatcagcaaggcctaccagagcttcctcggctatgacggcatcgtgctgcaggcggtggtcgccaccttcggcgtcttcttcctgatggcgatgctctatcgcgcccgcgtcatcagggccacccccaagttccagcggatcatgtatgcggtgctcggcggcctcttcatggtcatgctgatcaacctggtgctgtacctgttcggcgtcaacacgggcctgcgcgacaacggcccgctcggctacctcttcagcctggtctgcatcgtcgtcgcctcgctgagcttcatcctgaacttcaacgagatcgaggagggcgtccgccagggtctgcccaagcgctactcgtggaccgcggcgttcggcatcctggtcggcctggtctggctctacgtcgagatcctgcgcctgctgagctatctgcagggcgacgactga

SEQ ID NO: 2100 - DNA, 1446 bp, Actinoplanes utahensis
atgtgtccttcgacacttgactttcaaggttgcgatggtcacagaacgacgcatgaacggccggtcgcgcgcgagaataggggcgtgaatccgccgcgcatagtcgtcgtaggtgcaggtcatgtcgggctgtacacggccctacgcctgtccaagaagctgaaccggaaccacgccgaggtcgttgtcatcgaccccgtgccgcacatgacctatcagccgttcctgcccgaggcagcggccggtagcatctcgccgcgccacgccgttgtgccgctgcgccgtgagctgaagaagtgccgcatcgtctccggtgaggtcaccaaggtcgagcacgctcgcaagacggtgatcattcagccgatcgacggcccctcctacgagatggcgtacgaccacatcatcgtggcgcccggctcggtctcgcggactctcccgatccccggtctcagcgagatcggtatcggtctcaagaccatcggcgaggccatctacctgcgcaaccacatcctcgaccggctcgacgtcgccgccgtgacgccggacccggaggtgcgcaaggcctcgctcaacttcgtcttcgtcggtggcggcttcgccggcatcgaggcgctcgccgagatgcaggacctggtcgccgacggtttgaagtactacccggagctggacccgaaggaggtccacttcatcctggtcgaggcgaccaaccggattctgcccgaggtcggccccgagatgggggcgtacgccgctcgccagctcgccgcccgcggcgtcgacctgcgcctcgaggtcttcctgaactcctgcgtcgacggccagatcgagctctccgacggtgactcgttccgcgccgagaccctggtctggacggccggcgtgaagccgtcgccgatgctgcagcagaccgacctgccgctcggtccgcgcgggcacgtcaactgcctgcccaccctgcaggtcgccacgctcgagggcgaggtgctcgagggtgcctgggcggccggcgactgcgcgcaggtccccgacctgaccaacccgggtggctggtgctcgccgagcgcccagcacgcggtccggcaggccaaggtgctcgccgacaacatcgcccaggtgatcctcggcggcgctccgaaggagtaccggcacaagcacgtcggcggcgtcgccggcctgggcatcaacaagggtgtcgcgcacgtctacggcatcaaggtcaagggctacccggcctggctgatgcaccgcttctaccacgtcagccggatcccgtcgttcaaccgcaaggtgcgggtgctcgccgactgggtgctggccttcatcctcaagcgggagaccgtggcactcggccagctgcacgcgccgcgcgaggagttcctcgaggtgaccccaccggtcgcgccgaagccgaaggccgaggagaaggtggcctccggggctcgctga

SEQ ID NO: 2101 - DNA, 564 bp, Actinoplanes utahensis
gtgctgaccggactcctgcggcggatcagccggatcccgggcatggtccgccgggccaccgtgatcccgatgctggtacgcgccggcatcgccctgtgcgggctgttcgcgatcgccgtggcctggccgatcgagctggtggcgagtcagttcgtggtgccgctggtgctggtcgcgctctggccggcgttcgccccgcggggccgcgccgccaccttcgccgcgctggtcgtggtggccggctggatcgtcgacacctcggggtacgactcgcggatcgcgctctggcgggtgctgtccctggccaccctgctctatctcggtcacacgctgaccgcgctggccgccgtcctgccctacgacgcggtggtcaacctggaggtcccgggcctgtggctgggccgcgccgggatcgtggtgctgatctcggcggtgttgaccgtgctcgctctggggcttactgcggatcttgatggtgatgcgttccaattggcgacattggtgggattggctgctgcgaccggtgtgacgatgcttttggttcgccttaccaggcggagctga

SEQ ID NO: 2102 - DNA, 798 bp, Actinoplanes utahensis
atgaccgagccgttcaaggcgaccgaggcgatgccggccgcggccggcctggtcggcgcgcaccgctcgcggcggctgggggagggcggtgagctggccggcgtgcgccagttcgcacccggcgaccggctgcgccgcatcgactggcgggtctcgctgcgcacccgcgacctgcacgtggcctccaccctctcggaccgcgacgccgaggtgctgctcctgctcgacctgctgggcgaggtgggccggtccggcggggtggcgggcggcgcctcggtgctggacaccacggtccgcgcggccgccgcggtcgccgagcactacctgcaccgcggcgaccgggtgtcactgctggagtacggcgccaccgcccgccggctgcgcgccgcctccggccgccggcagtacctcaccgtcctggagtggctgctcgacgtgcgcgccgacccggtcgacgaggagtacgaacctgccctcggctcgcaccagatctccacctcggcgctggtcgtggtgctcaccccgctgatcgatccgcgcgccgcggacatgctggcccagctcacccaggccggccggttcgtggtcgcggtggacacgttgccggaggacgccgcgccgccggtccgcaaccagtggagccagctggccacccggctgtggcggatcgagcgggaaaacgtgctgggccggctccgcgagcacggtgtgccggtggtcacctgggccggcgccggcagcctggacctggtgctgcgcgacgtggcccggatggccgccgcaccgagggggcgatga

SEQ ID NO: 2103 - DNA, 453 bp, Actinoplanes utahensis
atgactgaaccggccgctccgagttgggcgccgacccgggcgctcggccgctcggtgctgctcaccgggctgctcctgctgctcggcgtggccctgggccgggtcgacctggtgctgctggccgccccgttcgcgatcggggtggcgctgaacctgcggaaccggccgcaggcgatgccggaggtgaccatcaccgccgacgaggcgcacctggtcgagggcggcgcggtgcaggccgccctgaccgtggccaacccggacgtgctcggctacgacctggtggtggtgcgcacccggacgtcgccgtggctgcgcctggagcacgccgaccggccgttcgcgatcaccgtgccgtccgacgggtgggccgccgtcgacctgcccggcgaggcgctgcgctggggccggcaggacgtcggcccggccgccgcgcgggccgcgctagctagctag

SEQ ID NO: 2104 - DNA, 1002 bp, Actinoplanes utahensis
gtgacccagcaaggcggacaggctcttcctccgtacgaggtcgggcggctggccggtgcggtgctcgacgcggtgaacagcgtcgtggtcggcaaacgggaggcgctcgaactggtgctggccggcatcctggccggtggccacgtgctgctcgaggacctgcccgggctgggcaagacgctgaccgcgcggtcgttcgcgcaggcgctcgggctcgacttccggcggctgcagttcacccccgacctgctgcccgccgacgtcaccggctcgttcctgtacgaccagcgcaagggtgacttcgcgttccgggccgggccggtgttcaccaacatgctgctggccgacgagatcaaccggaccccgccgaagacccagtccgccctgctcgaggcgatgcaggagaagcaggtctcggtcgagggcgtgacctaccggctggacccgccgttccacgtgctggccaccgccaacccgatcgagtacgagggcacgtacccgctgcccgaggcgcagctcgaccggttcctgctccgggtgtcgttcggctacccgaccgccgaggaggagtgggaggtgatgcgccgccggatgtcccgccgtcaggaggaggcgcagctcaccccggtggtcgacgcccgcaccctgcaggtgatgcaggccgcgctggagtcggtcgcggtcgaggactcgatcgggcgctacatcgtctcgctggccgcggccacccgcgagcacaccgcggtgctggtcggctcgtcgccgcgtggctcgctggcactgctgctgctggcccgggcccgggccgcgatggccggccgggactacgtggtgcccgaggacgtcaaggacgtcgcggtgccggccctggcgcaccggatcacgctgcgtccggagatgtggctgcgccaggtgaacccggcgttcgtggtgcaggaggtgctcagcgcggtgccggccccggccagcggggcgcttccgacctacgcccggcatgactga

SEQ ID NO: 2105 - DNA, 258 bp, Actinoplanes utahensis
gtgcgccgctgggagtggaccctggacaaggcgcacgccgacccggacacctatgcgcgtaccgtcgtgctgccggtgctcggcgaactcgccgacgaacgcctgcggctgcggcacggcatcacccgcgccaccgatccggcacgcgcccgggaactgctcggcggcgacgcctgggcggtactgtccgatcccggtcgtcgcggactgaaggcgaaagacctggagacgtacgtgcaagccatggaacgactgtga

SEQ ID NO: 2106 - DNA, 126 bp, Actinoplanes utahensis
gtgagcgacgggggactcgacgaactcttcgggatgacggccgcgccggccgccccggagcccgcgccggcgccggcccgtcgccgctcgccggcgctgcgggtggccggcaacgtgctgctctag

SEQ ID NO: 2107 - DNA, 690 bp, Actinoplanes utahensis
atggaccttggacttctgcgccgctggtggccgctggccgccgtcatcgggctgctcttcgtgatctcgctggcggccacccgctcggcgccccagctggaccggatcaccccggagtccaccacgccgaccacccaggcgccgctgctgccgcccaccccgcatccgaccgtggagcagagtgagtcgccggtcgaggcggctcgcggcctgcccggctgggtcggcagcgcggcggtcgcggtgatcgtcgtgctggtgatcgtgatggtggtgatcctcatctgggcgctgctgcgggacgtggcccgccgtcggcgcaaccggaccggccgccgcgacccgcgccgcgccgggaacaccgccgaggatctggtcgccgcgctcgacgccggtctggaggagctctccgacaccgaccgcgacccgcgtcgcgcggtgatcgcctgctgggtgcggctggagcaggccgccgccgcggccggcaccgtccggcatcccggcgacagccccaccgacctggtcggccggctgctcgccgagcaacaggtggacgccgccgtgctcgccgccctgatggaggtgtaccgggaggcccggtacgccacccacaccgtcgacgaccggatgcgccagcaggcgcggtacgcgctggagcggttgcgcgccgacctgggggcgctggcgtga

SEQ ID NO: 2108 - DNA, 753 bp, Actinoplanes utahensis
gtgcaaccgtcggagagctcaccgcgtacgccgcaatcggttgtcgatcaggcggccggggccgcgtcgctgaccgtgctcgatgcccgcgtcgcggattgtttcgcctgcccccggctggtcgcctggcggaccgaggtggccacggtcaagcgcgccgcgttccgcgaccagcactactgggggcgcccggtgcccgggtggggcccggcggacgccgcgatcggcatcctcggcctggcacccgcggcgcacggcggcaaccgcaccggccggatcttcaccggcgaccgttccggcgacgtcctcttcgccgccctgcaccgggccggtctggccaaccagccgaccagcgtcgccgccgacgacggcctgaccttgcggcacacccggatcttcgcggcggtgcgctgcgcgccgccggacaacaagccgaccccggccgaacgcgacacctgcgccccctggttccagcgcgagttgcggctgctcacccccaccctgaaggtggtggtcacgttgggtgccttcgcctgggcggcctggtggccggcgatgagatcggcgtacgcggtgacaccccccgtgccacgcccgaggttcggccacggcgccgaggtgcatctgcccggcgtgcccccgctgctggggtgtttccacgtcagccagcagaacactttcaccggccggctcacccccgacatgctcgacgcggtgttcgcgcgtgcgaaggatctggcgggcctggcatga

SEQ ID NO: 2109 - DNA, 627 bp, Actinoplanes utahensis
atgtccaacccggttgagccgaacccgtacggcgcgcccgccgagcagcccggcacggcgttcccgccgccgaacgcgggcgctcccggtgcgtacccgccgccgaaccccggcgcccccgctgcctacccgcccccgaacgccggcgcccccggtgcgtacccgccgccgaacgccggtgccccgggcgagtccgcctacccgccgcccggcgcggccgccttcccggccccgcagccggccccgaagaagtcgttcggcaagaagctgctgggtgttctcggcacgatcgtggtcctgatcgtcatcgcggcggtcaagttcggcatcggcttcggggtgagcaaggcgctcagcggcgacccgaccaaggacgccaaggtcggcaactgcatctcggtcgacgacaagctgtccgacaaggagaccgagaccaaggccgacatcgtcgactgctcgaagtcggacgccaagttcatcgtggtcggccgggtcgacggcgtcaacgacgtgaacagcaccgcctgcgacaagtacttcaccgagaaggacaaggacccggcgatcctgtccagcccgtccgactccaagaacaagtacctgctgtgcgtcaaggccaacggctga

SEQ ID NO: 2110 - DNA, 912 bp, Actinoplanes utahensis
atgagggtcgccgcgatcgactgcgggacgaacgcgatccgcctgctgatcgccgacgtggacggtgaccggctgaccgacgtgacccgccggatggagatcgtccggctgggcgagggcgtcgaccggacgggcatgctgtcgcccgccgcgatcgagcggacccgggtcgccctcgccggctacgccgccgacatcgagaaatcggaggccgtcgcggtacgcatgtgtgccacctccgcctcgcgcgatgcgtcgaacgccggcgacttccgcgccatggtccgtggtgtcctcggcatcgacccggaggtgatcaccggggaggaggaggccaccctctcgttcctcggcgcggtcaagggtctcgccgcgcccggcccgtatctcgtcgtcgacctgggtggcggctccaccgagttcgtcaccggcacggacactgtcgagcgcgccatctcgatggacatcggctgcgtccggatgaccgagcggcacctgcacggcgatccgccggccgcggaggagttggccgcggcgcagcgggaggtcaccgtggcggtggacaccgcgctggccgcggtcggcggccgggcggcacgcaccctggtcgggctggccgggacggtggccacggtcgcggcgctggcgcacgacctgccggagtacgactcggcgcggatccaccacagtgcggtcagccgggcggcggtcacccgggtcaccggggaactgctcgggatgaccgtggagcggcggctggcgctgccggtgatgcatccgggccgggccgacgtgatcggcggcggcgcgctgatcatgcggaccatcatggagcgttccggccatgacacggtgatcgcctccgaacacgacatcctcgacggcatcgcgttcggcctggcggcgggctga

SEQ ID NO: 2111 - DNA, 495 bp, Actinoplanes utahensis
atgctgatccgccgggcccgcaccggggatgtccgggcgatccggcacctggtcgacacgtacacgacggatcggcggctgctcagcaaggcgacggtcaccctctacgagtccgtccaggagttctgggtggcggtcgacgaggacggcacggtgtccggctgcggcgccctgcacgtgatgtgggaggacctggccgagatccgcacggtcgccgtgcaccccgacaagcggggccggagaatcggtcaccggatcgtcggcgtgctgctcgaccaggcccgcgagctgggcgtgcgacgggtcttctgcctcaccttcgagacccggttcttcggctcgttcggcttcaccgagatcgacggggccccggttccgcacgcggtctacgagcagctgctgcggtcgtacgacgagggcgtcgccgaattcctggacctggagcgggtcaagccgaacaccctggggaacacgagaatgctgctgcacctatga

SEQ ID NO: 2112 - DNA, 501 bp, Actinoplanes utahensis
atggatgcaccaacccccgccgacctcgacatcgtggcggcccagctgggccgcccaccccgcggcacccgcgcggtcgcgcaccgctgcccgtgcggcaacccggacgtggtggagacctcgccccggctggacgacggcacgccgttccccaccatgtactacctgacctgcccgcacgccacggccgcctgctcccgtctggagtcggccggcgtgatgcgtgacatgcaggagcggctgagcaccgacccggagctggccgcccactacgccgcggcgcaccgtgactatctggaccgccgccaggcgatcgacgacgtcccggagatccacggcgtgtcggccggcggcatgcccgaccgggtgaagtgcctgcacgtccacctgggacacgcgcttgccgcgggccgcggagtgaacccgttcggcgacgaggtgcgcgacgcggtcgagccgtggtgggtcgacggcccctgcgtcaagcgcgacgaatgctga

SEQ ID NO: 2113 - DNA, 600 bp, Actinoplanes utahensis
atgacacagcgccgcatgccgagcggtcagggcccgtcccgccgatcgggtggcgccagtggccgtcccggtgcttcccgcacccgtggcgccggtccggtccgggtggaggcccgcccgaccgtccgggtgcccacgtcacgcagcgcgcgcccggccggcgcgcggcgtacttcgcagtccggcggcccggccgccacgcgcaccgccgcgccccggccgcgtgcgctgaccagccgggcaaccgtcctgctcgcggtcctcgtggtgctggccctggcctacacctacccgatccgggtctatctgcagcaggaggcgcagatcgcccagatggagcgggcccaggccgagcagcgcgaccagatcgccgccacggcgacggagctggcgaagtggaacgacaacgagtacatccggatccaggcgcgcaagcagctgtattacgtgcgcccgggtgaggcaccgctgctcgtgatcgaggaccgggccggcgccgcgcacgacgccggtcagaaagccccggcggccgccccggaccgctggtacgacacgctgtggaacagcgtccgagccgccgacgcggagcccgcgaactga

SEQ ID NO: 2114 - DNA, 1284 bp, Actinoplanes utahensis
atggccaccattgaagcgatcgtcgcccgcgagatcctggattcccggggcaacccgaccgtcgaggtcgaggtcggtctggacgacggcacggtcggccgcgcggcggttccgtccggcgcctccaccggcgcgttcgaggcgctcgagctgcgggacggcgacaagggccggtacctcggcaagggtgtcgagaaggcggtcgccaacatcgaggacaagatcgccgacgagctgatcggttacgaggcgagcgagcagcgcctgatcgaccagaagatgctcgacctggacggcaccgacaccaagtcggagctgggcgccaacgcgatcctgggcgtctcgctggcggtggccaaggccgccgcgctctccgccgagctcccgctgttccgttacatcggtggcccgaacgccgccgtcctgccggtcccgatgatgaacatcgtgaacggtggcgcgcacgccgactccaacgtcgacgtgcaggagttcatgatcgccccgatcggcgcccccaccttccgtgaggcgctgcgcaccggcgccgaggtgtaccacgcgctgaagtcggtgctgaagaagaagggcctgtccaccggcctgggtgacgagggtggcttcgcgccgaacctgccggccaacgccgccgcgctggacctgatcgccgaggcggtccaggccgccggtttctccctgggcagcgacatcgtgctggccatggacgtcgcggccaccgagttctacaaggacgggtcctacgttttcgagggctcgccgaagtcgaccgacgagatgatcgcctactacgcgaagctcgccgccgactacccgatcgtctccatcgaggatccgctggccgaggacgactgggccggctggagcgcgatgagcgagcagctcggcaacaagatccagatcgtcggcgacgacctgttcgtcaccaacccgcagcgcatcgcccgcggcatcgccgagtcggccggtaacgcggtgctggtcaaggtgaaccagatcggttcgctgaccgagacgctggacgccgtggacctggcgcaccgggccggtttcaagacgatgatgtcgcaccgctccggtgagaccgaggacaccacgatcgccgacctggcggtcgcggtcggctccggtcagatcaagaccggcgcgccggcccggtccgaccgggtggcgaagtacaaccagctcctgcgcatcgaggagcagctggagagcgccgcgcggtacgccggtgcgggcgcgttcccgcgttaccgggtcgcgtaa

SEQ ID NO: 2115 - DNA, 630 bp, Actinoplanes utahensis
atgagcatcagcgtgtttccagaggacggctcacgcgtcgagatggagtccgggggcgacatccacccgggcgtccgggtcgtggccgggtcggcggccggggtgaccgtctccctgccgcaggccggggtgccccgggccggcgcgaccgtgatcctgcgctggccggccacgccccgcggccggtacgtggtgtccgccacggtcgccgcggccggtgagaaccgggtggaactccgcctggccggcgagccggagatcgtgcagaaccggctctacgtgcgcggcggcggcggtgagccggtggtgatgacccggcccgggcaccccgacgcgatcggctgggtgcacgacatcagcgaacgctcgatccgggcgcacttcaccgacgtggaggtgcggcccgggcacgaggtggcgctgcgcgtccaactcggcgccgacgtggtggagatgcccgccacggtgtggaaggccagcgcgatgcggcagcaggtgccggtccgcgggccgctgtcggtggagatggtcgccctctacgacccgcccgagtcacaggcgaagatcattcggcgttatgtcctgcgtcaccagctgttgatgcgcgcgaaaaccgccgagtcggcctga

SEQ ID NO: 2116 - DNA, 651 bp, Actinoplanes utahensis
gtggtgatcgtggcccgccgtcgttttgtgaatggaatactggccgtgggcgtgctgctcgccggcaccgcctgcaccgacctcgaccaggccagcgccgccggggtcggccccgccgacgcggtcgcccagctcgccgcccagctcgccgactcggccgacgcgacgtacaccgcgacctacagcctgaccggcggcgacaccgccacggtgagccgggcgcaggatccgccacggaccgcgtaccgctggcccggcggccggctcatcctcaccgcaaccgggaccacccggtgtgcgaaggcgacctgcgcgatcagcgaccccggcgggccggccccggagccgccgcccgccgccggtctcatcagcccggaaggggtgatggcgatgctgcgctccgccgaggcggacccggccctgcggatcacccagcgggacaccaccctggccgagcggcacgcatcctgcctgcagatcgtcggctcgttcgaggtgtgcgtggccggcgacgggacgctggccgccttcaagggcaacctcggcggcctccgcgtcgagatgaccctcaccgacctcacctcgaccaccgccgtcgccgacttccggcccccgcccggcgccaccgtcaccgaccaacgcccgaagtaa

SEQ ID NO: 2117 - DNA, 1617 bp, Actinoplanes utahensis
atgccggagtttgtgccacttgccgagcggatcgccgactctctcctggagagcgatcccgtgacggccctctacgcgggggaccatcggttcgacgaccgtctgcccgacctctccgccaccgcggtcgacggccgggtcgccatgctgcgggacgcggccgacgcgctcagcgcgatcgacgccgacgccctcgacccggaggagcaggtcgaccacgcgatcctcaccgcccaggtggaccgtgggctgttcgagctcaccgaggtccgcgagcacgagtggaacccgttggagcacaaccccggcccgctcctgcacggcctgctgtcccgcccgttcgcgccgcccgccgagcggctgaccagcctgcgcggccggctcgccgcgctgcccgacgcgctggccaccgcccgggccgtgctcgacgacgtgccgcggatccacgccgagaccgcggccggccagttcgccggcaccgccgggctgatccgcgacgagctgcccgccctgctcgcccaggagcccggcctgcggggcaccgtggagccggtcgccgcggccgcggtcgccgcgctcaccgagttcgacggctggctgcgcaagcggctggagagcggcgagtcggggcgtgacccgcggctcggccgccggctgtgggaggcccggctctggcacaccctcgacaccgagctgtccgcggccgaggtgctgtcccgggcccgggccaatctcgatcgggtcggcgccgagctgcgcgtgctggcggccgagatggtcggcggcgagcccaccgacgacaccgtgcggcgcgcactggacaccatcgccgatcagcaccccgacaacaccaccatcctcgggctggccaagagcacgatggacgaggccaccgagttcgtccgcgcccacgacgtggtgtcgctggtggacgacccgtgcgtgatcgaggagatgccggagttcgcccgcggcgtggcggtggcctactgcgacccgcccggcccgctggagaccgcggacgtgcccacgttctactgcatcgcgcccgcgccggccgggtggtcgcccgagcggatccgcagcttctaccgcgaatacaacaacgagatgatccgcaacctgaccgtccacgaggcgatgccggggcacttcctgcagttggcgcacgcgcggcggttccggggcagcagcccggtgcgggcgctcggctggtccggaccgttcgtcgagggctgggcggtctacgccgaggagatgatggtcgggctcggcttcggcgggcccgcggtgaaactgcagcagctcaagatgcagctgcggatgagtctcaacgcgatcatcgaccagctggtgcactgcgaggacctggccgagggcgaggcgatggcgctgatgaccgggcggggcttccaggaggagggggaggcggccgggaaatggcggcgggcgctgctcacctcgacccagctgtccacctacttcgtgggatacaccgaggtggcggggctggcggcgttgcggccgttcggggccacgcccaaggcgtggcatgacgcgatgctggcgcacgggtcgccgccgccgcggcatctgcgggcgttgctcggggtgtag

SEQ ID NO: 2118 - DNA, 960 bp, Actinoplanes utahensis
ttgagcgcccgcatcgttctgctggtcacctcgccgcggctgccggccgggctgctgaccgccgaggcctgggacaccgtccgctccggcccggtcttcgccgccgccgagtcgccgcaggccgaggcgctgcgggcggccggggtgccggtcaccgtgctggacatcgacgcgcaggggctgctcgacgcgatcggcgcggccccgctcgcggtctggctcgccgggccgcacggcgaccagccgttcgcccgacagctcggcctgcggctggcgcgcgagcccgggttggccgagctggagctgatgtacggctcgtgggacccgcccggcgcccgcctgctcgacgcggtcacggtgatggaccggttggcctcgcccggcggcgacccgtggaaacgggcgcagacccaccggacgctcgcgccgtacctgctggaggagagctacgaggcgtacgacgcgatcgagcgcgaggattaccacgagctgcgcgaggagctgggcgacgtgctgctgcaggtggtgctgcacgcccggctcgccgaggacctgccggacgggcgcgcgtggaacatcgacgacgtggccgggatcctggtggagaagatggtccggcgcaacccgcacgtcttcgccggggagaccgtcgaggacctcgaggagatcaccgccaactgggagcggatcaagcgcgaggagaaggcgcgcgagtccgtgctggacggtgtggcgctgagtcagccggccctggcgctggccgcgaaggtgctgcagcgggccgcccggggcggggtggacgtgccgctgccggccggtgacgagctgggcgccgggctgctgcggctggtcgccgaggcccgcgcggccgggcacgacccggaggcggagctgcgcgcggctgttttgacgtacgccgaagcggtgcgagcggcagaaaaagtcggaccccccgagtag

SEQ ID NO: 2119 - DNA, 711 bp, Actinoplanes utahensis
atgctgcgtacccgacgattcgcatccatggccgtcatcgcgtccctggcggtcgccggcctgtccgcgtgccgctccgagccgtccgtggccgcctatgtcggggacacccggatcaccgagaagcaggtcgagcggatcgcggacgaggcgcagcgggcccgggccggtgcgggcgccacgccgattccgcggtccgaggtcgtccggctgctggtcgcccggccgttgctggatcagctcgcggcccgccaccaggtgaccctgccggccaacctgccgtacgaccagtacgccaagctgatcgggctgccggcggacaacgagctcctgcacctcatcgtcgacaacggcaccctgcagcaggcggtgagtcagaagatcaccggcccggccacgctgagcgacgacgatctgcgcgatgtctaccagcgtcccgaggtgcagaaggcgctcccgccgggcaccagcctggagcagttccgctcggtgctgagcaacgcggacctcaaggccggggtgcaggccggcatcggcctgcgcaacgagctcgccgaggtggccgcgccgctgcacgtcacgatcaacccgcggtatcagccgctggagctggtgacgtacaccttccagccgtcccagacgactaacatcggcatggtcggcgccccgctcggcgacccggcgcacctcccggtctccgacgtctcttga

SEQ ID NO: 2120 - DNA, 3612 bp, Actinoplanes utahensis
atgcaactcgccggactcatcccggccgccctgcgcgaccgcggcctcgcccgggcccgtgacctggcccgtaagggcttcgtcgactcggactcgatggatctgaccgcgccggtctcgctgcggccgttcgtggtggccaccgtggccggtccggccgacgccggcggggcgcagcggccggtgctcgcggtcaccgccacctcgcgcgaggccgacgacctggccgacgcgctgggctgcctgatcgagccgggccgggtggcggtctacccgtcgtgggagacgctgccgcacgagcggctgtcgccccggtccgacacggtcggccggcggctggccgtgctgcgccgcctggcccaccccggtgaccagccgctgcaggtggtcgtggcgccggtccgctcgctgctgcagccgcagctcaagggcctcggcgacctggagccggtggagctggtcaccgggcgggaggcggagctggagggggtcgcgcggcggctctccgacatggcgtacgcccgggtcgacctggtgaccaagcgcggcgagttcgcggtccgcggcggcatcctggacgtcttcccgccgaccgacgagcatccgtcccgggtcgagttctggggcgacgaggtggaggagatccgtaccttcgcggtcgccgaccagcgcaccatcgagcaggtcgagcggctgtgggcgccgccctgccgggagttgctgctcacccccgcggtccgggagaaggcggcgctgctcgccacccggcacccggagctcgccgagattctcgaccggctggccgagggcatcccggtcgagggcatggagtcgctggcgccggcgctgctggacggcaccgacagcatggagctgctgatcgactgcatgccggccggcacccacgtgctgctctgcgacccggagcggatccgcacccgggcacacgacctcacccgcacctccgacgagttcctggaggcctcctgggccgcggccgcggtcggcggtgaggcgccgatcgacgtgggtgcggtcgccttcaagaccctcgccgacgtgcgggcccacgccgccgtcctgcaccagccgtggtggacgctctcgccgttcggcctggccaccgccgacgagccggccgccgcgctcccgtgggaggacgccgggacggtcgaggtctcgccggacaccggtgacgcggtggcgctggccgctcagccggtcccgctctaccacggcgacaccgagcggctggccgccgacctggccggctggtccgccgcgggctgggcggtcgcgctggtcttcgagggcaaggggaccgcccagcgggccaccgagctgctccgggacgcgggcctcggggtcaccccggtcgactcgatcgccaccccgatcgccgacggccagctgctggtcacctgcggcgggctgaaccacggcttcgtcgacgaggcgtcccggctcgcggtgatcaccggcaacgacatctccggcgggcgcggcgcctccaccaaggacatgcgcaagatgccggcccgccggcgcaacacgatcgacccgctggaactcaagatgggcgacttcgtggtgcacgagcagcacggcatcggccgctacatcgagctggtccagcgcacggtcaacggcgccgaccgggagtacctcgtgatcgagtacgccgcgtccaagcgcggccagcccggcgaccggctctacgtccccaccgaccagctggaccagctgtcccgctacgtcggcggtgagcagcccacgctgcacaagatgggcggcgccgactggcagaagagcaaggcccgcgccaagaaggcggtcaaggagatcgccgcccagctgatccagttgtacgcggcgcggcaggcctccaagggccactccttcggcccggacacgccgtggcagcgcgagttggaggacgccttcccgtacaccgagacgcccgaccagatggccgcgatcatcgaggtcaagcacgacatggagttgcagacgccgatggacaggctgatctgcggcgacgtcggctacggcaagaccgagatcgcggtgcgcgccgcgttcaaggcggtccaggacggcaagcaggtggccgtgctggtgcccaccacgctgctcgcccagcagcactacaacacgttcaccgagcggatgagccagttcccggtgcagatcaggcagctgtcccggttccagacgcccaaggaggcggcactcaccctggagaacgccgcggacggcaccgccgacatcgtgatcggcacgcaccggctgctgtccaagtcgacccggttcaagaatctgggcctgatcatcgtcgacgaggagcagcgcttcggcgtcgagcacaaggagcagctcaaggcgctgcgcgcgtcggtggacgtactgaccatgtcggccaccccgatcccgcgcaccctggagatggcgatcaccggcatccgggagatgtccaccatcgccaccccgccggaggagcggcacccggtgctcacctacgtcggggcgtacgacgacaagcaggtcgccgccgccatccaccgcgagctgctccgcgacggccaggtgttctacctgcacaaccgggtcgagtcgatcgaccgggcggcccgccggctgcgcgagctggtgcccgaggcgcgggtcgcggtggcgcacggccagatgagcgaggagcagctggaaaaggtcatggtcggcttctgggagaaggagttcgacgtcctggtctgcaccacgatcgtcgagtccggcatcgacatcccgaacgccaacaccctgatcctggagcgcgccgacctgctcggcctggcccagctgcaccagatccgcggccgggtcggccgcgggcgggagcgggcgtacgcgtacttcctctacccccgggagaagccgctcaccgagcacgcccacgagcggctggccaccatcgcccagcacaccgagctcggcgccggcatgtacgtcgcgatgaaggacctggagatccgcggcgccggcaacctgctcggcggcgagcagtccggccacatcgagggcgtcggcttcgacctgtacgtgcggatggtcggcgaggcggtcagcgcgttcaagggcgagcggcccgaggaggagcccgaggtcaagatcgacctgccgatcgacgcgcacctgcccaccgactacatcgcggtcgagcggctgcgcctggagatgtaccggaaactcgccgaggcccgcgacgacgcccggctggacgaggtcgtcgccgagatgaccgaccggtacggcgagccgcccgccgcggtggtcaacctgatcgcggtggcccggttccgccagctcgcccgggcgtacggcctgaccgacgtgtcgatgcagggtaggcacctgcggttcgccccgctcgcgctgcccgattccaagcagatgcggctcaagcggtaccacccggactcggtctacaagccggcgaacgaccaggtcagcgtgccgcggccgcagacccggcgggtcggcggcgagccgctgcgcgaccaggatctgctccagtggtgtgcccagctgctcaaggacgtgctcggtgacgcgccggccccggcccgggtgtga

SEQ ID NO: 2121 - DNA, 1656 bp, Actinoplanes utahensis
gtgcgcatcctgctgctagtcagcgctttcaacggcttgagtcagcgggtctggtgcgcgttgcgcgacgccggacaccaggtgggtgtgctgctggcgggcagtgagcagcagatcgccgacggggtccgggccgccgacccggagctgatcctctgcccgttcctcaaggaccgggtccccgccgaggtgtggcagcgccggcccacggtgatcctgcatcccggcccggtcggcgaccgcggcccctcctcgctggactgggcgatcagcgagggggcccgcacctggggcgtgaccgcgctgcaggcggtcgaggagctggacgccggaccgatctgggcgagccgcaccttcgacgtgccggccgccccgccgcgcaagtcggcgctctacaccgggccggtctcggacgccgccctggagtgcgcgctcgaggtggtgacgaaagcggccgacccgtcgttcagcccggtcccggcatccgtcgcggctccccggccgatgatgcggcagagcgaccggtcgttcgactggggcgacgccaccgacgcgatcctgcgccggatccgggccgcggacggctcgccgggggtgttgaccgaggtgggcgggctacccgcgtacgcctatgacgcccatcgcggagcggcccgcggcgcccggccgggagccctgctcagccgccgtcaaggggcggtgctcgtcgccaccggcgacggcagcctgtggatcggccacctgcgaccggccggccccggcgggatcaaggtgccggccaccacggcgctcggcgagcggctgcgcggcgtgccgaactcgccgctggaggcgcacgcccagccggaggcgccggccgcctaccggcaggtccgctaccgacgcaccggggcgatcggctggctgcacttcgacttctacaacggcgcgatggcgcccgggcactgccgccggctgctcgccgcgctgcgacacgcggccgcccaggacacccgggtgctggtgctgcgcggcgggaccgaggcgttcagcaacggcatccacctcaacgtgatcgaggccgcacccgacccggcggccgccgcctgggccaacatccgggcgatcaaccaggtgtgccgggagatcatcgggtgcacccggcagctggtggtggccgcctacgcgggcagcgcgggggccggcggggtgatgctcggcctgggcgccgacgtggtcgcggcccgcgacgggatcgtgctcaacccgtactacgacatcggtctgtacggctcggaactgcacacctacacgctgccccggcgggtcggcgcggaccgggcgcagcggctgatcgacgagaagctgccgctcagcacggcgcaggcggtccggatcgggctcatcgacgaggtcggcccgcgccacccggaggcgtactcgcagtggctgaccctgctcgccgaacgccactcggacgcccgcagcgcccggaaacgccgggccgccaaagcacgccggctggccggggagcgcatcccgctcgacgtgtacgagacccgcgagctggccgagatgagccgggacatctacaccgaccggtccggcttcgccgccgcccggcaggcgttcgtgcgcaaggcccggccggacggcacgccgcgccggcctagctag

SEQ ID NO: 2122 - DNA, 123 bp, Actinoplanes utahensis
gtgctgctcgccggcaacgccggaccggccctgcccgggcgccagcggaccggcaacagcggcccggccggcgagcggcgggcgccgatcacggtgcgcccggcggtgccggtctcggcctga

SEQ ID NO: 2123 - DNA, 2799 bp, Actinoplanes utahensis
atgacagagctgcccgcccatctcgacgagcgagaggggcccgacgccgagctccgtgccgacatccgccggatcggcaccctgctcgggcagaccctggcccgccaggaaggccggccgctgctcgacctggtcgaggagatccgcgccctggtccgccaggacgtgccggccgccgccgagcggctcgccgcgatggacatcaccaccggcaccaagctggcccgggccttctccacctacttccacctggccaacatcaccgaacaggtgcaccgcgcccgcgacctgcggcgccgccgggccaaggacggcggctggctggaccaggccgccaagcggatcgccgagcggggcgtcccggccgacgagatcgcctcggccgcccgccggctcgcggtccgcccggtcttcaccgcccacccgaccgaggcgtcgcgccggtcgatcctgtcgaagctgcgccaggtcgccgactcgctggacgccgagtcggccgccgccgcgctctacggcgacaccgacaccacgcagtccaccaagcggttcgccgagctgatcgacctgctctggcagaccgacgagctgcgtctcgaccggccggacccgaccgacgaggcccgcaacgcggtctactacctcaaggacctgtacgccgaggctgccccgcaggtcctcgacgacctggccgagacgctgcgccggctgggtgtggagaccgcgcccacgtcccgcccgctgaccttcggctcgtggatcggcggcgaccgcgacggcaacccgttcgtcacccccgcggtcaccgccgccgtgctgctcatccagcacgagcacggcattcaggccaccgagaaggtgatggacaagctgatcgaggagctgtccgtctcccgccggctgcgcggggtctccctcgacctgtccgccagcctcgcccaggacctggacaacctgcccgaggtcgccgaccggttccgccgggtcaacgccgaggagccgtaccggctcaaggtccgggcgatcaaggcgaagctggccaacacccggtcccggctgcagcacggcaccccgcacgtggccggccgcgattacctgggcagcgacgagctgatcgccgacctggaactgatgcgcgcctcgctggcccgcaactccggccagctgcccgcggtcggcgtggtcgccaccgcgatccgccaggcgtccgcgttcggcctgcagctggccaccctcgacgtgcgcgagcacgccgagaagcaccacgaggtgctccagcagatgtacacgcaggtcggcgaggtcgaggactacgccgccctggaccgcaccgagcgcaccaagctgctcgccgccgaactgaccgggcgccggccgctgtccagcgccgacaccccgctgaccgactcggcgcgcaagaccttcgacgtgttcaacacgatccgcgagtcgcaggagcggttcggggcggacgtcatcgagacgtacatcatctcgatgacgctgggcgtcgacgacgtgctcgccgcggccgtgctggcccgcgaggccggcctggtcgacatccacaccggccgggcccgggtcaacatcgtgccgctgctggagaccccggccgaactggacgccggcggcgacctgctcgacgagatgctgtcgctgcccgcctaccgggcgatcgtccgggcccgcggcgacgtgcaggaggtcatgctcggctactcggactccaacaaggaggccgggatcaccaccagccagtggcgcatccacaaggcgcagcgctcgctgcgtgacgtggccgcccggcacggcgtccggctgcgcctgttccacggccgcggcggcaccgtcggccgcggcggcggccccacccacgaggcgatcctggcccagccgtacggcaccctcgacggcgcgatcaaggtcaccgagcagggtgaggtgatctccgacaagtacaccgtgcccgccctggcccgggagaacctggagctcaccacggccgccgtgctgcaggccaccctgctgcacaccacgctgtcggtcgacccggtccgcctcgaggtgtgggacgcgaccatggacaccacctcggaagcggcgttcgccgcctaccgccggctggtggagaacccggacctgcccgcctacttctgggcggccacccccaccgaactgctcggcgcgctcaacatcggctcccgccccgcgaaacgccccaacgccgacgccggcctgggcggcctgcgcgccatcccgtgggtgttcggctggacccagacccggcagatcgtccccggctggttcggcgtcggcaccggcctggccgccgcccgcaaggccggcctcggcgacgtgctcaccgagatgcacgacaactggcagttcttccgcaccttcctgtcgaacgtcgcgatgatgctggccaagaccgacctgtcgatcgcccgccgctacgtcgagacactcgtcccggaggaactgcacccgatcttcgccaccatcgaagccgaatacgaccgcaccgtccaggaggtcctcgccatcaccggcgagccccgcatcctggcggcgcagccggaactctcccgcaccctcggcgtccgcgacacgtacctggagccgctgcaccacctccaggtcgccctgctccgccagtaccgcgacctgagcgacgcggcccgccagatgccgaccgcgccgggcgcccgccgcggcccgtcggactcgacggcgttggaacgcgccctgctcaccacggtcaacggcatcgccgccggcatgcgcaacaccggctga

SEQ ID NO: 2124 - DNA, 651 bp, Actinoplanes utahensis
atgtcgcaagatcccagactccaacgagcagctgagcttttccacgccgccaccttcaacggcgatcctgacgcggtaccggccgcgaccgagcagttagacagcctcgaagctgccctggcgttggcgcggggccgggttctgcacgcggcgttcctccgtgaccgccgggaggacccgcgcgagttggtcgccttcgagcgggccgccgagctatacgcctcgctcggcgacgaccacgcgctggccgaggcggagttctggctgggttgtttcctccaggttgtgcgccaggacggggatgcggcgcacccgcacctgcagcgctctgcagccctggcccgggcgaccgacaatcggctgacactgtcctacgcggtgcggcacctgggcttcgcggcgggcatggccggggatcacgccacggcacgcctcctgttggaggagtcggtagcgctccgccgggagctcgatttcccggcgggggtagcggccgggctggtagcgctggcggacctggcctatcgggacggtcgttcagacgaagccgagcgactgctcgacgaggcgacggcagtcgcggcgaagtgtggggccatcggggtgctcggctgggcggacaacacccgcgaggaaaatacccggccataa

SEQ ID NO: 2125 - DNA, 828 bp, Actinoplanes utahensis
gtggccgttcaccccgggcctcgaagtctccggaaccgtgtcgagctcggacccggcgtcacatgtccacgcctgggagaccgggtcgtcgcgctgaccaatgagggcggcctcgcggaagtcgcaacggctgatgccgcgttgactgcatccgttcccgccgggctgaacctcgctgatgcggtcatcgcacccggggtgctgaccaccgcagtgcttcttcacgaccacctggcgagagtccgcgccgctgacgtcgtactggtgcacagcgccgccggcgcgatcggccgcgccttcgccgacgtcgtacgtgcaaccagcggtgcgcgcctgatcggcgtcgtcggcgcaccttcccggatcgaggccgcgcatcgcgcgggctatcccgacgtactcgtgcgcggcgacaccttcgcggcccaggtccacgccgaactcagcgatcgaggcgtcgacgtcgtgctggaccctcagggcaccgccttcctggatcaggatctcgaactgctcgcccctagcggccgaatcatcctgttcggcaacgcctccggcgcacaactgggtgcgctaccggctaccgcttcgctctacgcgcgcaatgcctccatcggtggcttcagcctcgccgcactgtccgcccgggcgccgcacatggtcacctctgcgctgcgcgtcgcgctcgacctcctcaccgcgggacaggccagcacagaagtcaccgtgctgcacggcctggaagccgccgcgaatgcgcagcaagccctcgccgagggcaccggcaccggcaagtacatcgtcggcctcctcgagcttcagcgctga

SEQ ID NO: 2126 - DNA, 345 bp, Actinoplanes utahensis
atgactgtcgaaagagaagtcatgcccgtcacgccgcgccccccactggtccaccccgacatcgacgacgtagaactggtcgctgtgctgcacgcgctggccgatccaacccggctcacgatcgtgcggacgttgcgtggcgaacgggaacgcgcctgcggcacattccccgttcgcgtcgcgccctcgacgctgagccaccacttccgagtgctgcgggaagccggcgtcatccgccagcgtgaggacggcaaccgccgttgggcgatgctgcgcttggccgagctcgacgcccgtttccccagcctgatcgacatcgtgctcgcatcggccaccagaggctga

SEQ ID NO: 2127 - DNA, 711 bp, Actinoplanes utahensis
atgtcgaccgtcgccctgatcacggcgcgcggcctcttcggccgtcgccgggccctgctcctgctgcccctgcccctgctcctgatcggcctggcggcgctctgccgggccaacgacctcgacgtcaccaactggggctcgccggtcgtcatcggcctcggcttcggcgtcgtcctcccggtgatcgccctgatcgtcggcaccggcgtcctcggctccgaggtcgacgacggcaccctggtccacatcctgaccaagcccctggcccgccgcgagatcatcctcgccaagttcgtcgtcgcggtgctcgccaccgccgtgacgtcggcgatcccgctgtacctcaccggcctgctggccaactccgccaaactgggcgccgccctggccctcgccgcggtagtcggctccttcgcctacaccgcgctgttcctgctgctcagcctgctcacccgccgcccggtgctgctcggcctggtctacatcctgatctgggaaaacctgctcggcaaattcctcagcggcacccgggtgctgtccatccagcagtacgtcatcaccatcgcccacaagatgcagcccgccacgttcctcgacccgaaggtcagcgtcaccacggccgcggtgatgagcgcgatcttcgtggtggtctgcacggtcctggccatcaaccgcctcggctccttcagcctcgccggcgaaaccagctga

SEQ ID NO: 2128 - DNA, 966 bp, Actinoplanes utahensis
gtgaccctcgaaacccagcccacggcgcccgccgcacccgccgcggcggccacccccggcgtggtcgacctgcagggcgtgtcccgctggtacggcaacgtcgtggcggtcaacgacatcaccatgtcgctcggctccggcgtgaccggcctgctcggcccgaacggcgccggcaagaccacgatcctgcacatgatggccggcttcctcgccccgtccaagggcaccgtcaccatcgacggcaccccgacctggcgcaacccgggcgtctaccgcgacctcggcctggtcaccgagcgcgaggcggtgcactccttcctgaccgccgagcagttcgtgctggcctgcgccaagatgcagaaactgcgcgacccggccggcgccgcccgccgcgccctggagctcgtcgagatgaccgacgcggcgaaccgccggatcggcaccttctccaagggcatgcgccagcgcacccgggtggccgccgccctcgtccacgagccgcgggtgctgctgctcgacgagccgttcaacggcatggacccgcggcagcggatgcacatgatgcagctgctgcactcactcggcgacaccgggcacacgatcctgttcagctcgcacatcctggaggaggtcgagcaggtcgccgggctggtccaggtgatcgtcgcgggccggctcgccgcctccggcgactaccgcaagatccgccggctgatgacgaaccggccgcacgtgttcgccgtgcgcagctccgacgaccggcgcctcgcggtcgccctgatcgccgagaagtccgtcgccggcatcgagatcgagaacggcgggctcaccgtccgcgcctccgactacggcgacttcacccgcaacctgccccgtatcgccctcgacgagggaatccggctgcaccagctggtgccgtccgacgagtccctggagagcgtcttctcctacctgctggaggcctga

SEQ ID NO: 2129 - DNA, 861 bp, Actinoplanes utahensis
atgtctgagaccggcgtcatccatgacatcggctatcagcggtactccgggccacgcctgggccgctccgccgggatcggggcactctacgtccacggcctgcgtgccgcgttcgggttcggccggtccgccaaggccaagatctttccgtggatggtcgccggtgtggcgctgctgttcgcgatcatcatcgccgcggtcaagtcgcaggtgaccgagttcagtttcggctacgccgacctcgacgaccagctcagctggatgatcatcttcttcgtcgcgatcctggcaccggccctggtctcccgggacatccgctcgggcaccctgccgctgtacttcagccgcccgctgcgcgccgccgactacgtgctcgccaagttcctggccatggtcaccgcggtctggctgctgctcggcgtcccgcagctgatcatgttcctgggctccgccttcaccaccaagaagggcatgtccggggtctggcacgaagtcctcaagctgctccccggctggggctacagcctgctctgggcgctgctgttcaccagcatcggcctgctcatcgcctcgttcaccggcaagcaggcgttcgccgccggcggtatcgtcgcggtcttcctgatgaccaccccggtcgtcggggtgctggccaacctgccctccagcaacgcccggcagctggcgttcctggccagcccgaacaccctgatcgcgggcgtcggccactggctgttcgacaccagcatcgacttcgatctcgggcggttcggcccgatctacggcatcgaggcgctctgcctgatcgccgcctgcctcctgctcctgctcgcccgctaccggaaggtggccgcgctgtga

SEQ ID NO: 2130 - DNA, 915 bp, Actinoplanes utahensis
gtgaacatcatcgctactcaagcgctcaccaagacgtacgggggcggggtgaccgccctgtccgacctgaccgtctcggtcgagcccggcgtcatcggccttgtcggcgccaacggcgccggcaagagcacgttcatcaaaatcatgctcggcctgatcactcccagcgccggttcggttcgcgtcttcgacatcgacccggtcgtcgacaccgacaaggtgcgggcccgggtcggttacatgccggagaacgactgcctgccgccggacgtgtcggccgccgaattcgtcacccacctcggccggatgagcggcctgccccgcaccgcggcccgcgagcgcgcctccgaggcgctgcgccacgtcggcctctacgaggagcggtaccggcagatcggcggctactcgaccggcatgaagcagcgggtcaagctggcccaggcgctggtccacgaccccgacctgctgctgctcgacgaacccaccaacggcctggacccggccggccgggacgccatgctcgccctgatccaccggatcggcaccgagttcggcatctccgtggtggtctgctcgcacctactcggcgaggtcgagcggatctgcgactcgctgatcgccatccagggcggccgactgctgcgtgccgaccggatctcctcgatgaccgccgcctccgacgtgctggcggtcgaggtcaccgagggcaccgaccagctcgccgcccggctcaccgaggccggcctgcgggtcacccgggagaaccggatgctgctcgtcccgatggactccgacgaggcgtacgaccggatcctgcgcgcggtgaccgacctcgaactcaacctgcaccgcctggaccagcgccggcaccgtgtcgccgagctcttcaccgcgaaggagaccgccgatgtctga

SEQ ID NO: 2131 - DNA, 1227 bp, Actinoplanes utahensis
gtgagacagaccttacgttctgccgcgttcggcaccgccttcacgatggccgtggcggtcactctggcctgggcctggaccggcggcgtggagcaactcggccggctgcccgccggcgacccggtggtctccgccgcaccggccggcccacacccgggcacgacggccggcaccgcggccgaccccgcgccgcccggctccgcccggctccgccaggccgtgctcagcggcgccgacagcccgctgaccgggagcttcccggcccgggccgccgtccaccggacctgcaccaccggccggctgctggtgcccacctgcggcatcctgtggggggtggcgcccggtgcgcgcaccgacgaccacggggccgaggcgctcgccgagttcgagcgcaagaccgggcggcagcaggccatcttccacgcctaccaccacgggatccggcagctgttcccgacgccgcaggagatcgcgatcgcccggcagcccggcaagaagcggatcctgctgctcaactggaagccggagagcgcctcctgggcggcgatcgcgcgcggcgaccggcgtaccgacgcgttcctcgaccagctcgcggtgcacctgcaccgcgacttccgggagccgttcttcttcgcgatccaccacgaggccgaggaccaggtccgggaacgtcccgggtcggggtacaccgcgaaggactacgcggcgatgttccggcacgtggtgcggcggctgcgggcccacggcgcgacgaacgtggtcaccgtgctggtgcacatggcgtacgtgccgcacaccacaaagagctggttcaccgacatgtacccgggggactcggtggtcgactggatcgggttcgacacgtactcgtacagcgaccccggttacggccacggcgacttcgccgagctgctcaaccggcgctccgcgctcaagccgcgctggcccggcttctacaactgggtgcgcgccgcccacccccgcaaaccgctgatggtcgccgagtggggggtgtggttcagcaaacgccaccccgggcacatggccgcgttctaccgcgaggtgggccagcagatcgggcatttcccggcgatcaaggcgatggtgcacttcgagacaccggccaaccagaagggccaggactcgtcggtggactgcaccccggccgccctgcgcgaatatcgcaagctgggccggcttccggtcttccaggtcgcggtccgctga

SEQ ID NO: 2132 - DNA, 1521 bp, Actinoplanes utahensis
gtgagtggctcggtactgcccgaagacgtcctccgggacgcaccctcgttcgcgccgcgcccgtacgagctggccgatctcgaactgctgctctccggggcgtacgcgccgctgaccggattcctggtccgcgccgacctggtcgcgctggcccgcaccgggcgactggccgacggcaccccgtggccggtcgcggtgaccctggagatcccgctcgacctcgccgagcgcctgaacccggccgacccggcacggcgcaccgtggtgctgaccgacctggagggcgcgccgatcgccgcgatcgaggcgcgcgacgtctggcggatcgccgacaaccggtacggcgtgggcggcccggtgcagcggatgggcgacggcgggcacggcccgttccagcgtctgcgccgctccccggccgaggtcaaggcgctgctgccaccgggccgggtgctcggcgtgatcgccgaccggccgctgcaccgcccgcagctcgcccagatcgcgcacgccgcccgcaccctcgcggcccacctgctgatcatgattccggtgagcgggcacgggccggacggcctaccgcccgaggcactggtccgggcggtcttcgcggcccgcgaccggatgcccccggccaccgtggtcgcggtcccgctgatgccgcacggcgacgagatgcgcgacgcgctgctgcgctcccgggtcgccgcggcgtacggcgtgacccacgtgctctccaccggcgagtcgctctccggagccgggctgcgggtactggtgccgcgcgaactcgcctacgacaaccgggacggccagtggcgctggcgcgacgacatcccgccgcgcaaccgccggctggcgatgaccccggacgagatcgacgacctgctggaccgcggtttcccgctgcccgagtggcacaccccgccggcggtcgccaaggaactggcccgggtccggccgccgcgccggcaccgcggcctggtgctgttcttcaccggcctgtccggctccggcaagtcgacgatcgcccgcaacctggccgacgcgctgcgggagaccggcgagcgcacggtcaccctgctcgacggcgacgtggtgcgccgggagctgaccgccgggctgggcttcagcaaggccgaccgggaccgcaacgtgcgccggatcggctgggtcgccgccgaggtcggccggcaccgcgggatggcggtcgcctgcccgatcgcgccgtacgaggcggcccgcaccgcggtgcgccggatggcggccgaggcgggcgccgggttcctgctcgtccacgtggccaccccgctggaggtctgcgagcgacgggaccgtaagggcctgtacgcgcgggcccgggccggtcagctgcgcggcatgaccgggatcgacgacccgtacgaggagccgctggacgccgaactgaccatcgacaccagcacgatgtcggtggccgaagcggtcgagatggtcctcggctacctggtcgagaacggctgggtggagcccaagctgagctga

SEQ ID NO: 2133 - DNA, 1848 bp, Actinoplanes utahensis
atgcgtggtggtttcaccaaccctgcgaggcatggggtcgagctgacccatcactcgcggctgggagtgggcgttagcccttggggcgaaacgcccaaaatcctcctcgaaaggccgcggaaaccgatggaagcgtcacgcccaccgtcctccgatgtcgcgcactacctgggcgcggttcgccggcactggtggatcgccctggtggccacggccgccggcctgggcgtgggcgccgccgtcacgcactcgctcccgcgcgtctacgagtcctcgtcgtcggtcctggtccagtcggtcgaccaggacgtgaacgcgcagggtggccgcaccaagggcgcggtcaacctggacaccgaggcccagctggtcggttccggcgcggtcgccgccaaggccgccgcgctgatgcgcaccacggtgtcgccgctggagctggcgcattcggtgtcggtgcaggtaccggcgaacaccacggttctggtgatcactttccaggcggacaccccgatgaaggcccaggccggttcgcacgcgttcgccgaggcctacctgcgcaaccgtgaggagaccgcacgcggcctgctggacaagcagatcgcctcactgaacctgaaggtcaagcagctcaccacggcgctcaccgggatcaacgccaagctggccgacgcccggccgggcagttccgcggagagcaacctgcagagtctgcgcagcaactcgcagaaccagctgaacagcctcaccggccggctcaacgagctgaccaccaccacggtcggcgccggcgcgatcatcagcgacgcccggctgccggacaccccgtccagcccgaacacgctgctggacatcgccaccggcggaatgatcgggctgctgctcgggctggccctggcgtacctgcgggagcggttcgaccggcgcctggtgaccgcggccgacgtgcgtgaccgcggccgggtcgcggtgctggccacgctcgacgagcggaccacgccgcacttcgacgacgtgctgcagccgtacgggccgggcggccgcgtcttcaaccgcctgcgcaacgaggtgctggccagcctcgacccgcacgaccgggtgatcgtggtgaccgggaccagccgcggctcggcgagcacgctggtcgcggcgaacctggcggccgccctggcccgcaccggcagcgacgtggtgctgatcggcgcgcacctgccggacagcgtggtggacgccgcgccactggcccggatgctcggggtcgccccggtgcccggcctgtccgagatgctggccggccgggtgtcgctgagccgggtgctgcagcacaccgcccggatcccggcgctgcgggtgatcaccaccggcggcgcggcgaccgcggccgggctgatccagtcgcagcggctgcgcgacaccctggaggcgctgcgccggcagggcgggtacgtggtgatcgaggccccgtcgaccagcagcagcgccgacgcgcagagcctggccagcctcgccgacgcggcgatcctcgcggtcgagctgcgccgcacccgccggccggccctggtcgacgcgaccgagcagctgcagcgggtcggcacccggctgctcggcgcggtggtgctgccccggctcaacgtcaagcacaccgccgagccggccgccgcgcccgcggtgaccctgccgccgaccggcaccgagccggtcgtcgaggaggccacccagcagctgtcggcactcaaggaccgcggtgagccggtctcggccacggtccggcagcggccggccgacggcgacaccggcgagcagacctcggttgtcgaaggctcgggcgccacggacggcgacgagaagtga

SEQ ID NO: 2134 - DNA, 1374 bp, Actinoplanes utahensis
gtgatcacggtcgtcccggcggcgccgcccgccggaccggcccagcaccgggccggtaaggacctcagcctgccggcctggccggtgaccgggatcctgctgctctacccgctctggtgggcgctcggcctgggcgtgctgatcttcccgctggtcgccgcgccgatgctgttcctgctgatccgccgccgggccgcgggccgcccactgcgcctgccaccgggcttcacctggtgggtggtgttcctggtcgcggtggtggtgagcatcgccgcactgggcgccgacccggcgcagaccgtggtcgagcgggccgtcggccggctgcccgcggtgctctacaagctggccatgtacctctcgctgaccgtgctgctggtctacgccgggaacctgaccgagcgggagctgccgcggcggcggatggtccggctgctggccggcatgttcgtgctgaccgtgctgggcgggctgctcggcatggtggccgggcacttcgagttcacctcgccggtcgagtggctgctgccgcagggggtgcgcagcaagggcttcgtccggtcgctggtccacccgtacgccgcgcagatcatggacatcgtcggcggtgacgccccgcgtccggccgccccctgggggtacaccaacacctggggcaacaacttctgcctgctggtgccgtggctgctggtggccgcggcggccgcgcgcagccggggccggcgcgccgtgctgtgggtgttcctgctggtctcgatcgtgccggcggtcgtctcgctgaaccgcggcctgtggatcggcctggggatcatcggcgggtacgccgcggtccgctacgtgctggccggcaagttgtgggtgctcggcgtgctgctggtggcgggcggggcgctcgcggtggcgctggcggccaccccgctgggcaccaccgtgcaggcccggctggacaacggcaagtcgaacggggtccgctcgttcctgatcgagcgggccatggccgggttcaccggttcgccggtgatcgggtacgggggcacccgcaacaccctcggcggccgcaactcgatcacggtcggcgagagctcggagtgcgagcgctgcggcaacttcacgatcggcggcaacgggcagctgtggcagctgctgtattcgcacggcgcggtgggcaccgcgggctacctgggcttcttcgcgtacgggctgtggcggttccgccgggaccggaccccgatcggggtggccggcagcgccgcgctggtcagctcgttctccgcgatgctctggtacaactcgctggtcacccccctggctttcatggttctggcgtacgcgctgctctggcgcaactggatcgaggggaacgacgacaattga

SEQ ID NO: 2135 - DNA, 1239 bp, Actinoplanes utahensis
ttgagtccggtcaaaacggcgccagccgagctcacggcgggcgacgccgcactgcgtacccagtatctgaccgaggtcatggcgctgctctatccgccgccgtgccgccccgcccgcgaggacgacggtgcgggcaacacgatcgtggaatacctggtggtgccgaacgcgcaccgcccccgcctgctggtgccgaacacctccgccgcggtcgccgcggccgcggtccgccggtacgccgagccgcagtcccggatggcccggttcaagcgggacgccgtggtggccgcggtccgcacccggaccgaccggctggtcttccgcgaccggatccgggtctccggcccggtgtcggccagcatcgacggctacctcagcgacgcgctgcggcgcgacctgtcggtcagcgtccacatcggcccggcccgggccaaccgcaaaccggtgctgcagttgctcaccccggacggcgagaccttcgcgttcggcaagatcggtgccgggccgctcacccagcgcctggtcaaggcggagaccgcggcgctgaacgcgatcggctccagcggactgaccaagctgaccatcccccgggtgatgcacgccgggcagtggcgcggcatgcaggtgctggtccagtcggcactgccggtgtggctgccgcgcgcgccgctgaccccgcgccggctcaccgccgccatgctggacatcgccggatgctgcggctacaccaccggaccgctgacccagagctcttactggcacgagctgcgggcccggctggccgcggtctccgaccgggccgagggcgccgcgctgtccgccgcggtcgacctgctcgccgcgcacagcggcgagcacaccctgcgctacggcgcctggcacggcgactgggccccgtggaacatggccaacctcaccgacgcgctgctcgtctgggactgggagcggttcgccaccggggttccgctcggcttcgacgcggtgcatcacgagctgcagagacggatccagaccagcggtgacgcgcggggtgcggtggaggccaccgtgcgccgggccgacgagctgctcgcgccgttcggggtggccgcggtggcccgcgagacgaccgccctgctctacctggtcgacctggccgtgcgctacctgaccgaccgccaggccgaggcgggcgcccggctgggcgtgctcggtacctggctgctgccggtgctcatccggcgtgttgaggagctgtga

SEQ ID NO: 2136 - DNA, 879 bp, Actinoplanes utahensis
atgaacgtccgcaatctgcccgcgccgatgaaggcggtggtgcacctgggctcccgctcgtacggccggctcaccgccgaccaccggatgctgccgtccttcctgatctgcggcgggcagcggtgcggcaccacctcgttgtaccgggcgctggccgcacatccggtggtgctcaaggcggtgctccacaagggcgtgcactacttcgacacgtcgtaccaccgcgggctcgactggtatcgcgcgcatttcccggcgcggcgggcggccgagaagatcgccgagcggttcggggtgccggcacagaccttcgagtccagtccgtactacatgtaccacccccaggcggtggcccggatcgcgcgggacctgccgtacgccaggatcgtggttctggtgcgcgatccggtggagcgcgcctactcacagcatcaccacgaggtggcgcggggtttcgagaccgagcgtgacttcggtgcggcgatggcgctggagccggcccgcctgcaccggcaggaggaacggctggccgacgacccggcgtactacagcttcgcgcaccagcaccacgcctaccgggggcgcggcgaatacgcccggtatctgagcgtgatggcgcagcacgtcggccgggaacgcatccacgtggtggagagcgaacggttcttcagcgacccggagccggtgtacgacgaggtctgccacttcctcgggctgccaccgcacctggaacgaccggccttcgagcggcacaacgcccgcccccggcaggccgacatggacccgcagctgcgccgggaactgggcgcctactaccagtcccacgacgaggcgctggccggctggctggggcacacgccgatctggcgccgcgggtga

SEQ ID NO: 2137 - DNA, 1557 bp, Actinoplanes utahensis
gtgacggccggcccgctgaccgacccggcgccaccgcgggccgatccgggccggggcactcgcggcgcggcccgtggcggactcgccaacatggccggatcggcactggccggaggcgccggcgtgatcgtcacctgggtggtggcgcgtcgcctcggcaccgacgaggcgggcgcgttcttctccgccaccgcagcgttcgtgctggccggcgggctggccaagctgggcaccaacaccgggctggtctactggccggcccggttgcgggccaccgggcgtgctcacctgctcggcacctgcctgcgtaccggcctcgtcccggtcttcgtgttctcgctgatcctcgcggtggcggtgtgggccggcgcgccgcagatcgcccgggtcaccgcgcacgactcggccggtgcgtacctcaccggtttgcgggtgttggccgtcttcatcccgctgcaggcactcaccgacgtgctgctgacgatcactcgtgggtaccgctcgatgcgccccaccgtgctgctggaccggacgctgcgcagcgcactgcaattgctcggggtcggtgcggccggcctcctggcggcagcttcgctgccggtcttcgcgctggcctgggccgctccctacctcccggtgaccctgtttgcggcgtacgcggtgaggcggctctacctgaccggacgccccgccgcggcggccagccgacgggccgaacgccggcagctgcaccgggaattctggcggttcaccgcaccgcgcgcgctggccgccgtggcccagctcgccctgcaacgggtcgacgtgctgctggtcgccgcgctgggcggcctcgggccggccgccgtctacgcggtcgccggccggttcgtgatcctgatccagttcgccaaccagggcatctcccagtccgtgcagccccggctggccgaggcgctgagcatcggcgaccgggacgccgcgaatcgcctgtaccaggtggccaccggctggctggtgctgatcacctggccggtcagcctgctcgtcatcctgttcgcgccgtactacctccgtgtcttcggcgccgggtacacggccggcaccccggtggtccggctgctcgcggcggccatgctggtcgccaccggctgcggcatggtcgacatggtcttgtcgatggccgggcgcacctcgctgaacctcggcaacgtgctgatcgccctggtcgtcacgatcggcctggacgtggtgctgatcccccggtacggcgcgatgggggccgccgtgggcctggccggcgcgatcgtcgccaacaatctgctgccgctgatccaggtgttccgcggcgcccgcctgcatccgttcggcccgggcacccgggccgccgcgctgctctcgaccggctgcttcggcctgctgccccgggcggtgaccgccctgctcggggacggcccggccggactggcgccggccgtcgcggcagccgtgccggccttcgccgccggcgcctggctgctccggggccggctcgaactcggcgcgttcacccgacgaaagacccaggaggcgagttga

SEQ ID NO: 2138 - DNA, 738 bp, Actinoplanes utahensis
ttgaccagcgattacaccgaggtgttccaggacaccgaggcggtcgagaagtacgagtcgatcacgtacgcgccggacagttacgcgtcccgcatcaacgaccggcagcgcgactacctgcgtgccctggtccgccgcgaattcgagggtcagcacccgccggtccagcacgacttcgcctgcggcaccgggcgggccatccgcaccctgcacggcctggtccgggaagcgcacggatacgacacgtcggccgagatgatgacgaaagcggccgaggtcggctcccgcgcgtactggcaccgggtgtcgatcgacggaccggtcccggcgccggtcgcggccggcttcccggccatcgtgaccatcttccggctgctgctcaacgtggacgacacggtccgcgaccgggcgctcgccttcgccgcgaaagccctgccgcaccgcggctccggcctgctcgtcgtcgagaatcacggcaacgccggctccgtccggcacctgcgggcccggcggcaccagggcgaacgctggttcgccgagctctcccacgaggaggtcgcggcgctgctcgaccggcacggcttcgagatcgtcgaacggcgcggcttctccatgctcaccccgtccctgcacgacaaccggctggcccggctcgccgacgcggccgcccggcggctgcccggcaccgacggttacgcggtgaacgtgctgtacacggcgcggcgggtccatgcgtag

SEQ ID NO: 2139 - DNA, 1008 bp, Actinoplanes utahensis
atgcgtagggccgggctcggcggggtgctcgtcggcgtactcctcatcctgtccgcctgcagtggcagccaccgcgggaatcccgcgccgccgccgtcgccggacctgaccgcgcggccgccggccatcgcggtgcaggacggtccgttcgccgccggaccgttcacgcctccggcgacgggggcgtacgtcggcgcctggatcaagccggaccagctcacccacatcgggcgcctggaagcggtcgacacgttggaggcgtcgctgggtcgccggctcgacatcctgaacacgtatcgtcgcttcgaccagatggtcgggaccgaatccgatcaggagttcctggctcaggggcagtcgctgatgatcagctgggcgaccggcgacaaccggtccatcctggacggcgaacacgaccggctgatccggcagcaggccgaggcgatccggaggatcgggcggccggtgctgctccggatgcgctgggagatggaccggcccaacctgcgggccaccatgtggtccggcgccgactacatcgcggcgtggaagtacgtgcgggcgatcttccagcgggagcacgcggacaacgtgtcctgggtgtggtgcccgaccgccgaaggcttccagcgcggggatgcccagcagttctacccgggcgacgatcaggtggactggacctgcgtggacgtttacgccggcgccgacttccagccgatcgggcaactcatggggcccttcctgcagtgggcggcacaacggccgaaaccgatcatcatcggggagttcggggtggcgaaagcctggggatccgcgaaccgggcggcgtggctgcgcgacgcggaacgcaccttcaaggcgaaccggcagatcaaagcggtcgcctatttcgagtcggacccgacggggaacgggcccaaccagcagttccagctgagcggggacaaggcggctttcaaggcgttccacgcgctcgccaaggatccctacttcaacgtcgggcgctga

SEQ ID NO: 2140 - DNA, 375 bp, Actinoplanes utahensis
atgaccttccgcatcgacgacctgcaccacgtccagctcctgatcccgcccggcggcgaaccggtggcccgcgccttctacagcggcgtcctcggcatggccgagatcgtcaagcccccggtcctggccgcccggggcggttgctggttccgcgccggcggctgggaggtccacctcagcccggtccccgatttcgccccggccaccaaggctcaccccggcgtcctcgtccgcgatctcgacgccctggccgaggtcctgacctcggccggccacccggtcgagcgggatccgcacttcccgggccaccaccgcctctactccgccgacggccacggaaaccggctggagttcctggagcccatccggagttga

SEQ ID NO: 2141 - DNA, 540 bp, Actinoplanes utahensis
atgtccgacttcttccgtgagcagaccgagatcatccagcagttcggctgggccgtggtgcatgtggtgcccaccgacgaggaagcggccgacgacgtggcgccgttcgcctacacggtcgggctgaccgccgacagccacccggagctgatcatcgccgggctgccgcccgacctggcccaccagctgctcaacgagctggccgggcgggtgcacgaggagggcgcccggttccggcacgggcgacgggtgaccgatctgatcgtcgagcaggacgtggtgctgctgaacgggtcgccgaccgcggaactgtggccgggcgccgccctcgcgcggtatgggcggcgggtccgcctgcaacagctggtctggcccgacccgggaaaccggttcccctggcaggcggggtattcggatgccgaccacgcccagccgctgatcgacgcgccgccggccacgatggtccgttgcggttcgccgcgcgggttggccggcccgcgcgggcggcgttccgtcacccgccgcggcccgatcccctga

SEQ ID NO: 2142 - DNA, 1224 bp, Actinoplanes utahensis
gtggttatcgaggctttcgaccgcgtgcacctgggtggcaccggcatcgaccggatcaccgaggacgaggtggtggcggtcgtccgcgacgccctctcgcacggccgcggcggccgcatcatcaccccgaacgtcgacatcctgcgccgcgccgccgaagacccggccgcccgccgccacctcgacgacgccgacctgatcgtggccgacggcatgcccctgatctgggccagccgcctcggcggcgtccccctgcccgagcgggtggccggcagcagcctgatctggaccctctccgagggcctgggccgcgacacccgctccatcttcatcctcggcggcacccccaccccgcgaaccctgcacgccctccccggcccggcctcgtcctccccggaccgcgcgctcgccgctctccgcgacccggcctcgttcaccaccccggaccgcgcgtccgccgcccccggcgaccgttcgttttccgccacccccgaccgcgcatcgtccactgccccgggccgcccgtttgccgtcctttgcgatcgcgcgccttccggcgccccggaccgcgacttctcggctccggggaccgctgccgcccccgccaccgaaacgctggtctggaactccctctccggcgaaacctggacggcgaatgtcccggtcgccgagtccgtcactcggcgcccgcctgccgcgccgacgtcgggcgatatcgtgccggccgacccggccgcggaagccccgatcgtcggcggccgggggtccgcgcccgccaccggcgtcacggtccgggacgtgcgggcgtccggcgcggtccgggccgcggtgcgcctcgccaccgcgaaccccggcctgcggatcgccggcgcgctcagcccccctttcggtttcgacgacgacgagaacacctacgccgaggtctgcgcccgggtcaccgccgcccagccggacctggtcttcgtcggcctgggtttccccaggcaggaacaggtcatcgaacgcctccgccgcgacctcccggccacctggttcgtcggttgcggcgccgccatcaacttcgtcgccggcgacatccaccgcgccccgcgctggatgcaacgcaccggcctcgaatgggcccaccgcctcaccaccgaacctcgccgcctggcccgccgctatctgcgccacgacgctccatatgccctccgcctcctggcccgggcccgactagctagctag

SEQ ID NO: 2143 - DNA, 933 bp, Actinoplanes utahensis
gtggcacaagtgctatttctgggcggattagggcgaagcggcacgacgctcgtggaacgcctgctcggtgagctgcccggggtctgcgcgctcggtgaggtcgtccacctgtggcagcgcgatctacgcgacgacgaacgctgcgggtgcggggagcggttctccggctgcgacttctggaaacgggtgggcaagcacgccttcgacggctggaacaacgtcgacgtggaccgggtgcacgcgttgcgggacgcggtggagcgaacccggcacatcccgcggctggccgcgaccacccacccgggcgccgcggtgcgggagtacgccggctactacgccaaggtgtacgccgcggccgccgaggtgtccggcgccgacctggtcgtcgactcgtccaagcattccgccctggcgcacgtgctgcgcgcggccggccaggtggatctgcgggtgctgcacgtggtccgggacgcgcgcggcgtcgcgtactcctggaccaagcgggtggcccgcccggagaccgacggcgcgcaggagatgacccgctactcccccggccggtcggcgctgctctggaacgcgcacaacgccgctttcgggctgctggcccgccgcggtgtgccggtccgccggatccgctacgaggagttcctggccgacccgcgggccgcgctgatccggctggccgatttcgccgggctcaccctgcaccccgaggacctggacttcctgcgcccggggcacgccgacctgcgggccgggcacagcgcggccggcaacccgatgcggttcaccgtgggccggctgccgctgcggcacgacgacgcgtgggtccgcgccctgccgaccgtgcagcgccgcctggtcggcgcggtgtgcgcgccgatgctccgcgcgtacggctaccccctgaacccgcaggagtcacgatga

SEQ ID NO: 2144 - DNA, 915 bp, Actinoplanes utahensis
atgaactggccgtcggtcggggtcgtcatccccactcggaaccgccccgagctggtccgacggtcgatcgccgcggtgcgcgcccagaaatatccgggtgagcttcgggtggtcgtcgtctacgaccagaccgagccggattacctgctggcgcagaccgacggcgtaccggtgctggtgttgacgaattggcgggccgccggcctggccggcgcccggaacaccggggtgctggccctggacaccgagctggtggcgttctgtgacgacgacgaccgctggctgccggacaagctgcgtcgccaggtggccgcgctgctggccgagccggacgccgaattcgccacctgcgccatcgaggtggagttcgaggggcacaccacgccgcggctggccggccggagccgggtgacggtcgacgacctggcccggtcccggatggcgatgctgcattcgtcatcgttcctgatccgccgggaggcgctggccgaggacgcggtgggcctggtcgccgaggatgcgccgggcagccagaacgaggattgggatcttctgctcagggcggcgcgccgctcgccgatcgtgcatctggacgagccgttggtgcaggtgctgtggggccggagttcgcactacgcgtacgagtacgccaccaagatctcctcgctgcgctggatgatgcagcggcacccggagatcagtggctgccgcccgggggccgcccgggtgtacggacagctcgcctgctggtcggcggcgaccggaaaccgcagccaggcctggcagttcagcaaggaggcggtgcgggcgaactggaaggaaccccggaccgcgatcgcgctggccgcgatgaccggagcggtgaaggtggagaatgtgctttcagcgctgcacaagcgaggacgtggtatctga

SEQ ID NO: 2145 - DNA, 777 bp, Actinoplanes utahensis
atgttggcccagcaacgccaagccgcgatcctcgaccgggtccgcgccaccggcggcgtccgggtcagcgagctcgccaccgagtacggcgtctccgacatgaccatccgccgcgacctggaagccctggccgaccgcgggctgctcgcgaaggtacacggcggtgcgaccacggtcagccccggttccgcacacgagccgggcttcgccgccaagtcggtccgccagcgcgacgagaaagccgcgatcgcggcccggggcgccgccctggtctcgcccggcgacgcgatcgccctctcggccggcaccaccaccgcggtgctcgcgcagcggctggtcgacgtgccgtcgctgaccgtggtgaccaactcgatcccggtcgccgacgtcttctaccgcgccggccggcccgaccagaccgtggtgttgaccggcggcacccgcaccccgtccgacgcgctcgtcggcccggtcgcggtggccgcgatcggcaccctgcacctggacatgctgttcctcggcgtgcacgggatgagtgagcgggccggctacaccacccccaacctgatggaggcggatgtcaaccgcgccctggtcgaggcggccgagcgtctggtcgtgctcgccgacagcaccaagtggggcacggtcggcatctcgtcgatcgtcccgctggagcgggccgacgtgctgatcaccgacgacggcctggacaccgccacccgcaccctgctcaccgaaaccgttcctgaactcgtggtggtgaacccccagtga

SEQ ID NO: 2146 - DNA, 1095 bp, Actinoplanes utahensis
gtgacgttcttccgctcgaccgtcgcactctccgacgggcgcgagctcatctacttcgacgagaaggccgattccagccgctcggcgttcccggacacccgcgagctgccaccaccgccgccggcgtcccagttgcggtacgacccgctggtcgacgagtgggtggcggtcgccgcgcaccggcagacccgcaccttcctgccgccgtccgacgcctgcccgctgtgcccgagctcgtcgcggttcgccagcgaggtcccggcgccggactacgacgtcgtggttttcgagaaccagttcccgtcgttcagctaccgcgaggtgccgggcggcgacatcaccgagctgaccgacatggtgccggtcaagccggggctgggccgctgcgaggtggtctgcttcaccagcgaccacaacagctcgttcggtgcgctgccgccggcccgggtgcgcaccgtgatcgacgcgctggccgaccggaccaccgagatgtccgcgctgccgggcgtcgcccaggtcttcccgttcgagaaccggggcgtcgagatcggggtgacactgcaccacccgcacgggcagatctacgcgtacccgatggtgccgccgcgcaccgccgccatgctgcgggccgccgccaagcacgcggagcggaccggcgggcgcaacctttacgccgacgttctcgccgccgagcaggaggcgaaggtccgggtggtcgccgccaacgagctgtggacggcgtacgtgccggccgccgcccgctggccgttcgaggtgcagatcgccccgcaccgacaggtccccgacctgcccgcgctcaccgacgaggaacgcgacgcgctcgccccgctctacctcgatgtgctgcgccggttcgacggattgttcggcaagccgatgccctacatctcggcctggcaccaggccgtcgtcggcgagggccgcgacctcggctacctgcacctgcagatcttcagcatccgccgggccgccgacaaactgaagttcctggccggctcggagtcggcgatgggcgccttcgtcagcgacgtcgtcccggagaaggccgcgcagctgctgcgcgacgccggctga

SEQ ID NO: 2147 - DNA, 1215 bp, Actinoplanes utahensis
atggcgaaaatcaaggtcaagaacccggtcgtggagatcgacggcgacgagatgacccggatcatctggaagcagatccgggagcagctgatccagccctacctcgacgtcaacctcgagtactacgacctcggcatccagtaccgggacgagaccgacgaccaggtgacgatcgacgcggcgaacgcgatcaagcggcacggcgtcggcgtcaagtgcgccaccatcaccccggacgaggcgcgggtgcaggagttcggcctgaagaagatgtggcggtcgccgaacggcacgatccgcaacatcctcggcggcgtcgtcttccgtgagccgatcatcatgaagaacgtgccccggctggtacccggctggaccaagccgatcgtcatcggccgtcacgcccacggcgaccagtacaaggccagcgacttcgtggcgcccagcaagggcaagatgaccgtcaccttcaccccggaggacggttccgcgccgatcgagatgcacgtggccgacttcccggccggcggcgtcggcatggccatgtacaacttcgacgagtcgatccgcgacttcgcgcgcgcctcgctgcgctacggcctggcccgcaactacccggtctacctgtccaccaagaacaccatcctgaaggcgtacgacggccgcttcaaggacctgttcgcggagatcttcgagaccgagttcgccgaccagttcaaggaggccgggatcacctacgagcaccggctgatcgacgacatggtcgcggccgcgctcaagtgggagggcggctacgtctgggcgtgcaagaactacgacggtgacgtgcagtcggacacggtcgcgcagggcttcggctcgctcggcctgatgacgtcggtgctgatgaccccggacggccagaccgtcgaggccgaggcggcgcacggcacggtcacccggcactaccggcagtggcagaagggcgagaagacgtcgaccaacccgatcgcgtcgatcttcgcgtggacgggcgggctcaagcaccgcggcaagctggatgggacgccggaggtcacccagttcgccgaggctctggagcaggtctgcatcgagaccgtcgagggcggtcagatgaccaaggacctcgcgctgctgatcagcaaggacgcgccgtggctgtcgaccgacgagttcatgaacgcgctcgacgagaacctggcgcgtaagctcgcctga

SEQ ID NO: 2148 - DNA, 600 bp, Actinoplanes utahensis
atgaacgaagcacggcacgtcgccggtgagcggttctccggtgcggactgggcgctcgacgagcgggaacgggtccacttcgaggactgtgtgttccatgacgtcgactggagcgagtccaccttcaccgcgtgcaccttcgagcggtgtgagttcggcaactgccgcttcaacgcggcggtcttcgagcggaccgcgctcctgcagtccacgctgcgtcgctgctcgttcttcggcaccaccttcgacgactgcaagctgaccggcagcaccttcgacgactgcgggctgcggcccctcaccgtgcacggcggcgactggggtttcgtcagcctgcaagggcagaacctgtccggtgtcaggttcggcgcggtccggctccgcgaggccgacctgagtggggcggatctcaccaggaccgacctgcgcggcgctgacctgtcgaacgtgcggctggccggtgccgtgctgaagggggccgacctgcgcggcgccgacctggacggcgcaccgctgcgcggcgtcgacgtgaccggggcgaaactgaacctggcccaggccgtgcacttcaccagggcctatggtgcgatcgtcagctga

SEQ ID NO: 2149 - DNA, 684 bp, Actinoplanes utahensis
atggtgagtgacgctgagctgatcgagaagcgggacttctcgagggtcaagagcatcggcagtcatcggacgctggcgggcttccacctggtccggtgcgagttcgacggttccagcctggcgcagttcgacgatccgggcctgaatctggtggtccgggacgcgaggctgacccgttgcgtgtgcaggcaatcgtcgatccagggcgtccggttggaggacgtgctggtcgacggggtgaccatgagcggttcgctcaatctccacgggtgcgcgttgcggcacgtcaccctgcggggccgggtgggcagatggttcatcatgccgccgaatccgtcgctgcccgccgaggtgcgcgaggcgttcatgatcgcgatccagcggttctaccgggacgtggactgggcgctggacatctcggcggccgagttcacctccgcacaactgcactatgtgccgggcgagctggtccggcgggatccggagacccagttcctgctgcgccggcacgtcgtcgaagcggtcgatccggccgagctgccctcgttcggctcgatcgcggtgagccgcttcgagacgactccgctggattgcatcgtggcggctgccccgaagcggtcctcgaatttcgcggagattctggatcacctccagcagatgcggaaccgcggcctggcggagtag

SEQ ID NO: 2150 - DNA, 1560 bp, Actinoplanes utahensis
gtgagcaccgatgagggccgccgtccgatcaagcgggcgctgctgagcgtgtgggacaaggcgggcatcgtcgagctcgcccaggcgctgcacgcggccggcgtcgagatcgtctcgaccggctcgaccgcgtcgaccgtggagaagtccggcgtgccggtgacccgggtcgaggatctgaccggcttcccggagatcctcagcgaccgggtgaagacgctgcacccgaaggtgcacgccggtctgctcgccgacctgcggctggagagccatgcggcggagctggccgagcacgggatcgagccgttcgacctgttggtcagcagtctctacccgttctccgagacggtcgcctccggggccggcgaggaggagtgcatcgccaagatcgacattggtggcccggcgatggtgcgggccgcggcgaagaatcacgcgtcggtcgcggtggtggtctccaccgcgggctacccgtcgatcctctccgcgctgcgcgacggcgggttcacgctgaaccagcgcaaagcgctggcctccacggcgttcatcaacatcgcggagtacgacatcgcggtggcgaactggacggccagcaccctggcgcccgcggactggccggacttcgccgggatcgctctgcgcaagcaggacaccctgcggtacggggagaacccgcaccagcaggccgccctctacctcgaccccgccgcgcccgccggcctcgcccaggccgagcagctgcacggcaaggagatgtcgtacaacaactacgtcgacgcggacgccgcgtggcgcagtgccaacgacttcaccgagccggccgtggcgatcatcaagcacgccaacccgtgcggcgtcgcgatcggcgcggacgtggccgaggcgcaccgcaaggcgcacgagtgtgacccggtctccgcgttcggcggtgtgatcgcggtcaaccaggaggtgtccgccgagctggcccgccaggtcgcggagatcttcaccgaggtgatcgtggcgccggccttcgcgcccgaggccctggagatcctgcgcgagaagaagaacctgcgcatcctggtcgccccggcgtggaacccgccgccggccgaggtgaagcaggtcggcggcggcatgctggtgcaggcggccgaccggatcgacgcgaccggcgacgacccgtccggctggaccctggccaccggtgccccggcgtcgcccgaggtgctgcgcgatctggtcttcgcgtggcgggcgatccgcggcgtgaagagcaacgcgatcctgctggccaaggacggcgccgcggtcggcatcgggatgggccaggtcaaccgggtcgactcggcgaaactgtcggtggcccgggccggcgccgagcgggcggccggcagcgtcgcctcctcggacgcgtacttcccgttcccggacggcctggaggtgctgatcgaggccggcgtcaaggcggtcgtccagcccggcggctcgatccgcgacaacctggtgatcgaggccgccgagaaggccggcctgaccgtctacttcaccggcacgcggcacttcttccactga

SEQ ID NO: 2151 - DNA, 618 bp, Actinoplanes utahensis
gtgactgcgcccgcgcccgcccgcctggtcgtcctgatctccggatcgggcagcaacctgcaagccctgctcgaagccacccgcgacccggcgtatggcgccgaggtggtcgcggtcggcgccgaccgggacggcatcgccggtctcgaccacgccgccgcggccggtgtccccaccttcgtcgacgcggtcaaggcgtatccgacccgcgacgactgggacgcggcgctcaccgcgcacgtcgccgcgcaccggcccgacctggtcatctcggccgggttcctgaaactggtcggcaagcagttcctggacgcgttcggcgaccgctacatcaacacccacaacgcgctgctgccgtcgttccccggtatccacgggccacgcgacgcgctcgcctacggcgtgaagctggccggggcgacgctcttcttcgtcgacgccggcgtcgacaccggaccgatcatcgcccaggtcagcgtccccgtgctcgacgacgacacggaggagacgctgaccgagcggatcaaggtggccgagcgggcccagctggtcgacttcgtcggccgcctggtccgggagggctggaccattgagaacaggaaggtacggattccgtga

SEQ ID NO: 2152 - DNA, 1440 bp, Actinoplanes utahensis
atgcccagcacaaccgaccgtcccggcggctcggaggacccgttcgcggtcgccgaggcgctgcagtctgtcgtgcgggacaccgaggccccgccgatcgacgccgatcagcgcgacgagccgacgccgggcacccgggacaccgtcgtggtggacgaggcgatgctcggccgccgggagaccgtccgggtgccggtgcagcgccgcccgccggatcgtgccgggcgggccccgctcccggtcgcggtcgccttcgccacgatctgggcggccctgctcagctaccttccggtcgccgcggcgctcgggctggcccgcaccctggagggccagggtgggctggccggcgcggccaaggccggggcggccgcctggctgctcggccacggggtgccgatcggcacctcgatcgggtcactcgggctggccccgctgctgctcaccgtgctggtgctgtggcggctcggccgggccgggctgcacgtgacccgggcgatcggggcccggcactccggcggggtcggcgcggcgctgctggtcgcggcgtgcgtcggtgggacgtacgcggcaatcggcgccttgaccgcccacctgatcgacggtcgcggcacggatgtctccaccgcccgcgccgcgtccgattttctcgccctcggcgtggccggggcgctgatcggtgcgctgcgcggcagcgacgcggtgaccacgttggcccggcgggtcccggtcgtggtgcggcacggggtgcggaccggcctggtcgcggcgttcctgatggtcggggcgggcgccgcggtcggcggcctgtcggtggccctgggcggcggcgatgccgccaaaatcatctcggcctatcacaccggggtcgccggacaggccggaatcaccctggtcagcgtcgcctacgcggggaacgcggcgatctggtccaccgcctatctgctcgggccgggcttcgcgctcggcaccggctcggtgatccggctcacccagctcaccgtgcacgacctgcccaccctgccgctgctggccggcctgccgaacggtccggtgggcggcgccggcgcgctgctgctcgccctgccggtgatcgccggcgcggtggccggctgggtgctcacccagcggctgcggtacggccgggcgcacgcctggcggcccgggccgggttccggcgcggacgccccggaaccggcctggtcgctgctgctcggcgcgggtctgctggccggtccggtggccggcgtggtgctgggcgtgctcgccgcgctctccggcggcccggtgggggacggccggctggctcagatcggcccggcagcctggtcggtgggcctggtcgcggcgatcgtcgcggcgatctcggtgatcctgggagcgtcggcggcccgcatcttccgcgagccgcgcccgaagcgtcgtccgaacggccggcggtaa

SEQ ID NO: 2153 - DNA, 882 bp, Actinoplanes utahensis
atggctatctggctcaccaaggactccaaggtcatcgtccagggcatcaccggctcggagggctccaagcacacccgccggatgctcgccgccggcaccaacgtggtcggcggggtgaacccgcgcaaggccggcaccaaggtggacttcgacggcaccgagctgccggtgttcgccaccgtcgccgaggcgatcaaggagaccggcgccgacgtgtcggtcatcttcgtgccgccggcgttcaccaaggccgcggtggtcgaggcgatcgacgccgagatcccgctcgccgtggtgatcaccgagggcgtcccggtgcaggactcggccgccttctgggcgtacaacgtcagcaagggtgagaagacccggatcatcggcccgaactgcccgggcatcgcctcgccgggcgcctcgaacgccggcatcatcccggccgacatcaccccgcagggccggatcggcctggtcagcaagagcggcacgctgacctaccagctgatgtacgagctgcgcgacttcggtttctcgaccgcggtcgggatcggcggcgacccggtgatcgggaccacccacatcgacgcgctgaaggcgttccaggacgacccggacaccgacgcgatcgtcatgatcggtgagatcggtggcgacgccgaggagcgggccgccgagttcatcaaggcgaacgtgaccaagccggtggtcggctacatcgccggcttcaccgccccgcccggcaagaccatgggccacgccggcgcgatcatctccggctcggccggcaccgccgacgcgaagaaggcggcgctcgaggcggccggcgtcaaggtcggcaagacgccgagcgagaccgcgcggctcatgcgcgagatcatgagctga

SEQ ID NO: 2154 - DNA, 1293 bp, Actinoplanes utahensis
atggccgacgattcctcacgctggcggcgccactgcgacgcgccgcgcatacaacaggtcgggacgcaacggtgcggcttgccggcgcttggcgtcgcgagcgaaaggagacacgtggacctgttcgagtatcaggggcgcgacctgttcgaacggcacgggctgcccgtgctgggcggcggtgtcgccgagaccccgcaggaggcccgggcgatcgccgagcgactcggtggcaaggtcgtcgtcaaggcgcaggtcaaggtcggcggccggggcaaggccggcggcgtcaagctggctgacggtgcggacgaggcggaggcccgtgcgaccgacatcctgggcatggacatcaagggccacacggtccacaaggtgatgctggccgagacggccgacatcaaggaggagtactacttctcctacctgctggaccgggcgaaccgcaccttcctctgcatcgccagcgtcgccggcggcatggagatcgagacggtcgccgaggaggacccggagcgggtcgccaaggtcgcgatcgacgcgagcaagggtgtcgacgaggcgaaggcgcgcgagatcgtcaccgccgccaagttcccggccgacgtcgccgaccaggtggtcgacatcgcggtgaagctgtggcaggcgttcgtcgccgaggacgcgctgctggtcgaggtcaacccgctggccaaggtcggcgacggccgggtgctggcgctggacgccaaggtcaccctggacgagaacgccggcttccggcaccccgaccacgaggcgctcgaggacaagtccgcggtcgacccgatcgagcaggcggccaaggcgaagaacctcaactacgtcaagctcgacggcgaggtcggcatcatcggcaacggtgcgggcctggtcatgtcgaccctcgacgtggtcgcctacgccggggagaagcacggcaacgtcaagccggcgaacttcctcgacatcggcggcggcgccagcgcccaggtgatggcgaacggcctggagatcgttctcggcgacccggcggtcaagtcggtcttcgtgaacgtcttcggcggtatcaccgcctgtgacgcggtggccaacggcatcatccaggctctcgccctgctggccgagcgcggcgagacggtgaccaagccgctcgtcgtacgcctcgacggcaacaacgccgaggccggccgcgccatcctcgacggcgccaacaacccgctggtcgagcgggtcgacacgatggacggagcggccgcgcgcgccgccgagctcgcggctgcggggaagtga

SEQ ID NO: 2155 - DNA, 414 bp, Actinoplanes utahensis
atgcaagcacggatcagggtcgtcgtcgcgaagccggggctggacgggcacgaccggggggccaaggtggtggcgcgcgcgctccgcgacgccggcatggaggtcgtgtacaccgggctgcaccagacgcccgagcagatcgtcgagaccgcgattcaggaggacgccgacgcggtcggcctgtcggtcctgtccggggcgcacatgacgctgttccgccgggtggtggaactgctcgccgagcgcgacgccgccgacatcgtggtattcggtggcggcatcattccggaggacgacatcacggaattggaatcactcggtgtagccaaggtattcacgccgggtgccacaaccgcatccatcatcgaatgggttcgcgccaatgtcgggacccagcccgccggccagctctag

SEQ ID NO: 2156 - DNA, 753 bp, Actinoplanes utahensis
gtgcgccagcgcttgtcgtctgagcccgatcgctatcgcggccggcgtcgcgtgcccacccctccacgcagccgctacgccgccgtcggcgcggccgccttcgtcggagccgggatcgtcgccatcggcgccgcgtccaacctgcccgactccaaaacggtcaacccggacgtgctgtccagcctcgaccaggcgcagacccaggtcgccgcggacgccctgcagaaccgcgccggcacccacgcctcccgcagcgagaaccgggacgccgccgccaaggcgacgaccaagctctccgacgacgaggttgccgacgcctacctgctgccgctcgacgactacgagttcaccgccccgttcggtgtccggttcggcaagctgcacgccggcatcgacctggccgcccccgacggcacgccgtacaaggcgatccacgccggcgaggtgaccgcggcgggctacaacggcggctacggctactcgatcaccgtcaagcagagcgacggcaccgaggtcatctacgcccactcccggcgcctgctggtgaaaaagggtgacacggtcaaggccggccaggtgatcggcgaggtcggcaacaccggctactcctacgggacgcacctgcacctggagatccacgtcggcggtacgccggtcgacccgatctccttcctcaagccgcacggggtggacatccagctccagctcgaatccgtgtacgccgcccaggccgcgtccctcgccgcctcctga

SEQ ID NO: 2157 - DNA, 798 bp, Actinoplanes utahensis
gtggggcagacagcgacaccgggcagcaccggacggcaccgccaggaacgcctgcaccggcaccgcgcccccgccttcccggccctgttcgccacccgcggccgctccgccgtctcactcaccgcgctgaccgccaccctggccaccgggatcggcgtggccggtgcggccgcctcggccgcccccgtgcaccagcacgccacctccggcgggcacaccgccgcgcacccgtacgccgcgctgccgatcgtcccgccacccggtgacgacgccccggccaagacccacccggagctccagcacaccggcgacgaggtcagcgtgggccgccccgcgcccgatccggtcaagcgggcggaaaagccggtcgccgtggccgcggccaccggcacctgggtcgacccgaacccgaccgcccgggtcacctcctgcttcggcgaacgctggggccgcctgcacgccggcgtcgacctggccgccccggacggcaccccgatcgtcgcggccggcgccggcgtcgtggtccgcgccggcgtcgccgagggctacggcaacgcggtgctgatcgaccacggcaacgggtggctcacccattacggccacctgtcccgcatcacggtggccgtcggccaggtggtgcgggccggcgagcagatcggcaacgagggctcgaccggccactcgaccggtccacacctgcacttcgaggtgcacgagggttactacaagaacccggtcgaacccaccgcctggatgcaccggcacggggtggacatcgccggctgcgacaccttctag

SEQ ID NO: 2158 - DNA, 2274 bp, Actinoplanes utahensis
gtgacccacgccggcggccccctgctgatcgtggccggcgccggctccggcaagacccgggtcctcacccaccggatcgcctacctgctggccgcgcgggacgtgcaccccggcgagatcatcgcgatcacgttcaccaacaaggcggccggcgagatgaaggagcgggtcgcccacctgatcggtccgcgcgcccggctgatgtgggtgtcgacgttccactcggcctgcgtccggatcctgcgcgccgagcatgagcacgccgggctgaagagcaccttctccatctacgacgcggacgactcgcgccggctgatgcagatggtcgcccgcgagctcgatctcgacccgaagcgctacaccgcgcgtggcctggccgcccaggtgtcgaacctgaagaacgagctggtcgacccggaggagttcaaggccaaggcgaaggggccgaacgaacgggccgtcgccgaggcgtacgagttgtatcagcgccgcctcaaggaggcgcacgcgctggacttcgacgacatcatcatggccaccgtgcacctgttccagtcgcacccgctggtcgccgaggcctaccgccgccgcttccggcacgtgctggtcgacgagtaccaggacaccaacgtcgcgcagtacatgctgatccgcgagctggtcggccgcgacgatcaggacccgtccgagctctgcgtggtcggtgacgccgaccagtcgatctacgcgttccgcggcgccacgatccgcaacatcctggagttcgagcgggactacccgtccgcccgcaccatcctgctggagcagaactaccgctccacccagaccatcctgtccgcggccaacgcggtgatcgaccggaacacctcgcgcaaaccgaaacggctctggagcgaccagggcgccggcgagcagatcgtcggctacgtcgcggacaccgagcacgccgaggccgactgggtggcccgggagatcgaccggctgtccgaccggcacgaggtgcgccccggcgacgtcgccgtcttctaccgcaccaacaaccagtcccgcgtcttcgaggaggtgttcatccgggtcggtctgccctacaaggtggtcggcggggtgcgcttctacgagcgtaaggaggtccgcgacgcgctggcctacctgcgcgcgatcgtcaacgaggacgacacggtcagcatccgccgggtattgaacaccccgaagcgggggatcggcgatcgcgccgaggcctgcgtcgaggcgctgtcgaaccgggaccggatctcgttcggccaggcactgcgtcacgcgcggaccgccccgggcatctccacccgcgcggccaacagcatcgccgacttcgtgcagatcctcgacgacctgcgggagatgtcgctgaccgaagcgccggaggcggtgctggaggcggtgctgcagcgctccggcctgctcaccgagctggaggagagcctcgacccgcaggaccagggccgggtggagaacttgcaggagctggtcagcgtcgcccgggagtacaccgagcgggtggagacccaggccggcgaggacgatccggaggcgccggtcgcgtccctggccggcttcctggagcaggtggcgctggtcgccgacgccgaccagatcccctccgacgaccccgaccaccagggtgtggtcaccctgatgacactgcacaccgccaagggcctggagttcccggtggtcttcctgaccgggctggaggacggcgtcttcccgcacatgcgcgccatgtccgacaactccgagctggaggaggagcgccggctggcctacgtcgggatcacccgggcccggcagcggctctacctgtcccgggcggtcacccggtcggcctggggccagccgcagtacaacccgccgtcgaggttcaccgacgagctgccggccgagctggtccgctgggagcgcaccggcgggtcgtacacgtcgtggtccggcaccgggggcggggtgggcggccgcggcggcggcgaccggcagcgcggcggcggcttcgccggcggcaccccgaaagcgcagcggatcgccgagcggctcggcatcgacgccagccggctgtccaccgccagcgagctcaagcaggcaccgaaggtggaggccggcgaccgggtcaaccatcagcggtacggcctgggccgggtggtagcggtcgagggacacgggccgggcgcccgcgcccagatcgacttcggcgaccaggtgatgtggctgatcctgcggcacgccccgatcgaaaagatctag

SEQ ID NO: 2159 - DNA, 1842 bp, Actinoplanes utahensis
atgacttctccgctgcggcggcgggtggccgttccggccgtcgcgctggccgtcgtcggcgcgctctccacggcgcccgcccagtcggccgccgccgcgccgcccgccgagttcgtcccggtgtccgcgtcgtacggcgcctcacccggcacccccgtggtgaagggccggattctcagctacaacgacttccacggcgcgatcgacccgccgaccggcggcggtgcggtggtcaacgccggcggcaccagcaccccggccggcggtgtggaacacctcgccacctatctgaagaggctgcgcgccgaggcggcggcgcagggccggcagaccatcacggccggcgcgggcgacctgatcggggccagcccgctggtcagcgccgcgttccacgacgagccgacgatcgagctgatgaacacggtcggcctgcaggtgagctcggtcggcaaccacgagttcgacgagggcgtcgccgagctgatccggatgcagcgcggtgggtgccacccggtcgacggctgccaggacggcgacggcttcggcggggcgaaattccactacctcgcggccaacaccatcgacaacaggaccgggctgccgatcctgccgccgatcgacatcaagtacgtgggtggcgtgccggtcggcttcatcggcctcaccctggagggcaccgccggcatcgtgaacccggccggcatcaagaacgtgcacttcaccgacgagatcgtcaccgccaacaggtggagcaacatcctcaagctgttcggggtcaaggcccaggtgctgctcctgcacgagggcggcgcgcaggcgaccgtgacgcccaccgcgggcgtctcggactgcaccggcttcaccggcgcggtggtgccgatcgtggccgggctcaacccggacatcagcatcgtggtctccgggcacacccaccggttctacagctgcaagctgcccaacaaggcgggtaccgacaccgtggtcaccagcgccggcaccaacggtcagctgatcaccgacatcgattactcgctggacaagcggaccgggaagttcaccgagatcaccgcgaagaacgtgatcgtggagaacggcgtcccggacggcaacggcggctggaagaaggacgcgaccggcgtctacctgaagaacccggacaccgtcgacccggccgccaagaaggtcgccgacaagtaccgggtcgcggtggccccgctggccaacaaggtgatcggcaccatctccggtgacatcccgcgcagcaacaacgcggccggcgagagcccgctcggcgacgtgatcgccgacgcccagctcacctacaccaccgcggccacagcgcagatcgcgctgatgaacccgggcggcatccgggccgacctggacgccgaccagtcctccggcggcgaggcgtacggccaggtcacctacggcgaggcgttcaccgtccagccgttcaacaacctggtcaccaccgagccgctcaccggcgcccagctcaaggaggcgctggagcagcagttcgccggctacgccaagcagaccaccaccaagatcctgcaggtctcggccggcttcacctacacctggagcgcgtccgccccgctcggctcgaaggtcagcaatctggcgctgaacggcacgccgatcgacccggccgccacctaccgggtcaccatgaacaacttcctggccaacggcggcgacggcttcaccaacctggtcgtcgacccggccaaggtggtcaccgcgcccggcttcgacatcgacgcgctcaccgcctacctggccaccggcaccgtccagcccggcccggccaaccggatcaccaccaccccctga

SEQ ID NO: 2160 - DNA, 438 bp, Actinoplanes utahensis
atgaccgccgacgtgatgaacccgtccaccgacgccgcccgccccaccacgccaccgtccaccgacgccgcccgccccaccacgccgccgacccccgacgccgccccgcccgcgtccacaccggcggccgcgaccgacaaggcggctgccgcggcgatcgccctggacgcgtcgaccggcgccggccgcccgctggccgccgacgagatccgcgccctgcgcgaacggatcgacgagatcgaccaggccatcatcgacctctggcaggagcgttcccgcctctcccaggaggtcggcaaaacccggatggcctccggcggcacccgcctggtcctcgcccgcgaacgcgagatcgtcgaccgcttccgcgccgccctgggcccggacggcacccaggtcgccctcctcctgctccgctccggccgcggcccgctgtaa

SEQ ID NO: 2161 - DNA, 1008 bp, Actinoplanes utahensis
gtgagtgacgtcgtcctcgaagccaagggcctggtcaagcacttcccgatcacccagggcatcgttttcaagagcaaggtcggcgcggtccgggcggtcgacggtgtcgacctgcacctgcgtcgcggcgaaaccctgggcgtcgtcggcgagtccggctgcggcaagtcgaccctggcgaaactgctggtcggcctggaaaccccgaccgccggctcgatcaacgtccgcggcgaggacatggtcaggttgaaaggcgccgcactgcgccgggcccgccgcaacatccagatggtgctgcaggacccgtacacgtcgctgaacccgcgcatgacggtcggcgacatcatcggcgagccgttcgagatccaccccgacgtggtcccgaagggcggccgccagcgcgcggtgcaggacctgctggacacggtcggcctcaaccccgaccacatcaaccgctacccgcaccagttctccggcggccagcgccagcgcatcggcatcgcccgggcgctcgccctcaagccggagatcatcgtctgcgacgagccggtgtcggcgctcgacgtgtccatccaggcccaggtgatcaacctgctggagcggctgcagaacgagttcggcctgtcgtacatcttcatcgcccacgacctctcggtcgtccggcacatctccgaccgggtcgccgtcatgtacctcggcaaggtcatcgagacgggccacgaccaggcgatctacgagcagcccacgcacccgtacacgcaggcgctgctctccgccgtcccggtcccggacccgcgcctgcgcggccaccgcgaccagatcgtgctggagggcgacgtgccctcgccggccaacccgccctcgggatgccgtttccgcacccgctgctggaaggcgcaggacatctgcgcccagcaggagccgctcctccagatccgcgagcggtccccgcaccccagcgcctgccacttcgccgaaatccgggatgtcgtcagaggccgctga

SEQ ID NO: 2162 - DNA, 1038 bp, Actinoplanes utahensis
gtgacggatatcaaggcgcagatggacgtcctaccgggcgtcgaccctcgcgcacccctgctcgaagtgaacgacctgcacgtcgagttccgaacgaactacggtgtggccaaggccgtcaacggcgccaacttctggctctccccgggcgagacgctggcgatcctcggcgagtccggctgcggcaagtcggtgaccgctcaggcgatcatgggcatcctggacaccccgccggggtacgtcacccagggccagatcaagtaccgcggcgtcgacctgcagaagctgccggaggaccagcggcgcaaggtccgggccaaccggatcgcgatgatcttccaagacgcgctctccgcactgaacccggtctacacggtcggtttccagctgggcgagctgttccgcaagcaccgcgggatctcgcgggccgaggccaagcgccgttcgatcgacctgctcgaccaggtcaagatccccggcgcgcggacccgggtcgacgactacccgcaccagttctccggcggcatgcggcagcgcgtcatgatcgccatggcgctggcgctcgacccggaggtgctgatcgccgacgagcccaccacggcgctcgatgtcaccgtgcaggcgcagatcatgggcctgctcgccgacctgcagcggcagcgcaacatgggcctgatcctgatcacgcacgacatgggcgtggtcgcggacgtggccgaccggatctcggtgatgtacgcgggcaaggtcgtcgaggaggcgccggtctacgacatctacgcgcgtccggcccacccgtacaccaaggccctgctcgagtcgattccccggctcgacatgaagggacagcagctcagcgtcatccgcggcctgccgccggcgctgaccgacgtgcccaaggggtgcgccttcaacccccggtgcgcgtacgcgcgggacgcctgccgtcaggacccgccaccgccgccgtaccaggtttcggtccagccgcaccgcacggcgcgctgccacttcttccgggaggtcatcggtgagtga

SEQ ID NO: 2163 - DNA, 939 bp, Actinoplanes utahensis
atgagtgacctgaacaccgtgaccgcggccgaggcgccgggcggtcagccgaacgttccgcacggcccggtcaagaaggacaagccgcgcagcctcgccgccgacgcctgggacgatctgcgcaagcgcaagatcttctgggtcgccgtcgtgctggtggtggcgatcctggtgatggcggctttcccgacgctgttcacctccgccgacccgcgttactgcgtccttcccaaccagttcaagggcccgaggagcggtgccccgttcgggttcgacttccagggctgcaacgtctacgccaagaccgtttacggtgctcgcaactcgatcatcgtcggtgtgctctccactctgctggccggtgtcatcggcctcgtcttcggcctggccaccggctactacggcggctgggtggacgcgatcctgtcccgcttcgtcgacatcatgctgggcgtgccgttcctgctcgccggcatcgtgctgtcccgccggctctccgccggtgcgggcagtgacggcatcatggcggtgaccctcaccctgggcctgctggcctggacgtcgggcgcgcgggtgatgcgctccgcggtcatctcgtcgaagaaccaggactacgtggcggccgcccggatgctcggggcgaccccgggccggctggtcttccggcacattctgccgaactccatcgcgtcctacatcgtgctgctcaccctgctgctcggcatcaacatctccagcgaggcgaccctgtccttcctcggggtcgggctcaagggcagtgccatcagctggggcatcatgatctccgacgccagcgggttcgcccggatcgagccgtggcccctggtgtggccggccgccttcctcggcgtgaccgtgctcgccttcatcatgctcggcgacgccgtgcgtgacgctttcgacccgaagttgcggtga

SEQ ID NO: 2164 - DNA, 927 bp, Actinoplanes utahensis
atgttccgctacatcgtgcggcgcttactgcagatggtgttgacctttttcgggtccaccttcctgctcttcgccctggtgttcgccaaccagaccgaccccatccaggcgctggtcggcgaacgtccgatcactgcgagtcagcgcctggcgctcactcagcgataccatctcgacgaaggattcttcgggcagtactggtactacatcaagggcctgctcaccggggacctcggcatgtccctgaccggccggaagatcagccagatgatggccgatgcgtggccggtcaccctccggctcgccgtgatcgccatcgtgatggccgccgtcttctcgatcaccgccggcgtgtactccgcgatcaagcggggcggcatcttcgacaactcctcgctgctgctcaccctgatcctgctggccatgccgatcgtggtgatcgcgccgctgttccagctcgtgttcgctatgcagttgcactggttcacggctaccgcaacacgtgacgcgactttcacgcaactgcttttgccggccatcgtgctcgcctgcatcgtggtcgcccccgagatgcgggtcacccggacctcggtcgtggagaacctgcgcgccgactacgtccgtaccgcgcgggccaagggcctgacccggatgcgggtcatctgggtgcacgtgctgcgcaactcgctgatcccggtgatcacgctgatcggcgtcgacctgggcacgctgatggccggcgccatcgtgaccgagcacgtcttcaacatccccggggtcggcttcaacctcgcccgggcgatccggaccgaggacggcccgctcgtggtcggtttcgtgagcatcttggtgatcctgttcctgttcatcaacctgctcgtcgacctgctgtacgccgccctcgacccgaggatccgttatgagtga

SEQ ID NO: 2165 - DNA, 1635 bp, Actinoplanes utahensis
atgcctgggaaaagcccttggaagatggcggtcggtgcgaccgccatcgccttgttggccgccggttgcggtggcggcgggtctgatgaccagtcgaccacttcgaatacggtcgttatcggtatctccgagccggagcacctgattccgtcgaacaccacggactcgagcggctccgaggttctgcagtcgctgttcaccccgctggtcaaattcgacgacaagaacgagccgaccctggtcgccgccgagtcgatcacgcccgacaagaccaacaccacctggaccgtgaagctgaagtccggctacaccttcagcaacggtgagccggtcacctcggacaactacatcaacgcgtggaactacggcgcctacgggccgaacggccagaacgcgtcgtccttcttccagcacatcgccggttacggcgacctgcagtcggtcgacccggacggcgccggcccgaagaaggcgccggaccccaaggcgaagaccctgaccggtctgaagaaggtcgacgactcgaccttcaccatcaccctcgacgcgccgttcgccggctgggaaacggtcatggcctatgactgcttcctgccgctgccgaaggccgcctgggcctccgagggcaagctggccgacggcttcgaggacgccctgatcggcaacggccccttcaagctgaagggcaagtgggagcacgactcccagctcgtggtcgagaaggtcgccgattacaagggcgcggtgccgaagatcgacggcatcacctggaaggtctaccaggacctcaacgcggagtacgccgatctgaccgacggccacgtcgacgtgcagaccaccatcccgatcgaaagcctggccaaggcctcggccgacctgggtgaccggttcaagaagagcccgatgtccgggttcggctacatcggcttcccgaccttcgagaaggagttctcggacgtccgggtccgccaggcgctgtccatggcgatcaaccgccaggagatcagcgaccagatcttcctcggctcccgggttccggcgacctccttcgtctccccggtcgttcccggttaccgcgacaacacctgtggcgagaactgcacatacaacccgaccaaggccaaggagctctacaccgcggccaacggtccgaaggacatcaagatcacgtacaacgccgacggtggccacaagccctggatcgacgcgctgtgcaaccagatcaaggcgtccctgggtgtgaactgcaccggcgtcggtgagccgaagttcgccgacctgctgaagaaggcggaggccaagaccccgatcggcctcatccggctcggctgggtcatggactacccgctgatggaggactacctcggcccgctgtacagcacgggcggttcctcgaactactacggctacagcaacccgaccttcgacaacctggtcaaggagggttctgcggcgcccaccacggacgatgccgtgaagaagtggcaggcggctgaggacatcctcggcaaggacctgccggtcatgccgatctacacgcagcagaacgtgttcggccactccgagaaggtctcgaacgtgaacgtcgacctgtactcgcgcgtcgacctcagcaagatcgaggtcgtgaagtag

SEQ ID NO: 2166 - DNA, 666 bp, Actinoplanes utahensis
atgaccgagcccgtgacgcagtcggccggccggctgaccgtcttcctggtggacgaccacgcgatgttccgcgccggggtgcgcgccgagctgggccggcacgtcgaggtggtcggcgaggccagcacggtggccgaggcgatcagccggatcggtcagatccagcctgacgtggtgctgctcgacgtgcacatgccggacggcggcggccgggccgtgctggagtcggtccggcgcacccatccgcaggtcaagttcctggcgctgtcggtgtcggacgcggccgaggacgtgatcggcctgatccgggccggcgcccggggctacgtcaccaagacgatctcaccggacgagctggccgccgcggtgcgccgggtggccgacggcgacgcggtgttcagcccgcggctggccgggttcgtgctggacgcgttcgcctcccggccggacgtgccggtcgccgacccggagctggaccagctgaccaaccgcgagcgcgaggtgctgcggctgctggcccgggggtacgcgtacaaggagatcgccaaggagctgttcatctcgatcaagacggtcgagacccatgtctccaacgtgctgcgcaaactccagatgagcaaccgctacgagttgtcacggtgggcggctgatcggcgactcgtctga

SEQ ID NO: 2167 - DNA, 1299 bp, Actinoplanes utahensis
gtggccagggcttgccgcacgtgtgacgatcggggggtgaccgctaccgccgcaccgccgccgatccgccggctgtaccgccctcgcgagcaccggatcgtggccggtgtcgccgccgggctggcgcgccacctgggcgtgccggtgctggccgtgcggatcagcctggtcgtgctgctcggattcaacgcgctgggcctgctgctctacgcggcctactgggcggtgctgccgcaggaggcccgcctcgacgagaaaccggcccgccgcgacctgggcgcgctgctcccgttcgccgcgatcgggctgggcgtggtgctgctgcagaccctggtcttcggcgaccaggtgggcaccacggtgggctggatgatcgcggtggtcgcggtcggcgccggggtgatctggcaccagtccgacccgagccgccgcgagcagtgggccgacgcgaacgcgccgtccggctggatggcggcgatcatcggcgagacggaccggcgctcgttcatgctgcgcttcgtcggcggcggggtgctggtcgcggtcggcgtgatcggcgtggtcgcgatctactcgccggccgactcgctctcctcggtcttcaacggcatgatcttcgcgctggtcggcctgctcggcgtcggcgtggtggtcgccccgctggtctggcgcacgttcggccagctgcgcgccgagcgcgagggccggatccgcgagcaggagcgggccgaggtggccgcgatgatccacgaccaggtgctgcacacgctggccctgatccagcgcaactcggcggacatcaaggaggtccagcggctggcccggggtcaggagcgcagcctgcgcaactggctctacaagccgaccgcctcgccgaccgagcggttctccgcggcgctggagcaggccgccgccgaggtggaggacacctacgcgatcagcgtcgagaccgtggtggtcggcgacacccagtgcgacgagaaggtggcggccctggtcgccgcggcccgtgaggcgctggtcaacgcggcccggcacgccggggtgcagacggtgtcgctctacgccgaggtggagccggacgagttgagcgtcttcgtccgggaccggggcgccggcttcgacctgggcggtgtggcggagacacggcacggcgtccgtggttcgatcatcgggcgcatgcagcgccacggcgggcgcgcggagatccgcagcgcccccggcaacggtacggaggtgcgtctcacgctcccggtctcccgggagagcgtgaccgccggtaaggagtcgtcgagatga

SEQ ID NO: 2168 - DNA, 1374 bp, Actinoplanes utahensis
atgaacgacgaagctgccgaaccccgtaccccgggtaccggtcctgagggcgggccggcaccttccgccaccaccccaccgcaggcgaacgtgccgccgtggctcaccgcggcgcaggccgccttcgcccgccagcagctggtccgcccccgcgagggccgctacatcgccggcgtctgcggcgccctggcccggcgcaccggcaccgacccggtgctgtggcgggtgctgctcgcggtgctcggcgtgctgggcggcgccggggtgctgttctatctgatcggctggctggtcatcccgtccgagggggacaccgcctcgccggtcgagtcactgctcggcaagggtcactccgggatgtcgccgctgagcgtggtggtgctcggcggggccgcactgctgaccttctcgttcgtggtcagtgacggcgcccgggccagcatgctggcggcggccgtgctggtgggtgcgttcctgctgatcaaaagaggcgcgccggccggcaccttcgccgcaccgccggcaccggccgggccgcccgcgtcgcccggcgccgaggagccgacgatggcgttcacctcgccgaccccggccgcaccggccggcgaaccggtgaccccgcccgcgccggcggcgtacgagccgccacgctggaccccgccgacggagtccgggtaccgcccgccgttcgccccgcacggcccgttcgcgagcgccggcgcctacccgccgcccgcgccggccaccccgccgccgccgaaaccgcccaagccgccgaagcagcgctcgatcctgggccggctgacgttcttcgcgatcatcgtggtgatgggcctgctcgcggtgctcgacatggccggagtgaacgtcgcggtgtcggcgtacttcgcggccgctctgaccaccatcggcctgggcctgctggtcggcacctggttcggccgggcccgcggcctgatcttcctggccttcctgaccaccatcggtctgctgatcagcacgggcaccgagcggtggggcagcgagttccgggacagcgtgtaccgtccggccaacctcgccgaggtcgccgactcctacgagttcacgctcggcaacgtcaccctcgacctgcgcggcgtcgacttcaccggcgccgaccaggccaccacggtccggatgagcgtgggccagctccgggtgctgctgccggaccgggtcgacaccaccgcgcaggtgcacgtcggcggccggacggtgctgttcggccaggagtacagcggcgacgacgcctcgtcgcgatcggtcaccgacctcggccgggacggcgccggcggcggcaagctcgccctcgacctgcacctcgaaaccggaaacctggaggtgatccgatga

SEQ ID NO: 2169 - DNA, 333 bp, Actinoplanes utahensis
atgaaaccgcaccggatggacggcgtgtccctcaccttcggcctgatctccctggtgatcgcggcctggtgggcggtctcccaggtggtcaccctgcacctgccggcgctcggctggacggtggccggcggcctgatcctgttcggcgtgatcggtctgctcggggcgatcacttccggacgccgcgagccggtggccccggtcctggccgaggccgtaccggcgtcggtcccgggcgatctgccgcccgaggtgcacgcctcgatcgtccaggagctgatggacgacccggccgcccggttcccccgcgaagaacgtgaaacggataagtga

SEQ ID NO: 2170 - DNA, 1245 bp, Actinoplanes utahensis
atgacccagtttcccgccgtgtccgccacgcccgtcccggccgtgggagcccgggccgcccgcgccctgaccgccgagttcgcccggcagaacgcggccaccaccgccctgctgatcggtgccgaccatgcctccgccgtggtggccgccgccgtcgaggcgctcctgccgggcgacaccctcgtcctggtggccggtgagcacagcagcgccgacctgctccgcggccacatcaccggcctgggcagctgggtcgccgaccgggtgcgcatcctggagtcgttggacgaggcgcagccggccgacgtggtcatcgtcggggagccgctcaccggcaccgccgacgacacccgcggcctgatcgacaaactcgcgaaatacctgaccgacggcgccgtgctcagcgtcgccaccccggcgggcccgggccgcacgatgggcgccgcggccgagctgttccgccagggttcactcttcggggtcggctccgacctggtggtccgcaaccagccgccgctgcgcgtgcacaagctgcggttcaccccggccgaggtgggcgccgccgcgaccgtcgccccggcctaccggacggccagcgtcccgctgacccgcaccatgcacatcgactcgaacggggtggccgccgccggcatcgcgctcggtctggccgcgctggcccgccggacccggccgaagtcgaagctgtggctgatcccggcgctggccgcggcgccggtcgcggcgttcttccgggacccggagcgggacgtgccgtccgacccggcctcggtcgtggccgccgccgacggcaagatcctgtcggtggagcggatgcacgacgaccggttcggcccgggtgagttcctgcggatcgcggtcttcctgtcggtcttcgacgtgcacgtgaaccggtcgccggtggccgggcgggtcgccgactacttcgtcgaggagggcggcttcgcgaacgccgccaccgcggccgccgagcacaacgtcgcggcgtacacggtgctcgacaccgagcacgggaccgtcgtggtggcgcagcggaccgggctgatcgcccgccggatcgtgcagcgcaccccggtcggcacgctggtggccaagggcgagcggttcgggctgatccggttcggctcacgcaccgacgtctacctgccggcggaccgggcggaggcgctggtcagcgtcgacgagcgggtcgtcggtggcgccacggtgatcgcccgctggaagtag

SEQ ID NO: 2171 - DNA, 969 bp, Actinoplanes utahensis
gtgccgcgtaccccttggcgccggcgtcgaacgacggatagcccccgtcccgccggccgccgttgggctggccgtttgcgccgtggcgggactctcgcccggcaggccctgctggttcgggtgggtcgccgcgccgccgagacgagccgggccgccaccgcgacccgtgccgaggtgctctacacctcgccggaaccggggctgagccgcaccattcccgcccccggagttcccctggacacccccgccgccttccccgtggacgagtccgtcccggcgaccatcccgctgctgccgggcgagccgacgatggctcgccgggcgcgtttcgcgctggtcaacgcctgcaccctgagcagtctcgggctcggcctgctggccatcttcctggccatggccgaccagccccggtgggccgccggctgcctggtcgcctgcgtcgccttcgacggcctggacggcgcgctggctcgtaagctcggcgtcgccagcccgttcggcgcgcagatggactcgctcgccgacatgtgctcgttcggcctggccgcgccggtcgtggtctacgcctcgctgctcggcaccgtcccgcagccggccgcagcgctggcctgcgccctggtcgcgggctgcgccgcggtccggctggcccgcttcaacgtctcgccgaaggacgggcgcttcttctgcggcgtcccgaccacgatggcggcggcggtcctcgcgctcgccgtgctgatcggcctgccgctgcccggcatggcgctgctggccggcgtcgcgctgctggccttcgcgatggtgtccagcttcccgtacgcgaagctcgcccggatcgtgaagctgccgccgtggctgtggctgctgccggtggtcggcgcgctggtcgagccgaagatgacgttcgtcctggtcgtcgcgacctacctggtcagcggcccggtcctctgggtgcgcgccaagcgcgcctga

SEQ ID NO: 2172 - DNA, 894 bp, Actinoplanes utahensis
gtgaagatcagacgaaccgcggcgtacggggtgtgccgggccgccgacggcggggtcctgctcacccgcggctccgatctcagcgccttcccgggcgtctggtcgctgcccggcggcggggtggaccacggcgaggcgccggccgacgccgtggtccgcgagttcgccgaggagaccggcctgacggtggccgtcaccggggtgcgcggcgtggtcgccgacgtggtcgcgttcccgttcgacgatctggtggagcacaccgaccggatcctctacgacgtggccgtcaccggcggcgatctgcgcccggagaccggcggcaccagcgacctggccgagtgggtgccgcccgccgaggtggccgcccgcccactgctgccgttcaccgccggcgccctcggggtgtccttcgacgcccccgcggtggtgccgctcgacgacgagccggtgcaccgtggtgaccgcgtgcagcggttcggggcgtacgggctggtgactgatccagccggacggatcctgctggcccggatcacgcagggttaccccggcggcggttcctggcatcttcccggtggcggcaccgactacggcgaaacccccgaggaaggtttacttcgtgaactttatgaagagacctcgcagcgcggccggatcgacggcctactgactgtcggtcatcgatacgacccggcggcgctcggaccggaaggtgttccgctcgactggcatgtgattcgcgtcgtatatcgcgtaagagtggaggaaccggtcactccggtggtcagcgaagccgcaggtggatccaccgaccgggcgtcctggttcacccccggtgaggtcgccgggctgccgctgaccgaactggcccgggaagcactggctgaggcgggctaa

SEQ ID NO: 2173 - DNA, 948 bp, Actinoplanes utahensis
gtgacccccgcactggaaccgctccgcaggatcgccgcctacgccgtcgcgaccgacgacgaaggccgcgtgcttctggtccgggcctcggccaaatccgggacgcccggcatctggtcgctgcccggcggcgccgtggaccacggcgaagatcccaatcacaccgtcgtccgcgagaccgcggcggagaccggcctctccgtcgcggtgaccgggctgcgtgacgtcctggccgacatgcgctcactgccgcaccgtggcgtcaccatccacaccgaccggctgatctacaccgtgtcggtgcgcggcggcaccctgatcgaccgggtcggccaccccaccgacctggcgcgctggcacaccctggaggaggcggcgcggctcaagctgcgcccgttcgccgcggaggcgctgggactcccggccgcctcggccgacctgcgccccgacgtgccgccgaccttcccgtccttctacgcctaccaggggccggacgggctgcaccgggcgcagcggttcgcggcgtacgcgatcgccaccgacccgtacgacaatctcctgctgacccggatcgcgcccgggtatcccggcgccggctgttggcacctgcccggcggcggcaccgactacggcgagcagcccggcccggcgctgatccgtgagctggtcgaggagaccggccagcagggccggctgatcgagctgctcggggtggccagccaccgggacgccgcctcgctcgggccggagggctacccgatcgactggcacggggtccgcgcgttctaccgggtggtcgtcgacgcgccgaccgaggtggtgatccacgacgtcggcgggtccacctccgaggccggctggatgccgctgcgcgaggttgccgcgctcgccgccgaccagctcaccgaagtcaccgccgatgcgctgcgggcggccgggctaatctag

SEQ ID NO: 2174 - DNA, 1548 bp, Actinoplanes utahensis
gtgagtaccccgcgtcccgtcctcgtcgtcgacttcggcgcccagtacgcccagttgatcgcccgccgggtccgtgaggcccgtgtctactcggagatcgtgccgagctcgatgccggtcgccgagatgctggcgaagaatcccgccgcgatcatcctgtccggcggcccgtccagcgtctacgagccgggcgcgcccacgctcgacgccggcctgttcgacagcgacgtgccggtcttcggcatctgctacggcttccaggcgatggctcaggcgctcggcggcacggtcgcgcacaccggctcccgggagtacgggcggaccctgctcaccgcgcagggcggctcgctgctccgcgacctgccggccgacctgccggtctggatgagccacggggacagcgtctcggtcgccccgtccggcttcatggtcaccgcgtccacgcccggcgctccggtcgccgcgttcgaggacctcaccgcccggcgtgccggcgtgcagttccaccccgaggtggcgcacaccgagcagggccaggagatgctcaagcgcttcctgtacgacatcgccggcatcgagcccacctggaccccgggcaacatcatcgaggaccaggtcgccctgatccgtcagcacgtgggggacaaacaggtcatctgcggcctctccggcggcgtcgactcggcggtcgccgcggccctggtccacaaggccatcggtgaccagctcacctgcgtcttcgtcgaccacggcctgctgcgcgccggcgagcgcgagcaggtggagaaggactacgtcgcggccaccggcatccggctggtcgtcgtcgacgccgaggagcagttcctcggccacctcaaggacgtcaccgacccggagcagaagcggaagatcatcggccgcgagttcatccggacgttcgaggcggcggcccgcgacctggacgccgagcggcacatcgagttcctggtgcagggcaccctctacccggacgtggtggagtccggcggcggcaccggcacggcgaacatcaagtcgcaccacaacgtcggcgggctccccgacgacctgcagttcgcgctgatcgagccgttgcgcacgctgttcaaggacgaggtgcgcgcgctcggtgccgagctcgggctgcccgaggcgatggtgcagcggcacccgttccccggcccgggtctggccatccggatcatcggtgcggtcgaccgggaacggctggacctgctgcgccaggccgacctgatcgcccgcgaggagctgaccgcggccggcctcgaccgcgacgtgtggcagttcccggtggtgctgctggccgacgtgcgcagcgtgggcgtgcagggtgacggccgcacctacggccacccggtggtgctgcgcccggtctcctccgaggacgcgatgacggcggactggtcgcgcctgccctacgacctgatcgccaagatctcgaaccggatcaccaacgaggtccgcgaggtcaaccgggtggtgctggacgtcacgagcaagccgccgggcaccatcgagtgggagtga

SEQ ID NO: 2175 - DNA, 1065 bp, Actinoplanes utahensis
atgcggacaggcaggatcgcgcgagccgtggtggtcgccgtgctcgggatgacggtcgccgcctgccggcactccggcgccgccgccccggccgcgtccacggcgccgatcccggagtcgacgccgagcgccgcgccggcgccctccccgggcgccgacctcaccggcccgctcgatctggtgctggccggcgtcgacacccggatcaccgagcccggctgggagccgcactccgacgcgatcatgctgctgcacgtcgacgccgggctgaagtccgcctacctctactccctcccccgggacctgctcgtccaggtcccggcctatccgaaggccggcttcccgggcggcaggcacaagctcaccgaggcgatggcgttcggctcgcggatccccggtcggaccgccaagaacgtggcgaacggctacgacctgctgacccggacgatcagcgcgtacaccgggatcaggaccttccaggccggcgcgatcctcaacttcggcggcctcgaccggctggtcgacgagttgggcgggatcgacatgacgatcgaccagaaggtgaagtcgcggcaccggcgaccggacggcacactgcgcaagctgagcggccacgactacaccgggccgcaggccgtctacctgcccggtaagcggcacctggtcggctggcaggcgatcgactacgcccggcagcgctacggcctgccgaacggcgactacgaccggcagcgccatcagcggcagatggtcgaggcgatcctcgacaaggcgctcggcgagggcctcagcgacccggcgaaacttcagccggtcatcaccgccctcgggaagacgctggtcacggtcggcggacgacaaccgatcgactacgcgtacgcgttgcgtgacctcaccccgtcctcggtgaccatggttcagctggacggcggcggcgtcggcagtggcagcggctacctgggcgaggcgctgaacgcggaggcccgcggcttcctctccgcggtcgccgcgggcaccattgcggcgtacctgaaagcgcaccccgggatggtcgacaagggatga

SEQ ID NO: 2176 - DNA, 1386 bp, Actinoplanes utahensis
atgagacgacggggtccggtcgccgtgctggcggtcctgctcatcgccggtggctgccggtcctccggggccgcggccttcacggccggtgcgatcggggccggtgacccctacttcccgacgtacggcaacggcggctacgacgtggccggatacgacctggacctgcgctacgacccgggcagcggtcagctgggcggccgggcgacgatcaccgcgaccgccacccagagcctgtcccgcttcgacttcgacctggcccacctgaccgcctcgaagatcaccgtggacggcgccgcggcgaccgccgagacggccggcaacgagctggtcgtcaccccggccaccgggatcccgtccgggcggcggttcaccgtcgtcgtcgagtattccggcgaacccgaccagctggagaacaaggcgctcggcaacggcggctggatccgcaccgccgacggcggcatcgcgctgggccagcccgaatcggccagcacctggtatccggtgaacgaccacccgtcggacaaggccaccttccgcctggcgatgaccgtgccggacggactgcaggtgatcagcaacggggtgcccgggacgacggaccgccacgggggctggaccacctggcactgggccgagtccgcgccgatggccagctacctgtccaccgtggtgatcgggcactaccgggtcaccaccggcacccacgacggcaagccgatgatcgtcgcggtgcccgagtcggtgccggccaccagccccggggccagggcactggcccgcaccggcgagatcgcggatttcctggccgggctgttcgggccgtacccgttcgacgcctacggtggggtgatcgtcaccgacagccggatcgggtacgcgctggagacccagtcccggccggtgtacggcggtgacttcttcaccaaggacgagaacgccggggtggtcgcccacgagctggcccaccagtggttcggcgacagcgtttccctgcgacggtggcaggacatctggctcaacgaggggttcgcgacctacgccgaatggctgtgggccgagcacgacggcggccgcaccgcgcagcaggagttcatcatcgcgtactcgtcgacggactggacccagccgaccggggacccgggcccggcgcacctcttcggatcggcggtctaccagcggggggcgatgacggtttacgccctgcgccggacgatcggcgacgacgccttcctgaagctgctcaccgcgtggcccgccgcccacagggacggcaacggcaccacggagcagttcatcgcccttgccgaacagacgtccggcaaggacctgaaagacttcttccacgcctggctctacggaaccgggaagcccccggccccgtga

SEQ ID NO: 2177 - DNA, 1122 bp, Actinoplanes utahensis
atgcgtgacgtagtggagatcggcctcggtaagaccgcccagcgcggctaccacctggatgacatcgcgatcgtgccgagccggcggacccgggacgtcgacgacgtctcgaccgagtggaagctcgacgcgtacccgttcaagatcccctgcgtcgcgcacccctcggacgccacccagagcccggattcggtgatcgccctgggccgcctcggcggcctgggcgtgctcaacgccgagggcctctggacccgctacgaggaccccagcaagatccttgaggagctggcctcgctggacgaggaggcggacgccaccaagcggctgcaggaggtgtatgccgagccgatcaagccggagctgatcggcgagcgggtccggcagatccgcgagggcggcgtgaccgtggccgtccgggtgtcgccgcagcacaccctggcactcgccccggtgatcctggacgccggcgtcgacctgttggtcatccagggcaccctggtctcggccgagcacgtgtcgaccaccgacgagccgctgaacctcaaggagttcatcgccgacctcgacctgccggtgatcgtcggcggctgcaccgactacaagaccgccctgcacctgatgcgtaccggtgcggccggcgtgatcgtcggggtcggcgcggacgagtggtcgaccaccgacacggtgctcggcatccgggtgccgatggccaccgcgatcgcggacgccgccgcggcccgccgcgactacctggacgagaccggcggccgttacgtgcacctgatcgccgacggcgggatcgcgacctccggcgacatcgccaaggcgatcggctgcggcgccgacgcggtgatgctgggcgagccgctgtcgctggccgagggcgccccggccggcggcgcctggtggcactcggcggccagccaccccgccctgccgcgcggtggtttctgcatcgccggcgagccggacggttctctggagcagctgctctacggcccggccgaccgcgccgacggtcagctcaacctgttcggcggcctgcgtcgcgcgatggccaagtgcggctaccgcgacgtcaaggagttccagaaggtcgccctggtcctcgaccggcagtag

SEQ ID NO: 2178 - DNA, 1488 bp, Actinoplanes utahensis
gtggaaactgacagcgctcgcaccgttcccctcggtctgacgttcgacgacgtgctgctgcagccgggtgagtcggacgtggtgcccagccgggtcaacaccgtcacgcggctgacccgcaacgtggagctctccatcccgctgctctcggccggcatggacacggtcaccgaggcgcggatggcgatcgccatggcccggcagggcggcatcggcgtgctgcaccgcaacctgtcggtggaggaccaggcggcccaggtcgacctggtgaagcgttccgagtccggcatgatcaccaacccgatcacctgcgggccggacgacacgctgcgccaggtcgacgcgctgtgcgggcggtaccggatctccggcgccccggtcgtcgacgggcagggcgtgctggtcggcatcgtcaccaaccgggacatgcgcttcgtcagcgacctggatgccaaggtgcgcgacgtgatgaccaaggcgccgctgatcaccgccccggtcggggtcggcaaggaccaggcgctcgaactgctggccaggcacaaggtggagaagctgccgctggtcgacgagaacgggcacctgcgcggcctgatcaccgtcaaggacttcaccaagagcgagcagttccccaacgcggccaaggacccgcagggccggctgcgggtggcggccgcggtcggggtcggcgacgactcctacaagcgggcccgggccctggtcgacgccggtgtcgacgtggtgatcgtggacaccgcgcacgggcaccagcgggccgtgctggagatggtggcccggctgaagaaggacgtggcggtcgacatcgtcggtggcaacgtggcgacctacgcgggcgccaaggcgctggtggaggcgggcgccgacgcggtcaaggtgggtgtcgggccgggcgcgatctgcaccacccggatcgtcgcgggtgtgggtgtgccgcagataaccgcgatcatggaggcggcccgggcgtgcgcgccggccggtgtcccggtgatcggcgacggcggcatccagtacagcggcgacatcgccaaggcgatcgtggccggggccagcacggtgatgctgggcagcctgctggccggctccgaggagagccccggcgagctgatcttcatgaacggcaagcagttcaagtcgtaccgggggatgggctcgctcggcgcgatgcagtcccggggtcaggccaagtcgtactccaaggaccggtatttccagcaggatgtgaacgaggacaagctggtgcccgagggcgtcgagggtcaggtgccctatcgtggtcctctgtccagggtggcgcatcagctcatcggcgggctgcgcgcggccatgggctacgtgggcgcggagaccattcccgatcttcaggagcggggacagctcatccggatcactgcggcgggtctcaaggagtcccacccgcacgacatccagatgacggtcgaggcccccaactaccactcccgctaa

SEQ ID NO: 2179 - DNA, 402 bp, Actinoplanes utahensis
atgggggtgcaagaagagccgatcgacccgttcaacggcgaccccgccgacccggcagcggaactcgacgacctccaggaggaggccgagagtgagccgctgtccgaggatgagcggcaggacgtcctggaggacctctccgacctggagatctatcaggccctgctgagcccgaccggcatccgtggtctggtcatcgagtgtgaggactgccacgagccgcactacttcgactgggatctgctccgcggcaacctgcgccacctgttgagcagcggccgcccccgggtgcacgagcccgcctacgaccccgatccggatcactacgtgacttgggagtacgcgcgaggctacgccgatggcgtccacgacaccctgaccgagggcaacgacgagaactag

SEQ ID NO: 2180 - DNA, 114 bp, Actinoplanes utahensis
gtggtcaccggtcgtccagatcaccccacgtcatcggtcgtccaggtcaccccgcgaagatcaagttctttgaagatcgaattcgtttttgccacggtccgcgctgatcactga

SEQ ID NO: 2181 - DNA, 840 bp, Actinoplanes utahensis
gtgcgtaccgtcctcgtgtgcgtccgaaccccgctggcggcccaaaccgtcgcgtcgaccgcggcccggctcggcatgaccggcgtcgtccggaccgcggtcagcgagaccgaggccatgatccgactggcggaacggccggccgaagtggtcctggccgacaccgccgtgacccgacccgacagtgtcggcttcacccggcgcgtcctcgcccgcgccccgcaggcccaggtggtgctcttcggggcggaagacccccgggtggcggccgcggccgtcgccgccggcgcccgcggtgtgatccgcggcgtcgagcacgacctggtcagcgtcgtcgccaaggcgctgctcctgttgctgttgccggtgcgcccgcagggcatgccgatcaacggcaacgcgcagccggccacggtggccggcggaatgcgcaacaacaactcgcccgccgcccgcggggcgtaccagaacggcgggatcggcatgggcgcgcccaacgcggcggccgtcccggcgatgctgccgaactcgccgatggtcccggtgcagcgcggcgacgcaccgatcgacccggcgaccggccggccgatggtggcctggccgggcaacgaggcgatggccgacggtgcgccggccgggcggcggctgacgctgaccgagcgtgagctgcaggtgctgcgcggaatggcggacggcaagagcaacgcggagatcgggcgggagttgttcgtctccgaggacacggtgaagacgcacgcgcggcgcctgttccgcaagctcggtgcacgggatcgggcgcatgcggtggcggcgggcttccgcgccggcctggtggcatga

SEQ ID NO: 2182 - DNA, 387 bp, Actinoplanes utahensis
atgtcgaacgttcgcaggctgcccggcccgatcgccgatctctgggactggcagcgcctggggctctgccgcggccgggacagtgcacagttcttccacccggacggcgagcgggggtcgtcccgcaatcgccgtgaggcgaaagccaagacgatgtgcggcgcgtgcccggtgcgggccgagtgcgccgcccacgccctcgcggtgcgcgagccgtacggggtctggggagggttcagcgaatcggagcggctgcggctgctcgcggtcggctgggaggatctggccgatcgtcacggacgggtcgacctggcccggctcgaggcacgcctcggccggccccacaaatcggccgtgcccgcgcagaggcaggcaccggcggcctga

SEQ ID NO: 2183 - DNA, 1494 bp, Actinoplanes utahensis
gtgaggcattcgattcgggccggtctggccggcgttgcggcggccgcggccgcgctcggggtggccgagctgctggcggtgctggccggcccgcgctcggcgccgctggtggcggtcggcggggtggtggtcgatcacgtcccggccccggtcaaggacttcggcatcgcggttttcggcacccacgacaagatcgcgctgctcaccggcacggcgatccttctcgggctgtacgcgttcggcgtcggcgtcctggcccgccgctcctggccgctggccgccgccgggatcgcgctgttcgcggtgatcggcgcggccgccgcggtgacccgtccgggcgccggcccgggtgccgcgcttccgtcgctgctcggtgccgggctgagcttcctggtgctgcgccacctgctgcgggtcggcgccctcccggaggcggcgggtcgccggcagttcctcaaacaggccgggatcgtcgtcgcggtcgccgccggtggcgggctggccgggcgctggctgaccagccgcggggtggccacccaggcgcgggacgagctgcgcctgccggcggccggcgagccgaccccggtcgtcccgcccggggcccaggtcgagggcgcggtgccgtacgtgacgccgaatcccgacttctaccggatcgacaccgccctggtcaccccgcaggtcgacccggccacctggcgtctgcggatccacggcatggtccgcaacccgatcaccatcacctgggccgacctgctgaaacgcccgatgatcgagcggtatgtgacgcttgcctgcgtctccaacgaggtgggcggcgacctgatcggcaacgcgctgtggctgggcaccccgatcaaggcgctgatcgacgaggccgatcccctgcccggtgccgaccaggcggtgcagcggtcgaccgacggctggacgtgtggcacgccgaccgcggtgctgcgcgacgggcgcgacgcgctgctggcgatcgggatgaacggcgagccgctgccggtcgaccacggattcccggtccggatggtcgttcccggactctacggttatgtctcggcctgcaagtggatcaccgagatcgagctcactcaattcgctgacttcgatgcctactgggtgccgcgcggctgggcggcgcaggccccgatcaagacccagtcgcggatcgacacgccccgcgacggcgcctcccgcaaacccggcccggtggtggtcgccggggtggcctgggcgcagcaccgcgggatcgccaaggtcgaggtgcaggtcgacgacggtccgtgggaggtggccgcgctggcgccggcggtctccgacgacacctggcggcagtggacgcacacctggacggcgacctccgggcggcacgtcctgcgggtccgggcgaccgacctggacggcgccacgcagacctccgagcgagccgatccggctccggacggggccaccggatggcaccgtgtgacggtctccgtcaactag

SEQ ID NO: 2184 - DNA, 1740 bp, Actinoplanes utahensis
gtggatcaccatgccggtccgggagcagatcccgcagccgccaccccggcagcgccgcccgctccgcgaggtgctccgcttcccgcgccggagacagccctgatgatcaccgaacgggagatcggcggcattcccgccctgctcgccccggccaccgggccgatgcacgccggcctggtcttccgggtcgggcatgccgacgagccgctggccaagcggggtatcacgcacctgatcgagcatctcgcactgttctcgttcggggtggccgactaccactacaacggcgccaccggggtggagtacacgtacttccacatgcagggcgccgaggcggacatcgtcaccttcctcaacggggtctgcgccggcctgcgcgagctgccgatgtcgcggctcccggtggagaaggagatcctgcgcaccgaggagaacggtcgcggcgagagcccggccggcccgctcgggctgtggcggcacggcgcccgggactacggcatgccggccttcccggagtggggcctgaccggactcactccggacgacctgcgcgactgggtggcccgctggttcaccgcggagaacgcggccctgtggatcgccggcccgggcgtgccggacggcctcgacctgcggctgccgcacggcgaacgccggccggccccggccccgtcgaacgcgctgccctgtcgtcccgcctacttcgccggcccggagaacgtggtcgcctggaacgccgcggtgccccggcaaccggccgcggcggtgctggccggcgtgctggagcgggcgctgttccgctcgctgcgtcaggagagcggactgtcctacacggtgcaggccgacttcgaatcgcggggcgacggcgcgatggtgatcaccgcggccgccgacgcgctgccggagaagcaggaggcggtgctccgcgggttcgtcgaggtgctggaggtggcccgggacggcggcttcgcaccggccgagatcaccgccgtggtcaaccagcgctgcgaggacctggcccgggccgaggaggccggtgcccggctgcccgcgcaggtgttcaacctgctggccggccgccgggtgcggcagctcgacgaggcgctggccgagctgcgcgaggtcaccccggccgacgtcgcggtggccggccgcctcgcggtcgccgacggcctgttgatgacgccggggcggacgaccgccgagtgggccgggtacaccgccgcgccggagtgctccaccgaggcggtgaccggcgccgagtaccgcctgctcgacccggagcgcccgggggaccggctgatcgccgggacgcacggaatcagcctggtcggcgacgcgtcgaccgtcaccgtccggtacgacggcctcgccggcgtgctctcctggccggacggtgcccgccggttcatcggccacgacggtatccaggtgcacgtcgagccgaccctggtggacggtggtccggcgctggtcgcggcgttggacaccggggtgcggccggagcagcgggtcaccatggcggcccgcgacccggcccggatcccgcatccgcccgcgccgccggcaccgccgccccgggacccgcgccgcaccgagcggatctggcgcctgagtttcgccgcggtcggcctgatcgggctggtgacgctgcggctcctggccccgccggtggccgccgcgttcttcgcgatcgcgctgatcgtggtgttcgcggtgtatcggatcctcggtaggtga

SEQ ID NO: 2185 - DNA, 903 bp, Actinoplanes utahensis
atgctgccgcgcatgcccccgcaccaccccgtcctggatcccgccgtcgcgtacccgaagatcaatgaactccgggccgcactcgacgcgcgggactggaccgcctgccgcgccctgctggacgcggcggagccggtggagcggggcttcctgatcgacgccgccgcggaggccgccgaggtggccgggttcctgcgcggggtgcgcaccgccgatccggcggacagcaccgcggcggcgctgctcggccggcatctgaccgtggtcgccggctccgccgaacgctggcgggccgccgagatcgagctgatcgacgcggccgcccgcgccccggacgatccggccgtctgggccgcccggctgggcaccgcccgcctcctcggcctggggcagtccgaggctcgccgccgctacgaccggctggccgcaatcgatccgcacttcctgcccgggcagtccgggttcgcgcggcagctgtgtccgcagtggggcggtgactgggaccgggcgcacgagttcgcccggtcggccgccgaggccgcgccgcccggctcgctgagccacgtgctgatcgccgaggtgcacatcgagcactggctggcgctgcgggacaccgcggcccggcgcacctatctggccgccgacgcggtgcgctccgggctctacgacgccgcgaagagctcggtctggcacgccgacttccggcgtacgcacggctgggtgcacgtgatgaacgtcttcgcggtggccttcgcgctgctcgacgacatgcccgcggtggcctcgctgttcaccgccctggacggtctggccaccgggtggccgtggtcctgcctcggcgacccggtcaccgtgatcagccagtacgccgagcgcgcgctgccggacggaggtgccgcatga

SEQ ID NO: 2186 - DNA, 1179 bp, Actinoplanes utahensis
atgcgcgccggccccagccaggaagaggttcgccgccacaatctcgggacgctgttgcggtacgtgcacatgcacggcgccacctcccgggcggaactcaccacccggctcggcctcaaccgcagcaccatcggggcactcaccgccgagctgatcagcgctggtctggtcagcgaggcggtgccgaaggagaccggccgggccggacggccgtcactggtcgtccggcccgagtcggacacggtcttcgcgtactcgctcagcatcgaggtggatcggctgcgcgccgcccgggtcgggctgggcgggcagatcctggagcagtacgagaccgtccggccgcccgggatgagcgcggacgaggcggtcgagccgctggcccggttcgtccgggcgatgcacgaccaggtgagcgacgacgcccgctgcgtgggcagcggtctcgcggtggccggcatggtgcgccgcgaggacggcatggtccggctggcgccgaccatcggctgggtggaggagccggtcggcgccgcgctgcggtccgagctcggcgcacccgggcggctcagcatcggcaaccacgcggacgtctgcgcgctcgccgaacacgcgcgcggcgcggcggtcggctgcgacaacgtcatctacctgtacggcgatgtcggcgtcggcgcgggcatcgtggccggcggacggcgggtcaccgggcacggcgggtacggcggcgaggtcggccacatggtggtcaacccgtacggccggccctgcgattgcggttcccgcggctgctgggagaccgagatcggcgaacacgcgctgctgcggctgtccggccgggccgaccgcaccggacgcgacgtggtgctggaggtggtggacgccgcggtccgcggggacagccaggcgcagcacgcgctgcggcacgtcggcgactggatcgggttcggcgtcggcaacctggtcaacatcttcaacccggaggtggtgatcttcgggggcacgctgcgcgacgtctatctggtcgcggccgcccagatccgcagccggctcaactcggtcgggctgccggcctgccgggagcacgtccggctgcgcaccccggagctcggcgcggacgccgccctgatcggcgcggccgaactcgccttcgagcacctgctcgacgacccgctgatcagctga

SEQ ID NO: 2187 - DNA, 1260 bp, Actinoplanes utahensis
gtgaccaccacgaccaccaccacggcgggtggcatccaggccgtcaagccgacggtcagcagccacatccgcgactactgggcccgggtgcgcggtggcgacctcggcaccctgccggccgtgctcggcctgatcgtcctctccctggtcttcggcgtggcccgcagcgacacgttcctgagcggccgcaacttcgccaacctgttcaaccagggcgccggcgtcatcttcatcgcgatgggcctggtcttcgtcctgctgctgggcgagatcgacctgtccgccggttacaccagcggcgtctgcggcgcgatcatggcgatcatgctgaccgagcacgggcagccggcctacctggcgatcccggccgcgatgctcaccggcgtcgtgatcggcctgctcctcggctcgctggtcgccaaggtcaagatcccgtcgttcgtcgtcaccctggccgccttcctggccttccagggcgtgctgctgaagctgctcggcgagggcaagaacatctcgacccgtgacgagttcgtcaacagcctcaacaacgacaacctctcgatcggtctgagctggggcttcgccgtcctggcggtcgtggtgttcgccgcggtgcagctgaaccgggtccgggcgcgggccaagcgcggcctgatcaccgagccgatcggcatcgtgctgctgcgcgtcggcggcctggcggccatcgtgctgatcgccaccgcggtgctcacccaggagcgggcgatcaacccggcgctcaactcgctcaagggcgtgccgatcgtcgtcccgatcatcgtggcgttcctcgtcatctggacgttcgtgctgggccgcaccacctacggccggcacgtctacgcggtcggtggcaacaccgaggcggcccgccgcgccggcatcccggtcgacgggatccgcatctcggtcttcgtgatctgctcgttcatggcctcgatcggcggcatcatgctggtcagccgggccacctcggtcgacccgaacaccggcggcagcaacatcctgctgtacgcggtgggcgccgcggtgatcggcggcaccagcctcttcggtggcaagggcagggtgatcaacgcggtgatcggtggcgcggtgatcgcggtgatcgacaacggcatgggcctgatggggtaccagccgggcaccaagtacatcttcaccggtctgatcctgctgctcgccgcgagcgtcgacgcgctggcccgccgcagggcggccgcctcgggcaaccggtga

SEQ ID NO: 2188 - DNA, 804 bp, Actinoplanes utahensis
gtggccgcgacacccctactggaactgcgcgggatcaacaagagcttcggtcccgtccaggtcctgcacgacgtcggactcaacgtctacccgggcgaggtcaccgccctggtcggcgacaacggcgccggtaagtccaccctggtcaagtgcatcagcggtatctacaacatcgactcgggcacggccgtcttcgacggcaaagaggtcgccatccacagcccccgggacgcgtcggctctgggcatcgaggtcgtctaccaggacctcgcgctctgcgacaacctggacatcgtccagaacatgttcctcggccgggagaagaagcgcggcgtcgtcctcgacgaggcgaccatggaggagatggccggcgagacgctgcgcagcctctcggtacgcaccgtcaagtcgctgcgccagctggtcgccagcctctccggcggtcagcggcagaccgtggcgatcgccaaggccgtgctctggaacagcaaggtcgtcatcctcgacgagccgaccgcggccctcggcgtggcgcagaccgcgcaggtgctcgagctggtccgccggctggccgacaacggtctcggcgtcgtgctgatctcgcacaacatgaacgacgtcttcgccgtgtcggaccggatcgccgccctctacctcggccggatggccgcccaggtgaagagctccgatgtgacgcactcccaggtcgtcgagctgatcaccgccgggcgcagcggcaacctcggtctgccgcccgagaagccctccgacttcgtcgacatcacgccgggagaagagcagtga

SEQ ID NO: 2189 - DNA, 1110 bp, Actinoplanes utahensis
atgcgtaagggactgttcgcccttgccgcggtcggcctgctggccaccggaagcatggccgcctgtggcgacaagaaggacgacacgaccccgagctcgggcggcagcaacgccgcttcggcgggcaaggtcggcgtcatcctccccgacaccaagagctcggctcgctgggcgaccgcggacctcaagtacctgaccgacgcgttcaaggcggccggcgtcgacgccgacatccagaacgcgcagggcgacaagacccagttcgcgagcatcgccgacggcatgatctcgaagggcgtcaaggtcctggtcatcgtcaacctggactcgggttccggtgccgcggtgctgaagaaggccaaggacgcgggtatcgcgacgatcgactacgaccgtctgaccctcaacggtggcgcggacttctacgtgtccttcgacaacaccaaggtcggccagctgcagggccagggcctggtcgactgcctgaccgcggccaaggtcaccaagccggtcatcgccgagctcaacggctcgccgaccgacaacaacgccacgctgttcaagcagggctacgactcggtgctcaagccgaagtacgactcgggcgactacgtcaagggcccggaccagagcgttccggactgggacaacgcccagggcggcaccatcttcgagcagatgctgaccagcaacaagaacatcaagggtgtgctggccgccaacgacggtctcggcaacgcggcgatctcggtgctgaagaagaacaagctgaacggccaggtcccggtgaccggccaggacgccaccgtccagggtctgcagaacatcctcgccggcgaccagtgcatgacggtctacaaggcgatcaagaaggaggccgacgcggcctccgcgctggccatctcgctggccaagggccaggcgccgaccacggcgaccggcagcgtcaccgacccggagtcgaagaaggacgtcaagtcggtcctgctcgacccgcagtcgatcaccaaggcgaacgtcaaggacgtcgtggcggacggcttcgtgaccaaggaggagctctgcaccgcggacttcgccaaggcctgcaccgacgctggcatcagctga

SEQ ID NO: 2190 - DNA, 483 bp, Actinoplanes utahensis
atgccgaagagggcggccggcaccccggccactgtgctgctgaccgcgcagcgggtggcgcacaccctgcacccgtaccaggtgtcgccggacgcgccgaactacggcgccctggtcgcggcggctctgggcgtggcgccggagcgggtgttcaagacgctggtggccgaggtggacggtgccctggtggtcggtgtggtgccggtcaccggcgagctcgacctgaaggcgctggcgcacgcggcgggcgggaaacgggcggcgctggccgaccgggcgacggccgagcgcagcaccggctacgtccgcggcgggatcagtccactgggtcagcgcaggcgactgcccacagtgatcgacgactcggcgttcggtgcggagccgatgtacgtctcggccggccgccgcggtctgcaggtgagcctggcgccggccgacctggtccggttgaccagcgccaccgtcgcggccatccgggcgtga

SEQ ID NO: 2191 - DNA, 1170 bp, Actinoplanes utahensis
gtgacccctgaactccttgctctgctgcagaccccggaaggtgagcaggccctggccgtggcgaccgggatgggcgacggcgagccgctcgccgcggcctcggccctgcgggcccggggcttcggcgcggagctggccgcagccgcactcacccaggctagtttgcgccgccgggcggcgatgaaattcggcccggacgccgccggaatgttcttcacccggcacggcctggagcaggccacccgggcggtggtcgcggatcgccgggcggcccggctggtggcggccggcgtcaccagcctcgccgatctcggttgcggcctcggcgccgacgcgctcgccgccgcgcggcacgggatcacggtgtacgcggtggacgccgacccggccaccgccgccctcgccgcggcgaatgcgcacgccgccggcctggccgaccggatcaccgtgacctgcgccgacgccaccaccgtcacggtggagaggttcgacgcggtcttcgccgatccggcccgccggcagagcggccgcggccgggtgttcgacccgaagtcgtattcgccgccctgggacttcgtcgccggactggccggccgggtcccccgcacggtgctcaagctggccccggggatcgaccacgggctgctgccgccgggcgccgagggcgagtgggtgagtgtcggcggcgacctggtggaggcggccttctggtgcggtccgctggccgccgtgccgcgccgggcgaccctggccggggtcggcgagctcaccggcacgggggaccggcgggccccggtcggcccggtcggcgcgtggttctacgaccccgatccggcggtggtccggtcgcacctggtggccgagttcgccgagcggatcggcgggcggctgggtgacccggagatcgcctacgtctacaccgacgacccggtggacaccccgttcgcccggcggctggcggtgaccgacgtgctgccgttctcgctgaagcggctgcgcgcgctgttgcgcgaccgcggggtgggcaccctggagatccgcaagcggggttcggcgctcgtaccggatcagttgcgcaaggatctgaaactgtccgggccgcaggccgcgggcttggtcctgacccgggtggacggtgcccccacggtgttgctgaccgagcactcctga

SEQ ID NO: 2192 - DNA, 309 bp, Actinoplanes utahensis
gtgactaccgcgaccaaggttgcgatcaagccgctcgaggaccgcatcgtggtccaggccaacgaggcggagaccaccacggcgtcgggcatcgtgatccccgacaccgcgaaggagaagccgcaggagggcaccgtcctcgccgtcggccccggccggatcgacgacaagggcaaccgcgtcccgctcgacgtcaaggtcggcgacgtggtcctgtactcgaagtacggcggcaccgaggtcaagtacgccggtgaggagtacctggtgctctccgcccgcgacgtcctcgcggtcatcgagaagtaa

SEQ ID NO: 2193 - DNA, 1647 bp, Actinoplanes utahensis
atggcgaagatcctcagcttctctgacgacgcccggcacctcctggagcacggcgtcaacacgctcgccgacacggtcaaggtcactctcggcccgcgcggccgcaacgtcgtcctggacaagaagttcggcgctccgacgatcaccaacgacggcgtgaccatcgccaaggagatcgagctcaccgacccgtacgagaacctcggcgcccagctggtcaaggaggtggcgaccaagaccaacgacgtcgccggcgacgggaccaccacggcgaccgtgctcgcccaggcgctggtccgcgagggcctgcgcaacgtcaccgcgggcgccaacccgatcggcctcaagcgcggcatggacctggccgccgaggtcgtctccaaggcgctgctggccaaggccgtcgaggtcgccgaccacaaggcgatcgcgaacgtggccaccatctcggcccaggacgccaccatcggtgagctgatcgccgaggcgatggaccgggtcggccgcgacggcgtgatcaccgtggaggagggctcggcgctgcacaccgagctcgacgtcaccgagggtctgcagttcgacaagggcttcatctccccgaacttcgtgaccgacgccgagtcgcaggaggcggtgctggaggacgcgcacatcctcctcaccacccagaagatctccagcatcgaggagctgctcccgctcctggagaaggtgctgcagaccggcaagccgctgctcatcgtggccgaggacgtcgagggccaggccctgtccaccctggtggtcaactcgctgcgcaagaccatcaaggtcgccgcggtgaaggcgcccggtttcggtgaccgccgcaaggcgatcctgcaggacctggcgatcgcgaccggtggcgagctgatcgcccccgagctcggctacaagctcgaccaggtcggcgtcgagcagctgggcagcgcccggcggatcgtcgtcgacaaggagaacaccacgatcgtcgacggcggcggcaactccgccgacatcgccgaccgggtcgcgcagatccgcaaggagatcgaggcctcggactccgactgggaccgcgagaagctctcggagcggctggccaagctctccggcggcatcgcggtgatcaaggtcggcgccgcgaccgaggtcgagatgaaggagcgcaagcaccgcatcgaggacgccatcgcggcgaccaaggcggccgtcgaggagggcaccgtcccgggcggcggcgccgccctcgcgcaggtcgccacggagctcgacggtggtctggggctgaccggcgaggaggcgatcggcgtctcgatcgtccgcaaggcgctggtcgagccgctgcgctggatcgcgcagaacgccggccacgacggttacgtcgtggtggccaaggtcgccgagctgggctggggccacggcctcaacgcggccaccgaccagtacgtggacctggccgcggccggcatcatcgacccggtgaaggtgacccgcaacgcggtctccaacgccgtctcgatcgccgcgctgctgctgaccaccgagagcctcgtcgtggagaagccggccgagccggccccggcggctgccggcgggcacagccacggtcacgggcacggccaccagcacggtcccggcttctga

SEQ ID NO: 2194 - DNA, 1803 bp, Actinoplanes utahensis
gtgagccgtccgcttccggtggccggccgcgcgcaggcctggcggtacgcccgatccctgttccgcagccaccccggcatgttccgggccacggtcgggctgcacctgctcgccgcgtgcgccgggctggccggcccgcgcctgctcggcgagctggtgcagggggtgcagcgcggggtgcacgaggccgagctgaaccggctggccgccaccctggccggtttcgtgctggtgcaggcggtgctggtgcgctatgcctacctggcttcggcccggctcggcgagcaggtgctggcccggctccgggaggagttcatcgcccgggcgctgtccctgccgctgggcacggtcgagtcggccggcaccggggacctgctgacccgtaccacccgggacgtggacgcgctctccaaatgtgtccggctggccgtgccggagaccacgatcgcgctgctcaccggtgggctggtggtggtcgcgctggtcgcggtgtcgccggtgctggcgttgccgctgctgatcggggtgccgatcacggtggccggcacgcggtggtacgtgcggcgcgccccggccggctatctgcggcagaacgcggcgtactcggacgtcaccgacgggctggccgagacggtcgagggcgcccgcacggtggaggcgctcggccggcaggggcagcggatcgcgcgtaccgaccgggatctgcaccggtcctggcgggccgagcggtacacgcttttcctgcgcaccgtgtggtggccggtgatcgaggtcagctacgtgctgccgatggtgctgaccctgctcaccgggggctggctctatctgcgcggaacggtcggcctgggccagctgaccgcggccgtcgtctacgtccagcagctgatccaccccctcgaccggctgctctcctggctggacgagctgcaggtgggcgcggcctcgctggcccggctgctcggggtgaccgcgaccgccgagccgccccggccggccgccccggtcccggacggtccccggatcgaggtgcgcggcctgcgcttcggctacgtggcgggccgtgaggtgctgcacggtgtcgacctgacgttgcggccgggggagcggctggccgtggtgggcccgtccggcgccggcaaatccacgctcggccggctgctggccgggctgcaccagccgaccgccggcagtgtcacggtcggtggcgtgccgctgggtgcgctcgccccggaccggctgcgcaccgaggtggcgctggtcagtcaggagcatcacatcttcatcgggacgctgcgcgacaatgtggcgatggcccggccggacgcgccggaaccggacgtgcgcaccgcgcttgccgccgtgcatgccctggagtgggtcgacgcgctgccgcacgggctggacaccgaggtcggagacggcgggcaggtgctgaccgcggcccaggcgcagcaggtggcgctggcccggctggtcctggccggcccgcacacgctggtgctggacgaggccacggcgctgctggacccgggggcggcccgtgatctggaacggtcgctggcggccgtggtgcacgggcggaccgtggtggcgatcgcgcaccgcctgttctccgcccacgacgccgaccgggtggcggtggtggaggacggccggatcaccgagttgggctcgcatgccgacctggtggcggcgaacgggtcgtacgccgccctgtggcgctcctggcagggcggtggcgaagccccggagaagcctccggacatggcaagggcgcgcccccgccaggacgcgcccttctag

SEQ ID NO: 2195 - DNA, 1890 bp, Actinoplanes utahensis
atgtgtcgagtgacgtctattcgtccacggatcatcgcatcgtcgtcatctccaaatggcgaaacaccccggagagcctgcccagcccgccggagaagctggtggcacgcgctccgcacgtctgggatttcacccccgtcgatcgctgagcggtcgcagcacgggcgttcccggccgtaccgtcggggcctgatgcgcagactgcccgtggccgatcccggcctgcccgacgcccggtccgccacgcgttacctgagctggctgatccggcgctcccgtatgacgatgctcactgcgatcgcgctggcgatcgcctggatggggtgccagtcgctggtgccggcgatcgtcggtgaggcgatcgacgcggccgccgaacgccgtggccgggcgttgctcggctgggggctggtgctcttcgcggccggggtggcgcaggccgtcgccggtatcagccggcaccggttctcggtggtcaactggctcggtgccggtttccggacggtgcaggtcaccgtccggcaggcgaaccggctcggctcgtcgctgccgcggcggctggaggccggcgaggtggtggcgatcggcacctcggacatcaaccacatcggcggcgcggtggacgtcgcggcccggggcgccggggcgctggtcgcggtcggcacggtcaccgtgctgctgctgcgcacctcggtcccgctcggcctggtggtgctgatcggggtgccggccctgatgatcgtcgtaggtggactgatcggcccgctgcacgcgcgtcagcagacctaccgggagcggcagggccggctcaccgggcaggccgccgacctggtgaccgggttgcgggtgctgcgcggggtgggcggcgaggcggtcatggtggcgcggtaccggcagcggtcgcaggcgctgcgggtggccggggtgcgcaccgccgaggtggagtcgctgctggaggccgcccaggtgctgctgcccgggacgttgctggtgctgatcacctggctgggggcccggttcgcggccgagcaccggatctcgatcggccagttggtgtcgttctacgcgtacgccgccttcctggtctcgccgctgcggcagctcaccgactcgatcgacaaactgacccgcgggcacgtctcggcccgccgggtcgccgacatgctcggcctgcgccgtgacctgcccgatccgccggcgaagccgccggtgacggtaccgccgcccggcggcgaactggccgaccccctctccggggtgctggtcatgcccggccggctcaccgcgatcgtggccgaggatccggccgacaccgcccggatcgccgaccggctcggccggtacgcgcccggggccacctgggacggcacaccgctgaccgcgatcccgctggaggtggtgcgggagcggatcctggtggtggagaacgaggcgcggctgttctccgggcggctgcgcgccgacctcgatccgcaccggaccccgcggctggccgaggcgctcgcggcggcgtcggcacaggacatcgtggacggtctgccgggcggtctggacagtgtggtcgccgagcgcggccggtcgttctccggcggtcagcagcaacggctgcggctggcccgggcgctggtcgccgacccggaattcctgatcctggtcgagccgaccaacgcggtcgacgcgcacaccgaggcccggatcgccgagcggctgcgcgccgtacgggccggccgcaccacggtcgtctgcacctccagcccgctggtgctggcgcacaccgaccgggtgttcttcgtggagtgcggccgggtgaccgctgccggggcgcatccggagctgctcgccgccgagcccggctacgcccgtgtggtgctgcgcgaggagctgtcgtga

SEQ ID NO: 2196 - DNA, 1053 bp, Actinoplanes utahensis
atgcgtgacgagcccctggtcctcgggatcgagacctcctgcgacgagaccggtgtcggcatcgtgcgcggccacaccctgctcgccgacgcactggcgtccagtgtggaccagcacgcccggttcggcggcgtggtccccgaggtggccagccgcgcccacctggaggcgctggtccccaccatgcggcgggcgctggacgaggccggtgtcacgctggccgacgtcgacgcgatcgcggtcaccagcggccccggcctggccggcgcgctgctggtcggggtggccgccgccaagggatacgcactggccgcggagaagccgatctacggcgtgaaccatctggccgcgcacgtcgcggtggacactctggagcacggcccgctgcccgagccggcgatcgccatgctggtctccggcggccactcgtcgctgctgctggtcgacgacctgacggccggggtgaccccgctgggggcgaccatcgacgacgcggccggcgaggcgttcgacaaggtggcccggctgctcgggctgggcttcccgggcggcccgatcatcgaccggtcggcacgggacggtgacgccggcgcgatcgccttcccgcgcgggctgaccgccgccaaggacctggccgcgcaccgcttcgacttctccttctccgggctgaagacggcggtggcccgctgggtggaggcgcgcgagcgggccggcgagccggtcccggtggccgacgtcgcggccagcttccaggaggccgtctgcgacgtgctgaccgccaaggcgatcgatgcctgccgggagcacggggtgggcaccctggtgatcggcgggggtgtggcggccaactcgcggttgcgggtgctggcggagcagcgggcggcccggcacgggatcgcggtacgcgtaccacggccgcagttgtgcacggacaacggcgcgatggtcgcggcgctcggctcgcatctggtggccgccggcgtcgcgccgagtcgtctcgaccttccggcggattccgcgatgggtttgaccgcggtcagcgtcgcggggtag

SEQ ID NO: 2197 - DNA, 438 bp, Actinoplanes utahensis
atgcgcatcgagcgactccgctggtggcacatcgaggcgatcctcccgctggaggaggatctcttcgggccggagaagtggtccgccgccatgttctggaatgagctggcgcagcggaactactacatcgttgccctggaaaacgatgacatagccggttatgccggtttgtccgtggtggaccgggaggagtcctgggtgcagaacatcgcggtccgccgggatgcccagcgcggcggcatcggccgcgccctgctggaggatctgctcgccgaggcggcccgccggggcgtcggccgcaccctgctcgaggtggccgtcgacaaccatccggcacagaagctgtacgccacctacgatttcgagccggtcggcatccggcgcggctactaccaaccgagcaacaccgacgccctggtgatgatgcgagatgcgtga

SEQ ID NO: 2198 - DNA, 657 bp, Actinoplanes utahensis
gtgctcgtactcgctctggacaccgcaacgcccgcctcgacggcggcgctcgtcgaggtcaccgcagacggtttgttcggggtggcggaaagtcgcacggtcgacccccgggcgcacggcgagaaactggcgccggagatcgccgcggtgctcgccacggccggggtgcgaccatcggatctgaccgcgatcgtggccggcctgggcccggggccgttcaccggcctgcgggtggggctggccacggccgcggcgatggggcaggcgctgggcatcccgacgtacggggtgtgttcgctggacgcgctggggcgggcggccgggccggggcgggtgctgatcgccaccgatgcgcggcggcgcgaggtgtatttcgcgtcgtacgtcgacggcgtacgcaatggtggtcccgatgtctccaagcccgccgatgtcacggtgaacgcggacagggcggcgggcgagggggcgttgaagtacggggacgtcttcgggctgccggtggaggagcacctgctctacccgccgggtgccgcgctggtggccctcgcggccgaccgggtccgggccggggccgcgagcgagatcctcaccccgctctatctgcggcgtccggacgccgtcgagccggccggtcgcaagccggtgctgacctga

SEQ ID NO: 2199 - DNA, 684 bp, Actinoplanes utahensis
gtgaacctgaccgagcacctccccgccgagtggcgcgccgagctggcccccttcctggatgcgcaggcgacggccgagctgggcgagttcgtcgccgcggagtacgccgagcacaccgtctaccccccggcggaggacctgttcgcggcgtaccggctgtgctcgccggagcagacccgggtgctgatcctcggccaggacccgtatcacggcgccggccaggcgcacgggctgagcttcagcgtccgcgagggggtccgggtgcccccgtcgctgcgcaacgtcttcaaggagctcgccgaggacgtcaacatcgccccgccgaagagcggcgacctgaccggctgggcgcggcagggggtgctgctgctcaacgcggtgctcacggtccgggccggcaaggccgcctcgcacgccaacaagggctgggagacgttcaccgacgccaccatccgggcgttgaacgagcgcaacgagcgggtcgtcttcctgctctggggcaactacgcgaagaagaaggcggcgctggtcaccaacccggtgcacgcggtgatcgaggccggccacccgagcccgatgaaccccgccgggtttctcggcagccgcccgttcagcgccgccaacaaggcactcgccgacggcggccggccggtggtgaactgggacccgcgggccaccgtctag

SEQ ID NO: 2200 - DNA, 450 bp, Actinoplanes utahensis
gtgaagctgaccaccgtcgagcagacccgggccttcggccgccggctcgccgccgtgctgcgcccgggggacctggtgctgctcaccgggccgctgggggccggcaagacggcgctggcccagggcatcggcaccgggctgggcgtgcaggggccgatcacctcgccgaccttcgtgatcgcccgggtgcaccgcggcccggtgccgatggtgcacgccgacgcgtatcggctgggcgaccgccccgacccgcgcgccgagatcgacgacctggacctggacgcctccgccgacgaggcggtcaccgtggtggaatggggcgccggtctggtcgagcaactgaacgacgaacatctcctcgtccgcctcgagcggctggacgacgacacccgagtgatcgagctgacgccgcacggcggcgactgggcacaccgactggagcagatgtga

SEQ ID NO: 2201 - DNA, 1107 bp, Actinoplanes utahensis
gtgagccggtcccgtgcggccaagacggccgggatagccggggcggtcgtcggggtggcggcggccggtctggcgaccgcgttcgccgtggagcgggtgttggtccggcgctcggtcaacaagcccggtgatccctatgtcgacgagccgttcggcgatcagccctatgacgaggagcgcaccgtcaccgcggcggacggcaccgagctgcacgtggagatcgtcgatccgcgggccgaggagccccgcggctggaccggccggcccgggcgcggccggaaggagaaacccaccatcgtcttcgtgcacggtttcgcgctggacatgggcaccttctacttccagcgcaaggcgctggccgagcgcggcgaccaccgcctggtcttctacgaccagcccggccacggccgttccagcaggctgcagtccggggcgtatgacatcgccgccctgggccgttcgctggccgccgtgctcgacgcgaccgtcccggacgggcacatcatcctggtcgggcactcgatgggcggcatgacgatcatggcgttcgccgagcagttcccggagtggttcggcaaccgggtgaccggcgtggtgctgatgtccacctcggccgggctgttcgacaaggcgaccctcggcctgaccaacgtggtggcccgggccagcgcgccgttcttcccgctctgggatcgggcggccaagctgggcggtggcaccatcgaccgggcccgggtggcctcctccgacctggcctggctgctcacccggcggtacgggttcggggaggcccggcccagcccgtcgctggtcaccttcgtggagagcatgaattcgcggacctcggtggagaccctcaccaaatacctgaacacgctgtatcgccacagccggctgccggcgctgtccgcgctgcgcggcgtcccggtgctggtcgtcgtcggcgaccgggactacctcaccccggtcacccactccgagcagatcatccgcgagcttccgcaggccgagctgctgaagatcgagaacagcgggcacgtggtcatgctggagaaggccgacgaggtgaacgcggccctgatcccgttcctggagaagatctcgtga

SEQ ID NO: 2202 - DNA, 1119 bp, Actinoplanes utahensis
atgtggcaggccgaagtccgcgtgaatctggacgccatccgggacaacgtcgcgatgctgcgcgccggcacctccgccgaggtgctggtcgcggtcaaggcggacggctacgggcacggcatggttccggccgcccgggccgcggtcgccggcggcgccacctggctcggcgtggccaccctcgacgaggctctggagctgcgccggggcgggatcgaggcccgggtgctggcctggctgttcgcccccgggcagccgctgcacgaggggatcacggccggcgtcgacctgagcgcggccaccccggaactgctcgacgagttggtcaccgccgcgcgccgggccgggcggccggcccgggtgcacctgaaactcgacaccgggctgtcccggggcggcgcggtgccggccgagtggccggccctgttcgaggcggcggccaaggcgcaggccggcggggacgtcgaggtgaccggggtgtggagccacttcgcctgtgccgacgagccgggccacgagtcggtcgaccgccagctggccgcgttcaccgacggcctggccgtggcggagcggttcgggttgaccccgcgctaccggcacatcgccaactcggcggccacgctgacccgtcccgacacgcacttcgacctggtccgggtcggcatcgcggcgtacgggttgtcgccgatcgcgggcgagacctacggcctgcgtccggccatgacggcccgcgcccgggtgacgatgaccaagcgggtgccgggcgggcagggcgtgtcctacgggttgacctatcacaccgagcgggagaccaccctggccgtggtcccgctgggctacggcgacggggtgccgcggcacgcatccagcgccggcccggtgcggatcggcacgaccaccgcgcggatcgccgggcgggtctgcatggatcagttcgtggtcgacctgggtgacgccccggtggcgcccggtgacgtggcgacgctcttcggggcgggtgacgacggcggccccaccgcggacgactgggcggcggcggccggcacgatcaactacgagatcgtcacccggttcggcagcgggcgggtgccgcgggtctacaccggggaggtcgcgtga

SEQ ID NO: 2203 - DNA, 1452 bp, Actinoplanes utahensis
atgcggcaggcatggcgggtcgccgatgtgcgcgcggcggagaagacgctgatggcgacgctgccggagggtgcgctgatgcagcgggccgcggccggtctggcccgccgctgtgcgctgctgctcgaggactccggcggggtgtacggcgcccgggtgttgctgctggtcggcagcggcgacaacggcggtgacacgctgtacgccggggccctgctggcgcggcgcggggcgcaggtgcgggcgctgctgctcagcccggaccgggtgcatctggccgggctcgccgcgctgcggcaggcgggcggcttcaccaccgccgacctgcccacccgggtcgatctggtgctggacgggatcgtcgggatcggggccagcggtgggctgcgaccgcccgccgcggcgctcgtcggggcgctcggcgagctgcggggacgtaccggtgatcggcctttgatcgtggctgtcgacgtgccgagcggggtgcgggtggacaccggcgacgtgcccggcgacgcggtggacgccgatgtcacggtcaccttcgggtgtctgaagccggcccacctggtgggccccgcggcgccccgctgcgggcacgtcgagctggtcgacatcggtctgggcccggcgctggtcgccgacccggcggtgcgggtggccgaggcggccgacatcgccgcctggtggccgcgtcccggtgctgcttcggacaagtacacccgcggcgtggtcggcctggccaccggttcggccggatatccgggtgccgcgctgctctccacggccggcgcgctggccggcccgaccggcatggtgcggtacgccggcagcgcccaccgggaggtggtccacgcccacccgtcggtggtggcggcgccgaaggtggccgacgccggccgggtgcaggcctgggtctgcggttccgggctgggcaccggcgacgaggcccgcaccgagctgcgcagcgtgctggccacctcgttgccggtgctgctggacgcggacgcgatcaccctgctggtcggcggggagcacgccgagcacctgcgccgggacgcgccgctggtgctgaccccgcacgacggcgagttcaagcggctggccggggaggcgccgggcgccgaccggatggccgcggccgcccggctggccgcctggacgaacgcggtggtgctgctcaagggcgaccggacgatcgtggcgacgccgggcggagagatctgggccaatccgaccggcagcccggcactggccaccgcgggcagcggggacgtgctggccgggctgctcgggtcgctgctggcggccgggctgccgccggtgcgggcggcggtggcggcggcgtacgtgcacgggctggccggccggcatgcggcggcggacgggccggtcacctcgccggatgtggcggcggcgatccggccggtgctggcccacctactggggtga

SEQ ID NO: 2204 - DNA, 369 bp, Actinoplanes utahensis
gtgatcgtgtctgtcggcatcgacgtcgtcctggtcgaccgcttcgcccgcgctctggaccgcaccccgctgctcggggaccgcctgttcaccgaggctgagcggctgaccggctcgggcaatccgcgctcgccggagtcgctggccgcccggttcgcggccaaggaggcggtggccaaggcgctgggcgcgccggtggggctgcgctggcacgactgcgagatcgtcaccgacccggacgggcggccgtggttgaccgtctcgggtacggtcgccgccgccgcctccgagcgcggcatcaaccgatggcacctgtcgctgtcgcacgacggcgggatcgcctccgcgatggtggtcgccgagcagtga

SEQ ID NO: 2205 - DNA, 288 bp, Actinoplanes utahensis
atgaatccggatctcgacgtggataccgagacactgcaccggatcgccgacgcgacggagggaacggcgtcccgggtgcgcgaggccgcctcgtcggccccgcacccggtcgccggcccccagtgggccaccaccggcgccgccaccatcacctcggacacggctgcccgaaccctgcgccaactcggcgccgacctctccgacaccgcctccaggatcaaaaccaccatcacggcgtacgcggcggccgacacccgagccgccacccgcctccggtccacccgatga

SEQ ID NO: 2206 - DNA, 408 bp, Actinoplanes utahensis
atgagcgttcacccggtgaccgtcgggccgacgctcaccgtcacctatgaccgtctgcgcgtgaccgacccggctcgctgggccgcagccgcgctgacctggcgccgctgggccgccctggcaggcgtgctgtgcgccgagttcgggccactgatcgagggcttgcgcacagcctggtccggcgcagccgccgaggccgcggtcctccggctggccacgctccgccgccgtctggtggtgttccgcctgctctgctggcgagccgaccagatcctcagcgagttcgccgccgctctcacccgagcccgcgcacttctggaccgggcccgggccgccgcagccgccgcggccagctcgggcggcctcggccagggcggtaccggcccgggcgccggcggcactagctag

SEQ ID NO: 2207 - DNA, 1137 bp, Actinoplanes utahensis
gtggatctggtgcccggcgtgcccgggccgggcgccgccgagctcggcaacgctctgcggctcgccgcgagcgccgacgcgagcgcggcagcgcgtctggccgagctgacggcgatcccggtggcgccggcttccgacgaccggccgagttgcacggccaccccggcgcaggtccggttgtggtgggccgccctgtccccgggtgagcggatgtggctgctcggcaccgagccgactgccttcggcgggctcaacgggatccccgccgccgaccgtgacctggccaaccggttgctgctcgccgatcgccgcgacgagctgttgcggcacggcgggaccgcgggcaccgtgcagggtctggaccgcctggcggaccggctggccgacgaccggggcccccgggcgtacctgatgggcctcgacgtctccggcgacggccgggcggtggtcgccttcggcgacccggatcgggccgccaatgtgctgacccacgttccgggcatgacctcggacctggcctcgctgaacggtgagctgacccgcgccgagcgggtcgccggccgggccaccgacctcggcccggccgaggcgaccagcgccgtcctgtggctcgactacgacgccccggatttcctgcccgaggcctcgtcggcccgccaggcccgggacggcgccggtgcgttgcggttgttccaggacggcctgcgggccacccacgagggcgcggccgcccggcagacggtgctcggccacagttacggttcgctggtcgtcggcgaggcggcgaccggcggcctggacgcggaccgggtggtgttcgtcggctcacccggcgtcggcgtcgaatcggcggcccagttgcacctgccggccgaccgggtgttcgcctcgacgtcgatcagcgacccgatccaatatctggcggtctccccggccggcgcggcccgggagttggtgccgggcctggggctggcgcccaccgagcacctctggttcggccacgacccgagcgacccggccttcggcgcccaggtgttccacacccaggccgacggcggccacctcggctactgggatcccggcaagccggccctcgacgccctcgccaccatcaccctgggcggacacccgaaatga

SEQ ID NO: 2208 - DNA, 1920 bp, Actinoplanes utahensis
atgacgtttgcgcgaaagtcggctacgctgcccggcatgtgtgggatcgtgggttacgtaggcaatcgcccggccttgagcatcgtcctcgatggcctccggcgtctggagtaccgcggatatgactccgcgggtatcgccgtcatcgacgccggcgaggtgcacaccgagaagcgggccggcaagctggccaacctggagaaggccctggcggagcgggccgccggtggaatcgccgccgggcacaccggcatcgggcacacccggtgggccacccacggcgggccgaccgaccgtaacgcccacccgcacctgtccgccgacggccgggtcgccgtcatccacaacggcatcatcgagaacttctcccggctgcgcgccgaactcgaagcggacggggtcgagttccgcagcgacaccgacaccgaatgcgccgcccacctgctcgccgccgagatgcgggcgctgcgcgcggccggtggccaggacggcccggcgctgctcgccgagggcatgcgccgcgtggtgcgccgcctggagggcgccttcaccctgctcgccgtcgacgtcgaggtccccgacgcggtgatcgccgcccggcgcaactcgccgctggtcgtcggccgcggcgccggcgaatacttcctggccagtgacgtctcggcgttcatcgagcacacccgggaagcggtcgagctgggccaggaccaggtcgtcctgatcactccggccgggatcgagatcaccgacttcgacggcgccccggcgaccgggcaggaattccacgtcgactgggacgcgtcggccgccgagaagggcggttacgactacttcatgctcaaggagatcgccgagcagccgcaggccatcgcggacaccctgctcggccggctcagcgagcgcggcgagatcatcctggacgaggtgcggctcaccgaccaggacctgcgggacgtggacaaggtgttcatcgtcgcctgcggcacctcgtaccacgccggcatggtcgccaagtacgccatcgagcactgggtccggatcccctgcgaggtggagctggccagcgagttccggtaccgcgacccgatcctggaccggtccaccctggtgatcgcgatcagccagtccggcgaaagcatggacaccctgatggcgctgcggcacgccaaggagcagaaggcccgggtgctggccatctgcaacaccaacgggtcgaccatcccgcgcgagtcggacgcggtgctctacacccacggcgggccggagatcgcggtcgcctcgaccaaggcgttcctcacccagctggtcgcctgctacctgatcggcctgcacctggcccagatccgcggcgtgatgtacgccgacgaggtcgccgcggtcgtctcccggcttcgccgcaccccggacaacctgcgtgagctgctcgacaagatggaggacgtgcgcgcgctggcacgcgacctgaagagcgcctcgacgatcctgttcatcggccggcacgtcggcttcccggtcgccctggaaggcgccctgaagctgaaggagctcgcctacatgcacgccgagggcttcgcggccggcgaactcaagcacggcccgatcgcgctgatcgaccagggcaccccggtcgtctgcgtggtcccgtccccggccggccgcggcgtcatgcgcgacaaggtcgtctccaacatccaggaggtccgcgcccgcggcgcccgcaccatcgtcatcgccgaggagggcgacgagagcgtcaaggcctacgccgaccacctcatcgaggtcccgcacacccccaccctgctggccccgttgatgaccacggtgccgctgcagatcctggcctgcgaaatcgccgccgcccgcggccacgacgtcgaccagccccgcaacctggccaagtccgtcaccgtcgaataa

SEQ ID NO: 2209 - DNA, 567 bp, Actinoplanes utahensis
atgagcgatcagcgcgatccggcgcgggactatccgcctaccgcacagtttgcgccggtcggatacccgccaccggattatcggcaacatcggcgcagcaacgccccgctgatcgcgctgatcctggcgatcaccctgctgctctgcggcggcgtgatcaccactgtggtgctggtcgcccggcgcacctcggacaaggccaaggagacggtgcagaagattccgaccgccctgcccaccccgagcaggctgcccaagctccccgccggtggtgacgacgaccacaccaagctcacggtgcgatacgaggtgagcggcgacggccccgccacgatcatctactcggagaaactgggactgccgaaaacggtcaacgaggcgaagctgccgtggaagatcgcggtccgcatggacgggttgtcgttcgtctcggtgtccgcgctgcggctgtccctgcaggacggcagcatcacctgcaaggccatcatcgacggcaagacggtcgacgagcacaccgcgaccggtgtcggcgccaccgcgacctgcaacaagctcacgttcaattag

SEQ ID NO: 2210 - DNA, 1158 bp, Actinoplanes utahensis
ttgagcacggacccgctggtcgaacggatgcgtccgttcgggaccacgatcttcgccgagatgtccgcgctcgcggcgcgcaccggtgcggtcaatctcggacagggcttcccggacaccgacggcccgccggagatgctggcggccgccgcgcaggccctggcgagcggcgccaaccagtatccgccgctacccggcatcccggccctgcggcacgcgatcaccgggcacgagcggcggttctggggcctgacccgggacccggacaccgaggtcgcggtcaccgccggggccaccgaggcgatcgccgccgcggtgctggccctctgcgagccgggcgacgaggtggtctgcttcgagccctactacgactcgtacgcggcctcgatcaccctggccggggcggtccggcgcccggtcacgctgcgccccggcccggacgggcgctacgagttcgacgaggcgcagctgcgcgcggcgttcggcccgcgcacccggctggcgctgctcaactcgccgcacaacccgaccggtaaggtcttcaccccggccgagctggccctggtcgccgagctgtgccaggcacacgacgccgtcgcggtcaccgacgaggtctacgagcacctggtcttcgacggggtgcacgtgccactggccaccctgcccgggatgggcgagcgcaccctgcgcgtctcgtcggccggcaagaccttctcctgcaccgggtggaaggtcggctgggtcaccggcccggcccggctggtctccgcggtgctgcgggtcaagcagttcctgaccttcgtgaacgcctcgcccctacagccggcggtggcggtcgcgctggggctgcccgacgcgtacttccaggatttcaccgccgggctgcgcgccaaccgggaccggctgacggccgggctgaccgcggccgggttcgaggtgttgccgtcccaggggacgtatttcgtgaccgccgacatccggccgctgggcgggaccgacggcgtcgaattctgccgtgggctgcctgcccgctccggtgtggtggccgtgcccacccaggtcttctacgaccaccgggaggccggccgccacctgatccggttcgccttctgcaaacgccccgaggtgatcgaggaggcagtggcccgcctcaagtga

SEQ ID NO: 2211 - DNA, 1356 bp, Actinoplanes utahensis
atggggcgactcttcggcaccgacggcgttcgcggtctcgcgaacggcgatctgctcaccccggaactggccctctcggtcgccgtcgcggccgcccgggtcctggtcgaggccgacagcagccaccagccgctcgcgatcgtgggccgtgacccgcgggccagcggcgagatgctggaagcggcggtcgtcgcgggcctgaccagcgcgggtgccaatgtggtccgggtcggcgtgctgccgacgcccgcggtcgcgtacctggtggggcagaccggcgccgaccttggcgtgatgctctccgcgtcacacaacccgatggcggacaacgggatcaagctcttcgccgccggcggccagaagctgccggacgagctggaggagcggatcgagaaggcggtcgcggacgggcacggcctggtcgggcggcccaccggcgccggcatcggccgggtgcacgacctgctggacggcgccgagcactacatcaagcacctggtcgagtcgatcccgcaccgcctcgaaggcatcaaggtcgtggtggactgcgcgaacggcgcggccagcgatgtcggtccggtggcctaccgggaggccggcgccgaggtgatcgcgatccacgccgagccggacgggttgaacatcaacgaggagtgcggctccacgcacctcgacaaggtgcgcgacgcggtgctggccgagggtgccgacctgggtctggcccatgacggtgacgcggaccgctgcctggccgtcaccgcggccggtgacgtggtcgacggcgaccagatcatggcgatcctggcggtggccatgcgcgacgcgggcacgctgaccgaggacaccctggtcgcgaccgtgatgagcaacctgggtctgcggatcgcgatgaagcagtccgggatcaagctgctggagaccaaggtcggcgaccggtacgtgctggaggaactgcagggcggcggtctggccctgggcggcgagcagagcgggcacatcgtgatgccggcgttcgccaccaccggcgacggcgtgctgaccgggctgcacctgatggcgcagctggcatcgagcggcaagtcgctggccgacctggccgcggtggtgcacaagctgccgcagaagctgatcaacgtgaaggtgggcgaccgggaagccggcgcagccgcgccgaccgtgcaggccgccgtggcgctggccgaggccgaactgggcgagaccggccgggtgctgctgcgcccctccggcaccgagccgctggtccgggtcatggtcgaagccgcgaccgaggagcaggccggtgcggtcgccgcccgcatcgcggacgaggtgcgggccgccagccccgtcgcgtga

SEQ ID NO: 2212 - DNA, 507 bp, Actinoplanes utahensis
atgaccgacatcatcgagcccgaggtcgtcgagaccgtcgagaccgtcgaggagcccgctgagacggtcgtcgtcgtcgagacgcccgcgccggctccggttcgcgccccgcgtcccggtgaccgtccggtccagaccgtgggccgccgcaaggaggccatcgtccgggtgcgcctcgtccccggcaccggcaagatcacctgcaacggccgtgagctcgagaactacttcccgagcaaggtccaccagcagctgatccgcgagccgctcgtcaccgtcgagcgcgccgagcagttcgacgtgatcgcgaacctgcgtggcggcggcatcaccggccaggccggtgcgctgcgcctcggcatcgcccgcgccctgatcgcggacgaggccgacgaccgtcccgccctgaagaaggccggcttcctgacccgtgacgctcgggtcaaggagagcaagaagtacggtctcaagaaggcccgcaaggccccgcagtactcgaagcgctga

SEQ ID NO: 2213 - DNA, 510 bp, Actinoplanes utahensis
gtgtcgacgtcgagttcgacgcgaccagcgcgcgcccccagaccgacgacgagacaaggtaattctgtgcgtacgtacagcccgaagccgggtgagatcgagcgtcagtggcacattatcgacgcttctgacgtcgttctgggccgcctggctacccacaccgcgactctcctgcgtggcaagcacaagcccacgttcgccccgcacgtcgacacgggcgacttcgtggtgatcatcaacgccggcaaggtcgcgctgaccggcaacaagcggcagaccaaggtcgcctaccggcactccggttacccgggtggtctgaagcaggtcggttacgaggagctgctgtccaagcgccccgagaaggcgatcgagctggcggtcaagggcatgctcccgcacaacaagctggcgcgccagatcatcaagaagctgaaggtctacccgggcgccgagcacccgcacgccgcgcagcagccgaagccgttcgaaatcacccagatcgcgcagtga

SEQ ID NO: 2214 - DNA, 1215 bp, Actinoplanes utahensis
gtgcccttcggtggaccgcccggccacgccgcgacttctcactttcccatccccggccgctgcggcccttcccccgctgttcggcgccggatgacggagcggatcccggcggcacgacggtcggcgctggacgagcccgcggccgtcctggccggatacaccgtcggcgtcacctccgaccggcgccgggatgagctggccgccctgctggagggccgcggcgcccgggtcgtgctcgcccccgcgctgcggatcgtgccgatcgccgacgacgccgaactgcgcgccgccacccgtgcctgcctggactcacccccggacatcgtgctggtcagcaccgggatcgggatgcgcggctggctggaggccgcggagagctgggggctggccgagccactgcgcgcggtgctcgaccgctcctatctggtcgcccgcggccccaaggcgcgcgccgcggtccgtaccgccggcctgcgggaatgctggaccccggagggcgagagctccgcggaggtggtcgagcacctgaccacccgcggcctcggcgggctgaccgtcgccctgcagttgcacggggagagccagcccgaatacaccgaggtactgcgcgcggccggcgcccgggtgatcgagttgccggtctaccgctgggcgccaccgaccgacaccgcgccgctgcaccgcctcgtcgacctgatcgccggccggctggtcgacgccgtgacgttcacctcggcggccgccgtgcacgcactgctgcgcgccgccggtccggccgtcgatccgctgctggacgcactccgctcggacgtgctggccgcctgcgtcgggccggtcaccgccgagccgctgcgccggctggagatcccggtcacgacgccggcccgggcccggctcagcgcgctggttcgcaccctgaccgacgaactcccccagcgcgcggtctccctgcaggtcaacggccacgcgatcacgctgcgcgggcacgccgcggtgatcgacggccggctgcgccagctggccccggccccgatggcggtcctgcgcgccctggccacctcaccgggccgggtcctgtcccgcgccgctctcctgcaaaccctcccccgccacgccgacgaacacgcggtcgagatggccgtcgcccgcctccgggccgccatccccggcatcgtccagacggtcgtcaagcgcggctaccgcatcgccggctag

SEQ ID NO: 2215 - DNA, 612 bp, Actinoplanes utahensis
gtggacttcgcaagctctgagtgggcgggggcgtccccttcggagatcacctccgcgaagatcgtcatcgctggtggtttcggcgtcgggaagacgaccctggtcggcgcggtctccgagatcgagccgctgaccacggaggccgtgatgaccgcggccggggccggcatcgacgacgcctccaaggtgccggagaagggcaccaccacggtggcgatggacttcggccggatcaccatggccgacgatctgatcctctacctcttcgggacgcccgggcagacccggttctggttcatgtgggacgagttgatcaggggcgcggtcggcgccgcggtgctggtcgacacgcggcggctgaccgacgccttcgccccgctggactacttcgagaaccggcacctgccctacctggtggcggtcaactgcttcgacggcgcgccgcgctacgagccggaggaggtccgggaggcgctggcgatcccggcccgggtcccgctgatcatgtgcgacgcccggcaccgcgagtcggtcaaggcggttctgatcggcgtcgtcgagcacgccatgaccacgctggtcgccgaacacgagcagggcgtgaccgtgtga

SEQ ID NO: 2216 - DNA, 363 bp, Actinoplanes utahensis
atgagtgagccgcacgatccccggggcaacctggtgcggccgtacgcggtgacccgcggccggaccgagccgatccgggacatcccgatcgaagcggtcctggtcgccagcccggcggccgtgcaggagtcacgtttcgccgggcacgacaagtaccgcatcgccgcgctgtgtgagccgaaagcactatcgctcgccgagctcgcggcgttgacccggttgcctctcggggtggcccgggtcctcgtcgccgacatggtcgccgacggtttgctcgcgctgcacagtgccgctcccaagcgtggcttcacggagcggatggatctgctgggaagggttttgagtggacttcgcaagctctga

SEQ ID NO: 2217 - DNA, 414 bp, Actinoplanes utahensis
gtgaccaggcctcccaccatgcaggacatgggctggctgctcaacaacttcgccgacagcatcgccgggatcgcgcacgtggtggcggtctccgcggacggcctgttgctggcatgctcccgggatctgccgccggaccgggcggatcaactggccgcgatcacctccggggtggtcagtctcaccgacggtgcgtcccggatgttcagcgccgggaaggtgcagcagacgatcatcgagatggacagcggttatcttttcctgatgtccatcagcgacggttcctcgatggcggtgctggccgcgcgcagctgcgacgtcggccaggtcggttacgagatggccctgctggtggagcgcgtcggcgccgccctgtcgccggtggcccgcgaggccgtcggccacgccagatag

SEQ ID NO: 2218 - DNA, 2568 bp, Actinoplanes utahensis
gtgagcacgggatcctcgggcctgcctgtgcgacgtggtccgctctcctggtcgcgcgacgccgggatccgcaccaaactcgccggcctgatggtcattccgctggtggccgctctggcgctggcctcggtgcggctgatcgacgtacgcggcaccgcgtccgacgccggccgggtcgccgacctcacccggatcggcaccgacctctccggcctgagccggctgctgcaccaggagcggatggccgccgccgcgttcctcgccgacaccggcgcggcgccggaccgtttccggacggcgaccgaggcggtcgacacccagatccggaccttccgtgcgcaccgcaccgccctcggtgacgtcccggcccgggttgccgaccggcttcggctgatccaggagcagctcggcacgctcaccgacatccggggcgcggtcgaggcccgcaaggacctgccgatcgtcaccatggcccagcgctacgaccaggcgctcgaccagatcttcgacttcgacgacgtggtcgtccagatcgccgagccgggcacggtcgccgacggtctccgcgggctcgccgcgttcggccgcatccaggaggcggtggccgaccaggaggccaccgggtacgtcgtgcaggccacccgtcagctcggcgcggcccagcaacaggagctgatcggcgctcaggtcgcccggcaggcggcgctcgacgacttccggcagattgccgaccgcgaccagatcggcctggtcgagagcaccctgtcgaaccccgtggtggcccaggcggacggactggtcacccggcttgccggcggcgggtcggtggacgccgacgagctgaccacgacgtacggccaagtcctcgatctgcttcaggacaccggcggcagactcgacggacaggtcgccgaggacgcccggtacgaccgggacgccgccgcgcggcgggccaccgtcgagttcatcgtcgtgctgctggtgctgaccgccgcgatcgcgatcgccgccttcctcgcccgccggctgcacctgtcgctgcggatgctgcgcgagggcgcgctcgccgtcgcgcaccgcgacctgcccgacgcggtcacccggctgcaggacgcggacagcctcggcgagggtggcgtcgaccggatcgtcgccgagacccgcgacccgttccggctcaccgatcgcgacgagttcggccaggtcgccgaggcgttcaacatggtgcaccgggaggcgatccgggtcgccgcggaacaggccgccctgcgcaccagcgtctccgcgatgttcctcagcctggcccggcgcagtcaggcgctggtcgaccggatgatcggcgaactcgaccagatcgaacgcaccgaggaggacccgaagcggctcgccaagctcttcgacctcgaccacctcgccacccggatgcgccgcaacgacgagaacctgctggtcctggccggcgccgacgtgggcgccccgcgccgcgaggacgccctgctggtcgacgtgctgcgcgccgcacagtccgaagtggagcagtaccaccggatcgagttcggcgcgatcgacaccgacgtggcggtcgccgcggccgcggtcaacgacgtggtccggctgatcgccgagctgctcgacaacgccacccgcttctcgccgccgaccacggtggtgatggcccacggacggcgctccggtgagcagctcgtggtccaggtcgaggaccggggcctgggcatcaccccggaacaactcgaggtgatcaaccggcggctggccgaaccggccgaggtcgacgtggccgcgttccgcctgatgggtttcgcggtgatcgcccggctcgccgcccggcacggcatcacggtccgcctgctgccgcaccgcgagggcggcacgatcgccgagatcagcctgccggccgaggtcaccgtcctgcccggaatgcagagcaccccgggacgcgcggccagctggacacgtcccggcccgccgccgcaggcgatcgccggagcggagcgtgctacgccggaggtccgcccgccggtacgtaccgtcccggcgcccaccgcgccggccgctccgcggtgggcggcgatcgagcccggcccgcagcccgacctggacctgcggccgacaccggaccggccgccgctgcccacccgagtgccgaagccggacgtgggcgcggaacccgccccgacgccgctgttcaccccggccgccgcgcccgtctcggcgcatccggtgtccgcacatccggtgtccgtgcatccggtgtcggcgccgatccaggtcaggatgcagcacagctggttcgagggggaggcggcggccggtccgcgcgggatgccgaccgcgggctacgcgccggcaccggtctccgcgatgcccgccaccgcgccggtgagtgcggcgccggtctccgtgcccgcggcgagtgcggcgtccgtctccgtgcccgcggcgagtgcggcgtccgtctccgtgcccgcggcgagcgcggcgccggtctccggcggtggggcggtgccgcgtccccgcccggcgctcgaggaccggtggcctagctag

SEQ ID NO: 2219 - DNA, 1371 bp, Actinoplanes utahensis
gtgaagctgctcgccaccaccgccacggcagccgcggtggtcggcgccggccaactcggcatcgcctacggcctcggcatcgtgcggctcgaccgcgtcctcgacgtcactgcgcgtgatcaatggaccgcccatctggcctgggtcgcctggatcacgatgaccgccgccgcgctcggcgcgatcgtcggcaccggcatgcgggcccgctggctgccccacccggccggcgccggcggcgcgctcgccaccggactcgccggcggcctcggctccctggccgtcctgccgctgaccatgcagccggcccgagccgcgcaggtcgccggggtgcagccggtcttcgtcatcggcgtggtcgccgggctcggcgccgcggccggcatcttcgccggctgggcggccgccgccaaaccggccgcccgctggaacgtggccaccctgagcgtgctgatctggctgatcgcgctggtcaccatcgggccgtcgctgcgagccgggcacaccccgcccgcggtccggctcggcgtgctcggcggcagcctcatcccggccgccgtcagcgcgcacaccgcactcctcaccatgccgaccctcgcgctgctcgccggcctggtgatcggctccaccgcccgcgggcgcaggatgtcgacgctggccgcgggcctcgccgggttggccggcccggccctgctcacggtcgcctacctgatcgccgggccggaactgaaagcggccggattcgccgacgacccgtactgggcggcgatgaccgcgtgcggggccggggtgctcgggtcggtcctggccgccatcgtgcggggaaaccccgcccccacggaaagcgcggactcccccgcggagaccgcgtcgctgccgaagcgggacgtccccgcccggtccgcgatcgcccaggccgcggcggccgccgccgcgcggcgcccggaggaacaggtgcgtcctgccgacaccggggtgatcccggccgggcaacccgggacgccggacaacccgttctccggcggcaccggcagcccgttccgatccgggacgccgttcccgccgcagcccgtgccgacccaggcgccaccgcaggctccggcaccggagaaggcgccccgcttctccgggcagcagccgaccccgatcgccaccgggcgcggcggctggcgcggacgccgctcgaccccggcccccgcatccaccccggcgccggccgccgactccttcaacggtttcgccgcggcccagccgcccccttctcccgcgcagcgcggaccggtcgtcgagcccacctcgatcagcagtccgcgccggtccggccaggaaacggactatgtcgactgggtgagcggcctcggcggccagtaa

SEQ ID NO: 2220 - DNA, 405 bp, Actinoplanes utahensis
gtgaccacttccctgccccgcctccgaaagctgctgctgagcctcgccctgatcctgggcctggccggcaccgcgctcgccgtcccgtccgccgcccaggccgccgtctactcctcgtgcacgatcagccggtgctcggccgcccgcaccgcgtacaccggctggcagactctcggctggccgctgagcagcggctggtacgtctggccgtacggcagctacaactacaccggcggcaccttccagaaccgtgagggctacctgccgtcggccacctacaacgagtacgacgtgtactcccgcgccaagggcgcctcgcgggacgcctaccgcatcgtggtcaaccgcagcaccaaggtcgcctacttcaccccggaccactacgtgacgttctacaaactttga

SEQ ID NO: 2221 - DNA, 453 bp, Actinoplanes utahensis
atgcgcagcatgcttcagctcgtgggcggcgtcgcggcggccggcgtggttgccgccggagccaccgctttcaccgcgcccggcctgaccaacagcgtggcaacctccacgaaggttatctcggccggttcgctgtccttctcgaccgtcgagggcgccgagctgaccagcgtcgtcaccctttccagccgcaccaacaaggcggaaatcaccggagtccggctctacctggcaggcctgaacagcacggcgctcaacacgaccaccaccgtcgtcaacgcgtccatcaccggcaccagcgcccccgccggctccgtggtcggcacggtgcgcaccttgacctgcgcctacaactcgacgccggcggcctgggactgcaacgtcaccaccgcgggcaccgactacctgaccgcgctcaccgccgtcaccgtcgacgtccaggccggcgtctag

SEQ ID NO: 2222 - DNA, 2967 bp, Actinoplanes utahensis
atggccgccatcctgttgatggcggccatcgccgcgtgggccatcggaacccaccgcatctcctacgtcgtcacgcacggcatcagcatgaacccggtctactacgccggggacctggtggtcgtcgtcaaaagcgattcctacgaagtcgggcagatcgccgcataccatggtgtcggcggcgtggaaaccctccaccgcatcatcggcggcgatcccgacaccggttacgtcttcaaaggagacaacaaccagtcgatcgacatcccgcaccccacagcggatcaactcatcggacgcgcggtcctgcacgtctcgcagggcggcgtctgggtccgccggctgctgagcccggccaccctgggaatggtcggctttttgatcatcggcgccggcagcccggccggcgcccggacccgcagagacctgcgtcgccgtcgacgcgagaggaaagcgaagggcatggctggccaagggggctcgtggacagcggccgcggtcgtggtcaaggccgtcagccgccttcatcccctgcttcgcgtcctcgccgtcgggaccgcctgctgcgcgctgaccggcctggtcctcggcgtcctgagctggatgaagcctgccacgcaggcgagtccgagcagctcatcgagcggcgagtcggtgaccttctcatactcggcccaggtccagtcgtcggccgcctacgacgggacggtcgcctactcccccgacccgatctatcggaagctggcgcacttcgtcgacctgcggctgcagtatcacggcaagcccggccggatcggcgtcgacgcccggctgtccgcccaggcctggcactcgacggtgcagctggcccagtcccgccagttcaccgccgaccggtacaccggcactgtcctgctcgacctcgacggcatcgacgagcgggtggcggacgccgccgacgcgatcggcaccgacctcaccccggtcaccatcatggtgacggcgcacatcgaacaccccgacgggacgtcgttcgagccgcagctctccctctcgctcagctccctgcagctgagcctgagcggcgacgcgaacagcctgatcgtcagccagtccggcaggacgtcgggcggcgggatctatccccggcagatcgccgtgctcggccacgacctgatcacggcgggccgggcccggacgtacgcgttgcgcctgctcctgatcgcgatcgtggggatcatcggcatcggcctggccgcggtgcggcacgtgccgctcgccacccgggctcagatccagcggcggtacgggcatctgctggtgccggtcgaaccgctgaacggcaagcagggtgaagcggtcatcacggtggcctcggtgccggcgctggtgaagctggcggagaagtacgggcagatgatcctcacctggacccggccggacggggcggacgacttcgtggtccgcgacgacggggtgatgtaccggttccggatcacgccgcagcgtccggttaccgggaaaccgccgctgtccggggttccgcatccggcccgccggtcccagaggtccgccgccctcggcatcgcgtccctggtcacggccccacctcagcacaccaccgaagccaccgcggccaccgaaccggccaccccgtcgcccgagcccgcggcggccaccgcaccggacccgagcccggagcccgcgcccgcggtgcccgcggaacctgccgcggcctccgagcccaccccggaacccgtcgcggaagccccggcttccgccacggaatacccgcagcccgccccagagcccgtcgtagaagccccgacacccgccacggaatacccgcagcccgccccagagcccgtcgtagaacccgccccggaaaaccggcagcccggcccgcaacccgtcgcagaagccccggaacccgtcgcgaaggccccggcgtccgactctcccgagccgacgccttccgcaccggaatcggctgtacccgcaccggacgaagaagaactgaagaaggagccggaagactctgagccggcaaaggcggacgccgcagacgaggggccggaggcggctgccgagactcccgtccccgaacagcgcaccgaacccccggccgaagcggggttcgcaccacccgctgagccggagtcgacgtcagaggcggacaccaccgaatcttccgccgaagcggtggcggccgaagagaaggccgaggcatcgaccgagaaggagccgatgcccgccccggttctcgaacccggcccctcagccgaggaagaacccgccgcggaggcgaggccggaagttcccgcggaagcgaagcccgacgctcccgcgcaagtgaagccggagaccgctgcggaggcgaagccggaaaccgcggcgcaggcccccgcggaggcgaagccggagaccgctgccgaatccccggccccggctcaggcccagcgcccccgccgcacccgcaagccgcgccaaaagcccgaatcgaagccggatccggatcccaccatcgccgcgccggaaacaaatgccgcgccggaggcgaaggtcgcgcaggaaacgaccgccgcaaccgtgccggaggcggaggccacgcaggaaaggaccgccgcagccgcgccgcaggcggaggccgtcaccgccgggaaaaccccgcagaagcgcgccccccgccgcaaaccgcgccccagaaaagccaccccatcacccaccgagacgaaggccaccaccccgatgagcacagagttcgcccccgccgaggtcaccgcgaaggccgccgtcgatgaacgacaggcggccgaggacctcgccgaccgcaacaaggatctcgacgaggccatcacccgcaaggctgtccgtgaccaggcggccgccgaccgggcccgccagcagcggctggcgaagtccgccccgcgggacccggcctacgattttctgccccgcaatcagcgccctgaccagcccgaagactag

SEQ ID NO: 2223 - DNA, 1518 bp, Actinoplanes utahensis
atgaggcgcaaggtctacgtggagggctcccgtccggagatccgcgtcccgttcaccgaggtggtgctgaccggcgacaacccgtcggtccggctctacgacacctcgggcccgggcagcgaccccgagcagggcctgcccgcactgcggaaaccctggtgggacgggcgaacccagctcgccgcggcgcgggccggcgacatcacgccggagatggagttcgtggcggtccgcgaaggagtcgacccctcgctcgtgcgcgacgagatcgcggccgggcgggcggtgctaccggccaaccgcaaccaccccgagtccgagccgatgatcatcggatcgaagttcctcgtgaaggtcaacgccaacatcggcacctcggccgtgacctcgtcggtcgccgaggaggtggagaagctgacctgggcgacgcggtggggcgcggacaccgtgatggacctgtccaccgggccgcggatccacgagacccgggaggcgatcgtgcgcaactcgccggtgccgatcgggaccgtgccgatctaccaggctctcgagaaggtcaacggagacccgctgaaactcacctgggagctgttccgggagaccgtgatcgagcaggccgagcagggcgtggactacatgaccatccacgccggggtgctgctcgcctatgtgccgctggccgctgaacgggtcaccggcatcgtctcccgcggcgggtcgatcatggcggcctggtgcctggccgaacaccgggagaacttcctctacacccacttccgggaactctgcgagatcttccgggagtacgacatcaccttctcgctcggcgacgggctgcgccccggatcgatcgccgacgccaacgacgaggcgcagttcgccgaactgcggacgctcggcgaactgacccacatcgcctgggagtacgacgtgcaggtgatggtcgaaggccccggccacgtgccgatgcacaagatcaaggagaacgtggacctgcagcgggaactctgcgacggcgccccgttctacaccctcgggccgctggccaccgacatcgcgcccgcctacgaccacatcacctcggcgatcggcgccgcgatgatcggcatgttcggcaccgcgatgctctgctatgtcaccccgaaggaacacctcggtctgccgaacaaggacgacgtcaaagccggcatgatcgcctacaagatcgcggcccactcggcggacctcgccaaaggccacccgggggcgcaggcgtgggacgacgcgctgtcccacgcccggttcgacttccgctgggaagaccagttcgaactcgccctcgacccggaaaccgcccggtcgtaccacgacgagacactgccggccgcgcccgccaagaccgcgcacttctgctcgatgtgcgggcccaaattctgctccatgaagatcagccacgagctgcgggccgccggcatgaaagccaagtccgaggaattcgtcgacggcggagcgcgggtctacctgccggtcgtgccgtaa

SEQ ID NO: 2224 - DNA, 762 bp, Actinoplanes utahensis
atgacgccgcccgtggtgctgaccatcgccgggtcggactccggtgggggagccgggatccaggccgacctcaagacgttcgcggccctgggggcgtacggggtgtcggtgctcaccgcgatcacggcgcagaacacgctcggagtgaccgcgatccacccggtgccggccgggatcgtggcggcacaactcgacgcggtactgaccgacttcaccgtggccgcggtcaaggtcgggatgatcgccgactcggcggtggcgaaagtgatcgccgagcgggccgccgaactgccgaatctggtggtcgatccggtgctggtgtcgacctccgggagccggctgggggaggcggcgacggtccgggtgctcacggcgtacgcccgggtcgtgacgccgaaccgggaagaggccgcagccctggccggatgccgggccgagacggtgccggagatggccgccgcggcggccgagatcgccgcgaccgggccgcgcgccgtggtggtgaccggaagcgatctcgcggtcgacgtcctctgggacgccggccggatcaccgaactgcacggcgagccggtttcgacgccgaacaaccacggctccgggtgcaccttctcgtcggcgatcgcggtgcgcctggcgatgggcgacccggtgccggcggcggtcgcggcggccaaggagtacgtgtcgggggcgctgcgcggtggcgccgcgtggcggctgggtgccgggcccgggccgctgaaccacttctccggctga

SEQ ID NO: 2225 - DNA, 609 bp, Actinoplanes utahensis
gtggtgacgccgaccgggctcgtcgtgctcaccgaccggcggtccgccgccgggccgctggtggagacggtggccgcggcggtacgcggcggcgcgggctgggtgatcctccgggaacgcgatctgccgtacggcgaccgtgccgccctggccgcgcaactgcgcgccgtggtcccgcccgggcggctgatcgtggccgggcccgatccgctcggcggtgccgccgtgcacctggccgccgccgacccacggccgggcggcgtgccgctggtcggcagatcgtggcacggcaccgagccggtgtccgaggtggactatgtgacgctgtcgccgatcttcccgaccgcgaccaagccggggtacgggccggatctgggcgtggatcgggccgcgcggctcgccgcggggatgccgtggctggcgctcggcggggtcgactcggcggcccgggcggcgtcctgcgcgaccgccggggccgatggggtcgccgtactcggcgcgatcatgcgggccgccaacccggaacgggtcgcccgcgtcctggccggcgccttcgccgcggccgccgccgggtcgcccgcggccgccgacctcgggggtgtccgatga

SEQ ID NO: 2226 - DNA, 750 bp, Actinoplanes utahensis
atgggcgatctcctgccggagaacgggctgatcgtcggcaccggcggcgcgaacagcctggccgcgctcgaagaggcgatcgtcgcctcgcagaccgacctggtcaccgtggcgctgcgccggatcgaggcggccggtccgggactgctgccgatgctcgaccggctccgggtgcggatcctgcccaacacggccggctgctacaccgccggggacgcggtcaagaccgcccggatggcccgggaggcgttcgagaccgacctgatcaaactggaggtgatcggcgacgagcggaccctgctgccggacggcgtcgagctgctccgggcggccgagacgctggtcgcggacggattcacggtgctgccctacaccaccgacgacccggtcctggcccgccggctcgccgacgccggctgcgccgcggtgatgccggccggctcgccgatcggctccggactgggcatcgccaacccgcaccacatcgagctgatccggcagagcgtggacgtgccggtggtcctcgacgccggcatcggcaccgcctcggacgcggtgctggcgatggagctgggctgcgacgcggtactgatcgccagcgcgatcacccgggccgacgagccggccgtgatggccaccgcgatgcggcacgcggtcgccgccggacgactggcccggcaggccggtcgcatcccccgtcgcttccacgccgtggcgtccacaccggacgaggggatcccggtgtggtga

SEQ ID NO: 2227 - DNA, 1017 bp, Actinoplanes utahensis
atgagggtgggaatcgtcggcggcgggatgatcgggctcgccaccgcggtcgaactgctgcgtcgtggcgccgatgtcacggtctacgacccggagccggacggctccgcgggggcctggcacgtggctgccggaatgctcgcgccgggcggcgaatcggtgttcgagtttcccggactggagcggctgctcgcagcgtcgaacgcattgtggccggcattcgcggcgtcgctcggtgacgtcggctatgacaccgcgggaacgatcggcgtcgccatgacggccgacgatgtcgccgaaatggcacgcgagtggaagcaccagaaactgaccccgctcaccggatcgcgggtgcgggaactggcgccggcgctgtccccgcgggtgcgtgccggggtcttcgcgccgaccgagaaacaggtggatccacgccgggtggtcgccgcgctgcgcggcatcctcggcgggcggatcgtccgggccgacgtgcgcgatctctgcgaagtggacgccgacgtcacggtcgtcgcggccggctgcggcaccgcaccgctcaccgggctgccgatccggccggtcaaaggccagatgctgcggctgcgcggcgagccggggctgctgcggcacgtgatcgacggtgcggccgacggccggcacgtctacctggtgccgcgcgccgacggcgaagtcgtggtcggggcgacccaggaggagcggaccgaccggcaggcgaccgccggcggcgtccacgacctgctgcgcgccgccctcgacctggtgcccgggctggccgagcacgcactcgccgaggtcaccgtcgggcaccggccgggcaccccggacaacgccccgatcctcggcgtgctgcgacccggcgtgctggtcgcggccgggcaccaccgcaacggcgtgctgctcgccccgatcaccgcgcggctgatcgccgacctggtcctcaccggcaccaccgacccgatcatcgacgatttcacccccgggaggttcggatgcgcctga

SEQ ID NO: 2228 - DNA, 585 bp, Actinoplanes utahensis
atgggcgctgtttcgttcccccgtctccacgtcatcaccgacgatctcgatgtcgtccgggcggtggcgcagcccggcgtcgcggtgcagatcagggtcaagaccaacgacttcgcggcgtacgccgtagcccgcgaagccgtgccccggtgccgcaccgcgggggcgttgtgcctggtcaacgatcgcatcggggtggctctcgcgaccggcgcggacggcgtgcacctgggcgccgacgacctgccggtggccgccgcgcgccgggtgctcggtccggaggcggtgatcggggccacctgccggacaccggaggcggcgcgcgccgcggtggccgacggggcgacctatctcggggtgggcccggcctttcccacctccacgaaggacggtctgccgccgccgctcggaccggacggggtgaacgcggtcgccgcggccgtgccgggcatcccggtggtggcgatcggcgggatcactctggagcgggtggggctgctcacgacgtacggcgtagccgcggtgaaggctttcgacggtgaccccgcgggcgctgccgcggcctttctggcggccctgcaatga

SEQ ID NO: 2229 - DNA, 1647 bp, Actinoplanes utahensis
atggggtacgtggatgtggccggcgccgggttcgtcctgccggacgggcgcgagctgttcgccgacgtgtcgttccgggtcggcgagggtgccaaggtggcgctggtgggtccgaacggggccggcaagaccaccctgatgcggatggtggccggcgacatcccggcgcagaccggcaccgtggcgcgggtcggtgggctgggcgtgatgcgccagttcatcggcatgatcggcgacgaccggacgttggaggatctggcgctgtcgctggtcgcgccgccgctgcgggcggccggtgagcggcttgcgacggcgaccgcggcgctcgacgagaccgagcgcacccagctggcctatgcgaacgcgctggcccactggggtgaggtgggcggctatgacgccgaggtgctgttcgacacggtgaccgtcgcgatcctcggcaggtcgtgggacgaggcccggtcccggatcgtgcgcaccctgtccggcggcgagcagaagcggttcgccctcgacctgctgctgcgcggccctgacgaggtgctgctgctcgacgagccggacaacttcctcgacgtgcccgcgaaacgctggctggagcagcggatccgcgagtcggccaagtcgatcctctacgtctcgcacgaccgggagctgctggcccagaccgccgaccgggtggtcgcggtcgagggtggcggcgcctggacccatccgggcggcttcgcctcctggcacgaggcccggtcgaaccggcacgagcggatggaggagctgcgccgccgctgggaggaggagcacgagaaacttcgcgagctggtcttcacgctcaagaacaaggcggccttcaacgacggcctggcctcgcgctaccaggccgcgcagacccggctgcgcaagttcgaggaggccgggccgcccccgctgccgcccaaggagcagtcggtccggatgaacctgcgcggcggccgtaccggcaaacgctcggtcatctgcgagagcctggaactggaggatctgaccttcccgttcgacctggagatctggtacggcgaccgggtcgcggtgctgggtgccaacggcaccggcaagtcgcacttcctgcgcctgctcgcggccggcggcagcgaacccgacctggagcacaagccggtcgacggcgcaccgctcgcgcacgtcgcgcactccggggtggcgcggctcggtgcccgggtccggcccggccacttctcgcagacccatgaccggcccgagctgaccgagcgcaccctggtcgagatcctctggcgcggcgacgagcaccggtcgggagtagaccgcgccggcgcgatgaaggcgctgagccgctatgagctcggcgctcagggcgaccagcggttcggcaccctgtccggcggccagcaggcgcggttcctggtgctgctgctggagctgtccggggccaccctgctgctgctcgacgagcccaccgacaacctggacctggcctccgcggaggcgctggaggagggcctcaaggccttcgacggcaccgtgatagccgtcacccacgaccgctggttcacccggtccttcgatcgcttcgtgctgttcaggagcgataacgaagttgtcgaggtccctgaaccggtctgggacgtccgctag

SEQ ID NO: 2230 - DNA, 642 bp, Actinoplanes utahensis
gtgacacgggagactgaccgggtgagcgccgagcattacttcagcaccgacccggacgcgccactgcgccggagtgcgatcgagttcagtgtggccgggcgcgactaccggctggccgtggcgaacggggtgttctcggcggggcggctggatccggggacggcggtcctgctgcgcaaggcggagctgcccgggccggcgaccgagggtgcgctgctcgacatcgggtgcggctacgggccgatcacctgtgtgctggccagcgaggcgccgcgggtgacggtgcacgcgatcgacgtgaactcccgggcgcgggagctgaccgtggagaacgcggcggccctcggactggccggccgggtgcgggtgtcggcgcccgacgacgtgccggccggggtgtcgttcacgcagatctggagcaacccgccgacccacgtgggcaaggcggagctgcacgcgctgatggaccgctggctgccccggctcgcgccgggcggggtgggctggctggtgatcaaccggaacctcgggggtgactcgctgcacacctggctgaccgaccggggctgggtggtcgagcggatcgccagccagaaggggttccgggtgctgcgggtgaccggaaaaccggctgccatctga

SEQ ID NO: 2231 - DNA, 810 bp, Actinoplanes utahensis
atgcggtacgccaccccgagccgctccgcccaccgcgccgccccggcacccgatctgatgctcctgctccgcagcttcgcctggccccctccgcgggcagccggacccttccgggccgccgggtccggcaggcccgccgccggccagcaccggacaccagcccggacccggcggcacgcctggcgtgagccgcaccccgcccacctgatgctcgcccgcggcttggccgccctcatcgtgctcggcatcatcgccaccctcagcttcctgatcgtcagcgacgatcagcagccgggcaccgaccccgaccaggcgctcacctcgcgcgccgccgacccggaaccgctgaccgtcgccgaggccttcccgcccggcgccgccggttaccgggtggagaacacccgggcccagtccgactgcactctcgcggtcaccggcgccctgcggtccgcgctgaccgcgtacggctgctcccaggccgtccgcgccaccctcaccgtccccgacggcgactaccgggtgaccaccggcatcctgaacctggtcgacgccccgggcgcggccgcggtcgccgaccaggtccggcacctggtggagaccggcgacggcagcttcaccgcgctgaccggcaccccggtcgaacccggcaccccggtcggctggcgggcccgcggccactacctggtgtactgcgccatcaccggcccgggcggggtcgcggcgaccggccaggaccggcggctgtccgagataaccgcccaactgctcgacacgtacctcagcaaccaggtcctggcccgccgcgcttga

SEQ ID NO: 2232 - DNA, 831 bp, Actinoplanes utahensis
atgacggacaccatccggctacgactcgacgtcacgtacgacggcgccggcttctcgggctgggcggcccaaccggaacgacgtaccgtcgccggggtcttgaccgaagctctgcaccgcatcctcggagccgccggcgccgacctgccgctcggcctcaccgtggccggccgcaccgacgccggggtccacgccaccggtcaggtgtgccacatcgacctgcccgccgagcggtacgcggacctggccggcacgctgctgcgccggctgaacgggctactgccgccggacgcccgggtcaagggggtgctgccggtcccggccaccttcgacgcccgcttctcggccaccttccgccgctacgagtaccgggtctgcgacgacggctggggccccgaaccgctgcgccggcacgacaccctgggctgggtccgtccgctcgacctggacctgctcaacgcggccgcggccggcctgctcggcgagcacgacttcgccgccttctgtaaacgcaaggagcacgccaccacgatccgcgccatcgcccgcctcgactggcggcgcgagccggaccggacgctggtcgccaccgtgcaggcggacgcgttctgccaggcgatggtccgcagcctggtcggcgcgatgctcgcggtcggtgagggacgtcgtccgccggactggccggcgaagctgctcaccctgcgggaacgctccagcgaggtgacggtcgcgccggcgcacgggctgaccctggtcgcggtgggttatcccaccgaggccgactacgcggtccgcgccgacgccacccgccggctgcgcaccctgccctga

SEQ ID NO: 2233 - DNA, 579 bp, Actinoplanes utahensis
atgcccacgcccaccaagggtgcccgcctcggcggcagcccggcacacgagaagctcatcatggccaacctggccaccgagctcttccggcacgggaagatcaagaccaccgagacgaaggccaagcggctgcgcccgctggctgagcagctcatcacgaaggccaagcgcggcgacctgcacgcccgtcgccgggtgctgaccgtcgtgaaggacaaggacgtcgtgtacgccctgttcgagcagatcgctccgcggtacaccggtcgtcccggtggctacacccggatcaccaagaccggtccccgcaagggcgacgccgctccgatggcgatcatcgagctggtcgaggaggccccggtcgcggccaccaccgctcccgccgccaaggctgccgctcgcaaggccgccgcgcagcaggacaaggtcgaggcgctggctccggaggagacggttccggcggtcgccgacgacaccgtcgccgacgaccaggacgccgaggctccggtcaacgcctccggtgacaagggcgccgagggcccgggcaaccaggccgagggcgacgacatcaaggcctga

SEQ ID NO: 2234 - DNA, 1023 bp, Actinoplanes utahensis
gtgctcatcagccagcgaccgagcctctcggaagagtcgctcagcgaaacccgctcccggttcaccatcgagccgctcgagccgggcttcggctacaccctcggtaactcgctgcggcggaccctgctgtcgtccatcccgggcgcggcggtcaccagcatcaaggtcgacggcgtgcttcacgagttcaccacgatccccggtgtcaaggaggacgtggtcgagctggtcatgaacgtcaaggaactgaccgtcagctcggagcacgacgagccggtcagcatgtacctgcgcaagcagggcccgggcgacgtgaccgccggggacatccagccgccggccggtgtctccgtgcacaaccccgacctgaagctggccaccctgaacagcaagggccggctcgacatggagctgaccgtggagcgtggccgtggctacgtcaccgcggcgcagaacaagagcgcgggcgccgagatcggccggatcccggtcgactcgatctactcgccggtgctcaaggtcacctaccgcgtcgaggcgacccgtgtcgagcagcgcaccgacttcgaccgtctgatcatcgacgtcgagtcgaaggcgtccatctcgccgcggaccgcgctggcctcggccggctcgaccctggtggagctcttcggcctgtgccgggagctggacgagaccgccgagggcatcgacatcggcccgtcgccgcaggacgcgcagctcgctgccgacctggcgctgccgatcgaggagctggacctcaccgttcgttcgtacaactgcctcaagcgcgagggcatcaacagcgtgggcgagttgatagggcgtacggaggccgatcttctggacatccggaacttcggccagaagtccatcgacgaggtcaagatgaagctcgccggaatgggcctgggcctgaaggacagcgcgccttcctttgacccggcgcacgtcgtggattcgttcggcgacgtggactacgacaccgacgactaccgcgagaccgagcagctctaa

SEQ ID NO: 2235 - DNA, 627 bp, Actinoplanes utahensis
atggctcgttacgttggtgcggactgcaagcgctgccgccgcgaaaagatgaagctgttcctcaagggcagcaagtgcgacgggccgaagtgcccgttcgagtcgcgtcccttcccgcccggccagcacggccgtggccggaccaaggagaccgagtacctgctccagcaccgcgagaagcagaaggcccgccgcgtgtacggcgtgctcgagaagcagttccgcggttactacgaggaggctgtcaccaagcccggcaagaccggtgaggtgctgctgcagatcctcgagtcccgtctcgacaacgtcgtctaccgggccggctacgccgcgtcccgcgacgccgcccgccagctggtcaagcacggccacttcctggtgaacggcgtcaaggtcgacatcccgtcgtaccgggtgaaggagcacgacatcgtcacgctccgcgagaagtcgaaggagatgactcccttcgtcgtcgcgcaggcccaggccgggtcccggccggtgccggcgtggctggagcccatcccgagcgagatgaagatcctgatccacacgcttccggctcgcgcggtcatcgacacgcaggtccaggagcagctgatcgtggagctctactccaagtaa

SEQ ID NO: 2236 - DNA, 408 bp, Actinoplanes utahensis
atgccaccgaaggcacgcgcaggggccgcagtcaagaaggtccggcgcaaggaacgcaagaacgtcgcccacgggcaggcgcacatcaagagcaccttcaacaacaccatcgtgtcgatcaccgacccgaccggtgcggtcatctcctgggcctcgtccggccaggtgggcttcaagggctcccgcaagtccactccgttcgccgcccagctggccgccgaggccgctgcgcgtcgcgccatggagcacggcatgcgcaaggtcgacgtgttcgtcaagggccccggttccggccgggagaccgccatccgttcgctgcaggccgctggtctggaggtcggtcagatctccgacgtgaccccgcagccgcacaacgggtgccgtccgcctaagcgtcgtcgggtctga

SEQ ID NO: 2237 - DNA, 381 bp, Actinoplanes utahensis
atggctcgtctcgtcggcgtcgatcttccccgcgaaaagcggatggagatcgcgctcacctacatcttcgggatcgggcgcacccggtccgtcgaagcattgaccgctacggcgatcgacctgaacaagcgcgccaaggacctcacggaagaggagctgctcaagctccgcgaatacattgaggccaacttcaaggttgagggcgacctgcgccgcgaggtcgccgcggacatccgccgcaaggttgagatcggctgctacgccggcatccgccaccgcaagggcctgcccgtgcgaggacagcggacccggaccaacgctcgtacccgcaagggcccgaagcgcacggtcgccggtaagaagaagcccggtcggaagtaa

SEQ ID NO: 2238 - DNA, 117 bp, Actinoplanes utahensis
gtgaaggtcaagccgagcgtcaagcggatctgcaacaactgccggatcatccggcggcacggccgggtcatggtgatttgcagcaccgacccgcgccacaagcagcgccagggctga

SEQ ID NO: 2239 - DNA, 222 bp, Actinoplanes utahensis
atgcctaagaaagacggagccatcgagatcgaaggccgagtgatcgagcctctcccgaacgctatgttccgcgttgagctcgccaatggtcacaaggtcctggcacacatctccgggaagatgcgtcagcactacattcgcatccttcccgaggacagggtcgtcgtcgaactctcgccgtacgacctgacccgtgggcgcatcgtctaccgctacaaataa

SEQ ID NO: 2240 - DNA, 444 bp, Actinoplanes utahensis
atgcgggccgcggacagtgatcgtcagcgggtcgcggatcagttgaagtccgcgctcgacgagggccgcctggacctgaacgagtacgacgagcgggtccagcgggcctattccgcccggacctacggcgatctcgacggcctgctcgacgacctgcccggcacggttccggtgcagcacgcccaggtgcagccggcgcccccgccgccgcagccgcacccgctggccccgccgattccgcagcagccgtggaaaaaggacccgcagaccggtcggcacaccttcggctcggccctgtccgccttcctggtgtgcacgctgatctggacgatcacgtcggtcgccgccggtcacgcgtactacttctggccggcctgggtcttgatcccggtggtcatcacggcggtcggggcgctcactgagcgcaaccgccgggggcgctag

SEQ ID NO: 2241 - DNA, 837 bp, Actinoplanes utahensis
atgcgacgtcaggagctggacatccagctgaagacgccggagcagatcgagaagatgcgggcggccggcctggtcgtgcacgccgcgctggaagcgatgcgcgccgcggtcgcacccggcgtctcgacggccgacctggacgccatcgcggagaagacgatccgcgaggccggcgccatcccgtcgttcaagggctaccacggcttccccgcctcgatctgcgcctcggtcaacgagcaggtcgtgcacggcatcccgggagcccagcagatcctcgccgagggcgacctgatctcgctggactgcggggcgatcctggacggctggcacggcgactcggcgatcaccgtcggcgtcggcgagaccgacccggcactgctgcggatggccgaggtggccgaggatgcgatgtgggccgggatcgccgcggccgcccggggcgccgcgaacggccggggtcggctcaccgacatctcgttcaacgtcgagaaggtgatccgcaaggccggccggtacgggatcgtcgacggctacggtggccacggcatcggcaccgagatgcaccaggaaccgcacgtgctcaaccacggcaagccggggcgtggcccgcggctggtcgtgggcatggcattggcgatcgagccgatgatcacgatgggctcgccgcggaccgtggagctctccgacggctggaccgtggtgacccgggacggatcccgcgcggcgcacgtggagcacaccatggcgctgttggaggacggggtgtgggtgaccaccgccctggacggcggccgggcccgtctcggcgatctggtgaccgcgcgacagcctctgtaa

SEQ ID NO: 2242 - DNA, 654 bp, Actinoplanes utahensis
gtgcggctggtgttggtgggccctccgggggccggcaaggggacccaggctgagttcatcgccgcccacctcgccgtaccgaagatctcgaccggggacatcttccgggccaacgtgtcgcaggggacgccgctgggcgtcgaggccaagcgctacatggacgccggccagctggtgccggacgaggtgaccatcaacatggtccgggaccgcctggccgagccggacgccggcgacggcttcctgctcgacgggttcccgcgcacggtgccgcaggcggccgcgctggacaagctgctggccgacctcggcaccgcgctggatctggtgatggagctcgtggtcgacgacgacgaggtgatccggcggctctccggccgccggacctgccgcggctgcggcaagatctggcacgtcgagttcgacccgaccagcaaggagaacatctgcgaccggtgcgggtcggagctgttccagcgggacgacgacaaggccgagacgatcgccaaccgcctggtggagtacgccgacaagacggctccgctggtcgactactacggcgcccagggcaagctggtgggcatcgacgccaccggtccggtcgaggacgtcaccgtgcgcgcgatcgacgccctgcggtcgtacgggggctga

SEQ ID NO: 2243 - DNA, 1341 bp, Actinoplanes utahensis
ttgctctccgccttttcgagtgcgttgcggacgcctgacctgcgcaagaagttgttgttcacggtggcgatcatcgcgctctaccggctcggcgccacgctgcccagccccggtgtgtcgtaccacaacgtgcaggcttgtctgaagatcgaagagcagtccggcaaccaggtgctgaacctgttgaacctgttctccggtggcgcgctcctccagctctcggtcttcgcgctcggcatcatgccgtacatcaccgcgtcgatcatcctgcagctgctgaccgtggtgattccgcggctcgagcagctccgcaaggagggtcagtccggtcaggcgaagatcacccagtacacccggtacctgacgctcggcctggcgatcctgcagtcctcggcgttcgtcgcgctggcccgcaccgggcagctgttcggcggcctctgcgaccaggacaacccgcagttccagatcatcccggagaacaccggcatcccgatctggctgacgctgagcgtcctggtgatgacgatgaccgccggcaccggtgtggtcatgtggctcggcgagctggtcaccgaccgcggcgtcggcaacggcatgtccgtcctgatcttcacctcgatcgccgcccgcctccccggtgagggctggaccatcaagcagtccgccggcaccgcgaagttcctcctggtgatcgcgctggtcctggtgatcatcgcgctggtcgtcttcatcgagcaggcccagcggcgcatcccggtgcagtacgccaagcgcatgatcggccggcggatgtacggcggtacctccacctacatcccgctcaaggtgaaccaggcgggtgtcgtcccggtcatcttcgcgtcgtcgctgctctacctgccgcagctgtacctgcagttcttcaacaagaacacgctgaaggactaccagatctggatccagaactggctggcgacgccgaccagctggctctacatcaccgtgtacttcctgctcatcatcttcttcacgtacttctacgtgtcgatcacgttcaacccgactgaggtcgcggagaacatgaagaagtacggtggtttcgtgccgggtatccgcccgggcaagccgaccgccgactacctggacttcatcctcagccggatcaccctgccgggcgcgctgtacctgggtctgatctcggtcctaccgaacttcttcttcatctggctggaccagaagcagtaccagaacttcccgttcggtggcaccgctgtgctgatcatggtgggtgtgggtctggagacggtgaagcagatcgagagccagctcatgcagcggaactacgaagggttcctccggtag

SEQ ID NO: 2244 - DNA, 450 bp, Actinoplanes utahensis
atggcgatcaagattcatgacctgaagccggcccccggcgccaagaccaagaagacccgcgtgggtcgtggtgagggctcgaagggcaagacggccggtcgcggtaccaagggcaccggcgcccggaagaacactccggcgtcgttcgagggtgggcagatgcctatccacatgcgcctgccgaagatcaagggcctgaagaaccgcccgcggaacaaggtcatcttccaggtggtcaacctggacaagctggccgagctgttcccgaacggtggcgaggtcggcccgtccgagctcgtcgaggccggtgcggttcgcaagaaccagccggtgaaggtgctgggctcgggtgagctgggcggcgtgtcgctgacgatctcggcgcacgcgttcagtgagtccgccaaggagaagatcgcagccgctggtggttccaccaccgagctgtga

SEQ ID NO: 2245 - DNA, 183 bp, Actinoplanes utahensis
atggcgcgcttgaaggtcacccagatccggtccgagatcggccgtaagcagaaccagcgggactccctgcggtcgctcggcctgaagcggatcaacgatgtggtggtcaaggaggaccgtcccgaaattcggggcatgatcttcgccgtgaaccacctcgtcactgtcgaggaggtcgagtaa

SEQ ID NO: 2246 - DNA, 624 bp, Actinoplanes utahensis
atgcctggtcagcagcgccgtggcggcgggtccggcggtaacaccgaaggtggcggccgccgggacaaccgtcgcgagggcggccgcggtaacgcgcccgtcgagaagaccccgcacctcgagcgggtcgtcgcgatcaaccgcgtcgccaaggtcgtcaagggtggtcgtcgcttcagcttcaccgccctggtgatcgtcggcgacggtgacggcaccgtcggtgtcggttacggaaaggccaaggaggtgcccgcggcgatcgccaagggcgtcgaggaggccaagaagcacttcttcaaggtgccgcggatcggtgcgaccatcccgcacccgatcaccggtgaggctgccgcgggcgtcgtcctgctcaagccggcgtccgctggtaccggtgtcatcgccggtggcccggtgcgcgccgtgctggagtgcgcgggcatccacgacatcctctcgaagagcctcggctcctcgaacccgatcaacatcgtgcacgccaccgtggcggcgctgaagggcctcgagtccccggagcaggtcgcggctcgccgcagcctgccggtcgaggacgtggccccggccgcgatgctggcggcgcgtgcggaagcggcggtgcactga

SEQ ID NO: 2247 - DNA, 396 bp, Actinoplanes utahensis
gtgaccgccacgctgctcaagcgccgcaatggcggcggcatcgcctcccggcgggccgttggcaaggcgcgtcggcacttccgggtccgcaagaacgtgcgcggcacggccgagcgtccccgcctggtcgtcacccggtccacgcggaacatcaccgcgcagatcatcgacgacctcaagggccacacgctggcttcggcctcgaccctcgacacctcgatccggggcaccgagggcgacaagagctcgcaggccggcaaggtcggtgcgctcctcgccgagcgcgccaaggccgcgggtatttccaaggtcgtcttcgaccgcggtggcaacaagtacgcggggcgtatcgccgcgcttgccgatgccgctcgcgaagccggactcgagttctag

SEQ ID NO: 2248 - DNA, 540 bp, Actinoplanes utahensis
atgtcgcgaatcggacgtaagtcgatcccggtcccggccggcgtcgatgtcaccatcacggggcagaccgtcaaggtcaagggccccaagggcgagctctcgcacatcgtggccgagccgatcacggtgtcccaggagggcgccgagctggtcgtcaaccgcccgaacgacgagcgcaaggccaaggagctgcacggtctctcgcgcaccctggtcgccaacatgatcgtcggggtgaccgagggctacaagaagaccctcgagatcaatggcaccggttaccgtgtcaccgcgaagggcaaggacctggagttcgctctgggcttctcgcacccggtgaacatcgtgccgccggccgggatcaccttctcggtcgagaagcccacccagttcactgtggcgggcatcgacaagcagctggtcggcgaggtcgccgccaacatccggaagatccgcccgccggagccctacaagggcaagggcgtcaagtaccagggtgaggtcatccgccgcaaggctggaaaggcaggtaagaagtga

SEQ ID NO: 2249 - DNA, 408 bp, Actinoplanes utahensis
atgacgatgacggacccgatcgcagacatgctgacgcgtctgcgcaacgccaaccaggcgtaccacgacaaggtgaccatgccgtactcgaagatcaaggcgaacatcgccgaggtcctcaaggcggagggctacatcgcgtcctggacgtctgaggagcccgaggagggcgcggtcggcaagcgtctggtcgttgagctcaagtacggccagaaccgcgagcgcagcctcgccggcatcaagcgcgtctcgaagcccggcctgcgggtttacgccaagtccgacgagctgccccgcgtgctcggcggcctcggtgtcgcgatcatttcgacgtcccagggactgctgaccgacaagcaggcccgcaagcggagcgttggcggggaagtcctcgccttcgtctggtaa

SEQ ID NO: 2250 - DNA, 186 bp, Actinoplanes utahensis
atggcgaagaaggcgctgatcatcaaggctgccgcgaagccgaagttcgccgtgcgcgcctacacccgctgccagaagtgcggtcgcccgcactcggtctaccgcaagttcggcctgtgccgggtttgcgtgcgggacatggctcaccgtggtgagctgcccggcgtgtccaaggcctcctggtaa

SEQ ID NO: 2251 - DNA, 570 bp, Actinoplanes utahensis
atgactgccgccactgagacgaaggcgctgccgcgcctgaagagcaagtaccgggccgaggtcatcccggcgctgcaggagcagcacaagtacgccaaccccatgcagatccccggcctggtcaaggtcgtcgtgaacatgggtgtcggcgaggctgcccgcgacgccaagctcatcgacggcgcggtccgcgacctgaccacgatcaccggtcagaagccgctgatccgccgggcgaccaagtcgatcgcgcagttcaagctccgcgagggcatgccgatcggcgccaaggtcaccctgcggggcgaccggatgtgggagttcctggaccggctgctgtccatctccctgccgcgtatccgtgacttccggggcctcgacggccgcaagctggacgggcacggcaactacaccttcggtctgaccgagcagtcggtgttccacgagatcgaccaggacaagatcgatcgcccgcggggcatggacatcacggtggtcaccaccgcctcgaccgacgacgagggccgggcgctgctgaagctcctgggcttcccgttcaaggagaactga

SEQ ID NO: 2252 - DNA, 315 bp, Actinoplanes utahensis
gtgaagatcaagaagggcgacacggtcgtcgtcatcgccggtaaggacaagggcgccaagggcaaggtcatcgcggccttcccggcgcgggacaaggtcctggtcgagggcgtcaaccgagtcaagaagcacgaacgcatccgcaccacccagcgtggttcgaagaccggtggcatcgtgacccaggaggccgcgatccacatctccaacgttcagatcgtggacgaccaggggaagccgacccggatcggttaccggatcgacgagaacggcaacaaggtccggatcgcgcgtacgaccggtaaggaactgtga

SEQ ID NO: 2253 - DNA, 369 bp, Actinoplanes utahensis
gtgatccagcaggagtcgcgactgcgcgtcgccgacaacacgggtgcccgggagatcctgtgcatccgcgtactcggtggctccggtcgccgttacgcgagcatcggcgacgtcatcgtggccacggtcaaggacgccatccccggcgccggtgtgaagaagggtgacgtcgtcaaggcggtcatcgtccgcaccagcaaggagcggcgtcgtccggacggctcgtacatccgcttcgacgagaacgccgccgtcatcatcaaggacggcggggacccccgcggtacccgcatcttcggcccggtcgggcgcgagctgcgcgacaagcggttcatgaagatcatcagcctggcgccggaggtgctctga

SEQ ID NO: 2254 - DNA, 273 bp, Actinoplanes utahensis
atgagtgagaacactgttgcgccgcgcgcccagcgcaaggtgcgtgagggtctcgtggtcagcgacaagatggacaagaccgtcgtcgtcgaggtcgaggaccgcgtcaagcacgcgctgtacggcaaggtcatccgtcgtacccgcaagctgaaggtgcacgacgagcagaactccgccggcaccggcgaccgggtttcgatcatggagacccgcccgctgtccgctaccaagcggtggcgcatcgtggagatcctcgaaaaggccaagtga

SEQ ID NO: 2255 - DNA, 234 bp, Actinoplanes utahensis
atggcagcgggcgttaaggcagccgagctgcgcgagagctccgacgaggagctgatcgcgaagctgcgggaggccaaggctgagctgttcaaccttcgcgtgcagcgcgcgaccggccagctcgacaatcaccgtcgactgcaggtcgtccgcaaggacattgcgaagatctacacgatcatgcgtgagcgcgagctggggctctcggttgcgccggatgaggtgagcgcatga

SEQ ID NO: 2256 - DNA, 426 bp, Actinoplanes utahensis
atgctgatgccgcgtaagcccccgaagggcttccgtaagccgcaccacccggaccgccacggcgcgtccaagggcggcaaccgggtcgtcttcggcgagttcggtatccaggctctcgagccggcgtacgtgaccaaccggcagatcgagtcggcgcgtatcgcgatgacccgtcacatcaagcgtggcggcaaggtctggatctcgatcttcccggaccaggcgctgaccaagaagccggccgaaacccgcatgggttccggtaagggttctcccgagtggtgggtggcgaacgtcaagccgggccggattctcttcgagatgtccttcccgaacgagacggtcgcgcgtgaggcgatgcgccgcgcgatccacaagctcccgatgaagtgccgcatcgtgacgcgcgaagtgggtgaaagctga

SEQ ID NO: 2257 - DNA, 852 bp, Actinoplanes utahensis
atgggtcagaaggttcaccccaccgggttccgcctcggcatctccaccgactggaagagccgctggttcgcggacaagctctacaaggactacatcggcgaggacgtcaagatccgccggatgatgtccaagggtcttgagcgtgccggcatctccaaggtggacatcgagcggacccgcgaccgggtccgggtcgacatccacaccgcccggccgggcatcgtcatcggccgtaagggtgcggaggccgaccggatccgcggcgagctcgagaagctcaccggcaagcaggtccagctgaacatcctcgaggtcaagagccccgagtcggacgcgcagctggtggcccagggcgtcgccgagcagctgtcctcccgggtcagcttccgccgggcgatgcgcaaggccatgcagtcggccatgaagaacccgatctgcaagggcatccgggtgcaggtctccggccgcctcggcggcgcggagatgagccgcacggagttctaccgtgagggtcgcgttccgctgcacacgctccgggccaacatcgagtacggcttcttcgaggcccgtaccacgttcggccggatcggcgtgaaggtctggatctacaagggcgacgccgttcccggccgcgaggccgtggccgaggcgccggcgcgtccgcgccgtgaccgcgccgagcgtcccgagcgtccgcgccgtggccgttccggttcgtccggcacgaccgcgggtggcaccgaggcgggccgtgccgcggcccagtcccggtccaccgcggacggcgacaacgcgaacgacgccgcggttgccgcggctccggctccggccgaaacgcagcaggagggctga

SEQ ID NO: 2258 - DNA, 459 bp, Actinoplanes utahensis
atgccagcaaagggcgacgctccggtgcttccgggcgcgcgggcggttgcgcgacacgtgcgcatctcgccgaacaaggcgcgccgggtggtcaacctcgtccgcggtctgcccgcgaaggaggcgctgaccgtcctgcagttcgcgccgcaggccgccagcgagcaggtctacaaggtgcttgccagcgccgtggcgaacgcggagaacaacgagcggctcgaccccgacgcactcctcgtgagcgaggcgttcgtcgacgagggtcccacgctcaagcgtttccgtccgcgggcgcagggccgggcgtaccggatccgcaagcgtacgagtcacatcaccatcgcggtcgaggcggtccaggtggcccgcccggcgaagaaggccacggcgaagaaggctgccaagccggctgagccgcaggctgccgagtcccagagcacggagggtgccgagtaa

SEQ ID NO: 2259 - DNA, 282 bp, Actinoplanes utahensis
atgcctcgcagcctgaagaagggcccgttcgtcgacgaccacctgctcaagaaggtggaagtccagaacgagaagaactcgaagaacgtcatcaagacctggtcgcggcgttcgaccatcatcccggacatgctcgggcacacgatcgccgtgcatgacgggcgcaagcacgtcccggtgttcgtcaccgaggcgatggtcgggcacaagctcggcgagttcgctctgacccgcacgttcaagggtcacgagaaggacgaccgcaagagccgtcgtcgctaa

SEQ ID NO: 2260 - DNA, 840 bp, Actinoplanes utahensis
atggctatccgtaagtacaagccgaccacgccgggccgtcgcggctcgagcgtcgccgacttcgccgagatcacccggtccaccccggagaagtctctgctggtcccgctgcccaagaagggtggtcgcaacgtccacggccgcatcaccacgcggcaccagggcggtggccacaagcggcagtaccggctgatcgacttcaagcggaacgacaaggacggcgtgccggccaaggtcgctcacatcgagtacgaccccaaccgcaccgcccgcatcgcgctgctgcactacgccgacggtgagaagcgctacatcgtggcgccgaaggacctgaagcagggtgaccgcgtcgagtccggcgtcggcgccgacatcaagccgggcaacaacctgcccctgcgcaacatcccggtcggtacgacgatccacaacgtggagcttcgtcccggcggtggcgccaagctggcccgttcggccggcgtcggcatccagctcctgggccgtgagggtgtgtacgccacgctgcgtatgccctccggcgagattcgtcgcgtcgacgtgcgctgccgcgccaccgtcggtgagatcggcaacgccgagcagtcgaacatcaactggggcaaggctggtcgcatgcggtggaagggcaagcgcccgaccgtccgtggtgtcgccatgaaccctgtcgaccacccgcacggtggtggtgagggtaagacctcgggtggtcgccacccggtgaacccggcgggtaagcccgagggccgtacccgtcgcaagggccagccgagcgacaagctgatcgttcgccgccgctacgccacccgcaagcgcgggtaa

SEQ ID NO: 2261 - DNA, 303 bp, Actinoplanes utahensis
gtgagcacgatcgccgacccgcgcgacatcatcgtcgccccggtggtctccgagaagagctacagcgttctcgaccagaactggtacaccttcctggtcaacccggacgccaacaagacgcagatcaagatcgcgatccagcagatcttcaacgtccgcgtgctgaccgtcaacaccgcgaaccgcgagggcaagcgcaagcgcaccaagaccggtttcggtcagcgcaaggcgaccaagcgcgcgatggtgaagctggctgacggtgaccgtatcgaggccttcggcggcccggtcagctaa

SEQ ID NO: 2262 - DNA, 648 bp, Actinoplanes utahensis
gtgagctcggtggacatcatcaacgccgagggcgcgaaggccggctcggtcgacctgcccgccagcgtcttcgacgcgcaggcgaacatcccgctgatgcaccaggtcgtcgtggcccagctggccgcggcccgccagggcacgcacaaggcgaagacccgcggcgaggtcgccggcggcggcaagaagccgtacaagcagaagggcaccggtcgcgcccgtcagggctcgatccgcgcgccgcagttcaccggtggtggcgtcgtgcacggtcccgtgccgcgtgactacagccagcggaccccgaagaagatgaaggccgccgccctgcgtggcgccctctccgaccgggcccgcgacggccgcgtgttcgtcgtcgagtccttcgtcagcggcgagacgccgtcgaccaaggccgccgtcgccacgctgcggaaggtggcgcagaccaccaaggttctcgtcgtgctggacagccaggacgagctgaactggatctcgctgcgcaacgagccgaccgtgcacctcatcgaggccggccagctgaacacgtacgacgtgctggtcgccgacgaggtggtcttcaccaaggtcgcgctcgacgagttcctgggcgggtccgagacgtccgaggagggcgacaagtga

SEQ ID NO: 2263 - DNA, 651 bp, Actinoplanes utahensis
atggacaggcaagtaaaggggatcctgggcgccaagctcggcatgacccaggtctgggacaacaacaaggtcgtcccggtgaccgtggttcaggccggcccgtgcgtcgtgacccaggtccgtactgacgagaaggacggctactcggctgtccagctggcctacggcgcgattgacccccgcaaggtcaacaagcccgagagcggccactacgcgaaggccggtgtgtcgccgcggcgccacatcgtcgagcttcgtaccgtcgacgcctccgagtacgagctcggccaggaggtcaccgtcgaggcgttcgccgcgggtaccgcgatcgacgtcaccggtaagaccaagggcaagggctacgccggtgtcatgaagcggcacggcttccacggtctgcgggccagccacggtgtcgagcgcaagcaccgctcgcccggctcgatcggcgcctgcgcgaccccgggtcgcgtcttcaagggcgtgaagatggccggccgcatgggcggcaagcgctacaccgtgcagaacctgacggtgcaggcggtcgacaccgagcgcaacctgatcctggtccgcggcgctgtgcccggcccgaagggcgcgctgatcctggtccgtaccgcggccaagaagggtggtgtcaagtga

SEQ ID NO: 2264 - DNA, 309 bp, Actinoplanes utahensis
atggcgggacagaagatccgcatccggctcaaggcctatgaccacgaggtcgtcgactcctcggcgcggaagatcgtcgagacggtgacgcgtaccggggcgcaggtcgcgggcccggtgccgctgcccacggagatcaaccgtttctgcgtgatccgttcgccgcacaagtacaaggactcgcgcgagcacttcgagatgcgcacgcacaagcgtctgatcgacatcatcgacccgactccgaagacggtcgactcgctcatgcgcctcgacctgccggctggcgtcgacatcgagatcaagctgtag

SEQ ID NO: 2265 - DNA, 1194 bp, Actinoplanes utahensis
gtggcgaaggcgaagttcgagcggactaagccgcacgtcaacatcggcaccattggtcacatcgaccacggtaagacgacgctgactgcggccatcacgaaggtcctgcacgacgagttccctgagctcaacccgtacaccccgttcgacgagatcgacaaggcgccggaggagaaggcccgcggcatcacgatctcgatcgcgcacgtcgagtaccagaccgcggcgcgtcactacgcgcacgtggactgccccggccacgccgactacatcaagaacatgatcaccggtgccgcccagatggacggcgcgatcctggtcgtggccgccaccgacggcccgatgccgcagaccaaggagcacgtcctcctggcccgccaggtcggcgttccgtacatcgtcgtcgccctgaacaagagcgacatggtcgaggacgaggagctcctggagctcgtcgagctcgaggtccgcgagctgctgagcacctacgagttcccgggcgacgacctgccggtcgtgcgcgtgtcggcgctcaaggcgctcgagggcgacccggagtggaccggcaagctgctcgagctgatgaacgcggtcgacaccgcgatcccgcagcccgagcgggagaccgagaagccgttcctcatgccgatcgaggacgtcttcacgatcaccggtcgtggcaccgtggtgaccggtcgcgccgagcgcggcatcctcaagccgaacgaggaggtcgagatcgtcggtatccgcgagaagtcgaccaagaccgtctgcaccggcatcgagatgttccgcaagctgctcgacgaggcccgcgcgggtgagaacgtcggtctgctgctgcgtggcatcaagcgcgaggacgtcgagcgcggcatggtcgtcgtgaagccgggcacctccactccgcacacggagttcgagggccaggtctacatcctctcgaaggaggagggtggccggcacaccccgttcttccagaactaccggccgcagttctacttccgcaccacggacgtcaccggcgtcgtcacgctgcccgagggcaccgagatggtcatgcccggcgactccacctcgatggccgtgaagctgatccagccgatcgccatggagcagggcctgaagttcgcgatccgtgagggtggccgcaccgtcggcgccggcacggtcacgaagatcaccaagtga

SEQ ID NO: 2266 - DNA, 2097 bp, Actinoplanes utahensis
gtggccgccgcagacgcgctcgccaaggttcgcaacatcggcatcatggcgcacatcgacgctggtaagaccacgacgaccgagcggatcctgttctacaccggcatcacgtacaagatcggtgaggtccacgagggcgctgccgtcatggactggatggagcaggagcaggaacgcggtatcaccatcacctccgccgccacgaagtgcgagtggaagggctacacgatccagatcatcgacacgcccggccacgtcgacttcacggtcgaggtcgagcggtcgctgcgcgtgctcgacggcgcggtcgcggtgtacgacggtgtggccggcgtggagccgcagacggagaacgtctggcgccaggccgacaagtaccacgtcccccggatgtgcttcgtcaacaagctcgaccggaccggcgcggacttcttccgctgcgtgcagatgatgatcgaccggctcaacgccacgccgctcgttctgcagatcccgatcgggctcgaggccgaccacatcggcgtcgtcgacctgatcaacatgaaggcgctcacctggcgcggggagacccagaagggtgaggactacgcgatcgaggagatcccggccgacctggtcgactccgcgaacgagtggcgcgagaagctggtcgagacgctggccgacgtcgacgacgcggtgatggagaagtacctcgaaggcgaagaggtctccatcgacgagatccgggccgccatccggcgcgccacgatcgccagcaaggccaacccggtcctgtgcggctcggcgttcaagaacaagggcgttcagcccatgctcgacgccgtcgtcgactacctgccgtcgccgctggacatcccggcgatcgagggcaccgcgaccgacggcgagaccccgatgctgcgcaagccgtcgaacgacgagccgttctccggcctggcgttcaagatccagacggacaagcacctcggcaagctgacctacgtccgggtctactccggcacgctcgactccggttcccaggtggtcaactccaccaaggaccgcaaggagcggatcggcaagatctaccagatgcacgcgaacaagcgtgaggagcgcgccaccgcgcaggccggcgacatcatcgccgtccagggtctgaagcagaccaccaccggtgacacgctcagcgacccggcgaacccggtcatcctggagtcgatgaccttcccggagccggtcatccaggtcgccatcgagccgaagaccaagtcggaccaggagaagctgggcaccgcgatccagcgcctggccgaggaggacccgaccttccgcgtcttcaacgacgaggagaccggccagacgatcatcgccggcatgggcgagctccacctggacatcctggtggaccgcatgcgccgcgagttcaacgtcgaggccaacatcggcaagccgcaggtggcgtaccgcgagacgatccgcggcaccgtggagaagcacacgtacgtccacaagaagcagaccggtggctcgggccagtacgcgaaggtcgtcgtcaacgtcgagccgctgtcgctcgaggcggacggccccacgtacgagttcgtgaacgcggtgaccggtggtcgcatccccaaggagttcatcccctcggtggacgcgggcgcccaggactccctccagtacggcgtcctcgccggctacccgctggtcggcgtgaagttcacgctggtcgacggtcagtaccacgaggtcgactcgtccgagatggcgttcaagattgccggctccatggcgatgaaggaggtggcccgcaaggccgatcccgcgctgctggagccgatgatgtccgtcgaggtcaccacccctgaggacaacatgggtgacgtgatcggcgacctcaactcccgtcgtggcatgatccagtcgatggaggagcgtcacggcgcccgcgtcgtgaaggctctggtgccgctctcggagatgttcggctacgtcggcgacctgcggtcgaagactgcgggccgggccagctacagcatgcagttcgactcctacgccgaggttccgcagaacgtggcgaaggagatcatcgctaaggccaccggcgcctga

SEQ ID NO: 2267 - DNA, 471 bp, Actinoplanes utahensis
atgccgcgtaagggccccgctcagcgtcacccggtggtcgctgacccggtgtacaactcgccgctggtcacccagctggtgaacaagatcctggtcggcggcaagcgtcagctcgccgagcgcatcgtgtacggcgccctcgagggtgcccgcgagaagagtggcaccgacccggtggtcatcctcaagcgcgcgatggacaacgtcaagccgaccctcgaggtccgcagccgccgcgtcggtggcgcgacctaccaggtcccggtcgaggtgcgcacgccgcgccagaccaccctcggtctccgctggctggtgcagtactccaaggcccgccgggagaagaccatgatcgagcggctgcagaacgagctgctggacgccagcaacggcctcggtgccgcggtgaagcgtcgtgaggacacccacaagatggcggagtccaacaaggccttcgcgcactaccgctggtaa

SEQ ID NO: 2268 - DNA, 375 bp, Actinoplanes utahensis
gtgcccacgatccagcagctggtccgcaagggccgccaggcgaagacgaccaagacgaagacgccggcactgaagggaagccctcagcggcgcggcgtgtgtacccgcgtgtacaccaccacccccaagaagccgaactctgcgctgcgcaaggtcgctcgcgtgaagctgagcagccagatcgaggtcacggcgtacatcccgggcgtcggccacaacctgcaggagcactcgatcgtgctcgtgcgtggcggccgtgtgaaggacctgcccggcgtccgctacaagatcgtccgcggttcgctggacacccagggtgtccgcaaccgcaagcaggcccgcagccgttacggcgcgaagaaggagaagagctga

SEQ ID NO: 2269 - DNA, 480 bp, Actinoplanes utahensis
atgcttcagaccatgatgcagccgccgccgcccctgccgtacggtccgccgtcctacggcgcgccggtcccgccgccgccggccggcgcaggctgggagccggagcgggtcgacgtggtgagtggcaccgacttcggcctggtccagctgcgtgtcgtgccgatcacgtcgggcctggcgatcggttccctgatcgtcgggatcggctcgatcctggtcgcgttgatcaccgcctgcttcgggttcggtggcgcgagcgcgtgggtggccggcgccttcagcctgctcagtgtgctggccggcgggggagcggtgaccgccgcggtgatcgcgatgcggcagatcaagcgctccggtggcccgggccgggtccggttcaccggccgcgggctggcgatctccgggatcgcctgtggcgccgccggctcgggaatatcgttgcttgctctggtgctgggagtggtgttgcagacttcttga

SEQ ID NO: 2270 - DNA, 333 bp, Actinoplanes utahensis
gtgccgacccgccatccgctggatccggaaccggccccgtccacgaaggcgcgcgccgtcttcgtgctgggcctggtgggtctgctggccggcccgctcgtcggcggcgtgatcccggccacggtggcgttgctgctggcccgtcagacggcccgtgaggcctacgcggccggtggctacctcaccgggggcgcgtggatccgccgcggccgcaggctcgcctggggcggcctggtgctggccctgaccgccctggtggtggcgttgatcgccggtctgctgcacctggccgccaccccggccggtcagcagttctccccgggcaccgactga

SEQ ID NO: 2271 - DNA, 3891 bp, Actinoplanes utahensis
gtgctcgacgtcaacttcttcgacgagttgcgcatcggcctggcgactgctgacgacatccggcagtggtcgcacggcgaggtcaagaagcccgagacgatcaactaccgcaccctcaagccggagaaggacggactcttctgcgagaagatcttcggtccgcagcgggactgggagtgctactgcggtaagtacaagcgcgtccggttcaagggcatcatctgtgagcgctgcggcgtcgaggtgacccgttccaaggtccggcgtgagcgcatgggccacatcgagctggccgcgtccgtcacccacatctggtacttcaagggtgttccgagccgcttgggctatctgctcgacctggctcccaaggacctcgagaagatcatctacttcgcctcgtacgtggtcaccagcgtggacgccgaggcgcgtcaccgcgacatgtcgaccatcgagaacgagatcttcgcggagaagcggcagtccgagaacagccgcgactcggagatcgagaagcgggccgccaagctcgagcaggacctcgccgagctggaggccgagggcgccaaggcggacgtgcgccgcaaggtcaaggaagccggcgagcgcgagatgcgccagatccgggacaaggcccagcgcgagatcgaccgcctcgacgaggtgctcgacacgttccgcaagctcgactccaagcagctggtcaccgacgaactgctctaccgcgagctgcgcgaccgcttcggtgagtacttcaccggtggcatgggcgccgaggcgatcaaggccctgctgcagaacatggacctggacgccgaggcggacaacctccgggagatcatccggtccggcaagggccagcggaagatccgggcgctcaagcggctcaaggtcgtcgcggcgttcctgaacacccgcaactcgccgctcggcatggtcctggactgcgtcccggtcatcccgccggacctgcgcccgatggtgcagctcgacggtggccgcttcgccacgtccgacctgaacgacctgtaccgccgggtgatcaaccggaacaaccgcctcaagcggctgatcgacctcggcgcgcccgagatcatcgtcaacaacgagaagcggatgctgcaggaggccgtcgacgcgctgttcgacaacggccgccgcggccggccggtcaccggcccgggcaaccgcccgctgaagtcgctgtccgacatgctcaagggcaagcagggccggttccgtcagaacctgctcggcaagcgcgtcgactactccggccgttcggtcatcgtcgtcggcccgcggctcaagctgcaccagtgcggtctgcccaagcagatggcgctggagctgttcaagccgttcgtgatgaagcgcctggtcgacctgaaccacgcgcagaacatcaagtccgccaagcggatggtcgagcgtcagcgtccggtcgtgtgggacgtgctggaggaggtcatcagcgagcacccggtgctgctgaaccgtgctccgaccctgcaccgcctgggcatccaggccttcgagccgcagctggtcgagggcaaggcgatccagatccacccgctcgtctgcaccgcgttcaacgcggacttcgacggtgaccagatggcggtgcacgtgccgctgtcggccgaggcgcaggccgaggcccggatcctgatgctctcgtcgaacaacatcctcaagccggccgacggcaagccggtcaccatgccgacccaggacatggtcatcggcctgtaccacctgacgcacctcaccgcgggtgccaagggtgagggccgggtgttcagctcggacgccgaggcgcggatggcgttcgacaacggcgagctgcacctgcaggccccggtgaagatccggctgcgggacgtcatcggtgtcgacaacggggccaagcaggccgcgtgggaggcgccggaggagtgggtcgagggcgagccgctgctcgtcgagaccacgctcggccgggtcatcttcaacgagacgctgcccccgggctaccgcttcgtgaactacgagatccgcaagggtcagctgtcggcgatcgtcaacgacctcgccgagcgcttccccaaggtcgccctggccgcgaccctggacgcgctcaaggaggccggcttccactgggccacctggtccggtgtgacgatcggcatgggcgacgtcatcggtcccccgcgcaagccggagatcctggcccgctaccaggtcgaggcagaccggatcgacaagcagtaccagcgtggtctgatgaccgccgaggagcgtcgcggcgagctcatcgagatctggaccaaggcgaccaacgagatctccaaggagatggagaccgcgctgccgcaggagaacccgctctgggtgatgatcaactccggcgcccgcggtaacctgctccagctccggcagatcgccgcgatccgtggtctggtggccaaccccaagggtgagatcatcccgcggccgatcacctcgtcgtaccgcgagggtctgaccgtgctggagtacttcatctccacccacggtgcccgtaagggtctggccgacaccgcgctgcggaccgccgactcgggttacctgacccggcgtctggtggacgtctcgcaggacgtcatcatccgcgaggaggactgcggcaccgaccgcgccatcccgatggcggtcggcgagcgcgagccggacggcaccctggtcgtgcacacccacgccgagaccggcgtgcacgcccggaccatcgccgacgacatcagcgacccgaacggcaacctggtcgtcgcccgcggtacggacctgaactcgatcatcgtcgaccagctggtcgccgccggtgtcgagaacgtccgggtgcgcagcgtgctgacctgtgagtcgaagctgggcgtctgcgcggcctgctacggccgttcgttgccgaccggcaagtcggtcgacatcggcgaggcggtcggcatcatcgcggcccagtccatcggtgagccgggtacccagctgacgatgcgtaccttccacaccggtggtgtcgcgggtgaggacatcacccagggtctgccgcgtgtccaggagatcttcgaggcccgggtgccgaagggcaaggcgccgatcgccgacacccccggacgcatccggatcgaggacggcgagcggtcgcggaagatcatcgtgatcccggacgacggcagcgaggagatcgtctacgacaagatctccaagcgcgtcaagctgcgggcgcacgatggcgaccacgtgcaggtcggcgagaagctcaccgagggcaccatcgacccgcacgagctgctgcgcatcatgggcccgcgcgcggtccaggtccacctgaccagtgaggtccaggaggtctaccgctcgcagggtgtgctcatccacgacaagcacatcgagatcatcatccgccagatgctcaagcgggtgacggtcatcgactccggcgcgaccgagttcctcccgggcgtgctggtcgaccgggcgctcttcgagtcggagaaccgccgactcgtgggcgagggtggcgagcccgccgccggtcgtccggtgctgatgggtatcaccaaggcctcgctggccaccgactcctggctctcggcggcctccttccaggagaccacccgggtgctgaccgacgcggcgatcaactcgcgcagcgactcgctggtcggcctcaaggagaacgtcatcatcggcaagctcatcccggccggtaccggtatctccaagtaccgcaacatccgggtcgagcccaccgaggaggccaaggccaaggtgtactcgatgaccgggtacccggagaccgactacggcttcgggccggccagcgggcaggctgtgccgctggacgacttcgacttcgggtcgtaccgctaa

SEQ ID NO: 2272 - DNA, 3441 bp, Actinoplanes utahensis
ttggcagcttcccgccctgcgaagaccagccgtacgtcgagcgcttacgcaccccgccgggtctctttcggccggatcaccgagcagctagaggtccccaacctcctcgccctccagacggattcgttcgactggttggtcggcaacgaggcgtggcaggcccggacgacggacgacccgcacgcccactcgggcctcgcagagatcctcgaagagatcagtcccattgaggacttctccggcaccatgtcgctgtccttctcggctccgcgattcgacgaggtcaaggcctcgatcgaggagtgcaaggagaaggacctgacctactgtgccccgctgttcgtgaccgcggagttcaccaacaacaccactggcgagatcaagagccagaccgtgttcatgggtgacttcccgatgatgacccccaaggggacgttcgtcatcaacggcaccgagcgggtcgtggtgagtcagctcgtccgttcgccgggcgtgtacttcaccaaggagccggacaagacctccgaccgcgacctgaccagcgtcaaggtcatcccgagccggggtgcctggctggagttcgacatcgacaagcgcgacaccgtcggtgtccgcatcgaccgtaagcgtcgccaggccgtcaccgtcctgctgaaggcgatcggttggtccgccgaccagatccgtgagcgcttcggctggtccgagctgctcatgacgacgctggagaaggaccacatcgcggggcaggacgaggccctgctagacatctaccgcaagctgcgtcccggcgagccgccgacccgggagaacgcgcagaccctgctcgacaacctcttcttcaacccgaagcggtatgacgtcgccaaggtcggccggtacaagttcaacaagaagctcgagatcgacgtcccgatcgtccggggcacgctctccgaggaagacatcgtcaagaccgtggagtacctctgccggctgcacgccggtgaggagggctacgaggccgacgacatcgaccacttcggcaaccgtcgcctgcgcacggtcggcgagctcatccagaaccaggtccgcgtcggcctgtcccggatggagcgcgtcgtccgcgagcggatgacgacccaggacgtcgaggcgatcacgccgcagaccctgatcaacatccgtcccgtggtggcggcgatcaaggagttcttcggtacgtcgcagctgtcccagttcatggaccagacgaacccgctggcaggcctgacccaccggcgtcgtctgagcgcgctcggccccggtggcctgagccgtgagcgggccggcttcgaggtccgggacgtgcacccgtcgcactacggccggatgtgcccgatcgagacgcccgagggcccgaacatcggtctgatcggcgcgctctcgacgttcgcgcgggtcaacccgttcggtttcatcgagacgccgtaccgcaaggtcgagaacggtgtcgtcaccgacgaggtgcactacctcacggctgacgaagaggaccggtacatcaaggcccaggcgaacgccgtgctgtccagcgacaacacgttcgccgaggaccgcgtcctggtccgccgtaagggcggtgaggtcgactacgtgcccggcacggaggtcgactacatggacgtgtcgccgcggcagatgacctcggtcgccaccgcgatgatcccgttcctcgagcacgacgacgcgaaccgtgccctcatgggcgcgaacatgcagcgtcaggccgtgccgctggtcaaggccgagtcgccactggtcggcaccggcatggagtaccgtgccgcggtcgacgccggtgacgtggtcgtcgccgaggtcgccggcgtggtcgaggacctgtgcgccgactacgtgacggtgcaccaggacgacggccaccgccgcacgtacctgctgcacaagttccgtcgctcgaacgccggctcctgcgtcaaccagaagccggtcgtcttcgagggggaccgggtcgaggccggccaggtcatcgccgacggcccgtgcaccgacgagggggagatggccctgggccgcaacctcctggtcgcgttcatgtgctgggagggccacaactacgaggacgcgatcatcctgtcgcagcgcctcgtgcagcaggacgtcctcacctcgatccacatcgaggagcacgaggtcgacgcccgcgacaccaagctgggcccggaggagatcacccgcgacatcccgaacgtcagcgaggagatgctggcggacctggacgagcgcgggatcatccggatcggtgccgaggtcgtcccgggcgacatcctggtcggcaaggtcacccccaagggcgagaccgagctgaccccggaggagcgcctgctgcgcgccatcttcggcgagaaggcccgggaggtccgggacacctcgctgaaggttccgcacggcgagaccggcacggtcatcggtgtccgcacgttctcccgcgaggacggcgacgagctgccccccggcgtgaacgagctggtccgggtctacgtcgcgcagaagcggaagatccaggacggtgacaagctcgccggccggcacggcaacaagggcgtcatctccaagatcctgccggtcgaggacatgccgttcctggaggacggcaccccggtcgacatcgtgctcaacccgctgggtgtgccctcgcgcatgaacatcggccaggtcctggagacccacctcgggtggatcgccaagaccggctggtcgatcgagggcgacgacgaggagtggaagcgccagctccgctcgatcgaggcgcacgagtcccccgccgacagcaacgtcgcgaccccggtcttcgacggtgcccaggaggaggagatcaagggtctgctcgagtcgaccctggtcaaccgggacggcaagcgcctggtcaacggcgacggcaaggcgcagctgttcgacggccgctcgggtgagccgctgccggacccgatctcggtcggctacgtctacatcctgaagctgaaccacctggtcgacgacaagatccacgctcgttcgaccggcccgtactcgatgatcacgcagcagccgctcggtggtaaggcccagttcggtggccagcggttcggcgagatggagtgctgggcgatgcaggcctacggcgccgcttacgcgctgcaggagctgctgaccatcaagtccgacgacgttctcggccgcgtgaaggtgtacgaggccatcgtcaagggcgagaacatcccggagccgggaatcccggagtcgttcaaggtgcttctcaaggagctccagtcgctgtgcctgaacgttgaggtgctctccagcgacggtgttgccctggagatgcgcgagaccgacgacgaggtcttccgggccgcggaggaactcggcatcgacctgtcccggcgcccgaacgagggcgtcagcagcgtcgaagagatctga

SEQ ID NO: 2273 - DNA, 108 bp, Actinoplanes utahensis
atggcggagatccgacccggatctccgccatcggcgtctctcgacccctggcgatgtttcgtggtgatgtcgccgctgctcagcgtgggcgagtcggagcccggctga

SEQ ID NO: 2274 - DNA, 381 bp, Actinoplanes utahensis
atggcgaagctcagcaccgatgacctgctcgacgccttcaaggagatgacgctgatcgagctctccgagttcgtgaagcagttcgaggaggtcttcgacgtcaaggctgcggtggccgtcgccgccgccggcccggccgctgcggctccggccgaggctgctgtcgagcaggactccttcgacgtcgttctggagagcgacggcggcaagaagatccaggtcatcaaggtcgtgcgtgagctgaccggcctgggcctcaaggaggccaaggacgcggtcgaggccgcgccgaaggccatcatcgagggcgtcaacaaggagaaggccgaggccgccaaggccaagctcgaggccgagggcgccaaggtcaccctcaagtga

SEQ ID NO: 2275 - DNA, 549 bp, Actinoplanes utahensis
atggcggacaagccggtccgggccgacaaggccacggccgtcgccgagctgacggagaacttccgtgactccgcggccaccgtgttgaccgaataccggggcctcaccgtgaagcagctcaccgagctgcgccggtcgctcggccagcaggccaagtactccgtcgccaagaacacgctggcgaagcgtgcggctggcgacgcgggcatcgagggcctcgacgcgctgttcaccggtcctaccgcgctcgccttcgtgagcggcgacgtggtcgaggcggccaagggtcttcgggccttcgccaaggccaacccggcgctggtcatcaagggcggtgtcttcgagggcaaggcgatctcggccgaggacgtcagcaagcttgccgacctcgagtcccgtgaggtgctgctggccaagctggccggcgccatgaagggcaacctgagcaaggccgcggccacgttccaggctccgctctcccaggccgttcgcctggtggacgccctgcgtgacaagcgcgagaaggacggttccgccgaggccgcctga

SEQ ID NO: 2276 - DNA, 699 bp, Actinoplanes utahensis
gtgaccgccctgatccggatgcgtctggccggcttctttcacggcggccgggtgctggccccgctgatcgccgtcctggtcgtcctcggcgtcctctacggcgggggcgcctccccggccgccaccgcctacggctattccgccgccgcgctgttcccgatcctcgcctggctcgccaaggtggtcctggacaccgagccggacgtgcagcgccgcctggcccggctcgccgtcggcccggtccgggagggcctggccggtctgctggccgccacgctcgccggcgccgcggtgtgcgccgccgccatgctcaccccctgggcgttccacgcgatccgcggtccagagccggggtccgccgaggcgtctctgccggccggcatcctgctcggcgtactggcccacctgctcgcgctgccggccgcggtcgccctgggcgccctgtccggccgggcggtcacccggcgcatcctgcccggcgtggcggtcctggtgaccggctcgctcctggtcgtcgtcctgggcctgaacggctcgttcgcgccctggctggcgccgccggtgatggccgtggcccgggtcctgaccgacggtgccgtgccaccggcggccgagctggcccggctgacgatctggtcgctggcctggtgcacggtcgcgctcgccacctacgggtggctgcgccgggcccgctcctga

SEQ ID NO: 2277 - DNA, 876 bp, Actinoplanes utahensis
atgcgtttcgacggggtcggcttccggtacgcccggcgtgccccgtgggcgctgcgtgacgtgtccgtgacgatcgatcccggccgcagcgtggtcgtcctcggcccgaacggcgcgggcaagtccaccctgctgcaactggccgccggcgtcctgcgcccggtccgcggcgtgctccgggaccggccgccggtcgtcggctgggtgcccgagcgtttcccggccgaccagccgttcaccgcgctcggttacctgcgggcgaccgccgcggtccgacgggtgccggccaccgcggccgatcactggctggagcggctgctgctgagcgagcacgccgacaccccgctcaccgcgctctccaagggcaccgcgcagaaggtcggcctggcccaggcgctgctcgcccggcccggcctgctggtcctcgacgagccctgggagggtctcgacgcgcaggcccggacgctgatcccgcagatcgtcgccgaggtcaccacggccggcggcatcgtcctggtcagcgatcaccgcggcgagatcaccacgctgccggacacgatccactggtcggtcgccgccggtgcggtcaccgtcgcacagccggtcgggacggaccgggacgcggtcgcgggggagccggaggcggtcacgggggagccgggcgcggtcacgggggagccggacgcggtggtggcggagcgggacgaggtcgtggtcgagatcgccgtgccgcgcacggcggcggcgcggacgctggtccagctccgctcggccggtcaccacgtgctgcgggtccgggacagagccgattacggcgtacgcgatgaactctccccgccccgagcagaccgcacgccggacggggaggcccggtga

SEQ ID NO: 2278 - DNA, 720 bp, Actinoplanes utahensis
atggcacagcgcagcaagatctaccgcgccgcggcggcgaagatcgacgacggcaagctctacgagccgaaggacgcggtcgccctcgcgaaggagaccagctccgcgaagttcgacgccaccgtcgaggtcgcgatgcggctgggtgtcgacccgcgtaaggccgaccagatggtccgtggcacggtcaacctgccgcacggcaccggcaagaccgcccgggtcatcgtgttcgcccagggtgcgaaggctgaggaggccctcgcggccggcgccgacgaggtcggcaccgacgagctcgtcgcccggatccagggtggctggctggagttcgacgccgcgatcgcgacgccggaccagatggccaagatcggccggatcgcccgcatcctcggcccgcgtggcctgatgccgaacccgaagaccggcaccgtcacggtggacgtgaccaaggcggtcaacgagatcaagggtggcaagatcaccttccgggtggacaagcactcgaacctgcacctgatcatcggcaaggcgtcgttcagcaccgagcagctgatcgacaactacgccgcggtgctcgacgaggtcctgcgggccaagccgtcggccgccaagggcaagtacctgaagaaggtaaccgtcagcaccaccacgggccccggtgtcccggtcgacccgaacgcgcagaagaacctgcgcggcgagtccgccgacgcctga

SEQ ID NO: 2279 - DNA, 717 bp, Actinoplanes utahensis
gtgcctgagtacgacgacgagaccgcgcagtttgctgacgagcagtcgtcgccgatcaccgacgagtcggtcgaggaggccgacgagactccggtggcggttcaggagcccgaggccgacgaggactacgacccggtcaaggagctgcggcagaagctgcggtacgcgcccggcgactggtacgtggtgcactcgtacgccggttacgagaacaaggtcaagaccaacctcgagacccggatcaccagcctcgacatggaggatttcatcttccaggtcgaggtcccgacccgtgaagaggtcgaggtcaagaacggcaagcgcaaccaggtgcaggccaaggtcttccccggctacatcctggtccggatggacctgaccccggagtcgtattcctgcgtgcgcaacacgccgggggtcaccgggttcgtcggcgccaccgaccgggtcgaccgcccggctccgctctcgctcgacgaggtgctgaagtggctggccccggccgtgcaggccgaggagaagaaggcgaagcccgagatcaaggtgctcgacttcgaggtcggcgactcggtcacggtcaccgacggcgcgttcgcctcgctgccggcgtcgatcagcgagatcaacgccgaccagcagaagctcaaggtcctggtgtcgatcttcggccgggagaccccggtcgagctgaacttcaaccaggtcaccaagatctga

SEQ ID NO: 2280 - DNA, 378 bp, Actinoplanes utahensis
gtggccgacaaaaaccggcccggtgacgacgtcccgggcgacgacgagctgctcgccgacgttgtcgacggtgacgatgccgatgaggccgacgccccggtgagccgcggcggtggcaccgccgtcgccgagcgcacgaaggacgacgactccccgaagacgaagaaggagcgcaagcgcaccggattcttcgggcggatcggcggattcttccgcgaggtgatcagcgagctccgtaaggtcatctggcccacgcgcaaggagctgctgacctacaccaccgtcgtgatcgccttcgtcacgatcatgacggcgatcgtcggtgtgctggactatggcttcgcgcagggcatgatccacgccctgggcggtaagtga

SEQ ID NO: 2281 - DNA, 396 bp, Actinoplanes utahensis
atgggtgacgtgctggagccgcagaccttccggatcacccgtgccgacctggtgcgttacgcgggggcgtcgggtgacttcaatccgatccactggagcgaccggatcgccaccggcgtcggcctgcccggggtgatcgcgcacgggatgttcaccatggccctggtgggccgcgcggtgaccgcctgggccggtgcacccgattcggtcaaggagttcagcgttcgcttctcccggcccgtgccggtgccggacaccgacgagggcaccgaggtggtggtcaccgcgacggtgaaggagatcactgaggacggggacaccaggctcgccctgactgccacgtgcaacggggacaaggtactgtctctggcacaggcgcttatcggtaagcggtag

SEQ ID NO: 2282 - DNA, 501 bp, Actinoplanes utahensis
atgcgccgcccggagtcactccgggcggcgcattgtagtttgtggggtatgcccctggatcagacgtttgccggccgcacctggccgcccacggacacctatctcgtcggccgggagaagatccgtgagttcgcccgcgcgatcggcgccaccgaggcggagtatcacgaccccgaggccgcccgcgctctcggccacccggacgtggtggccccgccgaccttcccggtcaccatcaccatggcggccagccgccaggtgatcaacgacccggcgctcggcatcgactacagccgggtggtgcacggcgaccagcggttcgcctatacccgcccgctggtggccggcgacgcggtggtctgtgtgaacacggtcgacgagatcaccacccgtggcggccactggttcgtcaccatccgcaccgaggtgcgtaccgaggccggcgagccgatcgtcacggcctggtcgaaactggttcagcgcggcgaggagagtgcctga

SEQ ID NO: 2283 - DNA, 168 bp, Actinoplanes utahensis
gtggccaaggcgaccgacgtccgtccgaagatcaccctggcgtgcacggagtgcaaggaccggaactacatcacgaagaagaaccggcgtaacgaccccgaccgcgtcgagctgaagaagttctgcccgcgcgacgggaagcacaccctgcaccgcgagacccgctga

SEQ ID NO: 2284 - DNA, 2529 bp, Actinoplanes utahensis
atgccaaggccttcgggtccgcagcagcgttctgagcagtattcctgggcgatcaccggccccatggcgttgttcgccgtcgtgtgcaccaccggattctgggtcaccgacaccgactggtggcgggcgtggcccctcggcctcctgatttgtgttctctggacggttgcctcgttcgccgcgttcaacgtggtcgtgcggcgcagttccttcgtcctgcacctgaacgaagtccccctcgttctgggcctgttctacctgccgccgatgatggtgattctgacaatcgtctgcggcaatctcctgacgctgctcaagggcccttacagcccggtcaagacgttctacaacctggcccgggcggcggcgagcatctgcgccgcgctgctggtgatcgagccgttccggccgctggtggcgacgagtccgaaaacctgggcgatcctgttcttcgccaccgtgctcatgctgttggtgcagttggccagcctgttcggtgtgctgagcgtggtgcaggggatacaggccgggcgcaacgtggtccgcccgatgctgtccagcttcatcgtgccctgcatcagcgcgaccgtcggcctgctcttcctgaacgcgctcgacgcgaccggctggtcggtgctcctgatggcggtgctgatcggcgctctggtcttcgtgctccgctcgttcgccgggttcttccggcagcaccagacgctcgccgacgtctacgagatcacccaggcggtccgcaacgaggtctccgatcacggtctgccggacgtcctgctcggccgggtccgcacgctgatgaatgccgagttcgccacgctctggctggctccccgggagcgctatcccgagatgctgctctccgcccaggtcgacaacgccgggctcctggacatgtcgcccctcccgtccgccgttcgtgacctcgtggtggagcggcggagcccgatcgccttcggccggcagttcgcggaggacgcgcgggttcgcggggcgctgcgcggagtgcgggtcaaggacgcggtcgtcgtcccgctccggtccggccaggcggtgatcggcacggtcgaggtggtcaaccggatcggtgagggccggaccttccgcgacagcgacgtgcaggtgctggagacgatcgccgcgcacgccgcggtcgcggtggagaattcgcggctggtcgaccggctgcgctacgacgcgtaccacgaccggctgaccgcgatgccgaaccgccggcggatgctcgacgccctcgccgagtcggtgcgggtggcggtcgagggcgaggtcgtcgcggtcctgctgttcgacgtcgacggccagcgcaacgtcaacgagtcgatgggtcacgcggccggtgacaagctgctcgccgaggtggccgagcggctgcgcgggatcgccggcccgggcgccctggtcgggcgggtcggcggcgacgagttcatggtcacgctgcgggcccagggcatcgacgcgacgatcgagctggccacccagatgcgcgagcggctgcgcggcccgatggcggtcggctcgctgaccctggatgtggacaccgcggtcggtgtctcggtgcaccccgaccacggcgccgatccggagacactgctgcagcgcgcggagctggccgccaacgcggcgaaggtgctgccgtacggcgtccagccgttccatccggcgctggagtcccgggcggtgcgccggctgggcatcgccgccgatctgcgccgcgcgatcgacagcgatcagctggaggtctacttccagcccaaggtgacgctcaccgaccgacacgtgctgggcgtcgagtgcctggcccgctgggtgcatccggcgcacggcgaggtggccccggaggacttcgtcgcggtcgccgagcacaccggccagctggcccggctcaccgaggtggtgctcaccgccggcctgcggcactgccgggcctgggcggacgccgaccggccgctgtccgtcgcggtcaacctgtcggcccgcacgctgctcgattcccgattcccggacctggtccaggatctgctgggcgtgcaccaggtcgacccgggccaggttaccttcgagatctccgagccgggcatgctcagtgacatcgagcgggtcctgcccaccctctaccgcctgcgggacctgggtgtccggctgagtgtcgacgacttcggcaccggcgcctcgtcgctgggctatctgcggcagtggccggtgcacgaggtcaagatcgacgacacgttcgtgcagggcatggcgaccgactcgggtgatctggcgatcgttcgggcgatcgtcagcctggcccgggagttcggtctcaccgtggtggccgagggggtggagagcgagctcaccctggagctgctggaggagatgggctgcgagatcggtcagggctacctgttcagccggccgctgccgttcgagcggttggaggcgtggctgagcgcgcagaccgagcccgagtccactcccaccggtgaggtccgtcggctccgggcagtcatctga

SEQ ID NO: 2285 - DNA, 393 bp, Actinoplanes utahensis
atgactcccgacgatcttgagcgacaccatacgctcaccacggctacccggcgttacgacgacctacggatgcgggacgccctcgctgcgatgggccgcgacgacgacaaccccggcctcacccccgccgaaaccctcgaaatgctggccctcagcgagatcatcagccgcaaggccggatacggccggcaggccatggtccgctccgcccgcgcggccggcgtctcctggacccggatcggcgccgccctcggcaccagcaaacaggccgcctgggaggcccaccagcgctggatcgacgaccaggcccggcagcacgaacaaaccggataccagggcctggacccggaatcggcgcacgacgctcgcggcctcgccggccggcccgactag

SEQ ID NO: 2286 - DNA, 810 bp, Actinoplanes utahensis
atgatcgacgcggttgtggatcaggactggctgcgtgcccacgccgccgaggtgatcgtcgccgacgtccggtggtatctggacggccgctccggccgcgcggcgtacgagcggggtcatcttcccggcgccgtcttcatcgatctggacaccgcgctggccgctccggcgtcgccggccgagggccggcatccgctgccggatccggcggtcttcgcggccgccatgtccgccgccgggatcggtgacgcggacaccgtcgtcgcctacgacgacgccggcggcgtcatcgccgctcgtctcgtctggttgctgcgcgcgctcgggtgtgaggccgctcttctcgatggcggattgccggcgtacgccgcggagctgaccgccgagcccgccccccgccgcgccgcggtcttctccgcgcgtccgtggcccgaggatcgcctggccacgctcgccgacaccgccgacggtggccacctcgtgctggatgcccgggatgccgcccggttccgcggcgacagcgagccggtcgacccccgggccggtcacatcccgggcgcccgcagtctgccgtgccgcgacaacgtgtccgcggacggccggttcctaccggtccccgagttgcgggagcggttcgccgcggtgggggtgtcggatgcctccgaggtcatctcgtattgcggttccggggtgaccgcctgccacaacctgctggcgatggagcatgcgggcctggggcggggccggctctacccgggttcgtggtcgcagtacagcgcgacggaccgcccggctgccatcggcgactag

SEQ ID NO: 2287 - DNA, 627 bp, Actinoplanes utahensis
atgactcacgccgttctcagcttcgcccttctcggcgcgctgctcacgatcactcccggtctggacaccgcgctggtggtgcggtccgcggtcaccatgggccggggtccggcgttcgccaccgcgctcggtatcaacgccggcgcgctggtctggggtgcggctgccgcggtcggagtctccgcgctgctcacggcgtcggcggtggcgtacaccgtgctccgggtggtcggcgcgggctacatgctctacctcggcgtacgcatgatcgtctcggctctgcggaagccggcggtgaccggggaggtcgccgtggcctcggccgcgacctggtggaacacgttcgggcggggtctgctcacgaacctgttgaatccgaagttcggcgcgttctacgtcgcggttcttccgcagttcatcccggccgggtcgccgccgctcggtgccggcctgctgctggccctggtccatgacctggaggggctgctctggttcaccttgctcatcttcggcgcgcgggcggcgcgcggcttcctggcgcgccgcacggtacggcgtaccgtcgatgccgggaccggcgcggttctgatcggcttcgggcttcgtctgggcctgtcgggagactga

SEQ ID NO: 2288 - DNA, 291 bp, Actinoplanes utahensis
atgagtaccgaggtgctgggcggcctggcgggcctcgcgctgttcatcttcgggatgcgcatgctggtgtggggtcaggcaccgggcatgatcgtccggtcgttccggtcggtccgggacgccggttactaccacctgctgttcggcctggctctcctgatctacgtgggcggtctgcatctgcccggaacggtggcggcgcaggcggcggggctgctcgcggtggttctggtgggggtcgcggtcgtccgcttccgacctcgggggcgggggccgacccgtaaggcttag

SEQ ID NO: 2289 - DNA, 492 bp, Actinoplanes utahensis
atggcagccaacccgtcgttcgacatcgtcagcaaggtcgaccggcaggaggtcgacaacgcttaccaccaggcggagaaggagctgagcacccggttcgacttccgggggaccggcaccgagctcgccaagtcgggcgaggccttcaccatcacgtcggagaccgaggagcgggcgacggccgcgctcgacgtgttcaaggagaagctggtgaagcggaacatttcgctgaagtcgctggatgcgggggagccccggcagtccggcaagaccttcaagatcgacctcaaggtgctggaggggatcgagtcggacaaggcgaaggcgatcagcaagaagatccgcgatgaggggccgaagggtgtgcaggcgcagatccagggtgactcgctgcgggtcaccggaaagaagcgggacgatctgcaggccgtgatcgccctgttgaaggcggaggatttcggcgtcgcgctgcagttcacgaattaccgctaa

SEQ ID NO: 2290 - DNA, 1026 bp, Actinoplanes utahensis
atggtttgcgtagactgtgaggtgtattctgaggttatggctgccgtgatcgagagatggactgtgactggtcccgaatttcggggcttttacaacgtcaatgccgtagctcagacggatgcaggcgttgcaatcgtccgcagccgcattcccgcgacggatcaaatggatctgcgaccgttggatgaggtggctatccttgaagcaattgcgggacgtgtatacgccccgcaagtatggcgtaccgatcctgcgcgcaggttcttcgtctgctcattcgtgggagaggcgacgctgaacgaaataagcccgcgcggtactgcggtcatgatgcagcagatggattcgattatcggcacgatggcggcacttactaccgttccggtctccgcgttcgtggcgatgcagagggattcgatcagcgcacttggcctgccagtaacctcgaccctcgacatgctggtcagtcacctcggtctactcgcaaatgaggctattgagcggcggccgatactggccgctgcactaagtctcccgtctgtagacggaattgtgagtgctataccgcagcgcgaggttgcaaggccagacgtgctcatgcattgcgacctgcacaggaagaacctgcgtacgggcgctcccggcggcggcctatatgtgcttgactgggaactggcgctggttggagatccgctgtatgacctggctgtccacattcacaagatgagttatccggagtggcagaaagaggcgttcatctcggcctggaaagagcgtgtcatgccgacaggatggtcagaccgtgactttggcgcatacctggctattgagagaagtaagtcggcatacgttgaccttctacggtcgatgcagaacgtgcttcaaggtactgtggatgccgaaaccatggcgatcaagtatcggtccaagctggttgacctggcgcgtgtagtggacgttcccgtaccgagtgttgaaagcatcgcagcggagttccgtgctgaggctgcccggaacgaaaaatga

SEQ ID NO: 2291 - DNA, 558 bp, Actinoplanes utahensis
atgagcgtgggagtggttgaccacgtcggtccatggactgaggacgagtattttgcgctcggcgagacgacggaccggatcgagctcatcgatgggagcctggtggtgagccccgcgccgagcatgagccatcagcgtctctctcgccgactggcgaacgcgctggacgagggcgccgaaccagccgggctctttgtctatgaggcgatcaacgtccggctgaacaccggccgaatcgtcattcccgacctggctgtggtggaccaggacgaggaggccgtcacggcagacgcttcccgggtgctcctgatcggtgagatcgtttcgccgagcaatgccgccatggaccgtgtactcaagatgcagctctacgccgctgcgggcatcgggtggtacctcctcgtcgagcacgaggcgccggactcgctgacgctacggctcaaccgtctcgatggccagcactacgtcgaggaaaccgtcgtgaagactggcgcgagcttaacctccgagtacccgttccggttcgacctcgacacgcgttcgctcgttcgtcgctga

SEQ ID NO: 2292 - DNA, 303 bp, Actinoplanes utahensis
atggagttcaccgtcgccgaggtcccggacaagggccgcttcgaagcccgcaccgacacgggcgccctggccggggtcctcacctaccagatgaccggccccatcgtggtcttcacccacaccgaggtggacccggccttcgaacaccagggcgtcggctccgccctggcccggaccgccctggaagacgcccgcgccaggtcgcgcaccgtcgtcccgatgtgccccttcatcgccgcatggctcgaccagcacaaggagttcgaaccgctggtcgcccgcaacacccgccgcatcaaatag

SEQ ID NO: 2293 - DNA, 657 bp, Actinoplanes utahensis
gtgaacgggatcgcgttgtcggtcaacgtgggtgcttcggagccgagcatgggcaaggacgtcccgaccaccggcatcaacaagaagccggtgtccgccccggtccaggtccgtgcccccggcccgcgccgcaccggcctgcacagcggcatcgtcggcgaccacatcggcgacacccggcaccacggcggcgacgaccaggcggtgtacgcgtacgccacggaggattacgcctggtgggccgccaacctgggccgcgacctggctccggccaccttcggggagaacctgaccacctccggcctcgacctgcgcgacggcgtcatcggcgaacaatggcagttcggttccggcctgctcctgcaggtcacgttcggccggatcccgtgcctcaccttccagaacaggatggccgagccccgctgggtgaaacgcttctcccaggccaaccgcaccggcgcctacctgcgcgtgctcacccccggcacactggtccccggcgaccgcatcacggtcaccgaccgcccgtcgcacggcctgaccctcaccgaggcctacgagatctacatgcacgaccccacccgcctgccccgcctcctggaggccccggaactcccgcccgccatgctggccgaggtgaccgaccgcctcacctga

SEQ ID NO: 2294 - DNA, 813 bp, Actinoplanes utahensis
atgacctgggagatcaggtccgatctggaccgattcgccgcggtcgccggggatttcctgcgggcctcaccggtgcggcacacggttttcctgaccctgatcgacaacctgcgttcccgcggcctgcacgcctacggcgcgggagacccggttttcggctggtggatcacccccggcgacgactcggtgagcggtgtcctgctgcagacgcccccgcatccggtgatgttcaccgcgctgcccgcgcccgccgtgccggccgccgccgcggccttgcggagccgcccgcttcccggggtcaacatgctcgtcgacgatctccccgcgttcgtcggctcccgggcgcaccagcccgggatgcggacccgcctgcaccccctgggcacgctgaccccgccgtcgccgccgggtgccgcgcggcccgccggcccggccgaccgggatctggtgaccgcctggctcaccgacttcttcgcggtcaccggcgagccccgcgccgacgtcgccgcggtcgtcgacgaactgctgccccgggtcaccctccgggtcgacgacgccaccccggtctcgatggcggtccgctcccggcccgcggccggcatgatccggatcttgtacgtgtggaccccacccgccctgcgccgccacggttatgcggccggcgccaccgcggcggccacccgtgccgccctcgacgagggtgcggccgaggtcgtgctctacaccgatctggacaacccgaccagcaatgccctttaccaccggctcggctaccgtccggtggaggatcgagcggtggtgactttcgcgtga

SEQ ID NO: 2295 - DNA, 1044 bp, Actinoplanes utahensis
gtggcacccacccggttttccggattggatgaggtcatgacccgtgttccgctctccgtgctggatctggccaccgtccgcgaggggcacggcagcgccgacgcgttgcgcggcaccatcgcgaccgcgagggcggccgacgagctgggatatgcccggttctgggtcgccgagcaccacaacatgccggcggtggcgtcgacctcaccgccggtgctgatcggggcggtcgccgcgcagaccggccggatccgggtcggttccggcggggtgatgctgcccaaccacatgccgttcgtggtcgccgagcagttcgcgctgctggaggcgctctacccgggccgggtcgacctgggcatcgggcgggcgccgggcaccgatcaggcgaccgcggccgcgctgcgcggggtgtcgccgcatctgaccgtggagcggttccccgagcatctgcggacggtgctgggactgctcggtgacgctcgggtggcgggcgcggcggggcgtctgcacgcgacgccggcccccgagacgtacccccaggtctggatcctcggctcgtcgacctatggcgcgcaggtcgcggccgctctgggcctgccgttctgctacgcgtaccacttcgcgatcgccgccgatgtggacgccgcgctgcagctgtaccggtcgggcttccagccgtcgccgggcctgcccgagccgcacgtgatggtcagcgcgtcggtgatcgccgccgagaccaccgaggaggcggagttcctcgccggcccgagccggatcatggcgttgagcctgcgcaccgggcggctcggcccgatcatctcgcccgagcaggccgcgacccgcgagttgtccgatctggatcgtcagatgctgcacgcgttgcccggcacgcagtacgccggcaccgcggacgaggtggtcgccggcctggatgccctggtcgcccgcaccggcgcggacgagctgatgctggccggcaccgtctacgacccggagacccggcgggacaccctcgcccgaatagcgaaggcgtggggccgatga

SEQ ID NO: 2296 - DNA, 477 bp, Actinoplanes utahensis
atggcaaaagaggtaaccggcccggggcggcgtggcgagcagatcgagtcgctgcgggccgccgactccgaccggcagctgatcgccgaccagttgaagggcgcgctcgacgagggccggctgtcgctgcacgagtacgacgaccgggtggccgcggcgtatgcggcacagacgtacgcggaactcctggtcctggttcgtgatcttccgcagcccgggacgagcgccgccgaggtgcgggcccgccaggctgccgagagccggcgggagtcgcggcggctgccggtcgcgctgatcgtgctctggaccgtctgggcggcgctcgccgccgtcaacctggtggtgtacgcactggtccggaccacggtcgaccacgagatctacccgtggccggtctggatgctggtgcccggggccgccctggccgcggtcaccgccggcgtccaggtgctccggcaccagcagcgccgcccctag

SEQ ID NO: 2297 - DNA, 906 bp, Actinoplanes utahensis
atgccgaaggagtcgaacgtgcacagccatcacaacggactcaagacggccgccctgctcggcctgctcaccggcctgatcctggccgtggggtattggctcggcggcagcaccggcctcgtcatcgcggtgatcttctcgctggtcaccaacgcggtcagctacttcttctcggaccggatcgcgctgcgggcgatgggcgcgcagccggtcagcgaggccgagttcccggcgctgcaccagatcgtgcgggagctggcggcgcaggccggccagccgatgccgcggctgtacgtgtcgccgtcgatgcagccgaacgccttcgccaccggccgggatccgcagcacgcggcggtcgcggtgaccgccggcatcacccggatcctggatgcccgtgagctgcgcggggtgatcgggcacgagttgtcgcacgtctacaaccgcgacatcctgatctccagcgtcgccggcgcactcgccgggatcgtcaccatgctcgcccagctggcgatcttcctgccgttcggcggttcggacgacgacgatgcgccgaacccggcgtcgctgttgctgatgctcattctcggcccgctggccgcgtcgatcatccagctggcgatcagccggaaccgggagttccaggcggatgcgtccggggccaccctgaccggtgatccgctggccctggccagtgctctggaaaagatccactacggcacgcagcggatgccgctgccggccgaggggcaactgaccagcgcggcgcacctgatgatcgccaacccgttccgcgccgaggggatcgcggcgctcttcgccacgcacccgccgatggtcgagcggatccgtcggctgcatgagcaggcgtcgctcaccggcggggcgtcccgcccctaccttcgctga

SEQ ID NO: 2298 - DNA, 1455 bp, Actinoplanes utahensis
gtgagccagtccgtcgaccacttcgcgctgctgcccctctatgcggcggccggcaccgcgatcctcgccttcctggccgacctgttcctggcgaaccgcaccgccgtcctgtccgccaccgcgctcggtggcctggccaccgcggttctggccctggtcgtcggccccgaaccgggtaccttctgcaccaccggcgcctgctcctggctgcccacctggccggccgcggtcaccgccgccctgttcgccgccctcaccgtcggcgtcctggccctgtccaccccggccctgcgcctcggcatcgccccggccggcgagttctgcttcctgctggcctgctcgatgaccggcggcgtggtgatcgcctacgccggcgacctgatcaccctgatcgtcggcctggagacgctgaccctcccgctgtacgtcctggtcggcctgcgccgcttcgcccccggtgagcgccccaccaccgccggcgtctcggcctcgctgacgttcttcctgatcagcgtcgtctccacggccgtcaccctgctcggcgccgccctgaactacgccgccaccggctcggtgcacctggccctgctgcacccggccaccggcccgttccgcccgctcgccggcgtcggcgtggccctgctggtgatcggcctggccttcaaggtcgccgccgtcccgctgcacgcctgggctccggccacctacgacggcgccccgctccccgtcgcggcctacctgtccaccgcctcgaagctgggcggcgtcctggcgctggccgcgatcgtcgcccgtctcgacgcccgcgcggtcatggcggtactggccgtcctcaccatgaccatcggcaacctggtcgcccttcggcagacccggatggtccgcctgctggcctggtcgtcgatcgcgcaggccggttacatcctggccgccctggccctcggcgctccgggcgttcccgccgccctggcctacgcggtcctgttcatggtcctggagttcatcgccttcaccgtggtgaccgccctgcgcctgcccggcgccgacggcggcaccatcctcgaccaccgcggagccgcccgccgcaacccgtggccgggcgccgccctgaccctgtccctggccggtctggccgggctgcccccgggcctggccggtctgttcgccaagctgtccgtggtcgacgtcctgatccggcaccactggtcctggctcgccgcggtcgtggtcctgaacgcggtcatcgccctggcctactacatccgggtcaccgcgaccctctactccctgccgccacggatcggcatgaccgtcgccgacccggccctgatggacgccgccctgcacccccggcttccggtttcccggccggtcgccgccaccctcgcggtctcggtggcggtggccatcgtgctgggcttcgccccgcagctcctcttcgccgcgctgagctga

SEQ ID NO: 2299 - DNA, 1560 bp, Actinoplanes utahensis
atgttccacgactatgcctatgacaccgccacctggacagcggggtccgtcctgctgctggccctgctcgtggtcccggccgtgggcgcggccgtggtggctgtgctcccggcccggcacgaccggcgggcccggatcgtggccaccgtcttcgccgggatcaccttcgggctctcgatcgtcccggtcttcgccgggcagcggggccaggtctgggtcggcttcaccggccgggacaccgtgcccctgatgccctgggtcaatctcgacctgccctgggtgccggccctcggcctgcgtttccacctcggggtggacggcgtctcctatccactgatcgtgctgaccgggctgctcaccctgctctgctgcgcgtacacggtgcgcaaggtgcccaggggcggcggctccggtcgtacgctcagtgccctgttgttgatcctggaagtcggtgtcctgggcaccttcctcgccctggacctgctgttgttcttcgtcttcttcgaggtcgtcctccttccgatgtacgcggtgatcgccggctggggcggcccggaacgccgtgccgcggcccgcaagttcgtcctctacaccctggccggctcggtcctgctgctgctcggcgtgctgctggtgaccaccagggtgggcaccggcgacctgatcagcctgaccggcgccccgatgctctcccgcaccacccagtgcgtggtgttcgccctgctcgcggtcgcattcgcgatcaaggccccgctctggccgctgcacacctggctgcccgacgcgcacaccgaggcgcccacggtcggctcggtcgtcctggccggcgtgctgctgaaaatgggcacctacggcctgatccgggtcggcgtcggcgtcgccccgcagggcgcctcctgggcggccccggtcctcggcgtgctcgccgtgatcgcgatcctcgccggctcgctgatctgcctgcggcaacgcgacctgaaacgcctgatcgcctactccagcgtcggccacatgggtttcgtgctgctcggcatcgccaccctgacggtcaccggcctgcaggccgcgctgctcggcaacgtggcacacggcctgatcaccggcctgctgttcttcctggccggcacgatcaaggaccgcgccggcaccggctcactcgaccagctgagcggcctgcgggagaccgcgccgcggctggccggcctgctcggcttcgccgccatcgcctccctcgggctgcccggcctggccggcttctggggcgaggcgttcgcggtgctcgccgcggtccgccggggcggcccactctggctcaccctggccgccgtcgcggcgctcggcggcgccctcaccgcggcgtacttcctgcgcctgctgcgccgggtcacgcacggcccgaccaccccgaccgtccacgccctgcgtccctcgatcgccggcgtcgaatggttcgcctggaccccgctgatcctgctcaccctggcggtcggcgtcatcccggccctggtcatcgccaaaaccgccgtcccgctgaccaccctgctgggaggacacccgtga

SEQ ID NO: 2300 - DNA, 1914 bp, Actinoplanes utahensis
gtgaccaccgacgttctcggcgcgctgctccccggcatccccctgctgctgggcctgctcggcctgaccctgcgcccgggcgacggtgggccccgccggctcgccgccacgctcggcatcgccggcgccgccctggccctgctcgacgcgatcgccctgttggcgatcaccaccagccgcgctgcgccgctggcggccggcaccacctgggcgcgcttcggcgacatcgaagtgacgctcggcttcgcggtcggcccggccgcgctctacgtcgcgctcgcggtctgcgtggtcgccctgtgcgtccaggtctactcgaccacctatctgcacgacgacccgcgctatgcgccctatgccgcccaggtcgccctgttcaccggcgcgatgctgctggtggtcagctccggcgacctgatcggcctgctgatcggctgggaggtgatgggcgcctgctcctacctgctgatcggccacgaccgccggctacccgaggccccggccgccgcggtgaaggcgttcctggtcacccgggtgggtgacgtcggcttcctgctcggcatcgcgctgctggtcgccggcgccggcacatcccggctgtcggtggtgctcacccactcctacggccacggcacgctgatcgccgcgctgcttctgctgctcgccggggtggccggcaagagcgcccagttcccgctgcacacctggctgcccgacgcgatggccggccccaccccgatctccgcgctgatccacgcggccaccatggtcgccgccggggtctacgtggtgttccggacgttcccgctgttccagcagtcgccggccgcgctggccaccctcgcggtgatgtcgtcgatcaccatcctgctcggcgccctgtccgcgatggcccaggacgatatgaaacgcgtgctggcctggtccacggtctcgcagatcggctacatgaccggcgcgctggccgtcggttcacccgcggccgccctgttccacctgctcacccacgccgccttcaaagccctgctgttcctcgcggcgggcgcggtgatccacaccgtgggcggcaaccacctgtcccggatgggcggcctgcgcacgcacatgccggtcaccttctggtcgttcgtgatcggcctcagcgcgctggccggcctgcccccgcttgccggcttctggtcgaaggagaacgtgctgaccgcggccgcgcacgccaccgacggcggcgggacggcaccggtctgggccgcctggctggtctgggtcgccgcgctgctcggtgtggggctcaccgcctggtatgcgacgcgcctgctgctgcgcgcattcttcggcccgtcccgggcgcacggtccggcgggcccgcactgggaggtcggcttcgacgacgcgcgctatcagtccccggccgtcccgcacgatccgcccggcccgatgcgctggccgatcctgctgctcgcgatcccggccgcgctgctcggcctggccgccttcgcccccggcttccggcacgcgctggagctcgacgacccgcacctgagcgtcgccatcctgctgccgatgctgttgctcgcgaccggtgccggcacggcctggtggttgtggtgggcggtacccggggccgacccggccgaggcgctgggccgggcccggccgctgttcgccgccggattccatctggatcacgtccagagcctcctggtcgtacgaccggccaaagccctggcccggttcgccaccgctgcggacgagcgggtggtggacgccgccgtcgagggcgccggcacggccacccgcgggctcggcgggatgttcgccgacgcgcaccgggccagcctgcccggcgccgcggtcctggttctgttcggcgccctgatcctgagcgtcgtcgcgtggttgggggccctgggctga

SEQ ID NO: 2301 - DNA, 357 bp, Actinoplanes utahensis
atgcacgtgaccgttccctacgtgatcggtgcgtggctgttcggcctgggcgcctacggcgtggtccgccggcgcaacgcgatcctggtcctgatggccgtcgagctgatgctgaacgcggtgaacctgatcctggtcaccgccgacgtgtcgctgcgccccaccttgcgcggcgtcccgagcgagtcctgggccacgccgaatgcgcagcccggctcgggcggcgtcttcgccctgttcgtgatcgtgctggccgccgccgaggtgggcgtcggcctcgccatcgtcctgcagtattaccggatgcgccgggccgtcgcgatcgacgaggtcgccctcgacgaggtggatcagtga

SEQ ID NO: 2302 - DNA, 570 bp, Actinoplanes utahensis
gtgaccgtcgccgatgtgttgatgctcgcgctgggcgccgtggcggtcggctcgggcgccctggtggtgaccagcgcccacctggtccgctccggcctctacctggtcgtctcgctgggcgcgatcgccggcctctacctggtcctcggcgccgaactggtcgcctggacccaggtgctggtctatgtcggcgcggtggtcgtgctgctgctgttcgcggtgatgctgacccgcgccccgatcggcccgagccccgacctggaccggcccgccggcccctccgccctgatcggcgccggtgtcggtctcggcctggccgccctgttcgccgacgccttccgctggatcgaatatccgcgggccgcccccggcaccgctgagcggatcggcgcccaggtcttcggcacgtgggtgctcccgttcgaggtgctctcgattctgctgctgtccgccctggtcggagcgatcgtgctgtcccgcccggatatcggcaggcgcacggggcacccttccgcaccgggggagacgacggacaggcagacggacgaggacgaggaggtgccggcctga

SEQ ID NO: 2303 - DNA, 600 bp, Actinoplanes utahensis
gtgactgatgacggcgaccacctcgtacccggcaagggtttgatcaatggccttgccgtcaccctcaagacactgaccaggaagaccatcacccagcagtatccggacgtcgagccggagctgcccccgcgctcgcgcggcgtgatcgccctcctggaggagaactgcacggtctgcatgctgtgcgcccgcgagtgccccgactggtgcatctacatcgactcgcacaaggaggaggtcgtcgttccgggcgccgcccgcgcccggcagcgcaacgtgctggaccgtttcgacatcgacttctctctctgcatgtactgcgggatctgcatcgaggtctgcccgttcgacgccctgcactggacccccgagttcgagtacgcggagaccgacgtcctctcgctgctgcacgacaagggccggctgggcgagtggatgcggaccgtgccgccgccgcctgcgcacgacgtgctgggcgagccttccaaggaggaggcgaccgcggcacgcaaggccgccggtccgggcgcggccaccgccgccaagaccgcaagaccggctacggtacgcccgcagcagcgcccggagagccagcagtga

SEQ ID NO: 2304 - DNA, 960 bp, Actinoplanes utahensis
atgccgctctggctggatctgctgatccgggtcgccgccgtgatggtgggcttcctggtgctcccgctgctggtcgggcaggccgagcacaaggtgatggcgcacatgcagggccgggtcggcccgatgtacgcgggcgccttccacggctgggcgcagctcgtggcggacggggtcaaattcgtccagaaggaagatgtgcatccggacggagccgatcgccccgttttccggctggcgccgatcgtcgccctcttcccgtacctggtggtcatcctgaccctcccgctcggcccgcacggcctggtcgcgcaacggctggacatcggcctgttcctggtcctggcgatcctcgggatcggcgtggtcgccgtgctgatgtcggcgtgggcctcggccaacaagtacagcctgctcggtggcctgcgcggcgccgcccagctgctcggctatgagctgccgctggtgctcgccgcggccagcgtcgcgatggcggccggcacgctgagcctgcccggcatcgtcgaggcgtggcgcccgtggtggctgatctggcaggcgccggccgcgctggtcttcttcatcgccgggctggcggagatccgccgcccgccgttcgacatgccgatcgccgattccgagctggtcttcggctacatgaccgagtacaccggcctgcggttcgcgttcttcctgctcgccgagtacgtggggatcatcgtgatcgccgcgctcaccacggtcctgttcctgggcggctggcacggcccgttcgcggatcacctgggctggctgtggacgctgctcaagatggccgcgctgtccttcgtgatcatctggttccgggtcacctacccccggctgcgcgaggaccagctgcagcgactctgctggctgatcctggtcccggtctcgctggcccagctggtcctcaccgtcgcggtgaagtccctgctctga

SEQ ID NO: 2305 - DNA, 621 bp, Actinoplanes utahensis
atgacgcccgaagaggtcggagaacgcctcgtccacctgatggagacggacgacccgggcctgggcgtcgtcaccgccggggtgtccggcggcggtcccggccattcccgggcggtggtcgacgtcccggtcgcccgctggtggcacgccgccacgatcgcccgcgatccgggtgcgctgggctgcgacttcttcgactggctgtccgcggtcgacgagctggacgacggcttcgacgtggtcgcgcacctgtggtcgacccggcggcggcacggcctgctgctgcgcacccgggtgccgcgggccgacccggaggtggagtccctggtggacctctatccgggcgccgactggcacgagcgggagacgttcgagatgttcggcatcgtcttcgcccgccatccggggctgcggccgctgctgctgccgccggagttcgaggggcatccgctgcgcaaggagttcgtgctggccgcccgggtggccaagccgtggccgggggccaaggagccgggcgagtcggagcacggcacggcgaagcgggccccgatgcgcccgccgggcgtccccgatccgagcgagtggggcccccgcaggaccaggggcggggaggccggctga

SEQ ID NO: 2306 - DNA, 495 bp, Actinoplanes utahensis
gtgccgcccgacccgccgtcgttcgatgaggtgtacgccgcgcactatgccgacctgaccgtccagttgtacgcctacttcggcgatcgccaggaggcacaggacgtcgtgcaggaggcgttctgccgggcgttcacccggtggcgcaaggtctccggctacggggatccggtcgggtggatccgccgcgtcgcctggaacctggcggtgagccgctggcgccgggtgcggacctccatcggcttcctgcgccggcagaccgtcgccgagctgcacaccgaaggtcccggaccggaccgggtggcgctgatctcggcactggccacgctgcccggcgctcatcggcgggcgctggtcctgcactacctggccgacatgccgatcaccgaggtggcccgccgcgaaggggtcgccgagggaaccgtcaagtcatggctgcatcgaggtcgcgcggcgatggccgcccggctgaatctgaccatcggaggcgagtga

SEQ ID NO: 2307 - DNA, 969 bp, Actinoplanes utahensis
atggctgcatcgaggtcgcgcggcgatggccgcccggctgaatctgaccatcggaggcgagtgatggccgaccagatcgaacggctcttcgccgacctgcgtaccgacacgctgccgcggatcaggccgcccggcgctgacgcggcccgccggacggtccggcgccgacggcggcgggcggccgcggtgaccgggatcggcctggccgttctggcggtggccgccttcaccacccccctgcggctgtcctcgccggccgagccggccgccccactgagccaggcggaacgtgacagcctcgccctcgacgcggcccgggtgatccgcctgcacgattacccgcagaccaacggcgggacgatcaccggcgacggcccgctggtcactctcgacgtcctgcccggcgagtacgacttcgtcgccgcctgtgcgggccaggccggcaccgtcgacctgagggcaggcgagacgcacctggaactaccctgcggaccggccccggacaagaaggcgatcaccgtggcggtcaccgggcgacggcagcagatctccgtcgccgcccggtccgacccggccgcgctgggccgggtcgggatcggctgggcgctgaacctctccgagaagagccgggcgcagctgatggccgcggccaggcaggcgatcggggacaacgcgtcgagcaccttcctcgacgacaacggcgccagcggcgtgcaggacaacagcgtgcgagccggctcgtaccgggtcaccgcggcgtgcatcggcaccggaccggtccacgggcaggccgggaaccaacaggccaccggaccgttccacccgctcaaggccttcgtggtggagtgtgacgggaaagcgcacgacttcgatgtgaccatgccggccggcagcaagatgggtttcttcgaattcagcacggtcgcgtcggcccagggcgccctgggttaccgggtgacacgccgctga

SEQ ID NO: 2308 - DNA, 1302 bp, Actinoplanes utahensis
atgagttctgcgtctcgtgccgacttcatcgtcgacgtgctggctcgcgagttcggcgagctgatggccatcgatccgacggcgttccgccgcaagttccggaagatggcggcttcgccgttcgcgttctaccgggggagtgcctcgctgttctacgccgaccaggtcggtgacttccgtgacgacagttatctcgacgagcggaccagccgggtgtggatccacggcgatctgcacgcggagaatttcggcacctacatgaactcgtccgggcggctcgtcttcaacgtcaacgacttcgacgaggcgtacgtcggtccgttctcctgggatctgaagcgcttctcggcgagcgtcgcgctgatcggctattcgaaggcactctccgacgacagcatctcggcgctggtcaccacgttcgccgagtcgtacctgaccgagctgcgggcgatcgcgcagggcggcgacgacgcgatcgggtcgatcaccctggagaacgcggacggggtgctgcgccgggtgttgcaggaggcgcggctgaacacccgggtggccctgctcgacgggcagaccacggtcgacgactacgagcgccggttctccctgggcgacggcgtcttcgaggtggacgaggccacggtggcccgggtgacggccgccttcgaccggtatctggcgacgctgccggacaccggccggccgatctccaccaacatcaaggacatcaagctgcgcaagggcgtcgggatcggctcggccgggttgccgtcgtacaacctgctgctggaggggcacaccgaggccctggagaacgacgtcatcatctacatgaagcaggcccaggtgccggcggtggcgcggtggatcgacgacgagcgggtccggtcctacttcaagcatcagggtcaccggaccgccgagtcccagcgggcgctgcaggcgcacgccgacccgtggctgggctacaccgaattgggcggcgtcggccagctggtcgccgaggtgtcgccgtacgccgcggatctggactggtcggatgtcaacgagccggaggagctctccggggtgatcgccgacctgggccgggcggtggcccggatgcattcggtcgccgacgacgagtcgagccacgacctggtcgacttctcgaccgaggaggcgatcgtcgcggtggtcgacaaggacgagaaggggttcgtcgcgcacctggtcgacttcgcccacaagtacggtgaccaggcccgggaggaccaccaggacttcgtcgacgtgttccgcaacggtcgcatcccgggcctgtga

SEQ ID NO: 2309 - DNA, 537 bp, Actinoplanes utahensis
atggcccttcctggagtgctcggtgaacccatccggttcgtgctgaactggggccgtcggtactccctctgggtgttcaacttcggtctcgcctgttgcgcgatcgagttcatcgcctccagcatgagccgccacgacttcatgcgcctcggcgtcatcccgttcgcgcacggtccccgtcaggccgacctgatggtcgtctccggcacggtcaccgacaagatggcccccgccatcaagcggctgtacgaccagatgcccgagccgaaatacgtcatctcgttcggttcgtgctccaactgcggcggcccgtactgggactcgtacgcggtcaccaaaggtgtcgaccagatcatcccggtcgacgtctacgtccccggctgcccaccccgcccggaagccctgttgcacggcatcctgcgcctgcaggagaagatcgccgccgagcagtccggccccggcggcgtctctcgccccgaccccctcaccaggaccgccgccgccctaaccgctcccgtggtggccccgccggtctag

SEQ ID NO: 2310 - DNA, 1086 bp, Actinoplanes utahensis
atgcgcgaaagacttcgccatcagattcagtcgcggccttccaagtgggaacagggactccgcaaatttctcaccgcggacgcggtcgcagcctccaactccatcgaggggtttcgcgtgtcaacggctgacgtccaagacctcatggacggcgagcgggacgttgaggtgtccgacgagaatcgcgaggagacgcttgcttatcagcggatgatgacctacgtgcagacgctgcacgacttcgccgacttctcctacagcaagggacttctcaacgcgctgcactggatgttgcaggggcatcgccatacgccgaacaagcccgcgggccagtggcgtcacggtcccgtgtatgtcactgctccaggacaccgcactcgcaccctcgcctacacggcaccggatgcatccgaggttcccggtctgatgtcggaactcgtcgactggctcgacactgacgacggcgcgcatccgctgatccgggcggcaatggcgcatctcattctggtttccatccatccgtgggcggacggcaacggccggatgtcccgctcactgcaaacgctgatgatcgcgcgtgagggagtgcttgctccggagttctcctcgatcgaggcatggctcggccagtctctgaacacgttcgagtactaccgggtactccaggcccgcggatctacctaccggccgaaccaggacgtctcgccgtggatcaggtgcaacctgacggcttatcaccagcaggcgcaaatggtgcagggccaagccgatctgtcggcgacggtgtgggaacgactcttctccttcgccgggcagaaaggtctggacgagcgagtcgtctccgccttgcacgacgtagcggtattcggtcgaatccggcggcaccgctacgagcaggcggaaggactgaccctgcagcaggcccagcgtgacctccgtgacctggctgcggcgggaatgctggaaccggtcggtcgcacccgtgctcgctactacatcgagggctccaacttcccgcagcaggtgctggaggacgcgcgccgcccgatgagcctcatcgacccgtacgagaatgcagtaggttga

SEQ ID NO: 2311 - DNA, 102 bp, Actinoplanes utahensis
atggcgaagtctttcgcgcatcacgtcgacctcggcgaggaccgcctggtcagcgggttcaagagcgggagtcgggtagagcacgattcaatcaaacaatga

SEQ ID NO: 2312 - DNA, 171 bp, Actinoplanes utahensis
ttggctgggtacgcgttcggatccctggtcaccggcgctttcggcacggtgcccggtttgttgcttccgccgtatctgaccgacacgctgggtgtcgccgcgggcgtagccggcctgcttgtgctatcgccgaaggcgtgggacgcgctgtcaacccgctggccctcctga

SEQ ID NO: 2313 - DNA, 1392 bp, Actinoplanes utahensis
atgggaagcgttgcggccggcgtcgccgcgagccatccggcgaccgcccgcaccggagtgcggattctcgaggcgggcgggagcgccgccgacgccgcggtcggcgcggttctggcctgctgcgtcgccgagacgatctacaccgggctgggtggtggcggcttcgccacctacttcgacgcgcataccggtcaggtcacctgcctggacttcttcgtcgcggtgccgggcctggacggcgaccggaagccggagccgatggtcgcggtcgacgtgttcttcggcgggctgccgcagatctattcgatcggtggggccagcgtcgcggtaccgggggtgccggccgggctgggcgaggtgcaccgccgctggggccggctgccgtggcgggacgtggtcgcgccggcggccgggctggcccgcaccggggtgctgctgcccgccgcgcacgcccgcacgctgcagtcgtgtgcgccggcgctggccttcggcgagggcgcggccccgtaccagccgggcggccggctgctgcagagcgacgagctgctcttccacgacgggctggcgaccgcgatggacgcgctggccagtgacgggccgggcgtcttctacggcggggagtacgccgatctgctggtcgccacggtccgtgcggccggcggcacgctgggcccgggcgacctgggcagttaccgggtggccgaggtggcggtcgaccatgccacgttggccggctaccgggtctgcgcccggcacgacctgaaccgcacggtggacacgatcggcgcgctgccggccgacctgtcccgtccgggccgggccgccgcggtcgccacggcgctgcgcaatctgggggcgcagcggctgggtgacaccaccaacgtctcggtggtcgacccggacggcaacgcctgcgtggtcaccacgacgctcgggctgggcgccggggtgtggctgcccgggctgggcatcaacctgaactccatgctgggcgagggtgagctgctcaccgagccactggtgccggggcagcggatgtcgtcctacatgtgcccgctggtggtgatcggcccggacgactcgctgaccgtcgcggccggttcggccggcgcctcgcgaatccgcaccgccctggtcgacacgctgctcggggtcctggtggacggcctggacgtggccgacgcgatcgcccggccgcggttccacgcggtgggcgacacgatccacgcggagaacggctgcccgccggccgagctggcgacgctgcgggaggccgggtggcacgtggtcgagtggcccgagctcaaccactacttcggcggggtgaccgcggtgggccaggccggggtcgccggtgacccgcgccggggcggggtcgggctgctgctctga

SEQ ID NO: 2314 - DNA, 975 bp, Actinoplanes utahensis
atgtgtcatcgttgttctcgacagagagcggtgctcacaaaggagaacgacatgcacgtcatcatcggttccggtccgatcggcgcgaacgtcgcccgcctcctggccgaccggggcgagcgggtgcggatcgtgacgcgcagcggcagcgggccggagcatgcgctgatcgagcgggtcgccggtgacgccgccgacgcgcagcggttgaccgagctggcccgcggcgccgaggtcgtctacaactgcgccaacccgaaatacaccgagtgggcggacaagtggccgccgatgaaccacgccatgatcgaggccgcccgggccgccgacgcggtctacgcgatcaccgggaatctgtacggctacggcccgcagcccggcggcgtgatgaccgaggacactccgctggccgccaccgggcgcaagggccggatcagggccaggatgtggcaggacgcgctggccagcggcgtccgcacggtcgaggcgcgcgcctcggactacgtcggggccggcgccgtcagcaccatctccgcggtgctgctgccggcgatcaacaagggccgggcggcgatggcgccgggcgacccggaggcgccgcacaccttcacctacaccggtgacatggcccgcacgctggtcaccctggcccgcgacgagcgcgcctggggcaagccgtggcacgtcccgtccggcccggcgatcagcatgcgcgagctggccgaccggtactgcgacgcggccggggtgccccgggtcaaggtcaagggcctgccgcggttcgtgatgcgcacggccggcctggtggtgccgatcgcccgagagctggccgagatggactaccagttctacgcgccgttccacatggacagctcgcgcacccagcgcaccttcggcctcaccccgaccgacctggacgtggcgctgcgcgagaccgcggccgcggccgaggcgaccgccgcccgccggatgtga

SEQ ID NO: 2315 - DNA, 723 bp, Actinoplanes utahensis
atgcaagagcactgctctcgttgtggcacactggctcccatgaaggccgccaacctgcgggcccgcgtccgggccgagatgaccgaagagatcaaacaggtggctcagcgtcacctggcaaccgatggcgccaacctgtcgttacgggccgtcgcccgggacctgggcatggcgtcgtccgcggtctaccgctacttcgccagccgcgacgaactgctcaccgcgatgatcatcgacgcctacgacgcggtgggggcggcggcggaacaggccgccgaaacgaccgacgacccgatgcgcaggtgggtggcgatcgggcacgcggtgcgggactgggcggtggcgaatccgcaccagtgggcgctgatctacggcagcccggtgccggggtatcaggcgccgcaggacaccgtcgtgccggccacccgggtgatcttcgcgctcgccgcgacgacacagatggcactggcgcaggggcggctcggggaggttccggcgcagccggaagggcgcttcggggaggagatggcggcggtcgcggcgcagatcaacccggatgcgccggcgcatctggtgggggcggtgatgtatggcttcgtgcatttgtgcggggcggtcagcgcggaactcttcgggcagctcaacaacaccatcgaagacgaccggaggggcttcttcgaatggcagatgcgagcggcgggaaggtttgcgggacttctttag

SEQ ID NO: 2316 - DNA, 810 bp, Actinoplanes utahensis
atggagaccggacaggcgagtaggacggcgtacgccgcggcccgataccgcgcggcccaccaggtgctggaggacggggcgatcttcgccgacccgctggccctgcggatcctcgggcatcagccggacgagctgctgggtgacgcgccccggcgggggatgcggctgttcatcgcggcgcggcaccggttcgccgaggatcatctggcggccgcggtgggccgcgggatccggacggcggtggtgctgggggcggggctggacacgttcgcctaccggaatccgcatcccgggctcgaggtgatcgagatcgaccatccggacacgcaggcgtggaagcgggagcggctcgcctcgaccgggatcggcattcccggcaacctccgatatgtcgggatcgacttcgagcgggacgacctggaagcccggctgacgctggagcagcccgcgttcttcctgtggatgggcgtggtgccctacctgaccgtcgacggtttcaccgagacgctgcggttcgtcggcggacgcgagggcaacgaggtcgtcttcgactatgcgcagtcccccgagcggatgccggccgagcgccgcgccgccctggaagcccgcgccgcccgggtcgccaagatcggcgagccgtggctgaccttcttcgagccggaggagatcgccgccacgctgggggcgcacggcttcggcgacatcgaggacctggggccgtccggcctggccgcccgcttcttcggccgcaccgacgtccccgccgacactgccggtggccacatcctgcacgcccggcgcggggtttga

SEQ ID NO: 2317 - DNA, 324 bp, Actinoplanes utahensis
atgacaccccaggagtacgtcgaagcggttctcacgctcgtcgagagcattccggagggccgggtgatgtcctatggggcggtcgccgacgcgctggccgaggtctccgggcggaactcgccccggcagatcggcgggatcatgtcccggcacggcggcggggtgccgtggcaccgggtggtgaccagcgccggccggctgccgcccgggcacgaacgtgaagcgcgggcgcggctgctcgccgagggcgtaccgttgcgcggcgaccgggtgctgatcgagaaagccgggtggagtcctgatggagaccggacaggcgagtag

SEQ ID NO: 2318 - DNA, 1182 bp, Actinoplanes utahensis
gtgtcatcaccggccacgatatgggatccggaccggatcgacaccgggcggccgagcagaatgggccgggtgcgggaagtggtgaccggtgcgcgccggatcgtggtcaaggtggggtcgtcctcgctgaccaccgcggcgggcggcatcgatgagcagcggctggattccctggtcgacgcgctgggccggttggccggcgcgggccgtgaggtggtgctggtctccagcggcgcgatcgccgccggcctggccccgctgcagctgccgcgccggccgcgtgacctggccacccagcaggccgccgccgcggtcggccaaggcctgttgatcgggcgctacaccgccggtttcgcccggcacggccggaccgtcgcgcaggtgctgctcaccgtcgacgacgtgacccgccgctcgcactaccgcaacgcctaccagacgctgcgcaaactgctggatctcggcgccctgccgatcgtcaacgagaacgacacggtggccaccgaggagatccgcttcggggacaacgaccggctggccgcgctggtcgccgccctggtcgacgccgacctgctggtgctgctctccgacgtggacgcgctctacaccggcagcccgtccgacccggcctcgcgccggatcccgctggtccgcgacgacgccgacctggcgggggtggcgatcggctcggccggccggtccggggtcggcaccggcggcatggtgaccaaggtggaggcggcccggatcgccaccgggttcggcatcccggtggtgctgaccgccgccccgctggccgccgacgcgctgaccggcgccgaggtcggcaccctgttccaggccgccgagtcgcggccgaccgcccggctgttctggctggcgcacgccaccgcgccgcgcggccgcctgcacctggacgcgggcgcggtcaccgcggtggtggcccgacgcaagtcgctgctgccggccgggatcaccgcggtggacggttccttcgccgccggcgacccggtggacctggtcgacgccggctcgggcgccccggtcgcgcgcggcctggtcaactatgacgcggtcgagctgccggcgctgctcggccggtccactccggagttggcggccgcgctcggcccgggctatgaacgagaggtcgttcaccgcgacgacctcgtactgctgtga

SEQ ID NO: 2319 - DNA, 1242 bp, Actinoplanes utahensis
atgagcgtgctggagcaggcggccgcggcccggatcgccgccatcgacctggccggggccacccgcgcggacaaggacgcggcgctgctgctgatggccgatcgcctggtcgagcggaccgacgacatcgtcgcggcgaacgcggtggacgtggcggccgcacgggaggcgggcaccggtgaggcgatcgtcgaccggctggcgctgagcccggcccgggtcgccgcgatggccgacgggctgcgccagctggccgccctgcccgacccgatcggtgacgtggtgcgcggctcgaccctggccaacggattggagctgcgacaggtccgggtgccgttcggcgtcgtcgggatgatctacgagggccggccgaacgtgaccgcggacgccgccggcatctgcctgaaatcggggaacgcggcgctgctgcgcggttcccgctcggccttctcgtcgaacgcggcgatcgtcgcggtgctgcgcaaggcggtcgccgacgccggcctgccgatcaacacgatccagctgctcgacgccaccacccgtgactcggtgaaggatttgatgcgcgcccgcggcctggtcgacgtgctgatcccgcggggcggcgccgacctgatccgcaccgtggtcgaggagtccacggtgccggtgatcgagaccggggtgggcaactgccacgtctacgtggacgccgccgccgacctggagaaggcgctgtcgatcacgatgaactccaagacgcagcgcaactcggtctgcaacgcggccgagtcgctgctggtgcacaccgagatcgccgactcgttcctgccgctgatcctgtccgcgttcgccgaggccggggtgaccgtgcacggcgactcccgggtggccggctacagcgacgccgtggtcccggccaccgagcaggactggggcaccgaatatctgtcggccgacatctcggtcgcggtggtcgactcgctggaggacgcgctcgaccacattcggcagttcggctccgggcacaccgaggcgatcgtcagcgagtcgctgggcgcgacccggcgcttcaccgccggcgtcgacgccgccgccgtcgtggtgaacgcgtcgacccggttcaccgacggcggcgagttcggcttcggcgccgagatcggcatctccacccagaaactgcacgcccgcggaccgatgggcctgcccgagctcacctcgacgaagtacatcgtcaccggcgacggtcacatccgctga

SEQ ID NO: 2320 - DNA, 807 bp, Actinoplanes utahensis
gtggtcgatatcgatgccgccatcgggtacgtcgttgcccatggcgacccggtcgaacgtgctcgtctgcactatctgcggacgggccagccggcctccccggagatcatcgaccggctgtccggcggtcagatgtccgagggcggctggcccgcctccgccgacggtcaggtcccctcggtcgacgccacctgcttccggctcagcgagctcgacgacctcggcggcctgcaggccggtccggtcgccgagcgggcgctgacctggctcgcgagcgcccagcggtccgacggcacctggcaggagcacgagtccctggccggcgaggctccggcctgggcgatgcccggcgagccggaggccaccctctacctgacgtcggtcgccggcttctggctgaccgcggcagccgtcgagagcgacccgtaccagacccgcgggcgcaacggcgaggtgctcggccgggcggctgccttcgtcgcctcgcagctgcggccggacgggtcctggccgtccttcctggcggccggctggcacctcgccggcctcctgcaccagcagcagtatttctacgagtcgtcgcgggtgcagatcgtgctgggcgagcggctgggtgacatggccccggccgacgtcgcggcgatggcggccgcgttgcgccgggtcaacctgggcgacgactggctgctgcgcaacacgtggaagcggctgggcgagacgcagcgctcggacggcggttgggacagcaacgagggcccggtcttcgacgtgaacgtcaccctgaccgccctgcgcgcctgccgctga

SEQ ID NO: 2321 - DNA, 1182 bp, Actinoplanes utahensis
gtggctctgcccccgctcgtcgagccggccgccgagctgagcgtcgacgagatccgccgctattcgcgtcacctgatcatccccgacgtcgggatggacgggcagaagcggctgaagaacgccaaggtcctcgcggtcggcgcgggtggcctcggctcgccgaccctgctctacctggccgcggccggggtgggcacgctcggcatcatcgacttcgacacggtcgacgagtccaacctgcagcgccagatcatccacggcgtctcggatgtcggcacgcccaaggcggagtcggcggcgcgcagcatcgccgaggtcaacccgctggtgaacgtggtcatccacaacaccgcgctggaccgcgacaacgtcaaagagatcttcagtcagtacgacctgatcgtcgacggcaccgacaacttcgccacgcggtacatggtgaacgacgccgccgtgctgctcggcaagccgtacgtgtggggctcgatctaccgcttcgacggccaggcctcggtcttctgggaggagcacggtccctgctaccgctgcctctacccggagccgccgccgcccggcatggtgccgagctgcgccgagggcggcgtcctcggcgtgctctgcgcgtcgatcggctcgatccaggtcaacgaggcgatcaagctgatcaccggcatcggtgagccgctggtcgggcgcctgatggtctacgacgctctggagatggagtatcgcaagatcaaggtccggaaggacccgaactgcgtgctctgcggggagaacccgacgctgaccgacctcatggacgactacgaggacttctgcggcgcggtctccgaagaggctcaggaggcggtgaccggttccacgatcaccgcgcgtgagctcaaggactggcaggacaccggcaaggacgtgttcctggtcgacgtccgcgagccggccgagtgggagatcaaccggatccccggcgccgtgctgatcccgaagggggagatcctctccggcgaggcgttggcgaaattcccgcaggaccggcagatcgtcctgcactgcaagtcgggcgtgcgctcggcggaggcgctggccgcgctgaaggcggccggcttcaaggacgccgtgcacgtccagggcggcatcgtctcctgggtcaacaccgtggacccgtcgctgccgtcgtactga

SEQ ID NO: 2322 - DNA, 2883 bp, Actinoplanes utahensis
gtggccgccgagacgagcaccgcggcgcggccgcggaagacgctgtccagcgacgcgtcgccggccgggacgacgccgcggaagccggcagccgggacgccgcgcaagcccgcgggcggagcgacgccgcgcaagacgatcagcaggggcggtgagcccgctcggccggcgctgcaccccggctcggaccgcgacgaatccggcggccggcaccgacgcagcggtgagccggtggaaacttcgggcggccggcaccggatgtccggcgaggaacccctggctcggcaccgcgccgaaggggccccgccgcggctcaacccgtccgccggagcgctgcaggggtcggcggccggagggccgcaggggtcggcggccggagcgctgcaggggtcggcggccggagcgctgcacggatcggcgcccggggcgccacccgggtcgtcggtcgggtcggcggatcagccggcgggggtgccggatcggtcctcggccgcgcgccatgcgcaaccgcgcccggccccacccccggtggatccggagaccggcctgccacccggcatgacccgcggcatcctggaactggccgccgaacgcctggccgcctcccgggctgcccaggctgctgcccgggccgcgcaggccacccctaccgataccgattccgccgtcccgaccaggcaggatgctgccgagcctggcgcaccgggagtcccggatgccggctgggctgcggcggatcttcgccggcattcgccagaggcttcggtgggacacggacaccggccgtcgttcctccccgatgcgggtccgcaggcagcgcggggcgtggacgtctacgggcagccggtcgagacggcgccgcgtgcgtcggcggcgggggcggcttcggcggcgcccgatgtggacgtctatcaccagccggtggtcatcaccgaggctgagctgcatgctccggcggaggtcgagccgcagcccgtcgactggcagagcatgcggcggatgcgggcggcccgggcggcggcactgtccgagcagcgtgccgaaccgcggccggacccggccgccgtcgacgggcaaggggcggggctgcagcagcaggagccgcccgccgaagccgagccgatcgtggaaccggaccgccccagccgccgccggccgatcctgcggacgaccgcggacaccccggcgcagccgcaggacgcgggacaagcggtgcaccccgaggcgggacagacggcgtactcgccagggacggagccgacggcgtacccgcaaggggcggggccgacggcatacccgcaagcggcggggccgacggcgtacccgcaagcgatgggacagcaggacgccgcgatccgatggtcggaagcggacctggacagcctgcggcccgcccttccgccgcagttcgtgtccgataccgcggagattccccgcgtctatcccgatctgcatgaccggtcggtggcctggccggagccggagcccgaggacccgcacgacgcctggttctggtcaacgaccgaccacccgccggccggcctgccggagagtctgcgacttccggccggcatcccggagggcctctggcatccggccgaggatgagcgtgccgcggccgggagtgatctggccggaaccggtctggccgcctctgacgtggccgggatggacccagcctggccggcggaggatgccgggagcgcggggtatcccgaatatgcggaactggcgggagatgtcggatttgcggcctcgatgggacacaccgggtatgcgaatccggccgatcagaccgcgttcggcgaacaggcgacccatgagcaaccggcctacgtcgatccgcagcagtccggccatattccggcgcccgccgccgctccggccggggcggacgccgccggcctgaccggggcgcacgccgccggcctggcagaggcacacgccgtcgaggtgaacaccgccgccgcggccgaggtgcacgctgatgatctccccaccgcgcggggcggtgcgacgccggtcgtcgagatcgaccgtgacgcgccgccggatgtcgacgggcagcccgaggaatccggcacgctgaccccggacggccggaagctgctgcgccggcgccgacgggtcaccttcctggcgtacgtcatggtcgtcgctctcgtcctggtcgtcggccatgagttgcgggaccggcagcgacccgtggcggagccggaagcggcgcgcccggcgccgatcggcgcccccgaggcggaccgcgggcagcgtgatcacctggcggagcagcgcggttcggcgctgagcgagacgaacgggaaagccgggcacttccggtacgtgacctcgcgcggctcagtcctcggcaccggcggtgacctgcaccggttcaaggtcgccgtcgaggagacggtcggggacgtcgcacccgacgacttcgcccggaccgtcgaccgcacgctcggcgacaggcggagctggatcggcggcggcaaggtgcgcctgcgccgggtgccgaagtcggccgacaacgcggagttcaccgtcttcctggcctcgccgaccacctcggagaagatgtgcgcggccggtggcctgcacaccgaggggttcacctcgtgccgggtgccgggccaggtgatcatcaatgctgagcgttgggcgaccgccatcccggagtacgacggccacctgggcgagtaccgggaatacacgatcaaccatgaggtggggcatcagctcgggcacggccacgaagggtgcccgggcaagggcgaaccggctccggtgatgctgcagcagacgtacggtctggagggttgcacccggaacgcctggccgttcctggacggcgagcggtacgcaggcgacgcgcgcccgtaa

SEQ ID NO: 2323 - DNA, 882 bp, Actinoplanes utahensis
atggtcccttccggtacgcccaccctcgaaccgccggcacgtgccaccgatcgatggcggcagtggtggccggcgctgttcgcgatcacgctggtcctgctggtggtcatcacggtggcggtccggcactccgggaggccgacgccgtccgccgccgcgacgccgtccccggcggcctccccgtcggctgcgccgacctcggcggcgcccaccctggaacacacctcggctccgccatcggccggccccacctcgttggaccccgagatcctgcaggtgcccggggcggtcccgacgcacggttccggcgattttgtgtacgccgtgaaacgcggcgccgtgctcggcggcaaaggcccgatccgtcggttccacgtcgccgtggagaagggctccggggaggacgcgaacgcgttcgccactctggtggtgtcgactctcggcgacgcgcgcagctgggtcggtgacggaaacctgcgcctgcagatggtcgacgcggacgatcacgccgacttcacggtctacctggcgacccgggagacggccggagagatgtgtcagcggggtggcacgaacatccacatcggcggcgtcccgtacacgtcctgccgcgtccccggcgccgcgatcatcaacctggaccgctaccggaagtcggccaagccgtatctcgccgccaagatcccgctggccacctaccggatgtatgtgatcaaccacgaggtcgggcacgagctgggccaccaccacgagggctgccccgagccgggcggcccggcgccggtcatggtccagcagacgttgatgctgcgcggttgcgtgccctactcctggccgcgcctcgacaaccacccgttcaccggaccgtccgtctcccactga

SEQ ID NO: 2324 - DNA, 948 bp, Actinoplanes utahensis
atgctggccggcgaggacacgctcctgccggagggtgaggtgccgccaccgtggcccgcacgacgggtcgaggtgggcggcgccatgctgcacgtgcgggacaccccggcactgggcccggacgccgagcccgcggtctacgtgcacggcctcggcggttcctcccagaatttcaccgacctggccggcctgctcgccgaccggttcgacgggcaggcggtcgacctgcccggattcggctacagcgaccccagcccgcgatattcgattccggccttcgcggccaccctgatcgactatctggacgcgtccggccgcggcccggtgcacctggtcggcaactcgctgggcgggtccatttcggtacgggtcgccgcgctgcgccccgacctggtgcgcaccctcaccctgatctccccggcgatgccgttcctcgacccacgtcgcaccgcacagggcccggtgctgccgctgctcgcgctgccgggtgccgaacgcctgatggcgtgggcgctcacccgggtcaccgcggaacagatggccgagcaggtgctggccgcctgcttcggcgacaccagcaaggtgcatccgcagcggcgggccgaggcgatggcggagatccagctccgctacaccgtcgcccactatccgcgggcctacctgggcaccctgcgcggcctcgtcggcagtttcctgcgggcgtacctgccgggcgtcaactcgcagtggcggctggccgcccagatccaggcccccaccctggtgatcggcgggctgaccgacaaactggtcgacccgcgggtgcccgtccaggtggccaggaccatcccggacagccggctgctgatcctgcccggcgtcgggcacgtcgcgcagatggaggtgccccggctggtcgcccgcgcgatcgtcggcatgctggaggacatccgcgcaccgcaccgctga

SEQ ID NO: 2325 - DNA, 1845 bp, Actinoplanes utahensis
gtggatgaaacagggcattccggagacgccggagccgcgcatggcggcaacggcgccgacgcgcgtgaccgcaatcgggtgaacgggtgggtgaacggcgaaaacccgtggtcgaacgcgggttccgcacgggaacaggaggccgacgtgcccccgtggcggcgcggcgccatcggccggcagccgagcccgacacgccctttcggaccggctcccagctccgccgtgccggcgcaggtgcccccgccgccggggttcgtggacccgccaccgtccaccgagattcccccttccggggccgccgagcccacaccgtggcccgctgaacgcagccgtctggctgacattctcggtcaccggccgcgtccggtcgatacggcgtccaccgggcccgccccgagcagtgcacccccctacccgtacgagggcgacctcgacgactcgtatcactccgccaccgcgcagcgcgcggccgtgccgatgccccggccggtcccgtccgcccggggcgactggcagcccgccgagccgggcccgaccctgggagatcccctgagccgtaccgacgcgccgtccgagccgatccgttcccgccacgcgctggtcaacgacaccctcgcgcagggcctgccccgggtggagccggcggccccgcagggggaccagcgatcggtggacaacgaggcccgcaccggcctgccgacgtacgatgcctccagcttctcccgccgggcttacgagccgtcggcgccgcccgccttccccgccccggtcttccccggatattccggtacaccggaggaggtggcggccgcgctgggcgagcccagcgacgccctgccccagcgcgtgccggcccagccggacgtgccccgagttccggagccgccctccgtggagccatcggccgaggcgcccgccctggcgcgcatcgcgacgcacctgcgccgcggggacgtcgtgcccgcccaggagcggcaggagggcttcgacgtgcaggccatcctcgccgcggtgcgcgaggtcgacggagtccgggacgcctcgctgaaagccaccccggccggcgcgcacagcctgcgcctggacctggccgacggcgccgacgcggccgaggtgagccgacacgtcgcccggctgctggccgagcggatgggcctggacgcggcgatgcccggcggaatgccggccggtccgctgcccgccgacccgctgtcccccggtccgctgcagtccagcccgacgccgccgcctaccccggcaccccggccggcccgtgcctcggtcaagccggtgtcgccggcacccgtgcccacgccggccccggtctcggccgccccggtgtcgaccccgccggcccccgccaccgagcgtgccgctgtcaccccgcgagacctcaacggtccccgcccgctcgaccccggcgaccgccccggcccccgcgtcctgatcgagaacgtgcacgtcaacacgttcggcgcggacgcctccgtcgaggtgcgactgcgtgccggcgaccggaccgcctccggcgtcgccaccggcccggccgtcgacggctacctgctgcgcctgtgtgccaccgccaccgcgggcgcggtcgacgagctgctcgccgtctccacccacaccgacggcccggcccgctgcttcgtcgagcacgcggccgccgtctcgttcggttccacccaggtcgccgtcgtggtgctgctgctgtcctgcgccggtggcggctgggtcgagcagctctccggctcggccgtggtcaccggtgacgatcggcacgcgatggtccgcgccacactggccgcggtcaatcgccgcgccgaggcactgttggcgtag

SEQ ID NO: 2326 - DNA, 660 bp, Actinoplanes utahensis
atgaccgccgcgtccggcggggctcagaccacccgccccacccggctgcccagatcggcacgccgaaagcaactgctggccgccgctcagcagatcttcgtcgcgcacggctaccacgccgccgcgatggacgacatcgccgagcgcgcgggtgtctccaagcccgtgctctatcagcacttccccggcaagctcgagctctacctggcgctgctcgacacccactgcgacgcgatcatcgccaaggtccggggcgcgttggaggcgaccccggacaacaaggagcgggtgaagggtgccgtccgggcctacttcgacttcatggaccacgagagcgaggcgttccggctcgtcttcgagtccgacctgcgcaacgacccgcaggtgcgccagcgggtggagcgggtcgagcagggctgcatcgtggcgctgaccgagacgatcatctcggacaccgggctgcgccccgatcaggcccaactgctcgcctcgggcctcgccggggcctccggggcggccgctcagtactggttggcgaacggccgtcgtacgcccaaagctgaagccgagagcctcgtcgccgctctgatctggcgcgggatcgccagcttccccctccagggcggttcaacggccggaacggcaccggaaatcggatag

SEQ ID NO: 2327 - DNA, 225 bp, Actinoplanes utahensis
gtggaggtcaagatcggcgtgcaacagtcgccgcgtgagctcgtgctcgaaagcgcgcagaccccggcggaggtcgagcaggccgtgtccgaggctctggccaaggacggcgtcctttcgctcacggatgagaagggccgcaaggtgatcgtcccggtcaccaagctggcctacgtggagatcgccgaggcctcacaccggccgttcggcttcaccacccgctga

SEQ ID NO: 2328 - DNA, 1356 bp, Actinoplanes utahensis
atgaccgacattgagcaagctctcatccccgtgacgaaccgcgccccggtccgcccggacagccccaccttcgctgacctgggcgtccggccggagaccgtcgaggcgctggcgaaggccggcatcacgcacgccttcgcgatccaggagtacgcgctgccgatcgcgctgcgcggcaccgacctgatcggccaggcgccgaccggtaccggcaagaccctcggcttcggccttccgctgctggagcgggtcctcgccccgtccgagggcgccgacggccgccctcaggcgctgatcgtcgtccccacccgcgagctgggcctgcaggtggcccgcgacctggccgccgcgggcagcacgcgcggtgtccgggtgctgccgatctacggcggcgtcgcctacgagccgcaggtggagcagctgaagaagggtgtcgagattctcgtcggcacccccggccggctgctcgacctggccaagcagaagcagctgaagctgaacgcggtggccgcgctggtcctcgacgaggccgaccggatgctcgacctgggcttcctcgacgacgtcgagaagatcctggcgatgctcccggagcagcggcagaccatgctgttctcggccaccatgccggacccgatcgtggcgctgtcccgccggttcctgcgcaacccgatgaccatccacgccgggcacaccaccgacagcgggccgaacccgctgaccaagcaggtggtctaccgcacgcacccgctcaacaagatcgagatggtgtcccggatcctgcaggccagggaccgcgggctcacgatgatcttcacgcggaccaagcgggccgccgacaaggtctccgaggaactggacttccgcggcttcgcggtcgccgcggtgcacggcgacctgggtcagggcgcccgtgagcgcgcgctgcgggccttccgcagcggcaagatcgacgtgctggtcgccaccgacgtcgccgcccgcggcctggacgtctccggcgtcacccacgtgctcaactacgactgtccggaggacccggagacgtacacgcaccgcatcggccgcaccggtcgcgccggcgccaccggtgtcgcggtgacgttcgtcgactgggaggacatgccgcgctgggtcctgatcgacaagtcgctggtgctcggcatgccggagcccccggagacgtatcacaccagccccgcgctctacgccgacctggacatcccgtcggacgtctcgggcacgctgccgaccgcggaacgcaaccgggccggcctgtcggccgagatcgaggaggatctcggcggcggtggccgcggccggcggtcgtcccgtccggcacgcctagctagctag

SEQ ID NO: 2329 - DNA, 309 bp, Actinoplanes utahensis
ttgcgatccgcggccttcgaccgggccaccggtttcgtcgcgcaccacggcgcccgctacctcggcgacctcgacggtggtcaatggctgggcgccgccgtcctcgaagtgtatcgattccgccgcgagggctaccgcttcttcgtcttcgagggcgtcgacccggagctcttcccggcctgctactaccggcagctggatgcgacgccgtggtgtcgggccgagcagcacgccttcctggccgaggtgacggcggccggccaactctcggtcaacctgctgaccgacttagccgatcgatggctctaa

SEQ ID NO: 2330 - DNA, 339 bp, Actinoplanes utahensis
atgtggtcactggcggatccgccaaacaccggcatgctctccggccaactgcggagaattctgggcgaggcgtacgccgcggtccgccaccatcgtttcgtcgtcgccctggccggcgggcggctgccgatcgccgcctacgccgagctcgtcgcccagcactggttcgtctacgagtcgctggagttggccacggccgcgatggcctgcgatccggtggccggccgattccacttcccggagctcttccgggtgccggcgatcgaggctgacctgcgctttctgcacggtccgtgctggaccgggcggatcgccgcactgccggccacgaccacctaa

SEQ ID NO: 2331 - DNA, 1167 bp, Actinoplanes utahensis
atggcgaccgggcagaatggtgggatgccacaaccgctcgaccaagccctcgccgaggtgcgcgaactgctgctcgcccccggtctgacccgtgccgtcgcggccgggcggcgccgcggacagctaccgtcggtgacccgagcccagctacggccggtgactctgaagagcggtccgaaattgcagatcgtcaccgacgacggtgcccgacccgccacccgcaacgtcacacccggcgcggaagcggccgccgcgatcgacgagctgctcgccgagccgttcggcaactggcacatcgagaccgattccgccaccgtccaggtgcggatcaccaagaagggcgaggcccaggtgcaccgcgcggcgaccgtcgcggcgcccgtcgcgcaggaccacgaccgggcgaaacagtggctgctcgacccgggtgacccgctgttcgaggtgatcggcggcaacgccgcgaaacggcggcagatcgacgcgttcctgcgcgcgctcgccgcgacactgcccgacgagctgccgccgacgctccgcgtcgtcgacctgggctgcggaaacgcttatctgaccttcgccgcctaccgctatctggccgggcgcggcgtgacactccagatcgccggggtcgatgtccgcgaggatcagcgggtacgcaacaacgcggtcgccgcccagctcggatgtgcggccgaggtcagcttcgtggccggcaccatcgaggaggccgagctgccgttcacccccgacctggtgctcgcgctgcacgcctgcgacaccgcgaccgaccaggcgctggcccgcgcggtgcgctgggaggcgcgctgggtgctggccgcgccgtgctgccaccacgacatcgcggcccagctcaagggcggtgcggcgccgtcgccgtacgcggagttcacccggcacgccatcgtccgggaacggttcgcggacgtgctgaccgactcgctgcgggccgcactgctgcggttgcacggctaccgggtcgacgtggtggagttcatcgactcggcgcacacgccgcgcaatctgatgctgcgggcgcggcgcagcggtgcggcggcgacgccggagcagcacgccgagtatgacgcgctgatccggcagtggggcgtcacgccggcgctgtcccggctgctagccgacggttag

SEQ ID NO: 2332 - DNA, 1101 bp, Actinoplanes utahensis
atgcctgaccagcccggcgccgacgccacgacccacaggggcgaattagccggcgaaggcagggcagccgacccgacgcccgctgtccccgaaccgcagagtgcgataaagaagcagaagtccgtcaagtccggcagatggtcactcccggacacgaccgacgatgccctgcaccaggacgacgagccggagcatccccccagcggaaacaccttccggctcgccgccttcggcgccctgctcatcgtcgtcctgttcgccggctacggcctgggccgcctcaacaacggcaccgccaccccggccgccgccggccccagccccaccaccggcatggtcatgaacgagaacatgccgcacacccacggcaccaccggcaccggcgtcaccatggccgcggcgctcggcggcctctccctcagctccgacggactcaccctgcacccggccgccaccagtttcgacgccggtcaccgcgcgcgcctcagcttcgtgatcgacggtccgggcggcgccccggtcacgtcgtacgcgatcgtccacgacaaaccgctgcacctgatcatcgtccgccgcgacctgaccgggttccagcacctgcatccgacgatggccaccgacggcacctggtcgatcgatctgaccctggaccggcccggcgcctaccgcatgatcaccgatttcaccgcgctggccggcggccgacagatcgccaccacactcggcaccgatctcaccgtcgccggcgattacgcgccgcagccgctcccgccggccgaccgtcggaccaccaccggtggattcacggtcagttacgagggcgcgccgaacacccaggccgtccaacccgtcctgatcagtgtgaccggggccgacggccgcccggcgaccgtcgagccgtatctgggcgctttcggtcatctggtcgtgctgcgccgcggcgacgtcgcctatctgcacatccacccggagctgcagccggtcgacggcaaggtcaagttctgggtcaccgcgcccggcccgggcgactaccggatgttcttcgacttccaggtcgccgggcaggtgcacaccgcggagtggaccctaaccgtcggctag

SEQ ID NO: 2333 - DNA, 213 bp, Actinoplanes utahensis
atggctgtcaccagcacctacaccgtccagggcatgacctgctcgcactgcgtcaacgcggtgaccgaggagatctcggcgcttccgggggtggccgaggtgagcgtggacctggcttccggcggtgtcacggtgaccagcgaggcgccgctcaccgacgacgcggtccgcgcggcggtcgacgaggccggctaccagctcgcggatgcctga

SEQ ID NO: 2334 - DNA, 363 bp, Actinoplanes utahensis
atgtccggcgaacggtacgcaagtcccgcggataccggcggggggtatgctaggggcatgtcggaggaggcgaacacggggcacggtccgcacggctactcgggggacaaggctgccctgctcgggcggctgcggcggatcgagggccagatccgcgggctgcagcggatggtggacgaggacacgtactgcatcgatgtcctgacccagatctccgcggcgaagagtgcgctgcaggcggtcgcggtcgggctgctggaggatcatctggcccactgcgtggtggatgcggcacgcgccggggacccgtccgacaaggtcaaagaagcgtcgaacgcgatcgcccgactgatcaaatcctga

SEQ ID NO: 2335 - DNA, 936 bp, Actinoplanes utahensis
gtggcacaccgatccgctctcgatcatgtcgtgacgctgatcgccggctccgagtgggccgagacggtggtcctgcgcggcagcatggcgatgccggcctgggtcggcgacgccgcccgcccacccggcgacctcgacctgattctgctccccagcccgatcgtcggcgtcgacacccgcgagccgtggccgttcgtcccccacctcggcccgtcccagcattggccggaggccgtccacggcggcgcccgcaacgagatctggaccttcgaggagttcgagaccggcggcctgcgccccgtcctcccaccggagggcctgcactggatgaccagcctcgacgtgtccgagccgttcgacttcgcccaccagttcctgatcgacctgctcaccgggcatccccgcacccccgacggcgtcctgctcgacctcgacgccgccaccgagaacctcagctgggactacagcgaaccggacgaatacaccaccaccagcgagaacggccgagcccggctccgcatcccgtggaccacccccgccggccttcccggtcacatgcagatcgatttgtcgtacgacgaaccactccccaccccacccgtcctgaccgccgtgccgcgggtcgccgccccgccgatcgccgtcctcaccgccggccgggagctctccctggcctggaaactccactggctggccgccgaccagcagtcggagggccggtccgccgccaaagacctgtacgacgccgtcctgctggccgaactcccccagatccgcctgcggccccgcctgcagcggctggcgctgccccagcccttatcaccgaccgccctggccggctggaccatcgacggcccgctacccggcggcccggcgccctggctgacccggctcgccaccgccctcccccacctgaccgccgcccctgccccatga

SEQ ID NO: 2336 - DNA, 456 bp, Actinoplanes utahensis
gtggaagaccgcgagaaggacggctacgtcctcaccgacgatgcaggccgggtcgacatcgatcgcgtacaccgctggctggccgaggagtcctattgggctaccggccgcccgctcgacctggtcacccgctcgatcgacggctccgtgccctattccatcctccacaatggcgagcaggtcggtttcgcccgtgtggtcaccgacggcgccaccttcgcctgggtctgcgacgtcttcatcgccgagtcgcaccgcggccacggtctgggcgtctggctggtcgacaccatcgtcgaggacatgaccgcccgcggcatcctccgcctgctgctcgccacccgcgacgcccacgaggtctaccgccgctccggcttcaccccgttggaaggccccggccgcttcatggaaatcgaccgccgcccgacccgcaacgccatcctgggccgctcctga

SEQ ID NO: 2337 - DNA, 2127 bp, Actinoplanes utahensis
atgacagccgatgcggccgagcgggcgagtgtgcgggagcgcgccgagcaggtgctgcgccggctcgccggagagcacgcgagactgcgagaggatcagtggcgtgccatcgaggcgctcaccgtcgaccggcgccgggtgctgtgcgtgcagcgcaccgggtggggcaagtcggcggtctatttcgtggccaccgccctgctgcgggccggcggttcggccggccccacggtgatcgtgtccccgctgctcgcgctcatgcgcaaccaggtcgacgcggctgcccgggccggcatccgggctcgcaccatcaactcggccaacctcgacgagtggtccgagatcgagcaggagatccgggccggcacggtcgacgtgctgctgatcagccccgagcggctgaacaatcccgacttccgcgacaacgtgctgcccggcctcgcccacagcaccgggctgctcgtggtcgacgaggcgcactgcgtctccgactggggtcacgacttccggcccgactatcgccgtctgcgcaccttcctggccggcctgcccggccgcaccccggtgctggccaccacggccaccgcgaatgcccgggtcaccgccgacgtcgccgaccagctcggcgacgcgctggtgctccgcgggccgctcgaccgggattcgctgcgcctcgcggtgctgcggctgcccgagccggcacaccggttggcctggctcgccgaccatttggagcgcctgcccggctccggcatcgtctacacgctcaccgtcgcggccgccaccgagaccgccgacttcctgcggtcccgaaattttccggtcgcttcgtacacgggccaggtcgacgacgccgagcgccgcgccgccgagcaggacctgctggacaacaagatcaaggcgttggtggcgacgtccgcgctcggcatgggtttcgacaagcccgacctcggcttcgtcgttcacctcggcgcgccgaattccccgatcgcgtattaccagcaggtcggtcgcgccggccgggccgtcgagcacgccgaggtggtgctgctgcccggcccggaggatgcggcgatctggcgatatttcgcctcgctggccttcccgccggaggatcaggtgcgttcggtgctggcccagctctccgccgaccggccgatgtccacgcaggccctggagcccctggtcgatctgcggcgcaaccgcctggagctgatgctcaaggtgctggacgtcgacggggcggtccgccgcacacgtggcggctggctcgccaccggcgagccgtggacctacgacaccgcccggttgcggcgcgtcgccgaggcgcgctccgccgagcaacaaaccatgctcgagtacgccgtgacccccacctgccggatggaattcctccgcagatgcctcgacgacccggaggccacaccgtgcggccggtgtgacaactgtgccgagccgctcttcggcccggacgtgtcggccggctcgctggccgccgccgaggcgttcctcggccgtcccggggtggaggtcgcgccgaagaagatgtggcccaccggcatgaccgcggtcggcatctcgctgaagggcaagatcgggccggccgagcaggtcgagccgggccgggccgtcggccgcctctccgatctcggctggggcgcccgcctacgcggcgtggtcggccccgagtccccggacgcaccgatcccggccgagctcgccgccgcggtcgtcgaggtcctcaaagcgtgggcgcgcggcgatgacgcctgggcccagcgcccggtcggcgtcgtggcggtcggctcacgacgtcatccacaacttgtccacagcctcgccgagcacatcgcaacggtcggccgcctaccgttgctcggcgtcctcacctcagccggttccggagaggagacgttccgcggcaacagcgcccagcgcgtccgcgccctgcacaacgccttcaccgttccacccgaggtcgccgccggcctcaccgttcaccagggcccgctgctgctggtcgacgacctggtcgactcgggctggacgatggccctggccggccgcaccctacgccagtccggcgcccactccgtccttccgctggccctggccgtcgccagctga

SEQ ID NO: 2338 - DNA, 462 bp, Actinoplanes utahensis
gtgaccggctggcatcgaccgcaaatccgacccggacccactgctgaatggaagtctcagggcatgagcaaaacgatcgccgagaagctgttgatcaagccgaattccaccgtctggctcagccagccggcacgcctgccgctgctcacaccgatgccggagggtgtgcgcgagaccggatcgctggccgccgccggcaccgctgtgctgttcgccgaggatgccgcctcggtgcgcgcccagctcaccgagcaccgggccgacctggacaagccgagtgccttctggatcgcctatccgaagggcaacaaggcggacatcaatcgcgacacgctgtggccgatcgtggccgatttcgacatgcggccgtgcggccaggtggcgatcgacgaccgctggtccggtctgcgcttccggccgaaccgtcccgatgagggccgattcaccggaggcagccaatga

SEQ ID NO: 2339 - DNA, 726 bp, Actinoplanes utahensis
atgacaagactggctgtggtcaccggtggtggcaccggaatcggcaaggcgaccgccggcatgctggccggcgagggctacgacgtgatcatcgtgggccggcgacccgaggtgctcgccgacgcggtgaagtggatcggcccgcaggcctccgcggtcaccgccgacgccgccgacccggcgcaggtcccccggatcgtcgaggcggtcgccggtcgggcggtggacgtcctggtcaacaatgccggcgcgttcatcggcggcgacgacagcacgctggacggcgtggccgcacgctggcgggccaacctcgactccaacgtgctcaccgcggtgctgacgaccaccgcgctgctgccactgctccgccggccgggcggcaagatcatcctgaccagctcgatcgcggcccagcgcgggggcggggggccgtattccgcggcgaaatccgccctgcacggctacgcactggacctggcggtgaacctgggcggggagggcatcacagccaacgtgatctcgcccggatacatcaccgacagcgagttcttcgacggccggatgacgccggaggggcacgccaagcgggtcgactccgcactggtcaagcgcgccggtgagccgcaggagatcgccgaggcggtgcggtggctggtcgggccgggcggcggtttcgtgaccggtcagatcgtcaacgtcaacggcgggacggtcctcggccgctga

SEQ ID NO: 2340 - DNA, 1962 bp, Actinoplanes utahensis
gtgcggcaccggagactcagtccctcgggcgagaatcggcgcatggggcgtacggagcgaaacggtcacgagggatcgcttcggatcgccggccgttaccgcctcgtcgagaagctcggcaccggcggcatgtcggtcgtctggcgcgcgtacgacgagaccctcagccgtgacgtcgcggtgaaggtgctcaccccgcaactggccaccgaccgtgccttccgtgaccggcttcggcaggaggcgctggccgccgcccggctgtgccacccgcacatcaccggcgtctacgacttcggggaggctctgctttctgatcatctgaccgttccgtatgtggtgatggaactcaacgacggggagtcggtaggcgcgcgcataggccggcagggcaccctcgactggcgcgaagccgtgatggtctgcgccgaggtcgcttcggccctggccaccgcgcacgcccgcggcgtcgtgcaccgggatgtgaccccggccaacgtgatgctcaccggggccggtgcgaaggtggtcgacttcggcatctcggcggtggtcgggcagcgcgacgccggcccggacggcagcctgctggggacgcccgcctacctcgccccggaacgcctcggcggggcgccggtctctccggccaccgacgtctacgcccttgggctgctgctctaccgcgcgctcaccggccggatgccgtggcccgccgcgagcaccaccgaggcgctccgcgcccatctctacgccgaccccgatccggtccccgacgtcccgggcatgccggccgcggtggctgatctgtgcctgcggtgcctggccaaagccccggccgaccggccggtctccgcggaggtggcccgggccttggcggccaccgtcggggtgcggccgatcatcccgccgctgcgccccggggaacgtccggccgtcccggtcgcccgcgcggtggtacccgccccggccggctccgaggcgccgcgccgcgcccggttgtcctggctgtccggctcgccgcaccggagactccggcggcccgccgcgccgcatggtgcctccgggcggtccggctcttcgtacggcagtgtcgcggagtccgggcccgggttgcccgatcgccggccctggtcgtccggcccgtcgtgccgcttgcggctccgtgaactgcggctgcgggccgctctccgattcgggaccgtgctgcggacgggtgcggtgcatcccctcggtaatgggttgtttctcggctcgcgcctgcgccaggctggcgcggtcgccgcgtgggtgcggcacggccgcccggcccgcgcccggaaccggttgtcggcggccgcggctttggccaccgtggtgctgctggccggtagcgcgttgacctggtcggcccggcgggaggccgcggacgccgaccagtccagcgcctccgccgccggcccgggcgcggacaccacgcagcgggtccgttgctcggtccagtaccaggtgcggcgcgactcgggcggtgcctttgaagcgcggatgaccgtgctgaccaccggcggctcggccggctggcggttggagttcagcttccccggtacgcagcggctggccggaccgccccgatcggtcgcccagcacggtcgacgtgtcgtggtgcgcggtgccggccggagccgggtgatcacgctgcgcgggggttaccgggaccgcaacccgctgccgctcgccttcgccatgaacggccatccgtgccgggccgaggtgctcggcgtggtcagtgacccggccaccaaggacgatgcggtgagcgccgcctcggccaaggatgatcgcccggggccggaggaaaccatccaccagcgcaagcggccaccgtcccggcatggcggcgcccggaggaaggccgcgccgtcgccggccgacccgtcgccggccgccccggccaaaccgaacagcgggttctctctcgccctttga

SEQ ID NO: 2341 - DNA, 1098 bp, Actinoplanes utahensis
gtggcggccttccccccgcgccggcgcaccgacctgctcgccgactccacgcgcgccccatttgccgttattcggcggcgcggtggactgttcctcagccggtcggggcgaccggcccggttcgccgccctggtggccgcgaccctcgcggccgtgctcgtcgtgtccgggacgccggcccgtgccgccgacccggaaggcgggaccaaggcgctgcgggccaacctggaagcggccgccaaggggtacgacctggcgaagacgaaactggccgagtcgaagaaacggcagacgcagctgaccgccacgctgaaggcggcgcagacccgggtggacggcctcaccaggcgggtcgccgccgtggcgaaccgctcgtaccagatgggccggatgaacacgatgatgctgctgctcaacagtggctcgccggacagtttcgtggagcgggtgcagggcctcgacatgctcgcgcagctcgacggcagcaccctcgccgcgtacaagacggacatcgacaccaccaagaaggcgcagaccgcgctgtctgccgagatcatcgagcagaaccgccaggtcaacgtcatggcgcagaagaagaagcaggccgagatcgctctcggggcggtcggtggcggttcggtgggcggcttcgtcagcgccgactcggcggcggccgccccggcgccgcgcaactcggacggctcctggcccaaggagtcatgcacggtcgacgacccgacctcgaccggctgcatcacgccgcggaccctgcacgcctatcaggaggcgcggtcggacggcttcacgcattacacggtctgctggagccagcgcgactccggtgaacatccgaagggccgggcctgcgatttctccgccaaccccagcaccttcaaggacgccgcggcgaccggcagcgacaaggcgtacggcgatcgcctcgccgcgtacttcgtcaagaacgcggacgccctcggcatcatgtacgtgatctggtatcgccagatctggatgcccagcacgggctggcgtgcctacagcgccagtggtggtccgtcggtggttcataccaaccacgtgcacctttccatgctctag

SEQ ID NO: 2342 - DNA, 774 bp, Actinoplanes utahensis
atgacttcgtacctggatgagcttttcgggctgaatgggcgaactgcgctggtcaccggtgggagctccgggatcggccgggagatcgccctcgcgctgggtcgcgccggcgcccgggtcgtgctgctcgcccggcgtgcggggccactcgccgaagtggtcgctgagctggaaaaacatggtgccgagggtggggcgatcacggccgacctggcggaccggtcggcggtccggtccgcggtcggggagatgaactcgcggtacggcgagccggacatcctggtcaattcggcggccgtgaacctgcgaccgccgttggacgagctggccgaggacgtctgggacctgaccgtggaggccaacctgacgtccccctttctgctcggtcaggcgttcggcccggggatggccgcccgaggctgggggcggatcatcaacatcgcctcccagcaggcctttcgcgcctacggcaacagcggggcgtacggtgcggccaaggccggcctggtcggactgacccgctcgcaggccgaggcgtggtcgcgacacggcgtgtgcgccaacgcgatcgcccccggagtggtgcacaccccactcaccgaacccgtcttcggggatccctcgaaagtggcggcgcacgccgctcggacaatgatcggtcgcaatgggttgcccgaggatttcgccggatgtgccgtttttctggccagcggggcgagccaagcggtaaccggtcagacactcttcgtcgacggtggatattcggcgacctga

SEQ ID NO: 2343 - DNA, 819 bp, Actinoplanes utahensis
gtgcttgaccaggtttcggacctcgtccgtgaggtcgcgcagacggtggtgctgccccgattccagcggctggacagcgccgacgtgcaccagaaagcgcccggtgacctggtcaccatcgccgaccaggagtccgagcgggcgctgacccgcggactgaccgccctgctgcccgggtccacggtggtcggtgaggaggcggtcgccgccgatcccgctgtccgcgaccggatcgacgagggtggcgcggtgtggatcgtcgacccggtcgacggcaccaacaacttcgccgccgggcggacgccgttctgcgtgatggtcgccctggtgcgggagcgcgagacggtggccgcctggatcctcgacgtggtcgaggacagcctgaccgtggccgaggccgggtccggcacgttccgcgacggcgtgcgggtcaaagcccgggccgacgacccgccggccggcgacctgcacggggtgatcgcgaacaagtactttccgcccgacatgcaggcgcacatcgacgcgcacgcgggcgcgctcggcgggtacaccccgggccggcactgcgccggatacgaatacccggcgatcgccaccgacgcgcagcagttcggcatgttctggcggatcctgccctgggaccacgcgcccggcacgttgatcgtccgcgaggccggcggcgtcgcccgacacctcgacggcgtggagtacatgccgatcaaccgtcgcaagggactgctggtcgccggcaacgaggagatctggcataccgtgcagaacactcttttcccggatggaccgcccgtcatcgaggactga

SEQ ID NO: 2344 - DNA, 456 bp, Actinoplanes utahensis
gtgagcaccgaattccgggacagcggcacaccgatcgaggtcctgctggtcgaggacgatcccggtgacgtcctgatgacccaggaggcgttcgaggagcacaaggtccgcaaccggctgaccgtcgtctccgacggcgcggaggcgctggcctacctgcgtcgcgagggacagttcgcggaggcggtccgccccgacctgatcctgctcgacctgaacctgccgaggcgcgacggccgcgaggtgctcgaggagatcaagaacgacgacgatctgggccggatcccggtcgtagtgctgaccacctcctccgccgacgaggacatcctgcgcagttaccagctgcacgcgaacgcgtatgtgaccaagcccgtcgacttcgaacggttcatcgcggtgatccgccagatcgacgagttcttcgtcagcgtcgtgaagctgccgccccgtgcttga

SEQ ID NO: 2345 - DNA, 1593 bp, Actinoplanes utahensis
atgaacgtacgcacctggtccctgcgcggccggatcgtcgcgctgtgtgcggtcgtcggcctgatcctgaccgctctggggatcttcgccgcgaccaccgcggccacccacaaccgtcagctcgacgacgtgctgaaccgggtgagcccgatgcgggcggccagcgagacgctgggcaccgcgctggtcgaccaggagaccgggatccgcggcttcgcgatcaccgggcgggacgccagtctcgagccctaccgtcagggtctggtggagcagaacacccaggtcagccggatcgatggcttcctgcgtcccgatgacggccagatccgcgcggacctggccgcggtgcgcgcgcggatcgacgactggcaccgcgacgtcgccgagccggtgatcgcgaccgtgcgcgaccagggggccgccgccgggcaggccaaggtggaggccggggacacccggcagttcgacgcggtgcgtgacgcgctgagcgtgatgcagacgcacatccagacgctgcgggcgcacagcgcggccgccgccaaggagtccagtcacaccatggtggccatcgagatcgccgccgcggcgatcgtcgtgctcgccgggatcttcctgctgctcctgctcgaccggctgatcagccggccgatcctggagctggccggccaggtgcgcgacgtggcggccggcgattatgaacggcacatcgagagctcggtcggcgcgcccgagctggtcggcctggccgcggacatcgaccggatgcgccagcagatcgccaccgaactgaccgaggtgcgcgacgcccgccagcaggtcgagtgggtcaaccagcagttgcagagccaggccgaggagctgacccggtcgaaccgggacctggagcagttcgcctacgtcgcctcgcacgacctgcaggagccgctgcgcaaggtggccagcttctgccagctgctgcagcggcggtacgccggcaagctcgacgaccgcgccgaccagtacatcggtttcgcggtggacggcgcgcaacgcatgcagcggctgatcaacgacctgctggcgttctcccggatcggccggctcaccagcggcttcaccgacgtcgacctggaccgggtgctcggcgacgtgaaatcgcagctggacgcccgggccggcgaggacggtgagatcacctggggtcggatgcccactgtggagggtgaggagccgctgctcaccacgctgttcgtcaacctgatcggcaactcgctgaagttccggcggccggatgtggcaccgcgggtgcgggtcaccgccgaacgcgacggcagcgagtggaagttcaacgtgcgggacaacggcatcggcatcgaggccgagttcgccgacaaggtgttcgtgatcttccagcggctgcacgcccgggacgcttacgagggcaccggtatcggactggcgatcgtcaagaagatcgtcgaataccatggcggacggatctggctggatgtggacgtgtctccgggcgcgtcgatctggttcacgctcccggcgctgatcggcctggatgagcccggcgaggagcacgaggagcgagaggcggtgggggtgtga

SEQ ID NO: 2346 - DNA, 1341 bp, Actinoplanes utahensis
atgtgcgccgggtggccgcggccggcgatggcaacgctcccagcgggccggcgtgaggacaggtcacgaggtggtgaccgatgttgtgccgccgcgccgggtggtacacgatttccgggtcagctctgcgtcgagtcgggattgggaatgatggaacggtcgttcgcaccccgcgcgcacgcgctcgcgcagatggagcggctgcggatcctgctcgtcgaggacgacgagggcgacgccttcctcgtccgtgagctgctcagcgaggccgaggccccgttcgagctgaccgtggccagcagcctccggcaggcgcgcggcctggtcgccgacgccgactgtgtgctgctcgacctcggcctgcccgacgcggagggcatcgacgggctgcgcaaactgctggccgtcgccggcaacgccgcggtctgcgtgctcaccggccgctccgacgagcacctgggtgtccaggcggtggccgagggagcccaggactacctggtcaagggccaggtcgacggggtctggctggtccgcgccctgcggtacgcggtggagcgcaagcgcgccgacgagaacgcccgccggctgcgcgaggtcgagctgcggcaggaggagtcggcccggctggaacgcggtctgctgccccagccgctgatgcagaccaccgaggtgacggtcgagaccttctaccgctccgggcgggcggccgggctgctcggtggcgacttcttcgacgtggtgcagaccggcggcaagctgcacgtgatcgtcggcgacgtctgcggccacggggtggacgaggcggcgctcggcgtcgagctccgggtcgcctggcgggcgctggtgctggccggggtgcccgaggagcaggtgctggcctcgctggagcaggtgctgatgagcgaacggcgggcgcgggaggtgttcgccacggtcgcctccgccaccatcgacctggccgccaaccgggcgaccgtgcggctcgccggccatccgccgccggtggtgctcaccgacggccgggccgggccggtgcacgcgcgtaccgggatcgtgctcggggtacgtcccaccccgacacccgcaaccgagctggagttcaccggcgatgactggtccctgttgatgtacaccgacggcctgatcgaggggcacaccgggcccggcaacgagcgcctcgacgtcgacgggctgtgcaagctgctggacgagccggccgcgcgcgaggtgccgctgagcgacctgccggcctggctggtcgggcgtgccgaccaggacaacggcggcccgctgaccgacgacgtggcgatgctgctgatctcgcgaggcggtgggcgatga

SEQ ID NO: 2347 - DNA, 357 bp, Actinoplanes utahensis
gtgactgcctcgttcgacccggccgccgtcatcgcggagttcatcgacgcggtggccccctacgacccacaaccggaggtcccgccggtggcgctgctcggcctgcgcaccgcgctcggtgaccagactttcgccctgagtgaccacgtcatccgggcgatgtgccgtgctctggagtcctatcgcgaccccgaggaccgcggtgaatgcgtcgagtgtggcggtcgccacctcgacgagaacctgcactgccgggactgcggacggctgcacggcatcctcggacaggtgatcgccgagcatgtgcgccgggtggccgcggccggcgatggcaacgctcccagcgggccggcgtga

SEQ ID NO: 2348 - DNA, 2370 bp, Actinoplanes utahensis
atgtcacccatgcgtgacgccgctctcctccggccggctcggcgcggcttcgccgccctggccgtcctcgccgtgctggccctcgggggcttcgccgcggttcgctccatcctgccaccggcggcggctccggcctcggcgccgggcggcgagttcagcgcggaaagagcatttcagagcgtgcgtacgatcgcagccgccccgcatccggccggttccgcggcgaacgacacggtccgcgaccacctcctgcggaccctgcgcggcctcggcctcagtccgcaggtgcaggacaccgtcaccgcgcagggcggtgagctgtcggccagcgcgggcggcaccggcctggcccgggtccgcaacgtggtcacgctgatcccgggcagcgcctcgaccggacgggtgttcctggtggcgcactacgactcggcgcagaccggcccgggcggcaacgacgacgcggccggcaccgccagcctcctggagatcgcccgcgccctgaccacgggtccgaagctgcgcaacgacgtggtgctggtgatgaccgacgccgaggaggcctgcctgtgcggggccgaggcgttcgtccggcagaacccgttggccgccggcgggggcgtggtgatcaacctggaggcgcgcggcagctccggcccggccatcatgttcgagacctccgcgcggaacgcccggctggtcgacgcgtacgcgcacacgccggacccggtgggcacctcgttcgccgtcgagatctaccgcctgctgcccaacgacaccgacttcaccgcgttccgcgaggccggtttcaccgggctgaactcggcgtacatcgacggcgccgccgtgtaccacgcgcccaccgacctgcccgccgcgatggaccgggacagcctgcagcaccacggggcgaacgcgctggcgctgacccgcacgctgggcgacaccgaccggctggccgccgccacccgggccggcggcgacgccacctacttcccggccctcggcctgctggtgcgctacccgggcggtctggtctggccgctggccggcctcgccgtgctggcggtcgccgcgctggcctggcgggcccgccggacgggccggctgaccggccggcggctggccctggccgggctgctcaccctggcgccgatcgtggtcgcgccggttctggcacagctcttctggaccgtgctgaccctgatccgcccggagtacggcgcgctgccgatcgacccgtaccgacccggtctgtaccggatcgcggtgatcgcgatcgccgcggcggtggtgttctgctggttcgccctgctccgccgccggctgggcgcggccgcgctggccgtcgccgggctgggctggctggccggactgggcgtggtgctggccgcggtcaccccgggcggcgcctatctggccaccctgccggcgctggccggtgcgctcaccggactgctcaccccgcacgtccgaccgtgggccggcgccgcggtgagcactctgagcgggctggtcgccgtcgtcatcctgctgcccaccgtggtcatgctgttcccggcgctcggcatggcgatgggcgcggccggcgcgttcctgaccgtgctgatgctgctcgccctgctgccggtgatcgacctgatccacccgtcggcggagccggtccagggcctgccggccggccgggctcgccgccgcggcgcgctggccaccctggtcgcctcgctcaccgcgctcgcctgcacggcggccggcctggcggtcgaccggttcgacgccgcccacccgtcactcacccagctgatgtacgcgctggacaccgacaccggccgggcgcagtggctcagcgccgaggcgaagacccaggactggaccgcgcagtacgtgtcgggtgccccgaaagcggtggccaccacgctgcccgcgttcggcgccgaggaactgcggaccggcccggccccggcggccagcctgccggcgccggccctcaccgtggagtcggacaccccgtccccggacggtggccgggtcctcaagctgctcctgaaaccgcagcgcacggtccgtttcaccaccctgcacgtggccgcggcccatcaggtgacggcggcgaccgtcgccggtcagcaggtcccggtcggcagggcggcgggcggcggctggggcttcggcttcatcttccacgcgccaccggccgagggcgtcgaggtggtcctgaccgtgcgcggcaccggcccggtcaagctgcgcgccatggacgccagcgacaacgtcaccgagatgcccggcttccacgcccgcccgtccggcgtcggcgtcctcggctcgcacagcagcgagatggtggcggtcgccaagacctaccagttctga

SEQ ID NO: 2349 - DNA, 285 bp, Actinoplanes utahensis
atgaagctgaagctcgacctgcacgacatcttcaacaaggggcacgagatcgaccgggctctgcgcgggatcgtcgacgaggcgatccagaagaaggcggccctcgtcgagatcattccgggcaagggctccggagcgctgaagaagaaggtcctgcgcttcctcgaccagaaggagatcaagcagctctaccaccgggtcgagaaggacggcgacaactggggccgcctgttcatccacttccggcacgacgccccgaccggccgccgcggccggggcaggtag

SEQ ID NO: 2350 - DNA, 372 bp, Actinoplanes utahensis
gtggatcttctcgaggagtaccgcagagccaatttcttcttcgagtccggtgacccgctgggtgcgtcccgcctgctcgaaccgatcgtcgaggcggagccgcagaacaccgcggtccgtcagctgctggcccgggcatacttcaactcggcccagttgaacggcgcggaaacccagctcagggcactgatcgagcatgatccgtcggatcattatgcgcaccacgtgctcggccggaccctggaacgggccggccgtttccgtgaggcgctaccgcacctgcggctggcggccgcgatgaagcagcagccggattatcaggacgcgctgcgccgggtggagacctggctcggcaagaacgaaccggcataa

SEQ ID NO: 2351 - DNA, 732 bp, Actinoplanes utahensis
atggcgaacgcagactccagcaccgaactccggcggcccgacggaaccccggtgcgggtcctcgtggtggacgacgagccgacgctggccgagctcctgtcgatggccctgcgctacgagggctgggaggtcaagagcgccgctgacgggctcagcgcggtgcggaccgcccgtgacttccggccggacgccgtcatcctggacatgatgctgcccgacatcgacggcctggaggtgctgcgccggctccggggcgagacccccgaggtgccggtgctgttcctgaccgccaaggactcggtcgaggaccggatcaccgggttgaccgcgggcggcgacgactacgtcaccaagccgttcagcctcgaagaggtggtggcccggctgcgcgggctgatgcgccggatggggcacgccccgatgcgcaccgagtcgcagctgatcgtcggcgacctgacgctggacgaggactcgcacgaggtgcgtcgcggcggtgccctgatcaccctgaccgccaccgagttcgagctgctgcgctatctgatgcgcaacccgcgccgggtgctgagcaagccgcagatcctggaccgggtctggaactacgacttcggcgggcaggcgaacgtcgtcgagctctacatctcgtacctgcggaagaagatcgacgccggccgcacgccgatgatccacaccatgcgcggcgccgggtacgtcctcaagccggccgactga

SEQ ID NO: 2352 - DNA, 1626 bp, Actinoplanes utahensis
atggccgccgccgtcacggcccgcccccgcccagcccgctggcgcagcccggcgggctggccgctgcgtacccgcctggtcgccaccatgatcgccctgctcgcggtcctcggcctggtcgtcggcggcaccgccgagctctacgtctacaagacgctgcacgaccaggccgtcaaggatctccaggaggcgagcaaacggctcggcgtcggctttgactgccccgatccggccgatcccggccatgctggccagagatcgtgccctccgctgccctccggccccgacggcccgagccaggccggctccaaccccctcgccgaccgccgaatgttcaacggcatacagcgcgaccccatcgtgctctggatgttggccgacggaacgctgtccggcgggatcgtccacttcgccgacaacttcgggctgaaaaccgacccgctctccgccacggcgctggccaccgtgcataacaaggtcaccggcagccgcagcgtcgaggtgaacgtgggcagcgacctgccgcgttatctgatgacaaaacaaaccacgcgaagcggtgatcggacgtactacgtcggagtatcgctgaagaacatggatgccacgctgctcgcggtagccgggttcaccgggtgtgtggtgctcggggcgctgctcatcgcgggctgggccggggcgctgatcgtacgtcgtaccctccagcccctcgaccgagtggccgcgaccgcgagccgcgtcgcggaattgcgcctcgatcgcggcgcggtgcaactcgcgcagcgagtgcccgagtccgacaccgatccgcggaccgaggtcggccaggtcggcgccgccctgaaccggatgctcgaccacgtcggcagcgccctggaggcccggcacgcgagcgagatgcaggtgcgccagttcgtcgcggatgcgagtcacgagctgcgcaccccgctcgccgcgatccgcggttacgccgagctgacccggcgcagccgccagccgattcccgacgaggtggcgcacgtgctgggccgggtcgagtcggaggcgaagcggatgaccaccctggtcgaggatctgctgctgctggcccggctggacgccggccgcccgctggcgcaggatccggtcgatctgaccatgctggccgtggacgcgaccagtgacgcgcacgccgccggcccgcggcactactggcagctggacctgccggacgagccggtcacggtgatcggcgacggcgcacggctgcaccaggtgctggcgaatctgctggccaacgcccgtacgcacaccccggagggttcgaccgtcacggtgaaggtcgacacggtgccggacgccgccgtgctgcaggtgatcgacaacgggccggggatccaggccgagctggtgccgcacatcttcgagcggttcgcccgcggggacagctcccgttcgcgggcggccggcagcaccggtctcgggttgtcgatcgtgcacgccgtggtgacctcgcacggcggcaaggtcggtgtgcagagccgccccggccagacgatcttcacggtgatgctgccgtccgccccggcctcgccggtcgtcccatcagctgaacatcacacgccatatctgccgagggtcggctga

SEQ ID NO: 2353 - DNA, 1065 bp, Actinoplanes utahensis
atgaccgcccctgaggtgcagcgtgtccgcgaccagcgcatcgagaagatcgtcccgctgatgagcccggcgctgctgcaccacgagctgccgctgacgaccgagttgcacgacaccgtgctggccggccgcaagcaggtcgaggatgtgctgaacggccgagatcagcgcctgctggtcgtggtcgggccgtgttcggtgcacgacccggccgccgccggcgagtacgccgaccggctgcaggccgaggccgagcgcctgaaggacgacctgctgatcgtgatgcgggtgtacttcgagaagccgcgctccacggtcggctggaagggtctgatcatggatccggcgctggacggttccggcgacgtcggcgccggcctgcggatcgcccgcaagctgctcctggaggtggtcagccggggtcttccggtggccgtcgagttcctcgacccgatcaccccgcagtacatcgccgacaccgtggcttggggcgcgatcggggcccggaccgtcgagtcgcaggtgcaccggcagctgtcgtccggcctgtcgatgccgatcgggatgaagaaccgcccggacggcagcgtgtccaccgcggtggacgcgatccacgccgccgcggcccagcacgtgttcccggggatcgactactcgggcaccccggcgatcctgcacaccaccggcaacccggactgtcacctggtgctgcgcggtggcggcggcaagccgaactacagcgcgcaggacgtggaggcgtcgctggcgctgctgcgcaaggccggactgccggagcgcctggtgatcgactgttcgcacggcaacagcaacaaggaccacaaccggcagccgctggtggccgaggacatcgccgggcagatggaggcggggcagcacgcgatcagcggcgtgatgctggagagtttcctggtcccgggccggcaggagttgggcgccgagatgacgtacgggcagtcggtcaccgacgcgtgcatgggctgggacggcacggtggcggtgctggagcggctggccgcggcgtcggccaagcgccgcaccctctga

SEQ ID NO: 2354 - DNA, 2046 bp, Actinoplanes utahensis
atgatcacgacgacgccggcacctgtcgaagccgccgcgcccgcacccccggacccgaacccccgatgggttcgtccggccgtcatcgcgttgctcgtcggcaccgcggtgctctacctctggggtctacgcgcctcgggctgggcgaacgcgttctactcggccgcggtccaggccggctcggccagctggaaggcctttttctacggctcgtcggacgcggccaactcgatcaccgtcgacaagacgcccgcttcactctggatcatggcgctttcggtacgggtgttcgggctgagctcgtggagcatcctggtgccgcaggccctgctgggggtggccggcaccggtctgctcttcgccaccgtccgccgcgcgttcggaccggtggccggcctgatcgccggagcggtcgccgcgctcaccccggtcgccgtgctgatgttccggttcaacaatccggacgcgctgctcgtgctgctgatggtcgccggggcgtacgccacgctgcgcgccgtcgagagcggctccaccaggtggatcgtgctggccggggtgttcgtcggcttcggtttcctcaccaagatgctgcaggccctgctcgtcgtcccggcgtacggcctggcatatctgatcgccggcccgccgaagctgctcaagcggatctggcagctgctgctctcgctcggcgcgctgatcgtctcggccggctggtacctcgccatcgtcgaactggtgccggccgccgaccgcccgttcatcggcggctcgcagaacaacagcctgctcgaactcaccctcggctacaacggcctgggccggctcaacggggcggagaccggcagcgtcggcggtgggggcaggggcggcaacggcggcagcatgtggggccaggccggctggacccggatgttcgacagcgcgcagggcggtcagatctcctggctgctgccggccgcgctgatcgtgctggccgccggcctggtgatcacgctgcgccggacccgggccgacctgcagcgcgccgggctgatcctgtggggctcgtggctgctgatcaccggactgatcttcagcttcatgcagggcatcttccacgcgtactacacggtggcgctggccccggcggtcggcgcggtggtcgcgatgggcgtgaccctgctctggcggcaccgggccaacctcgtcgcggcgctcaccctcggtgcggcgatcgcggtgaccgcctggtggtcgtggaagctgctcggccgcagcgccgacttcctgccctggcttcgcctgccggtcctgatcctgggcatcggcgcggcggtcgcggtggtcgccgccttccggctgccgcgccggatcgccctggtaggcgcggtggtcgcgctggtcacggccctggccgggccggcggcgtacgcggtgcagaccgcctcccaggcacacagcgggtcgatcccgtcggccgggccggcggtcgccggcggattcggtggtcccggcggcgggggccgcggcggcttcccgggcggcggtcgcgccggaaatccgcccggcggcttccccggcggcggcttccccggcggcggcttccccggcggcgggtctcccgggggcaacaaccaggcgggcggcggtacgacggatggtggcggccgcggtgggcgcgtgggcggcggcgggggcatgggtggtctgctcgacgcgacctcggtcagctccgagatgaaggcgctgctggaacaggacgcggacaggtacacgtgggtggccgcggcgatcggctcgcagaacgcctccggttatcagctcgccaccgagaagccggtgatggccgtcggcggcttcaacggcaccgacccctcccccaccctcgcccagttcaaggcgtacgtggcggccgggaggatccattacttcatcggcggccgcggcttcgacggcggcgggtcgggcagcagcgacagcagccggatcgccgagtgggtggcgtcgacgttcaccgcgaaaacggtcggcagcaccacggtgtacgacctcaccgtgacttcctga

SEQ ID NO: 2355 - DNA, 1230 bp, Actinoplanes utahensis
atgagcctttcgacgctgccctcccaggacgccggttcggcccgcgtcaccgccccggtgctcgacgtggtcgtgccggtctacaacgaggaggtcgacctcgaaccctgtgtccggcggctgcacgcctacctcgcggcgcacttcccgtaccggttccggatcaccgtggccgacaacgccagcatcgacggcaccgcggccgtggcgcagcgactgaaggcggaattccccgaggtcgaggcggtgcacctgacccagaagggtcgcggtcgggcactcaaccacgtctggacgcactcggatgcggccgtgctcgcctacatggacgtcgacctgtcgaccgacctcggtgcgctgctgcccctggtggcgccgctcatctccggccactccgacctggcgatcggatcccggctggcccgcggctcgcgcgtggtccggggcgcgaaacgcgagttcatctcccgcagttacaacctcattctgcgtacgacgatggccgcccgtttctccgacgcgcaatgcggattcaaggcgatccgctccgacgtggcccggcgactgcttccgatggtggaggacaccggctggttcttcgacaccgagatgctcgtcctcgccgagcgttccgggctgcgcatccacgaggtgccggtcgactggatcgacgacccggacagccgggtcgacatcgtcgccaccgcgatcgccgacctgaaaggcatcgtccggatcacccgcgccctgagcaccggccgactcccggtcgcggcgctgcgcgaacagctgggccgcaacccgctgccggtcgacggcgtgcccaccggcctgaccggccagctgatccggttcgccgcggtcggggtggcgagcacgctggcctacctggcgctgtacgcgctgctgcgggtcggcgtcgggccgcaggccgccaacctgatcgccctgctggtcaccgcggtcgcgaacacggcggcgaaccgccggctgacgttcggggtgagcggcacggacggcgccctccgccaccaggcgcagggactggtcgtcttcgccgtcggcctcggcctgaccagcggctccctggccctgctggacgcggcggcggcgcagccgtcgcggttcgtcgagctgaccgtcctggtgctggcgaacctgatcgccacggcggttcgcttcctgatgctgcgcgtctgggtcttccgcacctcgcgagaccgcacctga

SEQ ID NO: 2356 - DNA, 282 bp, Actinoplanes utahensis
atgctcagcaaagaggacagccgacggctggcacagctggagcgtcagctccggcgcgacgaccctgacttctgcgcccggatgggcggcggcaatttcagcgtcccgaccccccgcccaccgttgaccctcttcttcgtcgccgccgcgatagccgtcgccgcgatcgtcctgggcatcctcggctggtggatcgccgccacactcgtcgccacctggggcctagccaccgcagccgccgccacctaccgcctgcgccggttccgcacccgcaccccatag

SEQ ID NO: 2357 - DNA, 588 bp, Actinoplanes utahensis
gtgggcacgatcgggtttctgcatacagcggacgtgcatgtggcgacgttccgggcgctggtgggcgaggtggcgccgggatggcgtgatcggcatgtggtggatccgggtctcctggccgatgcgcgggctggactccccgtggaggagggggtgcgggcgcggttggccgagttggcgggctgcgacgtgatcgtctgcacctgctcgaccatcggcccggaagcggaacgggccggcgtactgcgcggggaccgcccgatggcccaggcggcggttgccgtcggaggccggatagcggtcgcctacgccgtcgagtccacccgggaaccgaccaccgcactactgctcgacgcggaccccgcggccgatctgctgctggttccctgtctggcggcctgggagtacttcgaatccggtgatctgccggcctactaccggggcatcgctgaccagctgcgggatgtcgaggccgacgtggtcgttctggcgcagccgagcatggcaccggccgctgaccttctgcccggccgttcggtgctctccagccctcgggcggcggttgtcgccgctgttcgcggtcgctga

SEQ ID NO: 2358 - DNA, 1254 bp, Actinoplanes utahensis
atgctcaaggtggatcgcgcgcaggtgatggcctaccgcctcgccgcgctggggctgtccgcccgcggtgccatccggcccgccgacctgcccgtcctcgacctgggagtgcaggattacacccccggctccacccgggtggcactggccgcgcgcacccgggtcgccctcgacgacgatcggctgctcaccgtctgggccgcgcgcggcgccccgcacctgcaccgggccgtcgacctgccccggctgaccgcgcagctctggccgctcagccacgccgacgcggccgcccggatcaacagcaaccagatcccggccgccgcccgcctcggcatcgaggccttccgggtcaccgcggcggcgatgcgcgaggtcgtccgcgccccgatgccgcggggtgaggccagcacccgggtcagcgcccgggtgccggcggagctgaccttcgagtgcaagacctgccgggcccggcacatctcgggcaacgtgtggcagcagagcgggcttgccggcggggtgcaggtgctctcccgcggcagagacgccatgctcggcccgctgcccgacgcgggtcttccgctgtcggacgcgggtcttccgctgtccggtgcgggtcttccgctttccgacgccggccttccgctgcccgacgttgctttgccgctggccggcgccggccttgcgctctccgatgccggccggggagccggcgcgctgcctggcgcggcgctcccggcttctgatgccggtcgcgggatcggcgcgctgatcacgacttatctgcggtttctcggcccggcgggcccgtccgaggtggcgagatacctgtcgactacgaccgaggagatccgctcggtctggccggacggcctggtcgaggtcgacgtcgccgggcgccgggcctggcttcccgaggttgacgtgccggcgctggggtcgcccccgacaccggccggggtgcggctgctgccggcgatggatccgctgctgcaggcccgtgaccgggatctgctggtgcccgaccgggagcggcagaaggaggtgtggcgggcgctgggcaacccgggcgtgctgttgctggatggcgagatcgccggggtgtggcgaccgcggatgtccggccggagacgcgtcgatctcaccgtcagcccgttccggccgttgactgccacccagcgcgagcggatcgagggggaggcggccgaagtggcacgcgcccgcgacgtcccgtcggcgaccaccgccttcgactga

SEQ ID NO: 2359 - DNA, 627 bp, Actinoplanes utahensis
atgggcaggattcgaagtgtgaccgccagtccgctgccgcacccgctgacgttggcgggcaacggcatcgtgctgcgcgaatggagtcccgacgacctggccgacctggtcgggttgctcgacgagccggacatcgcccgatggacgccgatgccgtccccgttcgacgtcgacgccggcatcgcatacctgaaacgcgcccggcagggacggctgaccggccgacggatccagctcgcgatcaccgcggacggtgggccacccctcggcgaggtgctgctcttcggcgtcgacccggccctgcgcgaagctgaactcggctacctggtcggcgcccgcttccgccggcgcgggctggccgccgccgccctgtccctgctcaccgactacgcctgcgggacgctgcggctgaacaggctgctgctgcggatcgacccggacaacaccgcgagcaccgcggtcgcccggcgctgcggctaccggctgaccggcgagccacccatcccgcaggaggggccgtacgggccgacgagcctggacacctgggaatacgtccgcgggctgcccggcacccgccgcgagggcctgagaaatgtcgcatcccggcggtacggtcgtcgcacctga

SEQ ID NO: 2360 - DNA, 591 bp, Actinoplanes utahensis
atgcctgatccggtgaacacccctgagcattggacggaatacaacgcccaccagggtgaccgggcggtccgggacacctgccggatcgccatggacctggccggtccgggcgccggccgcaccgccgtcgatctgggctgcggggccggcatcgagacgcgcgcactgctcgacgccgggtggcgggtcagcgcctacgacagcgagccggccatgctggccggcctcgaccatccgtggctgaccgcgcaccggctccgcttcgaggcgatcggggcgctgccgccggccgacctggtctacgccggttatgcgctgccctggcagacccgcgggtccttcgatcgcttgtggacgctgatccggacggcggtgcgcccgggcggccggatcgccgtcgacctcttcggtgtccgggatgcctggtccggcaacccggcgatgaccttcctgaccgccgccgaggcccgctcgctcgccgacggcctggtcatcgaccactggcacgaacaggacgagaccgcgccggcctaccgcggcccgaagcactggcacgttttcaccctggtcgcccaccggccggagaactga

SEQ ID NO: 2361 - DNA, 1371 bp, Actinoplanes utahensis
atggttagagcccggtccgcagtgggtaaagagaatccgctgacgctgatttcggctgccagccacggttttccgggctttgttaccggcgggtgtacccaccgcccggcccggggtgcacaatctccgaccatgagcgatcgttcacgcgactacgaggtcatcgtctacggtgcgaccggattcgtcggcgcgctggtggcgcgtcacctcgccgggcacgcaccggccggcacccggatcgcgctggccgggcgctcaccggcgaagctggaagcggtgaaaaccaggctcggcgtcgactggccgatcgtggtggccgacgccggcgaccccgacgcgatggccaccctggccggccgggcccacgtcatcatcaccaccgtcggcccgtatgcgaagtacggccgggctctcgcgcacgcctgcgccgcggcgggtaccgactacgtcgacctgaccggtgaggtgctgttcgcccgcgacagcatcgacgagaaccacgaactcgcccgcggcaccggtgcgcggatcgtgcactcctgcggcttcgactccattccgtccgacatcggcgtgcacgtcctgcaccagcaggtcgtcgcggacggcgccggcgaactaaccgacaccacactggtcgtcaccagcatgcacggcggggtcagcggcggcaccatcgattcgatgcgcaaccaggtcgacgtgatgaaaaaggatccgtcactgcggcgcgtcgccggcagcccgtactcgctcagccccgaccggcaggccgagcccaaactgggccggcagagtgacatggacaccatcccggcctccgaagtggacccgaaactccgcgggcggctggcacccttcgtgatggcctcctacaacacccgggtggtgcgacggagcaacgcgttgcggggttgggcgtacggccgcgccttcaaatatcgcgaagcgatgagcgtcggggcgtcgccgctctccccggtcctggcggccggcatcaagctcggcctgggcgcgctgatcgtcgggctcgcggtgccgcccacgcgatacctgctcgaccggatcctgcccaaacccggcgacgggccgggcgagaagacgcagcaggacgggcacttcaccatggacatcttcacgaccacgacgaccggggcgcggtaccgggcgcgggtccgggccaagggcgaccccggatatgcggcgacagccgtgatgctgggcgagtcggcgctggcgctcgccctggaccgggatgcactgccggagagcgagggcggggtgctgacgcccgccaccggtatcggggatgcgctggtggcgcggctgcgggcggccgggatggagatcaccgcttacaagctctga

SEQ ID NO: 2362 - DNA, 843 bp, Actinoplanes utahensis
atggacgagcctcggggtgaagccgcacccgtgcggccgggctcctcggcccgaacccgacagctcacctcgcaggcgtggagggaaaacttcatgcttcacctgaaccagcgggttcgtcgtgtcctgtcccggcgagcccagtccccgcgtgccctgaaccggctcgcgcaggctccggccaccgccggactcgtcacggagagcaccgcaggacccggaaggcaccggcgcaccgaggtgcggcgggccagaatccatctcatcgcactcccgaacgcccgccccggtttcaagcgggctctcggcatcgccatcgccggcctggccggcacggtcggactgctcgccaccggggcctccccggccagcgcagccgccgcggacgtcaactgggacgcggtcgccaagtgcgagtcgagcggcaactggggcatcaacaccgggaacggctattacggcggcctgcagttcagccgcagcacctggcgggcacacggcggcacccggtacggctccaccgcgaacctcgcctccaagagtgagcagatcctgatcgccgagcgggtgctgcgccaccagggcatcggcgcctggcccacctgcggtcgccgcggcctcaccagggcacaccggacgacctcggtgagcccgtaccgcctggcgtcctacacaacgccgctgcgggcgagccacacctacgtggtgaggcgcggggacaccctgtcccggatcgcgagccgttaccacgtcaggggcggctggcgcgccctttaccgcaccaatgcgaagcggctgagcagcccgaaccgcctgtcggtggggcagcgcctggccatctag

SEQ ID NO: 2363 - DNA, 369 bp, Actinoplanes utahensis
atgacttcttccgagaaagccttccagcccgaggacctcacccggctcttcgtcgagcgggccaacgcgaaggatgccgagggcctcgccctgctctacgaggaggacgcggtgatggcctatccgcccggcagccagacggtcgggcgcgccgccatccagaagctgtgggcggagctgttgcccaagatgccgcggttcgagccggagccgccgctgcccacgctgatcagcggcgacctggccctcaccgcgaccccgccgaaagacggcgccggggcgagggcacaggtggtccgccgtcaggccgacggctcgtggctgcgggtcctcgaccacccggagatgcggcccggccagcaggcctag

SEQ ID NO: 2364 - DNA, 852 bp, Actinoplanes utahensis
atggatctgcgtcagctggagtacttcgtcgcggtcgccgagaccggcagcttcacccgcgccgcccagcgggtgcacatcacgcaatccggggtcagcgcccagatcaaggccctggagcacgagctcggcgccgagctgttcatccgcagcggccgcaccgcccggctcaccgacgccggctcggtggcgctgcgccacgcccgcgccgccctcgactccacgctcgacctgcgcgacgcgatcgacgaggtcaagggcctcatccggggccggctgacgatcggcatggtgatcggctgcgaggtggcgccgctgttcgacgcgctcgccgccttccatgccgagcaccccggcatcgagctggagctggccgaggccaactcggatcagttggtcgccggcgtccgcacgggcagtctggacgtggcgctggccgggctggccggcgttccgcccgagcatctggccacccgggtgctgatccgggaacggctcgtggccctggtgccacccaccagcgacctcgccgggagcccgggcgtgccgatcagcctgctgtcggcgtaccccgtgatctgcctcccggtggggaccggcatccgtgacgcgctggaccgcagcaccccggggcggtcggcggtcgcgctcgtcgcgacctcgccggacacggtcgccggtctgacccggcgcgggctgggtgtcgcggtgctcagcgagtcgatggcggccgcgcacccggatctgaccgccgtcccgatcgacggcgccgacgtcccggcgctgctcgcgctggtctggcaggagcgaccgaatccggcgctcaccgcgttcctgaagcatttcccctag

SEQ ID NO: 2365 - DNA, 4800 bp, Actinoplanes utahensis
atgcgtccatatctacgcagcgtgagtgccgctgcgagcccgcaggcgatccgagccttgggcgccgcggccctcgcgaccgcgctgggttttggtttctccgggccggcgttcgcggccgaagcccagatccccttcatcagcgagatccactacgacaacgccggctccgactcgggtgaggcggtcgagatcgaggcgccggtcgggttcgacctgagcggctggcagatcgtcctctacaacgggcacaccaacacgtcgtacgacaccaagacgttgtccggggccgttccggcggcgggtgtggtcgtgcagacctacccggcgaatggcgtcgagaatggaccggacgacggtgtcgccctggtcaagccggacggcacggtcgtcgagtttctgagctatgagggcacgctggtcccggtcgacggcccggccaccggcctgaccagcaccgacatcggggtcgcggagaccaccagcaccccggtcgggcagtcgctgcagaagatcgacggcaagtggaccggcccggccgcgaacacgttcggcgccctcaacaaagccggtggcaccgacccggacccggctccggccggttgcaccaccgcggtcaccaacaccatcgccgaggtgcagggcaccggcgcggcgtccccgctggccgggcagaaggtcaccgtcgagggcgtggtcaccgccgaccaccgcaccggtggcttcgccggcttctacctgcagaccgcgggcagcggcggcgccgatcgcccggtcgccgcgggtgccgcgtcggacgccgtcttcgtgcacggcggcaccgcggacatcaagatcggcgagcaggtccgggtgaccggcacggtcaccgagttcaactcgctcaccgagctgtcgtacaccgcgaagtccgacgtccaggtctgcgccaccgacgcgaccctgccgaccgcggtgccgctgaagctgccggccggcgacgcggtccgcgagtcggtcgagggcatgctggtcgcgccggtcggtgactacaccgcctcggacccgtactacctgaccacctacggcgaggtcgtgctggccgccggcgacaaggtcgccaaggtgccgaccgacgtggcgaaggcgggcagcgccgaggccgcggcggtcaaggcggagaaccgggaccgccggatcctgctggacgacggcaagaccaccaacctgtcggcgaacgggatcgccccgccgtacatcagcaaggagcagccgatccgggccggcgacaaggtcgcctcgttcggtccggtggtgctcgactacgcctacggtgactggctgctggagccgaccaccccggtgtccgcggacaccccggccgcgagccggaccaccttcgacgacagcaacccgcggaccgccaagccggcggccgtgggcggtgacatcaaggtggccagcttcaacgtgctgaactacttcgtccacttcggtggcgacgcgcgcggcgccaccgacgccgcgcagctggccaagcagcaggcgaagatcgtctcggcgatcagctcgctggacgccgacgtggtcgcgctgatggagatcgagaactcggtcaagttcgacgcgaacgacccgcagctggcgctgaagaccctggtcggcgcgctgaacgagaaggacggcgcgggcacctgggactacgtgcgcacgccggccgagctgccgggccccgagtcgcaggacgtcatcaccacggcgatcatcttcaagccggccaaggtcacgccgaagggcgcgtcccggtcggtgaacgacgagagcgtgtggtcgaacgcgcgggagccgatcgcgcagaccttccacgccggcagcatcgacttcaccgtggtggccaaccacctcaagtcgaagagcaccggggtgccgccgaccggcgacaacgtggacgccggcgacgggcagggcccgtacaacggggaccgcaagcgtcaggcggccgcggtcgtcaacttcgtcaagggtgtggagaaggacagcggcaccgacaaggtgatcctgctgggcgacttcaactcgtacacccaggaggacccgatgcaggtcctctacagcgcggggtacaccgacgtgcacagcgccaaggcgccggggaagaactcgtacgtcttcggcggcgagtccggctccctcgaccacgcgctgaccacgccgtcgctgaccgaccgggtcaccggcgtcgacatctggaacatcaactcggtcgagtcgtacggcttccagtacaacgggtacgcgccgttctacagccccgacccgtaccgggccagcgaccacgacccggtcgtgatcggcctggacaccagcgcgccgaagccgatcgacctgcagctgctcaccatcaacgacttccacgggcgcatcgaggccccgtcggcgggcgtcggtggcgcggcccagctggtcggcatggtcgacaagctgcgcaaggacaacccgaacacgctgtggacgtcggccggtgacaacatcggcgcctcgacgttcgtctcgtcgatcgacggcgacaacccgaccctggacgcgctgagcaccggtggcctggccgcctccgcggtcggcaaccacgagttcgacaagggcatcgccgacctgaccgggcacgtgcagagccgggccaagttcccgtacctgggcgcgaacgtctacgtcgacggcaagcgcgcgctcccggcctactcggtgcagaccgtgggcggggtccgggtcggctacatcggtgtggtcaccggcgagaccaagtcgctggtcagcccggacggcatcaagggcgtggagttccacgacccggtcgccgaggcgaaccaggtcgcggccgagctctccgacggcaacgaggccaacggggaggccgacgtggtcgtgctgctcacccacgagggcgccgcgaccgcgaacatctccagcgccgaggccctgcagaacgacccggtcttcggcccgttcaccaaggccggcccggacatcgacgtgatcttcagcggtcacacccaccagccgtacgcgttcgagatcccgatcccgggcaccgaccggctgcgtccggtgatccaggccgaggactacggcgtcaagctgggccgggcgaagctgacctacgacccggtcaccaggtcggtcaccgcgtcgaccgccgagctgctgccggtcaccggctacccggagaacgcggacgtcgccgcgatcgtgacggcggccaaggccaactccgcggagctcggcaagaaggtgctcggcaagatcaccggcgacatcaagcgggcggtctccagcaccgggtccgaggaccgcggcgccgagtcggacatgggcaagctcatcgccgacgtgcagctcgaccagaccagggacgccggtcgcggcggcgcgcagatcgccgtgatgaacccgggcgggctccgcaacgacctgctgtacggcgcggacggcacggtcacctacgcccaggcgtacgcggtgcagccgttcgcgaacgacgtggtcaccaagacgctgaccggcgcgcagctcaagacggcgctggagcagcagtggcagccggacaccgcgtcgcgtccggtcctctggctgggcgtctcgaagggcttcacctaccagtacgacccgaccctgccgaagggttcgcggatcatcgcctcgtcgatgaagctgaacggggtcaccatcgacccggccggctcgtaccgggtgacgatgaactcgttcctggcctccggtggcgacaacttcaccgtgctgggcgagaacaacccgagtcggaccaccaccggcgacaacgacctgaccatgctggtcaactacttcgcccagcactcgccggtcagcccggacccgaccccgcggtcggtgaagttcaccgacggcacggcgccgaccggggcgtacgcggtgaacgcggccgcgatctggaccgggcagacggtcaccctgacccagtcctcgctggccgacgacaagtccgccgccgcgaagatcaagcaggtggtcaactggggtgacggcagcgccgccgagaccctggaggccggcgccaagtccgccacgcacaagtacgcgacggcgggcagcttcaccatccaggtcacgatcaccgacgaggccggcaacgcggccaccgtcgccggcggcacggtcacggtcgccgcgcaggccggccagttcaagctggaccgcgcctcgatctggacgacccaggcggtcaccctgaccggcagtgtcgtcaccgccgactcggtcaacatcggttggggcgacgggaccaccggctcggcctcggccgacatcgcggtggcgcacgcgtacaccaaggccggtaaatacacggtcacggtgacgccggtgaacaagctcggtgccggcgccgccatccaggccggtgtcgtcacggtggccgacgacgtcttcgccccggcgcccagcctgctggtgccgaacccggcgaacgtcgccgagaagtggacgaacctgcacggcacggtcaccgaccaggggctcggcgtcgcgagcgtccgggtcaaggcggtcgagtaccgggtcgacggcaagtggtactactaccacgccggcgcctggtggaagtcggcgtccaaggagacggccatctcccgggccgacctgctcaccgccgccgtcagcggcaacctgtggtccgtgcgggtgcacggggtggccaccggcacgctgcggatcagctacagcgcggtggacagggcgggtaacacctcgcccggttacgtcgtgaaccagaagctgaccaggtaa

SEQ ID NO: 2366 - DNA, 552 bp, Actinoplanes utahensis
atgcggaacaccatgcgtgtgctcggcctcgccggcctgggagtgctgggcggcgccgtgctggcgaccgggccggccgccgcggcgcccagcactgcggcgaccggacactcccaggcgccggccaaggcgcagcgggacccgtggaacgacgacgaggtcgtggggtactaccggaccttctgggcgtgcgagcgggccggacaggtcggcgagcggttccgggcctgggacgaccacgcctgcgagcgggtgcggtggggggtccggcgcggagcgttcgcgctggtcgtcgaccagaacgactgggaccagcggtgggacagccggtggcggccgggaatctggccgagcaactggccgaaccggccgaactggcccgggcacggccggccggaccacgacggtccgggcggacacgacggtcccggcggacacgagggtccgggcggccccggcggacatgggggccccggcggacacgagggtccgggcggacacgacggtccgggtgcgggcggtcccggtgggcacgggggtctagctagctag

SEQ ID NO: 2367 - DNA, 1611 bp, Actinoplanes utahensis
atgctcaccgaccgcgccaccccgcagacagtgcggccggacgacgatccgctggccgatccgaactggcaggaacccgagcagcccggcgagagactgtcctggttccggttgctcttcctgatcctggcgctcggcgcggtcggcgccggcagcaccttcggcgcgatgcgcctcagggagaacgccggcacccgggccaagtcgtgggcggtgccgtacgtcgacgtgaccctcacgccgaccttcgaattccaggatccggacgccaacccggcgaacgacgtggccctcggcttcgtggtcgccgaccggaccgacggctgcgtgccgagctggggcggggcgtacacgctcgacgaggcggccgcctccctggaactcgaccggcggatcagccagctgcgcgcggccggcggcaacatcatggtgagcgtcggcggccagagcaacaccgaactcgcggtggcgtgcgccgaccaggcgcggctcaccgaggcgtaccgccaattggtgaagcgctaccagttggccaccctcgacctggatgtggaaggcgccgccctgggcgaccaggcgtcgctgaagcgccgcgccgcggcgctgaagacggtgcaggacgagcgcaaagccgccggtgacccgctcgccgtgtggctcaccgtgccggtctccccgtccggcctgaccgccgacgggctcgccgcggtccgcgccaccctcgacggcggcgtcgcactgcgcggtgtcaacgtgatgaccatggactacgggaccgggaacagcgcgaacccggacatgctcggtctcaccacgcaggccctcgacaacacccacaagcagctcaccgacctgtacctgcgactcggcgcgcaactcacctcggcacaggtgtggtcgcggatcggcgccaccccgatgatcgggcagaacgacgtcgacaccgaacggttcaccgtcgccgatgcccagggactcgccacgttcgcggtcgacaagggcctcggccgggtatccatgtggtcgctgaaccgggacgcacggtgcaagggcaccttcaccaacgtggtggtgcactccaacacctgcagcggtgtcgaccagcaggcgctggccttctccaaggtgttcgccgggctgcccggcacctcggtcggatcatccggccgggacgcggtggagatccccaaccggtcgtcggccatcgacgacccgacgaccagcccgtacccggtgtggcggctgaccgcgcagtacgtgggcggctacaaggtggtctggcacggcgtcgtctaccaggcgaagtgggccaactcgggagccgatccgtcggcggacgacacggcgggggcgccgaacccgtggtcggtggtggggccggtgaccacgggcgacaagcggccgacgccgacgccgaacgtgaccggcgtgacgaacgtgtggaatcccggcacgtcctaccatcgcggagatcgagtcacttacaacgatttgccgtacgaggcccggtggaccacccggggcgacgcaccgtcgaccgactacccggtcgacccggatgaggcatgggcgccgttgttcacggtgcccggggaaccggtggtgaactga

SEQ ID NO: 2368 - DNA, 3015 bp, Actinoplanes utahensis
atgcagcgcacctcggtggcccagccccggccggacgcccagcgccagtggggcgccgaccggcggtcggccccccatccggtggttccgccacccatttccgaggggcggatcgcccgcggccggctcgcgatcgtgctcaccatcgcggtctgggccggctatctcgcctacacgattttcgagcagttcatcgtcggccgggcgagcaccgcgcggctggcggtcgaggcgatcgtctacatgctggtgatcaccggtctcgccgcctcggcgatggcgtacctgatcacccggatcggcttcttctaccgcagtcgcgggcatcagcggtcgccgcggatcgtgctggacgcgttcctggccgagccgaagacgccgacggtcaccgtgctggtgccgtcgtaccaggaggacgagcgggtcgtccggaccacgctgctctccgccgcactgcaggagtacccgggtctgcgggtggtgctgctgatcgacgacccgcagcagccgaagacccggtcggcccgggatctgctgctgtccgcccggcggctgcccggcgcgatcgaggcggagctcgcggtgccgttcaaccgggcgcaggccgcgttcgagcagttcgagcaggcgctcgcggatcgcggccaacgggtcgggaccagcgacgacatgcgggcgctggccgccgagtaccgggccgcgaccggctggctgtacgggctggcgaaccggcaggagatggtcgaccacaccgacacgttcttcgtcgaccacatcctgaacgcgctggccgaggagttgtcgacgatcgccgaggcgctggagaccggcgccgaggagaacgccaccctgccggtggcccggttggtgcagctgtacagccggctgctggcgatcttcggcgtgtcgatgacgagcttcgagcgcaagcggtacgtgtcgctgtccggcgagccgaacaaggcgatgaacctgaacagctacatcggcctgatgggcggcagctaccaggaggtgcgtacgccgatggggctggcgctggtgccggccggaccgggtcgcgcccagttgaccgtgccgaatccggattatgtgctgaccctggacgcggacagtgtgctgctgccggattatgcgctgcgtctggtacacatgatggagcagggcgcgtcggcaggggtggcggtggcgcagacgccgtacagcgccttccccggggcggcgacccgggtggaacggatctccggggccaccaccgacattcagcacatcgtgcaccagggcatgacgcagtacgacgcgacgttctgggtgggggccaacgccgtactccgcaagaaggctctcgatgacatctgcgagacggcctacgagggcgattgggagatcaagcgctacatccaggaccgcacggtcatcgaggacaccgagtcgaccatcgacctcggggtgcacggctggacgttgtacaactacccggagcggctcgcgtacagcgcgacgccgccggatttcgggtcgctctgcattcagcggcagcgctgggccaatggcggcctgctgatcctgtcccggctgaaggaccagttcaaggcccgcaacaagcgggagcagaagaaccggttcggcgagctgttcctgcgggtgaactacatggcctccattttctggagttccgtgtgcctggtcgtgatgctggtctacccgttcaacaaggatctgctcaacccggtgctgctgctggtgtcggtgccgtatttcatgatgatggccggcgacctgaaggcgaacggctacaagcggctcgacgtgctgcgcatctacggcttcaacctgatcctgctgccggtgaacctgtccggtagcttcgcctcgctgctgcagttgctgaccggcgagaagagccagttcaaacggacgccgaaggtccgcaaccggaccaccgcggcgacgttctacctgctggcgccgctggccctgatcgcgctctgcgggtataccgtggtgcacgacgtccagcacaagctctggaacaacctggccttcgccggtttcaatctccttctctcgctgtacgcgatgatcgcgttcgtcggtctcggcaacaccctgatcgacctgttcgcccatctgcgtgcctggctgtaccgcccggtgaagccgaagaacaaggccacgggcacgccggtcagctcggttccggcccccgccgcgctcggcggcggcgcgatcggcgactgggcgtcggtgctgcactacggcggcgccgagcggggcggttccggaatggtcgcggtccggtccagccaggcgccggtcacccggggccgcaaggccagcgtgtcgcactcgttcgaggagttcaacttcttcaccgtgttccagccgatcttcgagctggagtccggcgacgtcgtcggctacgaggcgctgacccggttcgccgacggcagcaccccgcagctgagcctggccgcggcacaggaccagggcctgcacatcgacctggacgcggcactgatccgggccgcgctggcctcggcgaattcgctgccggccggcgcctggctggccgtcaacgtctcgaacgacctgttgcgccggccgcacgagctggcgccgctgctggacgaggcgaaccggccgctggtcctggagttccgcagcccggaggccggtgacctggagcggctgccggccggggcccggttcgcggtggacgacgcgggcgccgggttcgacacgctgtcccggatggagacgttacgaccggagatcctcaagctcggcccggccacgctggccggtatcgagacgtcggcggcccggcaggcggcgatccgcacgctggtggagttcgccgaggcgaacgactgcacggtgatcgccgagggcatcgagtcggccccgcagcgcgatgccctgcgggcctgcggcatccgcctggggcagggcttctacctgggcaagccggtgccggtggagcgggctctggcggacgccaccagccgctag

SEQ ID NO: 2369 - DNA, 633 bp, Actinoplanes utahensis
atgacagtgacgatcggacaggcggcgcaggtccgcacccgggtcaccgtgccgctggagttcccggacggctacgcgaccaccgcggaggtgttcaccttcaccggcctcgccgacggccgtgagcacctcgccctcggcctcggcgactggcggaacgcgacgaacccgctggtccgcccgcacagcgagtgcctcaccggcgatgtcttcggcagccagcgctgcgactgcggcccgcaactgcgggaggccgccgagcggatcaccgaggccggcggcatcctgctctacctgcgccaggagggtcgcggcatcggcctgtacgcgaaactcgacgcgtacgcgctgcaggacaccggcctcgacacctaccaggcgaacctggccctcggccacggtgaggacgagcgggactacacccccgccgcccagatgctgcacgccctgggcgccgaacggatccggctgctcagcaacaacccggacaaggccggccagctcgccgccctcggggtcgaggtgaccgagcagctgcctacgggcgtgcacctgtccccggcgaacgcccggtacctcgccgccaagcgggaccacaccgcgcacaccctcgacctgaccggtgccgcatga

SEQ ID NO: 2370 - DNA, 474 bp, Actinoplanes utahensis
atgacgcttcgcgacgcgaccgaggccgacctcttctggacccggtcggccatcgacctctcccggctctccccgccgtcgccgacccactacgcggtcggcgcggtcgtggtcggcccggccggcaacccgatggccaccggctacaccggcgagaccgacccgcacttccacgccgaggaggaggcgctggccaaactggccggccgcggcttcgacctgggcgccgccaccctctacacctcgctggagccgtgcaccgtccgcaagtcccggccggtctcctgcaccgagctgatcctggcgagcggcatccgccgggtcgtgctggcgctgcgcgaaccgctgcacttcgccgactgcaccggggtcgagacgctgctcggtcacggcgtgcaggtggtcgagatcgccgcgctgggcgaggcggtacgcgatatcaacgcccacgtcatggggatgcagacgacatga

SEQ ID NO: 2371 - DNA, 474 bp, Actinoplanes utahensis
atgacccaggatgccctcgcgaccgacacccgctggctcagcagccccgagatggccgcctggctcaacctcacccagctgctgatgctgctgcccagcgccctcgaccggcagctgcgcgacgacgcgggcatcccccacgcgtactaccagatcctggcgaacctcagcgccgcccccggccaccagatgcggatgaccgatctggcccgcatggtcggcaccaccaccagccgcctctcacacgcggtcaccagcctggaacagcgcggctggctgtgccgccgcgcctgcccgttcgacaagcgcggccagatcgcggcgctgaccgaggccggcatggcggtgctggaggcggcggctccgggccacgtcgccgaggtccgtcgtctgatcttcgaccacctctcggcgaccgaggtcgatcagctccgcgagatcaccggaaagatcctcccggccgccaccgcctga

SEQ ID NO: 2372 - DNA, 2694 bp, Actinoplanes utahensis
atgcgaaaaatcttggtcgccgcgatcgcggcgagcacgctgctgctgggcctgccgatgcccgcctcggcggatccgccgggcagcacggccgacgcgctgccccgcggatggtccctggagcaccggtcgctgacctggacgagcgatcgggccatccggaccggtgacgccgcggtcgagttctggtccggggatcggctgctgggacgggcccggggcacgcgtgacccgcacgcgttcacgctgcccggaaccccgcccggtgggttgaaggacctgcaggtcaaggtcggcggcaagcgggtggacgcggccgcgccggcttcggtgcagcgccgggcggcgggctcgccggtcatcccgccgatcctgccggccaacccggtcgacccgggagtgccggggccgtaccggaccacgaccggtgaataccagctgccgggggtgcacctctccacctacaaggccaaggtcgagatgcaggccgtcgtggtggcgccgaagggcgcgcccggcaagcggccgctcgcgctgttcctgcacggccggcactggacctgcttcgccggcaccgacgagaacgcgatcagcgccgactggccgtgcgccgccggctccgcgccggtgcccagttaccgcggctacctgcaggcgcagcaactgctggcctcgcagggctacgtcaccgtgtcgatctcggcgaacgggatcaacgcccaggacgacgcggacgccgacggcggcgcgcaggcgcgctcggcgctcgtccggatgcacctcgcacactgggccgactgggccggcagcggccgccgggctgcgcccgcgatcgttcgcgcggcgccgcccgccgacctgtcccaggtcctgctgatgggtcactcccggggcggcgagggggtcaaccgggccgcgctggacagcgtgaacccggcgccgggcgcgcacgacgactaccagggcaaggtgcgctggacgattcgcggcctgctgctgatcgggccgaccgcgttcgggcagaacccgcagcccgacgtgccgtcggcgacgatcctgccgggctgcgacggcgacgtctcggacctggaaggccagatgtacgtcgacgccacccgcgggctcagctccgggcgggcgctgcacagcgcgttgcacgtgaccggcgccaaccacaactacttcaacaccgagtggacgccggggcaggccgtcggacccgccttcgacgacttctccagcgagacgcccgacccgctgtgcaccccggggaccgccccggcgcggctcaccccgcagcaggagcagaccgtcggcgccacgtacatcgcgaccgccgcccgggtgttcctcggcggcgacgaccgggcccgcccgctgctcgacggctccggggtgcgcgcccgctcggccggcccggcccgggtgctgagccacgcgctcggcggcaaccgccgcccggtgatcgttccggacgcggcgctcaccgtccgcggcgcccggctgtgcgacgaggtcgccaccgacgccgccaagggctgcctggacaccgacacgatcgccggtgcctcgccgcacttcgtgccgttcgccgtcccggaacccggccgggtcgcggtcgcgctcaacggcaccgggaccgccacgttgcagccggccaagccgatgccggtggccggttcgcaggccctggccctgcggctgatcgtgccgccgaacgcgccggccacctcgttcgccgtcgcggtcaccgacgaccacggccggcgcaccgacctcggcccggccacggtcaccggcatgcccggcaccggcgtgaccacgtcgtactgggcccaggaggtgcggctgccgctcccgcggacggtcggcacggtggcccgggtggagatcaccgcgcgtggcaaccgcccggcgtggctgatcgacgcctggggctggcagcccggcacccccgccccgcgaccggccgcgctcgaccggatcgacgtcggcgacctgaccgtcgccgagggcgactccggcacccgcacgcacagcgtgccggtgcgggtgcgcggccggcaggcggccgacgtccggctgttcctgaccgaccccggcacgtcggagaccaagtcgtgggtggcccgggtcaagcccggcgacacccggatctcggtgccgatcaaggtcaccggtgacaccgtgtacaccggggaccggtcgtacccgctgaccgccaaggccgtccggaacgccgtggtcggcgactactccggtggggtccgggtgcgcgaggacgacccgatgcccaaggtcaccatcacgccggccgtggccaccgcgaccgagggctcgccgctgacctggacggtgcacctgtcgacggtcgccggcggtccggtgtacgtggagttcgtgacgcaggctccgccggccgggccggagctgtcgtcgaccgacgtcgacgcccgctggttcaccgaccagaccggtgaggacccgaagccgtcccggccgctgtccggcgccggcctgcagctgttcgtggcgatcgaaccggggaccacgtcgctcgcggtgacggtcccgacggtcgccgacggggtggccgagggcgccgagcacgtccgcttcaagacgcaggtctacccgtccgacttcggcgacccgatcccgctcggcgtgatcgacggcacggtcaccgactga

SEQ ID NO: 2373 - DNA, 984 bp, Actinoplanes utahensis
atgatcagccgaccgctttcgcgcctgctcgcgctggccacgctgctgctcggcaccctcgccggggtcgtcgcggccggcccgcccaccgaagccgccgtccgcccgccgcgcgtcctgcgcaacctggcctacgcccccgcgcagcccgccggcagccatggccacttgatcgacctctacctcccggcccagcccgctacgaccccgcgaccgcttctgatcgtgatgggtggcagcggctggttcgccgacgacggcaagggctacgccccggttctggtcccgtatttcaccgcacacggcttcgcggtggccggcgtctccacccgctccagctaccaggccaagttcccggcccaggtggaggacatccaggcggcgatccgctggctgcgcgccaacgcggcccgcttcgaagtcgaccgcgcccggatcgccgtcctcggcgactcgtccggcggctggaccgccctgtgggccggcttcaccgaccccggcgtccgcgcggtcgtcgacctgtacgccccgatcgacttcctggagatggacccgcaaatgctgcccggcgcgtgcgcgtcgttcaatcgcgccttccggctcgccgactgccacatcgacgcccggtcacccgagtcgtccctgctcggttgtgcgatcctgagctgcccggagcgggtggccgaggcgaacccgctgcaccggatcacccccgccgccccaccggtcctgatcatccacggcacccaggacgctctggtcccgctggaccagagcgacatgctcttcgacgccctgcaggccgcggccgtcccggcgacgtactacaccgtcccgggagtgggtcacaaccgcgacatcgtctccccacgggccgcccgagcccgggtccgccacaccaccccggcgctgaccccggacgcggcccgccccacctacgccaccatcgagaccttcctgcgcgccgccttccggacgggctag

SEQ ID NO: 2374 - DNA, 696 bp, Actinoplanes utahensis
atgccggggatccacccgtcgcgatggttgccgtggcgcgcggaaaggttgcccttggcgccggtttactgtttgcgcatgccgacgaaacgccgtgatgccgaggcgaaccgggaccggatcctgcgggccgcccaggagctgctgtcccggcaaccgacggcgagcatggatgacgtggcgcaggctgccggggtggtgcgccgcaccgtctacagccatttcccgacccgggaggcgctgctcgacggcctcgccgacaaggtgtccgggcatctgctgggcgcgctcggcggcaccgaccggtccgggctggagccggacgtcgcgttggccgatttcgcgttgaccgtgtgggcggtcggcgcggagtaccggttgctgatgacgctggccgaggccgatctgagcgccgcccggctgcacgagctgctcgccccgatccgggcgcagggcctggagctgctggttcgcgggcgggccggtggccggttcgccacccatctgccgcccgaactgctgaccctggcactgcaggggatgaccctgtcgatgatccaggcggtgaacgacggcgtgtggcacgacgacggcgtggccgcctcgacggcggtgctggtcgcggccgggttaccggtccaggcggcggagtcggccatcgcggcggcccgggacctgaaacttgcacacatctga

SEQ ID NO: 2375 - DNA, 2562 bp, Actinoplanes utahensis
gtgtcttccgctcttcaccgcctcgccgccgccgtcgtccgacaccgcggccgcaccctcgccggctggctgatcacgctggtcctgctggccggcggcggtctgctgatcagccgcggcaccgacgacgcgttcaccatccccggctccgagtcgcagcaggccctggacaccctgaagcgggtgttccccgaggtcagcggctcgtccgcgcagatcgtgatcaccggggtcgacccggcgacgatcaaaccggagatcaccgcggcggttcgccgggccgagcggctcgaccaggtggtcgccgtgatcagcccgttcgacgagcgcttccgggggaaccggaccgcccgggcggcgatcgtcacggtccagttcgacgtggcgttcatggacgtcaagccgtcgaccaaggccgcggtcgacgcgatcggcgcctcgatcccgcacgcgagcgtggtggtcggcggcgacgcgtacgcggaccgggtgcccaaaccgagcccggtcgaggggctcggtctcgccgtcgccctgatggtcctgctgatcactttcggctcgctggtcgcggccgggctgccgctgctcaccgcgatcctcggcgtcggcttgtcggtcggcctgctgtacggggtgacccgggtggtcaccgtgccgtcgaccgcggtcacgctggccatgatgctcgggctggccgtcggcatcgactacgcgctgttcatcctgtcccggcaccgggaccagctgcgcgacgggctgagcgtggccgagtcgatcgcccgggccgtcgccaccgccgggtccgcggtcgtcttcgccggcctgaccgtggtgatcgccctggtcgggctggtggtggcgggcataccgttcctcaccacgatggggttgtgcgcggcgctcgcggtggccatcgccgtactcatcgccatcaccctgatgcccgccctcctcgcgctggccggcgaccggatccgcccggccgcgaagccgcgtcagcggcagggacggatcttcgaacgctgggtcggcgcggtgacccggcacccggtgatcaccatcgtggtgctgctggccgggctcggcgcgctcaccctgcccgccggcgaactgcggctggcactgccggacggcgccagcgaggcgccgggaagtgtggcccgacggacgtacgacgtgatctccgccgagttcgggcccggctacaacggtccgctcctggtcaccgccgacatcatcgcctcgcacgacccggtcggcctgatgacgaagctgggcgccgagatctcccgggtgcccggcgtcgcgctggtcccgatcgccacccccaacccgagcgccgagatcggcatcgtgcaggtggtgccggccagcgcgccggactcaccggagaccgtcgcgctggtcgcccggctccgcgccctcgaaccacacttccggcaggagtacggcgtgggcaccgccgtcaccgggatcaccgcggtcggcgtcgacgtctcggcccggctcggcggcgccctggtgccgttcgggatcctcgtcgtcggcctgtccctgctgctgctgaccatggtgttccgctcggtcgcggtgccggtcaaggccaccgccggctacctgctctcggtcggcagcgcgttcggcgtcaccgccctggtcttccagcgcggctggctcgccaaccagctgaacgtcgcgcacaccggcagcgtgatcagcttcctgccgatcattctgatgggggtccttttcggactcgccatggattacgaagtcttcctggtctctcggatccgggaggagtacgtgcacaccggcgacgcccggcacgccatcgacgctggtttccgggcctccgcgccggtcgtggtcgccgccgcggcgatcatgttcgcggtcttcgcggccttcgtcccggagggcgccgccaccgtcaaacccatcgcgttgagcctggccgtgggcgtcttcgtggacgccttcctggtccgcatgacactggtgccggcggtcctggcactgctcggcgaccgcgcctggtggctgccggcccgcctcgaccgggccctgccctcgttcgacgtcgagggcgcaggcgtgacccgcgaactggccctcgccgactggccagaaccggacagcaccgacgtgatcgccgccgacgggctgcccttcctgccgcgccaggtccggatcggccccggcgaactcgtcgaagtggtcggcgacccgcacacgaccagcgcattcctgctcgccgtcggcggccggaccaccggcgtgtcgggccggatcaaaaccctcggccacgtgctgccgcaacgcgccggcagcgtacgcgcggtcgccgcgctgctgcgccgcccgtcgctgcgtgacatcaccgaggcggccgccgccggcccaccgctgctgctcatcgacggcttcgaacacctgccggaacgcgccctcgcgctggacgcgctgcgggccgccgccggccgcggcagcacggtgctggtgaccggtcgtgatcagcaccccgacatcaccgagaccattgaggtgtacgcatga

SEQ ID NO: 2376 - DNA, 1230 bp, Actinoplanes utahensis
atgagaacgctgccccgatgggccgccgcactgctcgtgccggtgctcgccaccaccgccctgctcgccgccttccaggacccggccggtcacctggagacggtgaccgcggccgtggtcaacggcgacgagccggtcaccgtgaacggcaggacggtgccgctcgggcgggaactcgcggcccgactcgtcgcgcacaccggcgacaactacacctgggtgctgaccggggcagacgacgccgcagccggcctgaacagcggaagataccgggtggcggtgaccatcccggcgaacttctcgcgcgccgcgacctccgtcggcaacgccgatcccgccacggcggaacgggcccgggtgtcggtgagctcatcgcgtaccgccgccggaatcgatccggtggtgagccgaaccttgaccggcgccgcggtcgccaccctcaaccagaccgtggtcgaaacgtacctggacaacgtctacctgggcttcaaccggatgcaccggcagctcggggatgccgcggacggcgccggcaaagtgtccgacggcgccacgcgggtcgccgacggcaaccggcaactggttgtcgggctgcggcagctcgcggccggcagcgacgccctggccgacggcaccgaccgcctcagcaccggcgcgtccaccctggccgacggcaccggcgagctccgcgacggcgcgaaccggctggccaccgggaccgggcagctcgcgaccggggccggccggctggcgagcggagccgggcaggtcgcggccggaaccggcaagctcgccgacggcctgggcacgctccgggacagcacgaagaacctgccgacgcagaccaggaaactcgcggacggcgcggaacaggtcgccgaaggcaaccggaaactcgccggcacggtggtcccgatcgccgaccagatcgtgaacgggatcgatcggctgcccgatctggacaagctggccgaccggtgcgagacacccgccgacgtgtgcgcccaacttcgcagagccgcggatgccttggcggccgccggcaatccggtggccgacctgcggaaccaggtggtcaccttccgggacgggatcagcgcgctcgccgacggatcgcagcgggtggcggacggcgccgaccagctcgccgaccggaccccggccctgaccggcgcgatcaatcaggcggccggcggcgccgcccgcctcgacaaggcgctagctagctag

SEQ ID NO: 2377 - DNA, 663 bp, Actinoplanes utahensis
gtgccgacctacaccgacgcggaacgggcccacctgcgagatgtcgcggccaccccgatcgaagccaccgaaaccgcggtcggcggcctgaccgccgggccgatcgtggtcctggtcctgtggctcggcgcgctggtcacgctgatcctcaccccggcggcccgccgcgacccgctgacctggcacggcccgacctggcgactggccgtgctcaacgcgcggccgctgctgcgatacgcggcggcgcaggcggtcgtggtcagcgcggccgccgaggcgttcctccgcctggccccgctgcgggtgatcgccctgctggcagtcgcggtgctgatcggggtggctttcatattggtgatccaggcgttgctgatcggcttccgcaccgccggccggctcgcggccatcctggtgccggtcctggcgttgaccacggcggtgatctccgcggtgccgggcgccctgacgacgacggcgagctatctgccgacgtacggcccgatcctggccgttcgcgccctgaccgctcacggcggggcggccgggaccgggctgatgctgaccgtggggtggttggccatcggggtgctgggcgtcctgtgcgccaccgcccaccgccggacggtgccggtccgctatggggcggcgccgagccacgcctga

SEQ ID NO: 2378 - DNA, 3624 bp, Actinoplanes utahensis
gtggcgctgaactccggcggcggcaccaacacgtcattcaccatctatgacggtttcctgcgcccccggcagacccagtccgaggccgtcggcggcggtcgggtcgtcaccgacaccctctacgaccagttcggccgcgccgacatggcgttcggcgcgcacgccgaacccgacgcgccgtcgggcaccctgtggtgggaaccggaatggtcggtgcccacccagaccctcaccgagtacgaccgggccggccgcgccaccgccagcatcttccgctccggcgacggcacgaccaacgtcgtggagaagtggcggaccaccaccagctacgaaggcgaccggaccacgcaggtgccgccggccggcagcaccccgaccaccacgctgaccgacgtcctgggccgcacctccgaactgtggcagtacaacaccgccgccgggatcgccggcgggcacgacaccgtcaaatacggatacgacgccaagaaccggatgacctcggcagccgactcggccggcgacacctggacctacaagtacgacctgctcggccggcagatcgagaccaaagacccggacaagggcgcgtcaagctcaacctacaacgacttcggtgacctgctcaccaccaaggacgccaccggccacgtcctggcctacgaatacgactccctcggccgcaaaaccggtctctacgacggcagcatcaccgaggccaacaaacgcgccgaatggaagtacgacaccctcgccaacggcctgtacatgtacggcaaagtcacccaggcaacccgttacgagacagctgctgacggtacccggcagccctacatctggcgtcccaccggtttctccgcccgcaaccaagtcagcgttgagcagtgggtcatcccggcagccgaaacgggacttggcggcacctacagctacgtccacagtttttccccatacaccggcgcggagaccggcatcacctacccggcagcggcgacgctaactagcgaaggcgtcgagaccacctacgacaaggcgagcggcctgccgaccgcgctgaagtcgctgtggtctgaccccggcagctacgtatccgctcagcagtacgacgcgtacggcaagccgacctccaccatgctgaagatcactggcggggtctacgcccagcagatgatgtcctacgagggggacacccgccgggtgcacgaggtgaaggtcaagccggagaccgcgaccggcacggtggccgaccgcacctacaactacgacgcatccggcaacatccagcaggtcaccgacgcgccggaggtgggccagaccgacacccagtgctacgtctacgactcgctgatccggctgacgtcggcgtggaccccgaagtccggcgtggactgcaagacttcgcccacggtcgccaacctcggcgggcccgccccgtactggatcgactggacgatcgacgcgctcggcaaccgcaccaaagaggtgtcgcacggcatggccggggacacctcccgcagctacgcggtgcccaccgccggcaaggatgtggtccggccgcacgcggtgaccggcatgaccacgaccaccccggcgcagagcagcaccacggtcggctacgcctacgacgacgccggcaacatgaccagccggcccggcgacaccggcacccagaccatcacctgggacgccgaaggccacccggtcaaaaccgtcgaaggcagcaaggtcaccaccgacctgttcgacgctgacggcagccgcctgatccgacgcgacagcaccggcgccaccctgttcctacccggccaggagatccgccgcctcggcgccagcaccaccgccaacgacgccacccgctactacagtttcggcggcgccgtggtcgcctcccggaccgtcgctgaccgaagcttgacgtggctgttcagcgaccaccagggcacccagtcgaccgcggtcaacgcctacacccagcaggtcagcatccggcgccagaccccgtacggcgcgccgcgcggcaccaaccccacctgggccaacaacaagggcttcgtcggcggcgacctggaacccaccggcctgacccacctcggcgcccgcgaatacgacccggcgctgggacgcttcatctccgtcgacccggtccaggacctgaccgacccgcagcagtggaacgcctactcctactgcggcaacaaccccatcacgcagtccgaccccaccggcctgcgcggtgatgaccagtactacgggccccaggctgccgcgaaacgcgaaagccccgcgtacaccggcgacccggacagcggcggtgccggtgacggcacccacgactacaacggcggcggcagcagccacggcagtggtggcggtggcgacggtggcagcggcagccacaaccagccgaagccgaaaaagaagtcgtggtgggagcgcggcgtcgactgggtcagcgagaacaagaacaccctgatcggcgcgggcgtcggcatcgccaccttcatgggctgcgaggccgtcaccgcaggcgcgggcacccccgcctgcatgatggccgccggcgccgccggcaagctgaccaccgacgccctcgacggcaacatccacggcgtcgtcgacgtgatcaactcggctggcgccggcgccctcgaaggcgcactagccgttccccttgctgccgccgacgcggtcagtcaagtgggcaacatcgccaacgacgtcaaaaacggtgactgggccgcggcagcaggccacacagccctcggcgcactcgacgtcatgaccgtcgtcgacggcgtcaaggccggacctaaaaaggaggtcgcatcgcaggaggagggcgtacgacctcccagtacatgcaaaaatagtttcaccgcaatgacactggtgcttctggcaaacggcaccagcaaaccgatcagcgacatcaagatcggcgacaaagttcgcgccaccgaccctcagacgggcaaggacaccgccgaaccggtcgaaaccctgtacgacaacctcgaccacgacttcgtcgacctcaccgttaaacaccccgacggcacctctgcggtcatcaacaccaccgcacaccatccattctgggaccagagcgaccacaagtggaccgacgccgctgaccttcaggtcggccaccacctgcgcgatacccatggccaggccgcgaccacgatcaccaaagtgcacgcctacaccggcgcgcaccacatgcacaacctcaccgtcacaagcctccacacgtactatgtgctcgccggtgccacgccggtactcgtacacaattgcggtggagctcaccgtgcggagggcgaatcaagccaaggtgaagattatgagcccaggcacggcaggccagaatcccttgatgtttatccactgcgtcacgctgttgccggagctgcagagggtgctatcacaaaatgggataacagtctgccgaagagaattataggtatgctgccgggagattcctggaaatcggttgcagatgtggtggggcgggctgcttatggtgccttctatgggcgaagggcatactatgattggggtggaggctatccggctgttcatcgtgcgcccgacgattacagtggtaggcatcgggctaattga

SEQ ID NO: 2379 - DNA, 849 bp, Actinoplanes utahensis
gtgcgccgacttggtccaccccgcatcccaggtctggaaggtccgacccagcgggtcgtaggtgacgtcggtgacccgcttgttgatgtcggagacgccgacggcacgatcactccgaactatccggacatggccatccgtgacttcaacggcgaccagaccaccgacgtcctagcccgagacaccggcggcaccacatacgtctacggtggtgacgggaagggcgtcttcgagccccagacctccgccgggaccgcattgtccggctacaacttcgtgctcagcccgggtgacgccaccgccaccttcccggtcaccctcgaccgcaccggcccggccatcagccacatcacccccggcgacatgaaactcgttcgcggcaccagcttcaccacgaccgcgtccgtgactgatcccagcggggtcgcagccacctccgtgaacggcgtcggcacccccggcaccgccgccaccggaaaggtgcccaccggacgcgacggccggctcaccgtcacctggcaagccaccgaccgcttcggcaaccagtcctccgccagccgcaccgtcgtggtcgacaacaccaaaccggccctcgcgatcagcgcggcgcccgccaccggcaccagactcacccgagccgccaccatcaccgccgctgccagcgaccacaacggcatcgccaaggtgcagatgctggtcaacggcaccgtcgtcgcgaccgacaccaccgccggctaccgcttcaccctgaacccggccaactacggcagaacgttcagcgtgcaactgcgtgcgtacgaccgagccggcaacgtctcacacagcagcacccgcacctaccaccgctga

SEQ ID NO: 2380 - DNA, 495 bp, Actinoplanes utahensis
atgagcggcgcggagcaggagttccgggtcttcgtcctggggatcgcggcctcgctgcaccgcacggcattcctgctctgcggagactggcatctggcggacgacctcgtccaggaggcgctggccaaggcctacagccattggcgcaaggtacagcgggccgagaacccctcggcgtacgtgcgacgcatcctgatcaaccaatcgcgtagccactggcgccggcaccgcaacgtgcccacgtacggcgacagcgacctggggcagctcacggttcccgatctctccgacggtgtggtgagccgcgcggacctggtccaggcgcttcagtccctggcgatccggcagcgggcgaccgtggtactgcggttcctggaagggctcagcgaacgggagaccgccgcggtcctcgggtgcaccgagggcaccgtcaagagccagacgagccgcgcgttggccaagctcaagtccgtcctgaaccgaggagaccactga

SEQ ID NO: 2381 - DNA, 1005 bp, Actinoplanes utahensis
atgccgaacgacaccgaggaacagctcagcacggcactgcacgacatcgtcaaagaccggccgtacacgcccgacttcgaccggatcgagagccgcgggcggacgttgaagaaccgtcgcctcgcctggcgcgccggcgggggcgccacgttcgccgtcgccgccgtgacggcgatcgcggtcgccgtcggcggcacgggaacacaggccccggcgcgtacggaggcgcagccgggcccgacgcggagcgccaccgccacgagcccggcaacatcggctacccagcagccgctggtgcagctggccgcctacctcaccacgatcgagaagcagcccggcgacgccgcgctcgtgcgacgcgacgagtggaacgcttacaactctccgcacaaggacgtggtgtgggacctgtacgccgacaacggcaagtactacttcgccaagacccgcgccgggctgccggcgaaggtgcgccacaaccagaccgacgcgggtgacacgttccgggtggcggtcgaggccgccaagtacgcggtgaacggtgatctgaccgtggcccgcaaaaagatggcggacatgaccggcgcctttcaggtcgaggatcccgggccgggcgtcgtcccgccctaccaggggccgattggcaagaaggtcccgaggcagatccgtgacgtgctcaaggtcaacctggtcgacaaccgggtatggctgaactcgatcttcgcgttggaggccggggccggcagcccgaccgtccgcgccggtgtgctgcggttgctgtcgacgctgcccgaggtgaaggtcacccagggcatcctcgacggcaaggcgacgctcaccctgaccgtgggcaagccggccatggccggcgaccgcaccgaggccctgaccatcgacgccaccaccggcgtcccgatgcgtttcctcagcggcgcaggcgcctcgggcgccaactaccaggtcacccgcgtgagtctcgcggacgtggccgcgggcaggttctga

SEQ ID NO: 2382 - DNA, 1578 bp, Actinoplanes utahensis
atggcggcacgcgggaaggtggcggagcttgccgctgagctggacctgctggaggaggacatcgggtgggacctggccgagtcccacgctcgcctggaccggctgatcgaggcgctgcggccgtccggtgagagtgagctgttctggcgggcgacgcttctgcgggcggacgccatcgagcgtgagggtgacggcgcgaccgcggcgaggctcgtcggcgaggtgcgccggtgggcggccgagcacggctcccaactgctgatctcccgcacgcaccggctgctcgcccggctcgccaccaacgccggcgacctgggcggaggcctggagcacatgcttcagtgcgtgatggcgctgggggacgacacaccgccggcggaacggatcctggcactgatcaagctggccgacgcgttcgccgcgaccgggtcgatggcggccgcccgggaacggttcgagcaggccttggcggccgccgccgagatcggtcatctggaacggcagatgaccgccctgaacaactgggcctacagcgagtacgaggccggcgagccgcagcgctcctgggaggtgctgcagcgactgcgggcgctcgcccgggcgcacgaccggccgctggacgccgccgagctggacacggtggctcgggtcgcgctggagctggggcatgtcgaggaggccgagcgggccgcccgcgatgcacttgagctgtatccgcacgacaaggtcgaggccgatgcgcaggccgcgtacctgctgacgttcggcatggcgcggcatcggcggggggacctggagggcgcccgggcggcgctcgccgagagcgcggagctgtgcgaacggcaccggctcggccggctggccgccggggtgatgaccgagcaggcggccctgctcgcctcggcgggccggttcgaggatgcctaccggaagttgtgcgaggccaacgaggccgaacggcggcagcgggacgccgaccgggaggagcaggcccgcaacctgcaggcggcgtacgaggtcgccgacgcgcgccggcaggccgagtcgttccgcgatcaggcccgccgcgattcgctgaccgggctgcgcaaccgtcggttcgtcgacgaacacctgcgcgggctgctcagccgcggtggcaccggcgcgactccggtgatcgccgccctgcttgatctcgaccatttcaagcggatcaacgactcgctctcccatcaggccggtgacgccgtcctggtggcgttcgccggcctgctggcgcaggtcgacgcgggcgtcgacggcttcgcggcccggctgggtggcgaggagttcctgctggtgatgaccggtgtcgccgcgccggaagcgatcatgagggtggccgatttccggcggtcggtgctggctcaccgatggacgtcgatcaccggcgacctgccggtgacggtcagcatcggcgtcaccaccgcggcgcccgactgcaccgtcgcggacctgctcggtcgcgccgacgaggccctgtacgccgccaagcgggccgggcgcgaccgggtccacctcgacgagctggccgacctggctaccggagcgtcatga

SEQ ID NO: 2383 - DNA, 2886 bp, Actinoplanes utahensis
ttgagaccgttatccgtaccgtccgcaacccggcgggtgggagcggcagccgccggtgtctttctgctcgcggcgttgctgccgcagcaggcacaggccgcgccgctaccgggcgccgtgaccgctggcactgacagcaaggcgccgcggcgagccgattacgattcccgtgcgaacctggtcgccgcggcccaggcgcaagcgccggcgacagcgtcgaagggcagcgcatcgagccgcgccttcgccaccgcaccgtccgcctcggcggtgcagagcatgcgcaacaaactcggcgtgcagggcatcgtcgacatcgatcgggccaccggcaccccgcgccgggtggccaagctggacggcttcctgaccggcccgagccacaagaagccgaccacgatcgccctcgactacatcaaggcccaccccgagatcttcggcctggacgcggccgacctggccacgctcgaactgcgccgcgactatgtcgacgtcgcgggcacccaccacctcagctgggtgcaggtcgccgacggcgtgccggtgttcggcaacggcctgaaggcgcacgtcgccaaggacggccgcctcgtgcaggtcgacgggtcgccgctgaagtcgctgccgtccacggcgggcgccgccaaggtgaccgccacgggcgcccgcgccgcggcggtcaaggacgttctcggcacgtccaccgccaaggccaccaagacggcggccggcacgaccaccttcagcgacaacggcacggccaagaaggtctggttccagaccgtctcgggcccgcgcctggcctggcagacgatcgtcgtcgacgagggctacgtgcacgtcatcgacgcggtcagcggcgaggtgctctaccgccacagcacgatcgcgaacgactccgccgaagtgtggaagaactacccgggcgcacccaagggcggcgtcccgcagaaggtcgacctgaccgccaagggctggctgccggacaacacgcgccagctgtccggcaacgtcgcgcacgtctactccgacgtgaacgacaacaaccaggccgacccgaccgaggaggtcggcccgtccggcctgcaccggtgggactacccgctggccgacttcaacgtcgcggtgggcggcctctgctccgccgcgtacccctgctcgtgggacccgaagacggcgaactcctggcaggtcaaccgcaagcagaacgcggtgcagctgttcacgttcctgggcaccttccacgaccacctcaagtcctcgccgatcggcttcacccgggcggccggcaacttcgaggcgcgcgacggcgacgcggtgcagggtcaggccatggacggcgccgacaccgcgaagggtctgcccgacgccgaccacaccgacaacgcgaacatgaacaccccgccggacggcatcccgccggtcatgcagatgtacctgctgaacccggccccggacgcggtcgccgcgaacaccggtgacgagtccgacgtcgtgttccacgagtacacgcacggcctgtcgaaccggctcgtcatcgacgccgccggcaactccaccctgagcaacatccagggcggcgcgatgggcgaggcctggagcgactggtacgccgaggactacctgcacgccaccggtctcgagaaggacaccgcgaagcccggcgacgtgctgatcggcaagtactggtcggccggcggcacgatccgcagcgagggtctcgactgcaccgtcggcatcgtctcggcggcctgccccggcaccccgaacgccggccccggcggttacacgtacggcgacttcggcaaggtctcctcgcgcggccccgaggtgcacgcggacggcgagatctgggcccagacgctgtgggacctgcgtcgcgcgatcggcagcaccaaggccgaatcgatcgtgacccgcggtatggagctgtccccggacaacccgtcctacctggacatgcggaactcgatcatcgccgccgacctggtggtcaacggcggcaagaacgccaagaccatctggaaggtcttcgccaagcggggcatgggctacttcgccgccgccatcgacggcgacgacacccagccggtcgaggacttctcgacgccgccggccgcgggcaccccgcgcgggacgctcaccggcaaggtgaccgaccaggacaccaaggccccggtggccggcctgaccatcgccttcggcgggcacgcctccggcttcgccggcgactaccgtgccaccaccgccgcggacggcacctacaagatctccgggatcattccgggcacgtacgccaaggtgtacgcccggggcgccggctacgaccagatcgtcaagacgctgtcggtcaactcggggaccaaggcggagaactgggcggtccggcacgactgggcggcctcctccggcggcgcgggcatcatcagcgccaccgggccggactacacggcgtacggctgtggtcccggtgagctgctcgaccagtcgcagatctccggctggggttccgacgtcgcggccgaaggccagaacgccgtgatccgtctgtccggcgcggtcaacgtcgcgcagctggtcgtcaacccgtcgtccacctgtggcgacgacaagacggcctccaccagcggctaccggatcgagacgtcgaaggacggcaagacctggactgtcgccgcgagcggcaagttcccggccggcaccgtcacgcccaccccggtcgcgctggccgcgggcaccggcgacgccatcgagtacgtccggtacacgatgctgaccacgcaggcccaggacgccgggctgtgcgcggccggccagccgggcaccgcgaacggctgcaagttcatggactcgaccgagctggcggtctacggaccggctgcctga

SEQ ID NO: 2384 - DNA, 1623 bp, Actinoplanes utahensis
atgaccgaagcacgccggaccgaccggagccccgcgcctgcgaccgtcgccgcgcttgccgcggagctggacgagctgacccgcaacagaggctccgacatcgcagtggccctgccccgcctgctcaaggtcgaacagtgcgccgccgaaatgggcgaggacatcctcaagtggcgggcgaccctgctgcgggctgatctcaccgaccgcacgggcgacttcgccgctgccgcgcggttgagctggcaggcgctgcagtggggcaccgaacacggctgtgcccaggtcgtctcccgcgcgcacgagctgatcggccgcggatcccgcaccatgggcgacccgctcaagaacctggaccacatgctgcaggcggtcgaggcactggacgacacggttcccaagtcggcttacctgggcattctggtcaagctcgccgatgctctggcggagaccggctcgatgccggaggcccgccagcgctacgaggccgccgcgcgcctggcgctggaggtcggcgatgtggaacgccaggccatgatctacaacaactgggcccacggcgagtacgaggccggctgccccgacgacgcccgcacggccgtcgaccggctcctggccttcaacacggcgaccggccgtgcgttggactgctgcgacctggacaccgtggcgcggatccgtctcctgctcggggagcatcgggccgccgaggaggccgcccgggccgcgctggacgcctatcgggagagcgacaaggtcgaggcggaccgcgaggcggagctgctgctgacggtcgctgtcacgcagcgtcaccagggtgacctggccggcgcgcaggtgtcgctggacctcagccgatcgttctgcgacgacctcaacctcggtctgctcgccgcgctggttcagcgggaacagtccgagatccatgccgcggccggccggtgggagcaggcctaccgggcgttgcgcgcacaccaggagatcgaaacgaagcgggccgacgcgcagcgcgaggcgcaggcccggaaccgacaggtgatgttcggcttgagcgaggcccgccggcaggccgaatcatttcgcgagcaggcccgtcgcgatccactgaccggcctgcacaaccgccggcacatggacgagcaactgccgggcctgctcgccgaggccgcgcgcaccggcgcaccgatcaccgccgcggtgctggacctcgatcacttcaagcggatcaacgacaccctctcgcacgaggccggcgacaccgtgctgagccggcttgccgcccggctgtcccaggtgccgctcggcgacgacggcctcgccgtccggctcggcggtgaggaattcctgctggtgatcacgggcgtccggccggccgaggccatcttccgcctcgaggatctccggcgggacatcgcggaggagtcctgggcgacgatcaccggcgacctgccggtcaccgtgagcatcggcgtgacgaccagtgacgccggcagcacggtgaacggtttgctcggccgcgccgacgccgcactgtacgaggcgaagcacggcggccgtaaccaggtgcgcgtcgaccccggatgcgacctgacggaacggcggtggttccgcagcctgcgctga

SEQ ID NO: 2385 - DNA, 690 bp, Actinoplanes utahensis
gtgcgttcacgtgtgtaccgaggtgctgtcggacgtcgtcgtaaggcgatcggagcggtcgtggtggctggcgtgctgggggtgggcacggtgaccggcgtgcagttcgcgaacgcgagcaccaccccccgcgcggccaccgatctggccgccttcggcgggcgccaggcagccgcgccgggccagaacccggccggtgccaaagacgccgcggccagggctgcggcggccaaggcggcggccgccaagcgtctcgcggccttctgtgccgcgaacggccaggccgccggtgacaatgccgcgggtaacgccgccgccggtaagggtgcggcgttcggtaaggccgctgccggtaagggtgcggcgttcggtaaagccgctgccggtaagggtgcggcgttcggtaaagcggctgccggtaagggtgccaaaggtaaaggcatcgcagcgaaaattgccgccgccaaggctgacgcggccaaacggatagcggccaagtgcgccgccatcaatggcgcggcggccaatggggccgcggctgatgccggcgcgggaaatgccggcaaggcgaacagcatcgccgccaagatcgccgcggccaaggctgcggcggccaagcgggcggcagccagactggcggccgccaaagccgccgcagccaagcgcgcggccggcgcggcgggcaagtag

SEQ ID NO: 2386 - DNA, 654 bp, Actinoplanes utahensis
atgacccagcggacgtcacccgggaaacttcgcaggccgatctggcgcggctggatacatctcatctggttcctgctctccttgccggccggcgggttgctcatcgccggggcccgcggcgaaggcgcggtcgtcgcggccgcggtctacgcggggacggtcagcgcgatgttcggtaccagcgccctctaccaccgggtcagccggccgcccgcgctgcgccggctactgcagcgcctcgatcatctgatgatcttcgtgctgatcgccggcagcgccaccccgccgtaccagcttgccgtcccggcccgctaccacggcatctgcctggtggtgatgtgggcgctcgcggcggtgacggccaccctgcacgtggcgcgaatgcaggctccggagcgtgcggtcggcggcacctacatcgggctggcagccgtggcgggcctggctctgccgctgatctggatccacgccgggccggctgccggggccctcgcggtcgccggcggtctgttgtacgtcgccggggctctcgcctaccactaccgcaggcccgatccggcgccgtcggtgttcggctatcacgaggtcttccatgcgctggtcagcgccggggccacctgccactacgccgccgtcttcatgctggtgacatag

SEQ ID NO: 2387 - DNA, 1446 bp, Actinoplanes utahensis
atgtggcacggtggacgggtggccggcacgcgtctgcggcgacccgcgggtgtccggacacggctgccccggcgcgacttctcccgatcctggtccgggtcccgggaccggtcgccgcgcagagccgtgttcgcgccggaggctgccggagtcgcccacccccgtcgcgcccgccgccggccgcggcccgcggtgcgggcgcccgagccgttctcgatcgtctcccgggacttcccggccgtcagcgaccttccggtgctgcggattccgcccgcccccgccactccggccgctccggtccgccgggtgcggaccggcaccgctcccgctcccgtgccgccgttgttcccggcctggccggcggtcgccctgtacctggtgctgcgggccgtgagcctcatcttcacctggcatttcgtggccgagaaacaccgcgatccgtgggcgctgctcggcgcatacgacgcggcctggtacgccgggatcgcccggcacggctacgacaccgcgatcccggtgcacgccgacggcaccctggcccccaccaacctggcgttcttcccgctcttcccggccctggcccggctggccgacccactggtcccgggcggcgcggaccgggccgggatcgccgtcgcctggctggccggcctggtcgccgccggctgcctctacgcggtcggcgcccgtctgcacgaccgcgccaccggcatcctgctcgccgggctgtgggcggtcctcccgcacgccgtcgtcgagtcgatgggctacaccgaaaccctgttcaccgcgctggccgcggccgccgtgcatgccctgacccgcggccggtggctgaccgcggcggcactctgcgcgctggccggcctgacccgcccgacggccgccgcactgatcgccgtggtcggggccgccgcactggtcgccatcgtgcggcgacgcgacggctggcggccgtgggcggccgcggcgctggcgccgatcggcctgctcggctacgcggggtgggtcgggtggcggctgggacgcgccgacggatacgtgcacgttcagaaggacgcctggaggatgtcgtacgacctgggcggatacaccgtcagggcggcgcgcggtctgctgaccggggagtccacgccggcgtatttcgtggtcacgctactgctgatcgccgcgctgaccctgctcgccgtgctggccacggacccggtggcgccgtggcagctcaagatctattcagcggcgatcgtggcgctggcgttcttcggccacggctactaccactccaaggcgcggctgctgctgccggcgttccccctgctgctgccggtggcggcgacgctggcccgggcgcggcggaccaccgtggtcgcggtcctggccgcgatgaccttgatttccgcggcgtacggcgtttacctctgcacggtctggacatggtcgccgtga

SEQ ID NO: 2388 - DNA, 567 bp, Actinoplanes utahensis
atgacaaccggacggacggccgtccccgtccaaggggtgatgacccgacggagggtgcgtgacatgcgggacggcgcggagcaggaatacatcgagtacgtcacggcgcggatcccggcgctgcggcggctggcgttcctgctggtcggtgacgaacaccgggctgacgacctggtgcagcagacgatcaccacgctgtatctgaagtggcggcgggcgtccgcggccgagcacctggacgcgtacgtgcgcaccatgctggtccgcacgtatgtcgacgagcgcaggctggcctgggcccgggtgcggctgttccagcatgcgccggagccgccgccgctggagccgggcggtttcgaggagcgtcaggtggtccgggcggccctggcccggctgccccgccgtcagcaggcggtgctcgtgctgcggttcttctacgacctgccggtggaggacgtggcggcgacgctcggctgctcgaccggcacggtgaagagccacacctcccgggggttgatcaccctgcgtcgcctgctcggcgagccggagctcgccgtgacgaactga

SEQ ID NO: 2389 - DNA, 1188 bp, Actinoplanes utahensis
atgccgtccgattttgacctgttgcgttcgatcgacaccgagccgcgcgccacgtccacggtggacgtcggccgggcgatcagtacggcgcgccggcgacgcagccggcagcgcaccacctatgccggggtggcggcgctggccgccgtggtgctcaccggcggcgtgctgacctggcggccgtccacgccgaccgccgccgacagcactcccgggtcggcggcgccggtcggggtgaagccacccacgaggtgcaccgtgcggcagctcccgatcccggacggtgcgccggcagccctcgtcgccggcgccgaccggaccgggagatacctggtcgggcgctcctatccgaaggagaacgagtggcagccggtgatctggcaggacggcgccgccagcacggtgccgattccgggcaccttcgagaagcagctcgcggatgtcaacgcgtccggcgtcgcggtgggctggggcttttcgtcaaaaaccacctccttgccgtacgtcttcggcaacggccaggtcacccggctccccggcgtgaccggcggccaggctctggcgatcaacgacaggggagcgatcgtcggcgatgacggcagccggccggtgctgtggcggtcggccaccgcacagcccacccgcctgcccgtgccacccggcaccacccacgcccaagcgaccgatatcgaccaggacggcacggtcgtcgggacgatcgacgaccgcatcccttacgtatggctgccggacggcacgcatcacccgctcagcctgccggacctggacggtgaaccggtcgaggggcgcgccttccacatcagcggcggctgggtgtccggggtggtcaacacccgtggcgcggcggccgggctggccgcggagaggggcgagatccgggtggtccggtggaacctgcggaccggggccgcgaccccggtcacggcgttcgacaagagggccgacgcgatcaacgcgcagggctggcagaccgggatcgcggcgggcggcggtggcgcggtgctggtggccgacggcaccacgctgccgctgagtggcctggcaccggccggcgacgaccggctggcggtcatcgcgaacgcggtcagctacgacggccggacggtggccgggcaggccgacgacgccgccggccggatccagccggtggtgtggacctgctcctga

SEQ ID NO: 2390 - DNA, 720 bp, Actinoplanes utahensis
atgtccgccggacccgacttcgcgccgcgctacttccgcatcgagcaggagctccgagcgcggatcgcgcaggcccggccgcacgacccactgccctccgagccggagctggcccgcgagttcggcgtcagccggatgaccgcgcgtgccgccgtcacccagctggtcaacgacggcctcgcctaccgcgcgcccggtcgcggcaccttcgtcgcggtccccaccggcccgcgccgcgccgacaacctgatccgcctcagcgaggagatccgcaagcggggcaaggagccgtcgtcgcgcgtcgtcagcgcggaattgcgcccggcgaccgtcatcgaggccaccagattgcggcagcgggccggggacgtggtcgccatctatcgcgtccggcaggccgacggggatccgttcgccttcgagcacgcctgctaccccggggtgctcggcgcactgctggacttcgacctctcgcaatcggtgcatgaggcgctggtggcgctcggccgcatcccgaccaggggaacgtcgacgatcaccgcccagccggccaacgaggaggacgcgcgcgaactcggcgttcccgcggggaccgcgctactggtggaggagcgcctgatcctcgatcaggaaggccggccgctggaattgagcgagtcccgctacaccggaacgaaataccgtctggacgtcgccttcggcgtagaaccccatcaataa

SEQ ID NO: 2391 - DNA, 768 bp, Actinoplanes utahensis
atgaggcacaccctaccgatagcgacaacctgtctagacaggcggttgtctagacaggtacggttcggccctatggatttctcggtgtcgcagatcgcccgcatgatcgatcactccatcctccagccgcagttcaccctcgaggacgtgcgtcaggggtgtgccgtcgccgcgaagtaccaggtcgcgtcggtgtgcgtgcgcccctccgacgtgccgctcgcggtcgagctgctgcgcggcaccgacgtgcgggtcggcaccgtgatcggcttcccgcacggtgacaccagcaccgaggtgaaggccgccgagaccgagcaggcggtggcccgcggcgcctcggagatcgacatggtgatcaacatcggctggctgcggtccggcgacgtcgccgcggtggagaccgagatcaaggagatcgtccgggtggccggcgaggcgcacgtgaaggtgatcctcgagacggcctacctcaccgacgaggagaagctcgccgcgtgccgggccgccgagcgggccggcgcggcgttcgtgaagacctccaccggcttcgccccgaccggcgcgacgatcgacgacctcgccctgatgcggtccgccgtgtcggccaaggtgcaggtcaaggcgtccggcgggatccgcggcctggacacgctgctggcgatggcggcggtcggcgtcacccgcttcggcacctccgccaccgaggagatcctcgaagacctggcgcggcgacaggcgacaacctacgcccggcgcgcctga

SEQ ID NO: 2392 - DNA, 1218 bp, Actinoplanes utahensis
gtgatccacaaacgactgtccaccatggtggcggccgggttgatcggcgccgccaccctgctcggcgccaccccggcacacgccgacgagaccgatccaccccgggtcgagctggtcctcgacgtcagcgggtcgatgcgggccgccgacatcgacggcgaaacccggatcgcggtggccaaacgcgccttcggcaaggtcgtcgacgcgctcccggcggacacccggctcggcatccgggtgctcggcgccacctacgccggcaagaacaggaaggtggcctgccaggacacccagcagatcgtcggagtcgggccggtcagcgcggtgcaggcgaagaacgcgatcgccaccctgaaaccgaccgggtacaccccgatcgggctggcgctgcggaaagcggccgcggacctcggcgacagcggttcggtccgccggatcgtgctgatcaccgacggcgaggacacctgcacgccgcccgacccgtgcgaggtcgcccgggaactggccgcccagggcacccacctggtgatcgacacgctcggcctgacgcccgacgagaagacccgcaagcagctggtctgcatctccacggcgaccggcggcacgtacgccgcggccaagagcgaacaggaactcaccgaccgggtgcagcagctggtcgaccgggccgtggtgccgccaccggtgaaaccggccgtggtcaccggcaccgcggcctgcgccggcgcgccgctgttggcgccgggcgtctacaccgaccgggagcagatcagccagcaccggttctaccgggtggcggtaccgcccggtcaggaactgcgcgcctcggtcagcatcgcgctggaccgggcggtcaaccccgactacggcgtgttgctcaccgcctcgacgcccggtggccgcgagctggtccgcgggctggacgccggcagcggacgcaccgatgtgctgtcggccgggctgcgctgggccgccgagcagggcagcgaagtctgcctgacggtgagcaactcgttcgccacggccaccaccagcccgctgggcatgccggtcgagctgaccatcggcctgaccggcgcctcgcacgccccggacgcccccggactcggccgcggcttcctgttcctgctggtcctggcggtcgccggactgatcgccggcatcctggccggctgggcgacccgctactgggtggccacctggagggagaactga

SEQ ID NO: 2393 - DNA, 771 bp, Actinoplanes utahensis
atgcggagcacgacgtacgccgccgccgccgtcgccctcgcggccctcgccgtcccggcgccggccctggccgatgacccgtccccggcgcccgccgtacacctcgccggcacctcgttcctcaccgcggtgccgatcagcgccggtcagccggtgcaggtcggcgcggtcaccggcgactacctgtactggcagttcagcgcggacgccgggcagcggccggagctcaccgcggcggtcaccctgccggccaccggccgcaccggcgacgaatcctggatcatcgaggtgttcgacggcctgcgccgccggcaggcctgcgtggccggcgagcagagcccggtcgcggcccgggacgccgcgcaggtgaccgtcggctgccggatccggcaggtgcgctcgtgggccgagccgcaggacggtgacccgctgcccggcacctactacgtgcggctgtccagcaccaggacaccggagaccgacctgggcctgccgctcaaggtcagcctcacgctcaccgcggacagcggcgacctggacaccgaccagggcaccctggcccagcctctggtcccggacaaccggcccggcacggtgctgaccactccggcgccgtcggccaccccctcggcggccgcggacagcacgttcagcgcggactggctgccggacttctccggacgctggttctggaccgccggcggcggcatcctggccgccctgaccggcctgttcggcttctccctcacccggcgccgccggctccgctga

SEQ ID NO: 2394 - DNA, 996 bp, Actinoplanes utahensis
atgctgctcgaccccggaatggacctgaccctgcggccgatgaagtatccgcacttcttcgaccggttcaaggacgccatcaagaacacctggacggtcgaggaggtcgacctgcactccgacctcgccgacctggcggtcctgtcggacgcggagaagcacctggtgtcccggctcgtcgcgttcttcgccaccggcgacacgatcgtggcgaacaacctggtgctcaacctgtatcagcacgtgaacagcccggagggccggctctacctgtcccggcagctgttcgaggaggccgtgcacgtccagttctacctgaacctgctcgacacctacgtgcccgatgaggcggagcggttcgaggcgttcgccgcgatcgagaacatcccctcgatcgcgcgcaaggccgaattctgcttcaagtggatcgactcggtcttcgacctgcgccggctggagaccagggagcaccggcgggccttcctgctcaacgtgatctgcttcgccgcgtgcatcgagggcctgttcttctacggcgctttcgcgtacgtgtacttcctgcgctcccgcggcgtcctgcagggcctggcgtccggcaccaactgggtgttccgcgacgagagcatgcacatggcgttcgccttcgacgtggtcgaccaggtccgccgcgaggagccggacctgttcgacgcggagatgcagcagcaggtccgcgacatgctggccgaggccgtcgagtgcgaggtgcagttcgccgccgacctgctcgagcagggcgtcagcggaatgtcactggccgacatgcgggagtacctgcagcacgtcgcggaccggcggctgcaggtgctgggcatcgctccggtctacggctcgaagaacccgttcgccttcatggagctgcaggacgtgcaggagctgtcgaacttcttcgagcgccgggtctcggcctaccaggtcggcgtcaccggcagcgtgaccttcgacgacgacttctag

SEQ ID NO: 2395 - DNA, 2469 bp, Actinoplanes utahensis
atgacgctcacaccggagaagaccggcgtgccggagcagcggcggcacgtgatgcgggtgcggaagcggaacggtgagttcgagcccgtcgacgtcaacaagatcgtgaccgcggtggagcggtggatcaccgggctggacgaggtggatccgctgcgggtcgccaccaagacgatcagcgggctgtacgacggcgccaccaccgaggagctggacaagctctcgatccagaccgccgcggagctgatcggcgaggagccgcagtattcgcggctggccgcgcgcctgctgatcgacctggtggagcaggaggtccgggagcagggtgcgaccacgttcagcgagtcgatcgagctgggcttcgcgcaggggctgatcggtgacgacgcgcacgcgttcgtggtggcgcaccgggcggagctggacgcggccgtggacgtcgccaacgacctgcggttcgagtatttcgggctgcgcacggtcgccgaccgctacctgctgcggcacccgatcaagcgggtgccggtcgagaccccgcagtacttcctgatgcgggtggcctgtggactgtcgcagaccgcgcaggaggcgatcgggttctaccggctgatggcgtcgctggcctatctgcccagctcaccgacgctgttcaactccggcacccggcacacccagatgtcgtcgtgcttcctggtcgactcgccgaaggatgagctcgactcgatctacgagcggtatcaccaggtcgcgaagctgtcgaagttctccggcgggatcggcatcgcctggtcgcgggtgcgcggccggggcgcgttgatccggggcacgaacggcaagtcgaacggcatcgtcccgttcctgaagacgctggacgccggggtggccgcggtcaaccagggcgggcggcgcaagggcgcggcgtgcgtgtacctggagccgtggcacccggacgtggaggagttcctggagctgcgggacaacaccggcgaggagtcgcggcgcacccacaacctgaacctggcgaactggatcccggacgagttcatgcgccgggtcgaagccgacgaggactggtcgctgatcgacccctcggacgcccccgaactgcccgacctgttcggtgacgcgttcaccgaggcgtaccggatcgccgagaagaaggcggtcaagaagatcaaggcccgggagctgtacgggcggatgatgcgcacgctcgcgcagaccggcaacggctggatgaccttcaaggaccggtcgaacgcgctgtcgaaccagaccggcgcacccggcaacaccatccacctgtcgaacctgtgcaccgagatcctcgaagtcaactcggacgacgagaccgcggtctgcaacctcggctcgatcaacctgggcgcgcacaccaccgccgacggggtcgactgggagcggctgcgggccacggtgcgcaccgcggtcgtgttcctggaccgggtgatcgacatcaactactacccgtcgcagcaggcggcggtgtcgaacccgcgctggcgtccggtcggactggggctgatgggtctgcaggacgcgttcttcacgctgcgcctgccgttcgactcgccggccgcgaaggagctgtcgacccgggtgcaggaggagatcttcctgacctccctggaggcgtcggcggggctcgccgagcagttcggggcacatccggcgtacgccgagacccgggccgcgcagggcgatctgcacccggagctgtggggtgcgccgatgacccagggcgcccgctgggccgccgtcaaggagcggatcgcggcgcacgggctgcgcaactcgctgctggtcgcgatcgccccgacggccaccatcgcgtccatcgccggctgctacgagtgcatcgagccgcaggtcagcaacctgttcaagcgcgagacgatgtccggcgagttcctgcagatcaacaactatctggtacgcgagttgaagtcccgcggcctgtggacccccgagatccgggaggcgatcaagcgcgccgagggttcggtgcaggacatcgcggcgctgccggcggacgtgaaggagatcttccggaccgcgtgggagctgccgcagcgggccctgatcgacctggccgccgcccgcgccccgttcatcgaccagtcccagtcgctgaacctgttcctggccgccccgaccatcggcaagctctcgtcgatgtacctgtacgcctggaagtccggcctgaagacgtcgtactacctgcgctcgcgcccggcgacgcggatccagcaggccaccacggcggtcgcggccaccacggtcgtccccgccgcgacgatcccggtcgtcccggccgcgaccaccaccctggtcgccaacccgtccggcccgggtcaggtcgccaccctcagcctgaacctgctcggcgacaccgacggtgccctcgccgcgtccctggaaaaccccgacatctgcgaggcctgccagtaa

SEQ ID NO: 2396 - DNA, 582 bp, Actinoplanes utahensis
atgagccatgagaagcgtgcggcggatcgaaaacgtcgcatggccgagctgatggccgaggcagaggagcagcgtgctgaggcgcgggcctcgatggaggcggcggcgacggtcgagggcggcccgggcagctggctgatcgaggtggcgttcgtggtgattctgatggtcatctcggcagctctgttcggcacggcggtcaccatcagccgcttcacgggcgcggacatcgctgatgcgcgccgtaccggtgaggccaccgtcgagcagtgtgagcgcgatgggccgatcggtctcagcggattcggctatgtcaaagcgtgtgccgtgtccattcggtggaacggcggcggtggcgagcgggtgatgatcggcaagcctggcttcttcaccgacgagaagcccggggacaccttcacgatcggggagaacacgggcagccggggcagcgtcggttactcgcgtgccgaggtgccgccaaggcggtgggtgaccgctctcgtcaccctcatctccatcatcggtgtcgcgccgctgctgttcgccatcggcttcgtgcgataccgcctgcggaggcggtga

SEQ ID NO: 2397 - DNA, 1035 bp, Actinoplanes utahensis
gtgagcgactccttcgccgtctcgcgggctccgctgacggcgccggccgcggacaccaaatggtacgagggcgcgggcatcctcgaagccgtggcgggtgcggccgacggcttttctcagggtgacttcctcaccgggttcggcaattcggtcgtcgccgggatgagcgccctcggcgccgtgctcgatcctttccaggcggtgttcgcggccggcgtcggctggctgatggagcacctgaattgcttacgggagccgctcgactggctggccggtgatcccaaggagatcgaaggacatgcggccacctggaggaatgtccgcgatcaggtcaacgctgcggtgaacttcttcgccgcccaggtcacggccgccacggccccgtgggaagcgcaagccgttcacgagtaccgggcgaaggcggccgggatagccgacggggttcgtgccctgggcgtggtgtccggcgctgtggccgacgcgacgctggctgccggcgcgatggtcggggtggtgcgcaacaccgtccgcgatctgatcgccgaggttgtcggtgcggcgatctcgaaggcgttgcaggcgcttctggtggtgaccatccctgaggtgttgaccagcgtggcgatgatggttgccgaatgttccgcaaagatcgttcgagtgctgcggaggctttccgctgacatggtccggctggggatgaagttcccgcagctggaaaggctctgtgctttcctcagaggttttttggacaaggtcgcctcggacatcagcatgccggcggtgctcctcaactcggccaaggtcaatgcggatacctacccggcggacagcagcgggtcatggggtgggtggaaagaggcgtaccgaaccttcggcgacgctgacgatgccgtctatggcacgaagatcgagatcgcctcggatgccatacgggaagcgctcaaaggaaacagtatccagaacggcggagctaccggcgacgccatgatcggcgacgccgagacctcccccgatgtggacatgccccggtaa

SEQ ID NO: 2398 - DNA, 306 bp, Actinoplanes utahensis
atgagcgtggagatttccccggacgaggtccgccggcatgctcgcgatgtcgacgaggtcgcccgcatgctcgacgaagcccggtcggccggtgccggcgctcgaatgtccagcgacgcgtacgggtatctgatcggccccctcttcaccaacctgtatctccatccccagggcgatgagctcatcgacgtgatgcgccacgcttccgaggggatgagggggctcgccgaccaattgcggaccatggccaccgctttcgaggagaccgatgggatttccgcggccggcctcaggcggatccggtga

SEQ ID NO: 2399 - DNA, 390 bp, Actinoplanes utahensis
gtgatcgtgcggttcgatgtggatgaccccatgcgctcctttcaggcgcgggtcgaggagagtgcgcagcgcacgcttcggttcagcgcggccctggaggcgatcgaggcgaccgggcgcgcgccgggtggcgaggtgagcgtgcgggtcaattcagccggcgggctggccgacctgcgattccacccggaggccgaccggctctcgctggacgagttggcgcgcttggtggtggagacgacgcaccgtgcgcaggggcggctcgcagaacacgtcggtgagctggtggcctcggtctacggctcggactccggaaccgcggcgctgatcaacgaggcatacgcgaagcggtacccgaagcccgctgtcgacgaggagaaccgtcgatga

SEQ ID NO: 2400 - DNA, 1188 bp, Actinoplanes utahensis
atgaagattgataaacgtcgattgtccgggatggtggcggcggtgctcgcggcatccggcatcgtcgccctgagctccggctcgcccgcctccgccgccgactgcggctatctcttcgacgactttcactacaacacctcgtcggacgccgcgctgaccgcgaacggctggaccccgcgcagctactccggcggccccggcgtcgccggagccacctggtcaccggccaacatcaccttccccaccgcgaacggcgacaaggtcgcccagctcaccgcgtacaccgacggcaccgcggccggcaccgggcacgccgagctgtactcggcccagaaacggttcctggacggcacgtacgccagccggatcagattcagcgacaccccggccgccggcaccgacggcgaccacatcaacgagacgttcttcacgatcagcccgctcaacggggacctcgaccccacctacagcgaactcgacatctccgaatacctgccgaacggcggctggggcgaaaccgggccgatcaactaccagacgacctggtacacctatcaaaacgatccgtggtacgccgacaacctgcactcctcgcaacgatccagcctggacggttggcacgacctggtcgcccaggtcgccaacggacacgtcgtctactggatcgacggcgtccaggtcggcgaccacggcggcaagtactacccgcgccagaccatgacgatcaactggaacctctggttcatcgacctggccgcccacgccggtggcaagagcacctacaacgagcagatcgactgggtgctgttcgccaagaaccaggtgctctccccggcgcaggccaccgcgcaggccgccgcctaccgcaccggcggcaccggcttcctcgacacggtcgcctccagtggcacctgctccaccccgaccaccccgccatcctccccgtcgacgccgccgtcctccccgcccacctcgcagccgcccgcaaccggctgctcggatgcgccggagtgggcgttcagctcggtctacctgggcggagcgctggtcaagcacgagaagagcaagaacggcgacccgagcgggccgccgtccggacagggcgaacacctgtggcgggcccgctactggacccagggttccgaacccggctggacccagcagtgggaagacctcggccgctgctga

SEQ ID NO: 2401 - DNA, 753 bp, Actinoplanes utahensis
gtgagcgtcaccagtgaagagttcctgcaccaggtccgggccgtggtcgaccgggtcggcgccggtcaggccgaggagaaacggcgcgccgccgagctgctcgccacgacggtgctcaacgggggcgtgatccaggccttcggctgcggccactccgaggccctggccatggagatcgccggccgggccggcggcctggtgccgaccaaccggatcgccctgcgcgacatcgtgctgtacggcggtgacccgctcgaagccctcgccgacccgatggtcgagcggggcaccgagatcgcgcaccgcctctacgaactggccccgatcaagccggacgacgcgttcgtgatcgcctcgaactccgggatcaacggcgccgtcgtcgagatgggactgctggtcaaggaacacgggcacgcgctgatcgcgatcacctcggcgcaacactcggcaggcgtggcgtcccggcacccgagcggccgcaaactcggtgagatcgccgacgtggtgctggacaacggcgcaccctacggcgacgcgatcctgcccctccccggcggcggcgcggtcggcgccgtctcctcgatcaccgcggcgctgctcgcccagcagatcgtcaccgaggtggtcgccaccctgatcgcggcgggggtcaccccgccggtctacctgtcggacaacgtgcccggcgggaaggaacacaacgcggagatcgaggcgcgctacaccggtcgcatccggcgcaccgcctga

SEQ ID NO: 2402 - DNA, 1182 bp, Actinoplanes utahensis
gtgacccagcgcctgccggatagcggcggcgatcgccccgatcgccgcccggcccgccgcgatcggattgccgggaccggcctgacctcggccgatgacgccggccggaccggccagcacggcacgcgtcccggtgccacccgcgtcgactcccagcaccagctccatgcccaaggatcgaagcatgaatatttcttgttgactagacgtcgcagcggtcgtaattttcatcgacaacaacaatctatgaaaaggatgaccaccgtgaccggtgagagcggcggcctgctcgggcgactgcggatcgagggcccgggcatgccggaagccctggcccggatcgccgagacgatcctggccgacccggagacctcggcgcacgccagcatcgtggacctcgccgagcggtccggcacctcgaccgcgacggtcacccggttcagccgcacgctgggcttcaaagggtacgccagcctgcgggtcgcgatcgccaccgaaaccgggcgggccgaacaggcccgctgggagaccgacatcagcggcgacatcgcccccgacgacccgctcaccgacgtgctcggcgtggtcaccgcggccgacacccgggccattcagagcaccgcggccggcctcgacgtcgccgcggtcgaacgggtggcggccgcgatcgccggcgcccagcgggtggagatcttcggcctgggcagcagcggcacctcggcccgggagatggcgttccggctggaacgcatccgggtgccgatctggcaccggcccgactcgcacaccgcgctgaccaatgcggcgctgctgctgcccggcgacgtggcgatcgggctgtcgcactccggtcgcacccgcgaggtgatcgagacgctcgccgaggccgccgaccacggcgcgctgaccgtggcggtgaccagctacgcccggtcgccgctggccgaggtggccgacgtcgtcttcaccacctcggtgcaggagaccaccttccggctggccgcgctctccgcgctgcactcccagctgctcgtgctcgacctgatctacgtcgcggtcgcccagcgcaccttcgagcggaccgccgaggcgctggagctgaccgtgcgcgcggtcgacgcccaccgactgcccgagaagatcccgacccgccgccgcgggcgcgcgaaaggacaaccgtga

SEQ ID NO: 2403 - DNA, 1527 bp, Actinoplanes utahensis
gtgctggtcgtcgcccggacggtcacggcgctcacccgcctgctggacgtactctcgctgatcgccgccgaccgccgcatccagatcgtcttcaccgtcgacgacgaacatccggcgatcttcgaggccggcgtcaccgccctgctcgacgacctggccccccgcaccatcgactggcggcaggcccgcaagacccggttcgacctgatcctgtcggccagcgagaacgacggcctggccgacctgaccggcccggtcctgttgttcccgcacggcctggcgttccagaagttctatccggacagtgacgtcgtggccggtctgcgccccggccttccggacggtgtgaccaccgcgctgacccatcccgcccagagccgcaccgcttccggccggaccgccgtgctcggcgatccggcctgggcccggatgctggccagccggcagcggcgcggcgtctaccgcaccgcgctcgacaccaccggccgccgtctggtcgtgctcgcctccacctgggggcccgactctctgctcggcaccgtcccggatctgccggaacggctggtcgcggacctcccgatcgacgagtaccggctggtcacggtcctgcacccgggtgtctgggcggagcacggccggtggcaggtgcgcgcctggctcgcgtacgccgccgacgccggggtgctggtgctcgacccggattccggctggcaggccgctctgctggcggcggatctggtggtcgccgatcacggttcgctcggcgggtacagcgcgctgctcggcgttccgctgctgctcggacctcggccgagtggcagcaccgtgcccggctcggtcgccgcgcgcctcggcgaacagtgccaccgtctgaatccgcacgccgcgctgcgcccgcagatcgacgccgtgctggacgggcacgatccggaccgttaccggcgggcggtggccgatgccgtcgtcgagccgcgcgacaccgcggcccggttgtcccgctgggtctatcgcgcgctggatctcccgcggccgtccgcgccgcccgggtttccgccgctgccggtgccgctgccggtgccggcgccggtcgccgcgtgggtggccggcgttcacgaggagcccgatgcgatcgcggtgtcccgttttccgctcgtcggggaccggcacgaggatctgccgtaccggcacgtcgtggcccgggtggaacgggcgacgctgacccaggtggccggcgctgcggtcctgggggtcgacgccgccggcgacgacgacttgttccggctgtggccgcacgcgcggctggtcgtctccgtcgacgatcggggctgccgggcccggttccgcgacggcgacgcggtgcacatccgtgccgatgatccggtggtcgacccgtgggtgctggcctcctgggcgtactggcggatgcggcgcggcgagtcgccggtgggcacgacgcggctgcgggtgggccgccgcctggtcaccgttgtcgcggtcagtcgccgagggctgccagacgacgactga

SEQ ID NO: 2404 - DNA, 2178 bp, Actinoplanes utahensis
atgtccacgatcgaggtgctcacctccgaagccgtgcgggtgatcgcccccggcgtggccaacgccgccgaagccgggatccggcgcctgatcgaccggttcctgaaacggggcagccgtttcccggacgatccggccgagcgccgcgcctacctgcggcgcctgatcgaggaggacgccgagttccgggagctcctcgacgacctggtgacgaccgccggccgaaacgcggtccacgtcgacgagcagccgcactacgtcgaccatgccgacctgcggcgacggctcgcccagccgggcgtctggctgatcaacggcgcgcgcgagtcgggcaagaccgcgctgacccggcaggtcgccgtcgacatgcgggaccggctcaccggctacgccgagatcgacctcgacgagtaccggaccggcggggtcctgcggatcaccgaggtgcagcagcgcatcctgcgccggctcgacgtcgacgaggtggccgtgaccgcggccgacgtcgacctgcagtaccggcgcttcctgcgccgcggtcgctgcctggtggtgctggacaacctcgtgggcgccgaggaggccgaagccttggcgcacatcgggccggccggcaccgtgctgatcaccacccggcagctcaccccggacctgcgcgcctggtatcccggccgccccgaacccgtcgagggggtcgacccggcgagcgccagacagatcctggccgaccgctgcggtcgcgggccgctcgccgccgaaccggacgcggtcgacgagctgatccggctctgcgacgcctacccggccctgctccgtcagttcggtggtcggctggcgatccgcggcaacgtgccggacgcggtggccgaggaggtgcggtggttccgcaccgacccgggcgtcgaggtgctgttcgcgaactcggtgcgccgcagcgccggactgctcggcgcggacagcgcggccgggctggcgctgctggccggccaccccggcaccgacctcagcgacgccggcgccagcgcgtggctcggctacccgagccgcgacctgatcgcggacctgctcgacacctcgctgatcacccgggaccggtccggccggctgagcttcccgtggtcggtgcggcgctacgcggccacggcgctgcggccgggcgaggagacctcgaacgccgccttccaccggtatctcacctggttccgggacctggccggtgccgccgacctggcgatggacccggccggtgtcaccgaccgggcgcgcgacggccggctgcggcgttacccggccccgccggcgatcacctggccgtttcccgcggtgcgcccggtggactggctggccgccgaggcgcacaacgtcgaggacctgctccgcgaggcgcacttccgcgggcaccacgccgaggtggtgcagatcgccggagcgctggaagccctgctcaccatgcgcggccggcactggacctgcctgcgggccaacgaatcggccctggccagcgcggcggcgctgggccggaccgcggcggtgatccggctgcacatcgtccaggcccggatcctgactctgctcggcctgctggaacaggccggacacgaggcggaccgggccgacgcgggcatcgcgggcctggccgacccgcaactgacggcgtccctgcgggaaacgcaggcgcgccgggaacaggagatcgcccggcggggcgaccccgccgcgctggaccgggccgcggcgctgctgcggcagtcggtggacatcgatcaggccatcggcgaccgccgggcgctcggcctgcacctgcggatgctggcgaacgtgctgatcgaggccggctccggccgggacgcactggacctgctggccgatgtgcacctgccggccggagacccgcgcaacgccgcccgcgtgcacacggtccgggccaaggcgtggctgtccctcggggacgccgtcgagggccggcgcgactgggcccgcgcggtcgagctgaccggactcagcggcgccggccagtatcagggagagctgctcgaactccaggcccggctggcggagctggagggcgaccggcagaccgcacgggactgcctgagccggctcgcgattcactacgcccgggacaagcatccccgcgagcaggagttcagtcgtcgtctggcagccctcggcgactga

SEQ ID NO: 2405 - DNA, 1044 bp, Actinoplanes utahensis
gtgaccgccctgctggacgcccggctggtggtgcggcgtggcgacttcgagctcgacatcgcgctgtccgtcgcgcgcggcgagacggtcgccctgctcgggccgaacggggccggcaagaccaccgccctgcgcgccctggccgggctcaccccgctgggcggcgggcacctcaccctcgacgggcgggacctgtcccggaccccgccggaacgccgcccgatcggcgtcgtcttccaggactacctgctcttcccgcacctgtccgcccgggacaacgtcgccttcggcccgcggcggcacggcgccgaccggcggaccgcgcacgccaccgccgaccactggctggaccgcgtcggcctgaccgcgttcgcccgccgcaagccgcggttgctctccggcggccaggcgcagcgggtggcactcgcccgggccctcgcggtcgacccgacactgctgctgctcgacgagccactggccgccctggacgcgcgcacccggctggagacccgggccgagctgcggcgccacctggccgcccaccccggcgcgaccctgctggtcacccacgacccgctggacgcactggtgctcgccgaccggctggtggtgatcgagggcggtcgggtggtgcaggagggcgacgcggccacgatcaccgcccggccgcgcaccgactatgtcgcccagctggtcgggctcaacctctatcgcggccgggccgacggtcacgccgtacggctggaaagcggtgtggtgctgaccgcgaccgatatcgttcacggagacgcgttcgtggccttccccccggcggcggtcgcgctgcatccggcgaagccggatggcagcccgcgcaacacctggtccgctgtcctcaccgacatccagcggcacggcgacaatgtccgggtacgcctcgacggcccgctcgtggtcgccgcggacgtcaccccggcggccgccgcccacctcgacctggtccccggccgtgagctgtgggtcgcggtcaaagccagcgagacccgggcctatccggcgacctga

SEQ ID NO: 2406 - DNA, 768 bp, Actinoplanes utahensis
gtggcgctgctggtgcccgcgatcggcggactgatcttcctggtcctgccgctcgccgggctcctggggcgcactccgtgggcctcgctgccggaccgcctcacccggcccgaggtgctcgcggcgctccggctgtccctgctgaccgcgagcctggccaccacgctctgcctgctcctcggtgtgccgctggcctggctgctggcccgggtggacttcccgggccggcggctggtccgggcgctggtcaccgtgccgctggtgctgcccccggtggtcggcggcatcgccctgctgctcgccctgggccggcgcggcctgctcggcggctggctggcggccaccttcggggtgagcctgccgttcaccaccgcgggcgtggtggtggccgagtcgttcgtggcgctgcccttcctggtgatcgcggtggagggggcgctgcgcggcgcggacagccggtacgaggaggccgcggccaccctcggcgccacccgctggaccaccttcacccacgtcacgctgccgctggtggcgcccggaatcgcggccggcggggtgctctgctgggcccgggcgctgggtgagttcggcgcgacgatcaccttcgccggcaactatccgggaatcacccagaccatgccgatcgccgtctaccagaccatggagagcggtgacctggacggcgcggtggtgctcagcctgatcctgctcgtcgtctcggtgaccatcctggccgccctccgcgaccgctggctgaccacgccgtga

SEQ ID NO: 2407 - DNA, 741 bp, Actinoplanes utahensis
ttgaaacgcgtcacagccgtcgcactgttggcggtgagcctggccgggtgctcgtctccggcgaaggacaccacgcccaccgatgtcagcgttttcgcggcggcctcgctcaccgagtcgttcaccacgctcggcaggcagttcgaggcgtcgcaccggggcacccgggtgaccttcaacttcgccggcagcgccgcgctggccacccagatcaaccagggcgccccggccgacgtgttcgcctcggccgcctcgaggaacatggcgaccatcggcgacgccgccgtcacccccaccaccttcgtgaagaatcagttggtgatcgccaccgcgaagggcaacccgaagcacatcaccggtctggccgagctcgcgaaaccgggcctcaaggtggctctctgcgccgccgaggtgccatgcggcgcggccgctcagagcgccctcgcggcctccggcgtcaagctcaccccggtgacgctggagcaggacgtcaaagcggcactttccaaggttgaactgggtgaggtggacgccgcgctggtctaccgcaccgacgccaggacggcgtccgcgcaggtggacgccgtcgagttcccggaatccgccgaggcgatcaacgagtacccgatcgcggtgctgaagagggccgcgaacccgaccggcgcccgcgagttcgtcgactacgtgctctccccggaggggaccagggtgctgaccgccgccggattccagacgccgtga

SEQ ID NO: 2408 - DNA, 531 bp, Actinoplanes utahensis
ttgcccggggcgaagggctttttcgcctttccgcagatgcgagccgattcattggtagagcctgaggatgcgcgtgggggacgccatgccggatggcaactgcgattgactagggtgagtggcatgacggtgtttccgatgggcgaggcggcggatctgctcggggtcagcccggacacggtgcgccgctgggtcgacgccgggcggctggccgccacccgcgacgagcacggtcaccgggtcatcgacggcgccgacctggccggcttcgtccgggcccggaacgcggacgcggccgagcggtccgattcctcgtcggcgcgcaaccggctgcgcgggatcgtgaccgcggtggtcaaggacaccgtcatggctcaggtggacattcaggccggaccgttccggctggtgtcgctgatgagccgggaggccgtcgacgagctcgacctccaggtcggctcgctggcggtggcagtgatcaaatccaccaccgtcgtggtggagcgggccaccccggggaggatcggttga

SEQ ID NO: 2409 - DNA, 216 bp, Actinoplanes utahensis
atgagtgcgaaggggtatgccgccgcgttcgacccggcgaccgcggtctggctgcggtccgggaacgacgaggacggctacgtggagatcgcccggctgcccgacggcggcgcggcgatgcggaactcccgggacaccggcacgacgctgttcttcaccaagggtgagtgggacgcgttcaccggcggggtcttcgacggcgagttcgacatctga

SEQ ID NO: 2410 - DNA, 1488 bp, Actinoplanes utahensis
atggcgcaaagcttgggttcgcctgccccggcctccgaaccaggaacgatccggagcttgatccccgcacgcatcgaccggctcagctggtcacctttccatacccgcatgatcctggcgctgggcaccgcctgggtgctcgacggcctggagatcaccatcgccagcgcgatcggcccggtgctgtccgacaaggcgaccctggcgatgacctccgccgaggtcggcgcgatcgccaccgtctacctgatcggcgaggtgttcggcgcgctgttcttcggccgtctctccgacaagctgggccgcaagaacctgttcgtggtgaccctcggcgtctacctggccggtaacgccctcaccgcgctgacctggggcagcggcaccgcggcgatcgtcttcctgtacctgacgagattcatcgccggcgccggcatcggtggcgagtacgcggcgatcaactcggcgatcgacgagatgatgccggcgaagtatcgcggccgggtggacatcggggtgaacggcacctactggggtggcgcgatcctcggcacgctgggcacctttgtcctgctcaaccacatgaacctgaacctgggctggcggctcggcttcctgatcggcccggtcatcggtctgtgcatctggaacctgcgcaagcatctcccggagagcccccgctggctgatcatgcacggccgggaggccgaggccgaggagaacatcgcgcagatcgagcgggcggtggagtcgtccgggcagacgctcgccccgatcgacgacagccgggccatcgacatccggccgacccagtcgcacggttacctgtcactcctgcgggtgctcttcaagcagctgccgcagcggtcgatcctcggcgcctcgctgatgatcacgcagtcgttcctgtacaacgcgatcttcttcacctacacgctggtgctgaccaagttctacggggtggatgagaagaacgcgccgatctacctgatcgcgttcgccgccgggaacctgatcggcccgctcaccatcgggcacctgttcgacgtggtcggccggcgcaagatgatcgccgggacgtacctgctctccggtgtgctgctggcgatcaccgcggtgctgttcaacgcgggtgcgctgaacgcgatcacccagacgatctgctggtgcgtgatcttcttcttcgcctcggccggggccagctcggcgtacctgacggtcagcgagatcttcccgctggagatccgggcgcaggccatcgcggtgttcttcgcgatcgcccagtgcttcggcgcgatcggcccggtcttctacggctggctgatcggcgagggcgacgacccgggcaagctgttcatcggttatctgatcggcgccgcggtgatggcgatcggcggagtcgtcgagatcttcctgggtgtcgacgccgagggcaagtccctggaggatgtggcgactccgctgtccgcggtggtccgcacggcagactga

SEQ ID NO: 2411 - DNA, 942 bp, Actinoplanes utahensis
gtgcttggtagccttggcggcgcatttgccgcggctgaggggttgggaactacgttgagtcaaactctgctggtcaccggtggcgccggattcgtcggcacggctctgatccggtccctgctgaccgagttccccgacgccaccgtcgtctcgttggacaactacttcaccggctcgccggcgaaccacatccacgacccgcgggtgacctacctggagggctcgaccgccgagatcgccaagatctgggccggccacgggctgcccgctccggagctcgtcttccacctcggtgaatactcccggatcgtgcagtcgttcgaggaccacgacctgacctgggacttcaacgtgctgggcaccaaggaggtggtgaagttcaccgcctcggcgggggcgaagctgatctacgccggctccagttccaagttcggcaacgacggcgacgacgagaacctgaacccgtacgcctggaccaaggcgaagaacatcgagtacatcaagaactactcgaactggttcgggctggactacgccatcgcgtacttctacaacgtgtacggcccgggccagatcggcaacggcaagtacgccaccgtgatcggcatcttcgagcggcagtacctggccggcgagccgctgaccgtggtctccccgggcacccagacgcgcgacttcacccacatcgacgacatcgtgcggggcctgatcctggtcgcccgcggcggtgccggcgacggctacctgctcggcaccggccgggagtggccgctggccgaggtcgcgcaactgttcggcgccgagttccagctgatcccggcgctgcccggggagcgggtgcgcggcaaggccgacctcaccaaagcggccggcctcggctggcagccgcagcgccggctcgacgagtacatcgccgagttcgtcgccgcgcacccgcgctga

SEQ ID NO: 2412 - DNA, 2292 bp, Actinoplanes utahensis
gtgaccggggtccaggtcaccgtgtcggggctggaccaggcggccgggcgggtgtcgtcgccgtccgggacggcgcccacgacgtaccaccggtcgccgcaagcggccgcgtcgcgcaacgtcgcgcgctccccaccggggagggtgatccgggtccaggccggcgccgccggccgggcgctgcaagcggcgagcatcgagatgacgagcatgccgcaagaaatccaagctcgcatgaaagatccaagcatttcatcggcaaaacaggaccgacccttgtggagcagatcacacgattctatggtcggcggcatgtccgctccgccccgctgggccgctctcctggtcacaccgctggtcattctcggcgtgctggcgatcggcccgaccgatcccgccctggcccatccgccctccgccaaccccgcggccacccgggccgccctcgatccggccctggtcgccggccgcggcgccaccgtcgcattcgccgagcaggaagccgagcaggccgtcaccaccggcagtgtgctgagccccgaccggaccccgtacacgctcgccgcggaggcctccgggcgctccgcggtcaccctggacccgggggagtacgtcgagttcaccctgcccgaagccgcgaacgcgatcaccgtgcggtacagcatcccggacgccgcgaccggtggcgggatcaccgcaccgctgtccgtcggcaccccgggcggcacccgcaccatgacgctgacctcgcagtactcctggctgtacaaccagtatccgttcagcgacgacccgcgggccgggctgctgcacccggactggtggatcaccgagtgcggctgtgtgccggccgccaccacgccggcgccggcgatcaccgagccgttccggccgatgcacttctacgacgagcagcggctcgcgctgggccgcacgtaccgggccggcgaccggatccggctcaccgcgcgcgaggtgccgaccacgatcgacctgctcgactcggagctggtcgggccgccgaaggtcgacctgggcgcggtgaacgtgctgctgttcggcgcggacccgaccggccggcgcgacgcggcgggcgccatcgagagggcgatcgccttcgcccggaaggtccaccgcgcggtctacctgccgcccggcacgttccaggtgaaccggcacatcgtcgtcgacgacgtgaccgtcaccggggccggcaactggtacaccgtcgtcaagggtcaccaggtcaccctgtccacgccggccgccgacggctcggtgcacaccggggtgggtttctacggcaaggagggcggcagtcacgacgtccacctcgccgacttcgcgatccagggcgacgtccgcgagcggatcgacaccgaccaggtgaacgggatcggcggcgcgatgagcgactcgtcgatcgaaaggttgtacatccagcacaccaaggtcgggctgtggttcgacggcccgatggcgaacaccacgatcagcggcaccatcatcgtcgaccagatcgccgacgggctgaacttccacaccggggtgaccggctcggtggtgcggaacagcttcatccgcaacaccggcgacgacggcctggccatgtggtcggagaagaccgcggacagcggcaacaccttcgaccacgacacggtgcagacgccgaccctggccaacggcatcgccgtctacggcggcgcggacaacaccgtctcgaacaacctggtggccgacccgatccgggagggcagcgggatccacgccggctcgcggttcggcgccgagccgttcaccggacacctgtggatcaccggcaacaccacggtgcgggccgggacgtacgacctgaactggcggatcggcctcggggcgatctggttcctcgcactggacgccggcatcgacgcggacatccgggtgaccggggacgacttcctcgacaacacctacaacgcgatcatgctggtgtccgactggggcgtgaaggaccggtacgcgatcaccggggtgcatttcaaggacatccgggtggacggcaccggcaccagcgtggtcagcgcccgcgccgccggcggtgccacgttcgagaacgtggacgcccgcaacgtcggcgcggtcggggtgaacaactgcggttccttccacttcacgcccagcgggtctgagttcaccctcagtgatctcggcggcaacgacgggggctggctcggcccgttcgtcccgaacgtgatcacctgcgacgaccgtcccgcggtggttccgccgccggcgccttctgcctggtga

SEQ ID NO: 2413 - DNA, 1587 bp, Actinoplanes utahensis
atgaccggaaaccgtgggctggggcagtggtgccgagaccgaaaggtcgccaccaaagtgctcgcggtcgccggagtggcgatcaccgggaccatcgtcaccggtgtgctcagtgtgaccgggatcagcgcgatggagaagacccgcaacgccgaggtcggccggatggcgccgtacgtcaagaatctcggcgacgccgcactgcagctcaaggcggccgccaacgacgagcggggcttcctgctcaagggcgacgcgaagttcagcgacgagtcgctcggccggcaggcgaaggccgacgcgtcgctggccgcggcgcgggcgatcgccgccccggacgacgtgacccgggtcgacgcgatccgggcggcctcggacacctggttcgaggcgctgaagtccgagttcgccctgtacaagagcgacccggagaaagccaccacgctgggcctgggcgcgaaccgggacctgcgcaaggcctacgaggcgctgctcaccgcggatctcgacaaggccaacaaggatctgctcgccggtcagagcttcgatcacaccgtgacccgcacgcgcaccctggtgatcgtggcactgtccctggcgctgctgctcgggctcggcagcgcgctgctcgtggcgcggttgatcatcgtgccgttgcgccgggtcagcggcgtgctggaccaggtcgccgagggtgacctgaccggcgacccggacgtgtggcagcgcgacgagctcgggcacatggccgactcgctgcgcgccgcgaccggctcgctgcggcagaccgtcaccgacctgaccgcgcacgccgagtcgctggccaccgaggccggcggcctggccgagaccagccggcagagttcggccagcgcggccgagggcgccgagcaggcggccacggtggccgactcggcggcgaccatgtcggtcaacatccagaccgtggcggccggctccgaggagatgggcgcgtcgatccgggagatcagcgagagcgccaccctggccgtgcaggtggccaaccgggcggtcgaggtcaccgcgaacaccagcgcggtgatggccaagctgggtgagtcgtcggcggagatcggcgatgtgatcaagacgatcaccgccatcgccgagcagaccaacctgctcgcactgaacgccaccatcgaggcggcccgcgccggtgagatgggcaaggggttcgcggtggtggccagcgaggtcaaggagctgtcccaggagaccgcacgggccaccgaggacatcggtcagcgggtcgccgcgatccagacggacaccgcgggcgcggtcgccgcgatcgaggagatcagcgagatcatcgggcggatcaacgacttccagaccacgatcgcctcggccgtcgaggagcagacggtgaccaccaacgagatgagccgcaacgtcggcgaggccgccgaggcaggtggccgggtagccgaaacgatcaccggagtggccgcgtcggtgcagctcaccacggtcggcgtggccgaggccgaccggtccgccgcgcatctggccgggatgtcgaccgacctgcgccggatcgtcgaccgcttcaaggtgtag

SEQ ID NO: 2414 - DNA, 1260 bp, Actinoplanes utahensis
atgcgccgacctggacgaggcgatcgaggtggcccgggcccacccgatggcctggggcggccggatcgagctgcgcccctactgggccggctgaggtcggccgcggtgcaggaggtcttcttccgggagtcgttcggccggatcgtcgccaccctgatccggctgaccggcgactggacgctggccgaggactgcgcgatggacgccatcgagacggcgctgcggcgctggccggtcgacggcgaaccggggaatccgggcggctggctgatgaccgccgcccggaaccgggccatcgaccagctccgccgggccgccaccgccgaccgcaaacttcaggagctggccttgctgcagcccgacgagccaccgccggcggccgacgaccgcctccggctgatcttcacctgctgccacccggcgctggcgccggagtcccgggtggcgctcaccctgcgcgtcgtggccggggtaccgaccgctgacgtcgcccggctcttcctggtcgccgagccggcgatggcccggcggctgtcccgggccaaagccaggatcgagcaggccgggattccgtaccgggtgccgcagggcccggcgctggccgaacgcctgcccggcgtgctggccgtgctctacctgctgttcacgcacggctacgacaccgcggacagccaggccgaggaggcgatccggctggcccgactgctggtcgcgctgatgccggccgagccggaggtcgccgccctgctcgccctgttcctgctgcagcactcgcgccgggcggcccgccgcgacccggccggcgacctggtgccgctggccgagcaggaccggtcccgctgggatcacgcggcgatcgccgaggcggtcgggctgctgaccgcgcatccggtcaccgggccgtacgcgatccaggcgcacctggccgcctgccacgccaccgcgcgtgacttcgcggccaccgactggccgaccgtcgcgggctggtacgaccagttggcccgggtccacccgaccccgatggtggcggtgaaccgcgcggtggcgcacggatacgcgtacggcgcgcaagccggccttgatcttctggccgaggtccggggcgcggtcggcggctatgcgctggccgcagaagcggacctcacggagcgggccggtgaccatcggatggccgccgggctgttccgccgcgccgccgcggcagccacctcggagccggagcgccgcgccctgcgcagacgcgcggaggcgctgggttga

SEQ ID NO: 2415 - DNA, 600 bp, Actinoplanes utahensis
atgccacctcagaaacccatcatcctgtacgtcgtgaagcagccccaccggatccgggagatcgccctccgggccggtctcagcccggccaccgtcgaccgcgtgctgcaccggcgcggcggggtccgggacagcaccgtcgcccgggtccgccgggcggtcgccgaccttgatcgggagtgcgcggagccggacgacttcgcggccggcgccaccgccgcctacctgatcgagcagtggctgcacgaccgggccggtgacgtcctggtgatcgccggtccgggaaccgggaagcggatcgacgggttccggtcggcgctggggcccggccgccggctgcggacggtgaccgatcccggccaggtgccggcgacgctggccggcacacacaccgtccgggcggtctacacggcccggccggacggctgcgccggggtgatcacggcgttcgaggatgccgggcggaattttgacgtgttcgtcgcgcacggcgccgaccaggagattctcgcgctgctgcggcagttccggatcaacgcggtactccgcgacggggcgccgccggaaataatcacgccattcaacgttccggtgtcctga

SEQ ID NO: 2416 - DNA, 849 bp, Actinoplanes utahensis
gtgcgcgtgatctcccgctgggccgacggcggcgtcgaagtcttcgacgagtccctcgagccctgccgatccttcccggttccgcccgaggtcgagggctgggcggtgccggcgagccgggacagcctgatccatgcgatcggcaacacggtgatccggatcggcccgggcgccgaggaacggtggcgctgcgatctcagcctgcgtgaacggccgacggcttggcccagcgccgtcaccctgtccgcggacgagacccggatctgggtctacgccccgggccgggaggacggccacgacgcctggttcgtgctcgacgccggcaccggccgggagatccggcggtaccggctgccgaccggtggccagcgaggacagcagttcccggtccgtgacggcagcatgctgctcagcgtcagccgcggccaggacggctgggcgacctaccgcgccgggccggacggcaccgtgcacgactacgcctgggatgaccgcgccctggtcgacctctcccccgaccagcggcagttcatgaccgtggaccactggcaggaggacgtcgccttccacgacttcgccgatggcgcggtgcgcttccggatcggcgccgaagccttcgggctggaccggccggacgtggaatacgccggcggatatctggacgacgagaccgcgatcgtggtcgccgtcgccgacgacgactcgtggcggcacttccgggtcggtgcccgcaccggagaggtgctgggtgacctgggaatcatgacgatcgacgagtatgacctccagccgctcggcgacgggacctatgtcatcaccgacaccgacggaactctcaggcgcatgtga

SEQ ID NO: 2417 - DNA, 1461 bp, Actinoplanes utahensis
atgagcgacaaacttcgatccgtcaacggtctcgacttcgcgatcgccgacatcaacctggccgaggccggccgccaccagctgcggctggccgagcacgagatgcccggcctgatgtcgctgcgcgccgagttcggtgagtcgaagccgctggccggcgcccggatcgccggttcgctgcacatgaccgtgcagaccgccgtgctgatcgagacgctggtcgcgctcggcgccgaggtccgctgggtgtcctgcaacatcttctcgacgcaggacgaggcggcggccgccgtcgcggtcggcccgaccggcacggtcgacgccccggcgggtgtcccggtgttcgcctggaagggcgagacgctggaggagtactggtgggcgaccacccagctgttcgacttcggcaacggccggggcccgaacatgatcctcgacgacggcggtgacgccaccctgctggtgcacaagggtgtcgagttcgaggcggcgggcgcggtcccgcagaccaccgaggccgactcacacgagtactcgatcatcctggacacgctgcgggcgagcctggccgaggacccgcagcggttcacccggatcgccgccgagatccgcggtgtcaccgaggagaccacgaccggtgtggcccggctgtacaaactggccaaggagggcaccctgctcttcccggcgatcaacgtcaacgacgcggtcaccaagagcaagttcgacaacaagtacggcatccggcactcgctggtcgacggcctgaaccgggcgaccgacgtgatgctgggcggcaagctggccgtggtctgcggttacggcgacgtcggcaagggctcggcggagacgctgcgcggccagggtgcccgcgtcgtggtgaccgaggtcgacccgatctgcgcgctgcaggcggcgatggacggcatgcaggtggtccgcctggaggacgtggtcggcgaggcggacatcttcgtcaccaccaccggcggcaccgacatcatccgggtcgagcacctgcaggcgatgaagcacaacgcgatcgtcggcaatgtcggccacttcgacgacgagatcgacatggccggcctggccaaggtcccgggcgtcgagaaggtggagatcaagccgcaggtgcacgagtggcgcttcccggacggccactcggtgatcatcctgtccgagggccggctgatgaacctgggcaacgccaccggccaccccagcttcgtcatgtcgaactcgttcaccaaccaggtgatggcgcagatcgagctgtggaccaagcccggcgagtacgcgaagcaggtcttcgtgctgccgaagcacctggacgagaaggtcgcgcggctgcacctggacgcgctgggtgtgcgcctgacgacgctgaccaagaagcaggcggagtacctgggcgtcgacgtcgagggtccgttcaagccggagcactaccgctactga

SEQ ID NO: 2418 - DNA, 522 bp, Actinoplanes utahensis
atgcgacgtatcttcaccgccttcggcctgaccgccgcgatgctgctgccgctgaccaccgcgtcagcggcgaaggcggccccggcccgcctcgatccggacgcggccttcctgcgcaccgcccaccagggcgacctcgcccagatcgcgatcggccgactggccgtccagcgctcggcgaacccggtcatccgccacctgggcacgcgcttcgcggcggacagcacccgcctcgacaccgccgtccgggccaccgcccagcgcctgcacgtccgcctggacgccgccccgaacgccaccgtccagcagagtctggcggctttcgaaaccgcgcagggcccggccttcgaccggttgttcctgaccggccagaccggactgcacgcccaggccgcccacctgatccgcgccgaactcaccgatggtgacgagccggccgtccagcagatcgctcgccgcgcgttgccgctgatcaaaaggcatcggctcgccctgaaaaatctgggtaacaagatccgctga

SEQ ID NO: 2419 - DNA, 1641 bp, Actinoplanes utahensis
atgagccacgaggagacccttcttttcggtctggtggccatcacgatcatcgtgatcatcgtggtggtgcgctggatctccgggaagaccggcctgcccgccgccgtcctgctgaccgtcatcggtatcgcctatacccgcctgcccggcaagaacatcgaaatcgatccggatctgattcttaccttcatcctgccgccgctgctctacaccgcggcgctggattcgtctctgctggacatccggcgcaacctgcgcaccgtgatcagcctctcggtggccctggtgatcgtcaccgcgctcctggtcggcctcggtttctccctgtgggtgaccggggtcggcctggccgcgggcatcgccctgggcgccgcggtggccccacccgatccggtcgccgcgctggcggtgggccgcaaggccggcctgcccaccaacctgatcaccctgatccagggcgagggcctgctcaacgacgcgaccgcgctcaccatcctgctggtcgcccgggacgtggcgatcggcgccgagcacttctcggtcaatgccacggtcggccggttcgtgcttgccgcggccggcggggtgctggtcggctgggcggtggcccggctgatccggctgttgcgggtgctgcgcgccgacccgctgaccgcgaacgcgttgtcgctggccaccccgttcctcgcgtacctggccggcgaacgcctgcacgtctccgggctgctggcggtggtggtggccgggttgatcatcgggcacgacaccccgcggtacgcgtccggcgccagccgcctgcagaccagcgccgtctggcggctgatcgacttcctgctggagggtgtcgtcttcctgctgatcggccagcagatggacggcgtgctgaaacatctgaagaactacgagaccagcacgatcctcgccgcgctggcggtcaccctgggcgtggtgctgttcctgcggccgctctggctggtgctcacgcagttgctgccgcggtcgctgcacactcggctgggcggcgaggacgactccgggacgatcctggagaagtcgctgaccggccgcgagtcggcggtgctcagctgggccggcacccgtggggtgatcacgctcgccgccgtctacagcctcccggacaccctgcccaaccgggatctgctggccttctgcgcgttcgcggtggtgctggtgaccctggtcggccagggtctgaccttcgccccgctggtccggtggctgggtctgaaggcgaacgagaccgacaaggcgaagctgcgcaacgaggcccgctcggccgcggtgcgggccgcgctgaaccggatcgacgacatccagagcgagcaccacgaccacgtcgaggacgaggccatgcacaccatgcgcaagcagctgcaggtccgtctggaccgctaccagcaccggctcgacgtgctggaacaggtggacaccccggaggtgccgccgtccccgcagtacgaggcggcgctgatggtgcgccaggcggtgatcgacgccgagcgggaggagttgctgcgctggcgcgacgccggccggctcgacgacgagaacctgcgggtcctcaaccgcgagctggaccacgaggagctggtcctgccccagcggaacaaggggcactga

SEQ ID NO: 2420 - DNA, 1218 bp, Actinoplanes utahensis
gtgggcgccgttcgccgccgccctgctggtcaccctgaccggctgcctgatcgtcggcgtgctggtgaccgtgacgatgatcggcggcgggctgccggtcgccggctcggccgccttcggcgcggtgttcaccctcagcggctggctgttcgccggggtcgcggcgatcgcggcgcaactgaccagcggcgcccgcggtgcccgcaccatcgcggtgctggccctgggcgtctcctacgtgctgcggctcggcggcgacatctcggcgcagggcgacggccggctcggccggctctcctggctctcgccgatcggctgggtgcagcggatcttcccgtacggggcggacgacccctggccgggcctgctcgccctgctcggcaccggcgcgaccgtcgccgtcggcgcccgcctgctggcccgccgcgacctcgggtccggcctgatcgccgaccggctcggcccggcgcacgccgaccgggcgctcggttcgccgttcggcctggcctggcggctgcaccggggccgctgctcggctggaccgccggcttcggcgcgctcgggctggtcttcggcggggtgggcaccagcgtggtgcagctgtcccgggagagcagcggggtcagcgacgtgttcagcaggctcggcggcagcgggacggtcaccgacgcgtacttcgccaccaccgccgggctctgcgggctggtcatctcgctgtacgcggtgcaggccgccctgcggatgcgcgacgaggagcagaccggccacgcggagctgatcctcggcacgcgagcgagccgggtcggctgggctgccggtcacctgctgttcgtgctgctcgggccggtggtcgcgctggccgtcgagggcctgctggccgggctggccttcggtgaaccgggccgggtgccggccgcgtcgctggcccaggcacccgcggtgtgggtgctcggcgcgatcgccgtgctgctggtcggcgcgctgccccggcactccgcggcggcctggggctcggtggcgatctgcctgctggtgctgctggtgggcgggctgctcgggatgccgcagtgggtgctggacatctcgccgttcacgcacgtgccgcagctgcccgcggcggggttcaccgtcgtaccggaaatcgtcctgatcctgatcgccgccctgctgtccggagccgggctgaccgccctgcgccgccgcgacatccccgcctga

SEQ ID NO: 2421 - DNA, 900 bp, Actinoplanes utahensis
atgaccgaggccatcgacgccgccggactgatcaagcggttcgggaaggtcaccgccctcgacgggctcgacctgcgggtccggaccggtgaggtgcacggattcctggggccgaacggggccggcaagaccaccgcgatccgaatcctgctcgggctgacccggctcgacggcggccgggcccggctgctcggcggcgatccgtgggccgacgcgacgacacttcaccggcgcctggcgtacgtgccgggcgacgtcacgttctggcccaacctcaccggcggcgaggtgatcgacctgctcggccggctgcgcggcgggctcgaccgccgtcgtcgcgacgacctggtcgagcgcttccagctcgacccgcggaagaagagccgcacctactccaagggcaaccggcagaaggtcgcgctggtcgccgccctcgcctcggacgtcgagctgctgctgctggacgagccgacctccgggctggacccgctgatggaggaggtgttccgcgaggtgatcctgcaggagaaactgcgcggcgaccggaccgtgctgctgtccagccacatcctggccgaggtcgaggcgctgtgcgaccgggtgacgatcatccgggcgggccgcgccgtggagaccggcaccctggccgacctgcggcacctgacccgcaccacgatccgcgccgagctgaccggcccggtcaacggcctggccgggatcgccggcgtgcacgacctgagcaccgcggacgggcgggtggccttcgacgtcgacgccgaggcactcgaaccggcgctgcggtcgctggtcgcggccggggtacgcagcctggtcagccagccgccgtcgctggaggagctgttcctgcgccactacgcccacgacgaggccgggaaatga

SEQ ID NO: 2422 - DNA, 615 bp, Actinoplanes utahensis
gtgagtagtgacagcgacctgaccgcccgggcccggatccgggacgccgccatccggctcttcgccgagcggggcatcgacggcgccacgatccgggagatcgcgcaggccgccggggtctcctccgggctgttgcggcaccatttcggctccaaggaggggctgcgcgacgcgtgcgacgagtgggccatgagccgcgtcgccgagctgcagatccggttcgccgagacccggatcatcggcgccctcccgccggacaccatgagcctgcagcgctacctggtgcgctcgctgatggacggctcgccggccgggatgaggatgttcgcggagtcggtcgaccgcggtggcctctggctggagcggaccggcatcgacagcgccgacccgcgcgcgttcgtggccgtcgtcgccgccatgaagatgggcatgttcctgatgcacgagcagctcggtgaggtgctcggggagagcgtcagcgagatgcccggctggctgcggatgatccgcgccgccgtggagatcttccagcagccgctgctcaccccggaacaggccgaccaggcgagaaaagcactggatcggctggccacccacgaaggggagcagccatga

SEQ ID NO: 2423 - DNA, 909 bp, Actinoplanes utahensis
atgaacgtcgtccgtcgtgccctgaccgtctccggcctgctggccgtgctggccgcgggcggctgcaccgccgccgcggaggacgccgggaccacggccagcggcctggacctcaccggcgcggtgaccgtcgacggcagcctgcgcgccaagctgccaccggccgtgcgcaaccggggtttcatccggttggtgaccgacgccagctacgcgccgatggagtatttcgccgcggacgggcgcaccatcatcggtttcgagccggacctctccgccgcgctcggcggggtgctgggcatccgggtggagacggtggccggcgacttcgccaccgcgatcgacgaggtggacaaggggacgtacgacggggtgttctcgtcgatgaccgacaccgccgagcgggagaagaaggcggacttcgtcgactacttcagcaccggcacctcgatcctggtgcagcgcgggaacccggaccacatccggaacctggccgatctgtgcggccggacgatcgccgtggagaccggcacgttccaggaggacatgctccggcgccggcagaagggctgcgccggggagccgatgaccatcgacgtgcgcaagaccaacgcggatgcgctggtgcggctgcgcaccgggcgggcggtggccgtgctcaacgacttcccgccggcgtcgtacctggtcagccaggtgaagacgaacctgtactacgagctggcctcggacatgcagtacgagccgggactgttcgggatcgccgtgtccaaggacaactccgcgctgcgggacgcgctgcagggcgccctcgcgcggctgatccggaccggcacgtacggcgagttgctgcagcgctggaacctcggttcgggagcggtgacggaggcgacggtgaacggcgggaattga

SEQ ID NO: 2424 - DNA, 1959 bp, Actinoplanes utahensis
atgcggttgcgccgagtccgacggcgagcaggcgtccggaccagctcccgcctgttcgccacctacgccgctgccagcctgatcccggtgatggtgctgggcgcggtgatgtggcagggctaccgccgggacgccgccgagcagggtcgccggcagggcctggcccaggccgcggtgatcgccgagatggcggtcgccccggcgctcgacggcgccgacctgaatgccggcctgaccggcaccgagctggaggacatgcggctggccacccagttggccctgttcaacgggtcggtgctgcggctgcgggtgcgcggcttcgccggccaggtggtgttctccgacgacggctcgaccggcggcggcgtgccgaccaccgatcccgatttccgggccgccaccgccgggcagtcccgggtgaaggtgatcggcgaccacggcagcgaggtgatccgggtggtgcagccgctggtcgccagcgcctccgggcaggccatcggggtgcttgagttgtacctgccgtaccaggggatcgccgcccagatgcgggcccagctgacccggttcgcccagcgggtggccggcgggctggccgccctctacctcgtgctggcgctgctggccggctggaccacccggtcactcggccggtatgccgcccgccaggagtatcacgccagccacgacatgctgaccggcctgccgaaccgggccgcgtaccgtcggcacgccgaggcgatcctcgaggtggccgcccgcgacggcggccacggcgccgtggtgctgctcgacctcaaccggttcaaggaggtcaacgacaccctgggccaccacgccggcgacgagctgctgcgggtggtgtccgagcggatgcgcgccggcctggccgagggtgacctgctggcccggctcggcggcgacgagttcgcgatgctgctgcccggccgcgacgtcgcccaggcggtcgcggtgctgaccgggatccgtgcccgggtcgccgaggagctggtcctcgacggcgtgccgctgaacatggaggccagcttcggcgtcgcgctgtacccggagcacggcaccgacctgcaggacctgaagatgcgcgcggacgccgcgatgtatcagggcaagcgtggcaccgaggacatcgtggtgtatgccggcggggcgaccgggcacccgcaccagtggctgaagatccaggccgagctgcggcacgcgctggaacgcgacgagctggtgctctggtaccagcccaaggtcggtctgccgagcaccgagatcaacggtgtggaggcgctggtccgctggcagcacccggagcgcgggctgctgccgcccggcgagttcctgccggccgccgaacactccgggctgatcgcgccgctcaccgagtgggtgctgcgccgggcgctggccgaccaggccgggtggaccgccaccgggcgggactggacgctgtcggtcaacgtgtcggcccgcaacctggacgcgcccggcttcgtcggctacgtcgccgcgctgctggccgagaccggtgcccggccggaccggctgatcctggaggtcaccgagaccgcgctggccggcgacgcggacaacgcggtgcgggcggtccgggaactgggcgccctcggtgtcggcatctcggtcgacgacttcggcaccgggtacaccagcctgtcgcacctgcgcgggctgccgatcagcgagatcaaggtggaccgggcgttcgtcgccgacgtggaccacgatccgcagagccaggccatcgtccgctcggtgatcgagctggcgcacggtctgggcagccgggtcaccgccgagggcgtggagaccacggcgatccacgcctggctcgtcgaggccggctgcgacgagggccagggctacctgtacggccgcccggtgccctggccgcaggtcgccgtcgaaccgatcaccgagaggagcctgcgatga

SEQ ID NO: 2425 - DNA, 1146 bp, Actinoplanes utahensis
atgcgtatctctccgcagccgcgactcgtgctcctcgccgccgtcgccctcgtcgcggtgctgctgggctggtcaccggccagggccgcgccggtcggcgcgcggtcgccggagctgccccggttcaacggctcggtctacgcggtcgcgttccgcggcggcatcgtctacgtcggcggcgacttcacggcggcgaccaccgacgggcgccgggtcgggcgacagcggctggccgcgttcgacgcgcgcaccggcgacctgctggactgggcgccgaccgcggaccggacggtgcgggcgctggccgtcgcgggggacgcggtctacgcggccggcgacttcggcacggtgtccggggcggcccgggacgcggtggccatgctcgatgcggactccggcgcggtcggcggcttcgcgcacgagttggacggctatccgcgggcgctggcggtggcgcacggccggctctacctcggtggcgacttcaccgcggtggacggcgcgcagcggacccggctggccgcgttccggatcggcgacggcacgctcgacgacgactggcagccgagtgcggacgcgacggtgtacacgctggccacggcggggcgccgggtgtatctgggcgggagtttccatcgtacgaacgagatgcgctccaccgggcgcctgaccgcggtcgacgccgtcagcggcgacctggtccagggtttccggccgcagccgaccgcggtcgtgtactcggtggcggccgacggccgaggcgtctacgccggtctgggcgggctcggcggccgcgccgaatcgtggaccagcggcggccggctgcgctggtcccgcaccttcgacggggatgtgcaggcggtcgccgcgctggacggcaccgcctacgtcggcggtcacttcgaccgggcctgcaccagtgcgaacgtcgacaagttcggcgactgctcggacgactcccggtcccgggtgaagctggccgcgatcgacgccgacggcgacctgtccgactgggcgccgcaggccaacggcgtgcacggggtccgcgcgatcgccgccagccgggccctcggcgccctcgcggtgggcggcgacttcaccatggtcggtggcgccacccaccaccggatcgccaccttccattga

SEQ ID NO: 2426 - DNA, 762 bp, Actinoplanes utahensis
atgacgacaccggtcttggcggcgaacgggctgaccaaacgctacgggcgggtggtggcgatcgacggcagcgacctggagctgctgccgggcgagatcctcgccgtgatcggggacaacggggccggcaagtccagcctgatcaaggcgctctccggggcgctgatcccggacagcggggagatccgcctggacgggcagccggtgcagttccgcaacccgatggaggcgcggtcggccgggatcgagaccgtctaccagaccttggcggtcgctccggggctggacatcgcggacaatctgttcctcgggcgcgaggagcggcgggccggcccactgggatcgatcttccggatgctggaccggcggaggatgcgcgaggaggccgcccggcacatgagcgagctcggggtggcgaccctgcagaacatcgggcaggccgtcgagtcactctccggcgggcagcggcaggcggtggcggtggcccgggccgcggcgttcggcagcaaggtggtgatcctcgacgagccgaccgcggcgctcggcgtcaaggagggcaaccgggtgctgcagttgatccgggatgtccgggaccgcgggctgccggtgatcctgatcagtcacaacatgccgcacgtgttcgaggtggccgaccggatccacatccagcggctcggccggcggatcgcggtgatcacgccggcctcgcactcgatgtcggacgcggtggccatcatgaccggggcggccccggcctcctga

SEQ ID NO: 2427 - DNA, 1014 bp, Actinoplanes utahensis
atgtcgaccacggccactgacttcgacgtacgaaagcatgattcgctgggtctgcgggtgcagcacacgctgcacggcaacccggtgctcggcccgctcgccgtcctgattctggcgatcgtcgccttctccatcgtgaacacccgattcttcgccgcggcgaatctgtcgctggtcctgctgcaggtcaccgtgatcgcgacgctcgcactcgggcagacgctgatcatcctgaccgccggcatcgacctgtcagcgggggcgatcgcggtcttctcgtcgatcctgatggcgcaattctgcgtcaaggccgggatgcccggcctgatcgcgctgctgctgggcctggcctgcggcaccgcgatgggcgcgatcaacgggatgctggtcacccggatcaaactgccgccgttcatcgtcacgctcggcacgctgaccatcttcttctccctgaactcggtggtcagcaacagtgaaacggtccgtggatcggacatgccgcacctgatgacgtggaccggggacgccatcgcgatcgggaacttccaactgacgtacggctccatcctgatgctgttgctcttcgcctatttctattacgcgctggggcggacagcgtggggccggcacgtctatgccaccggcgacgacgccgaggcggcccggctcgccggcatccgcaccggccgggtgctgttctcggtctacacggtggccgggctgctctacgcggtcggcggctggatcctgatcggacggctcgcctcggccagcccgaacgtcggcaccgagtacaacctggactcgatcaccgcggtcgtgctcggcgggaccagcctcttcggcgggcgcggcggggtgatcgggacgctgatcggcgcgctgatcgtcggcgtcttccgcaacgggctgcaactggccggcgtcgaggtggtctggcagggcttcgccatcggcctgctggtcctggtcgccgtgtcgctggaccagtggatcaggaaggtcaaatcatga

SEQ ID NO: 2428 - DNA, 1023 bp, Actinoplanes utahensis
atgcgcaggctgatggcggtcgcggggtgcgtgacgctggtgctcgccggcgcggcctgcaaccgcggctcgggcgacccggtggtcgggctgatcaccaagaccgacacgaacccgttcttcgtcaccatgaaacacggcgcgcagcacgccgcccagcagcagggtgtcgacctgcagaccttcgccggcaaggtggacggtgacaacgaggcgcaggtccaggccatcgaaaaccttatttcgtacggggccagaggcttcctgatcaccccgaacgactcgaaagccatcgtgccgtcgctggaccgggcgcacaaagcgcacatgctggtcatcgcgctggacaccccggtcgacccggcgaacgccgcagacgccaccttcgccaccgacaactaccaggccggcaagctgatcggccagtgggccaaggcgaagttcgccaaggacggcaagccggcgaagatcgcgatgctcgacctcaaccccaaccaggtctccgtcgacgtcaagcgtgaccagggcttcctcgacggattcggcgtcccggtcggcgacccgaaccggatcggcgacgagaacgacccgcgcatcgccgggcacgacgtcaccgacggcaacgaggacggcggccggacggcgatggagaacctgctgcagcgggatccggcgatcaacctggtctacacgatcaacgagccggcggcggccggggcgtatcaggcgctcaaggcggccggcagggagaaggacgtcaccatcgtctcgatcgacggcggctgcccgggcgtcgacaacgtcgccggacaggtgatcggggcgacctcgatgcagttcccgatcaagatggccgagctcggcgtggaggcgatcgcgaaatacgccaaggacggcacgaaaccgcagaacaccgccgggaaggacttcatcgacaccggcgtgcaactgatcaccgacgacccgcaggccggcgtggaggccaaggactccgcgtggggcaagcagaactgctgggggtga

SEQ ID NO: 2429 - DNA, 2187 bp, Actinoplanes utahensis
atgagacgctcccgctggcggagcggcgcgatcgtcggcctcacggccgcggtcgtcgccggttatgccgcgatcaccatgaccggcgcatcggctgccgagacgctgctgtcgcagggcaggcccgcgaccgcgtcgtcgaccgaggcggccggcgcctacctcgcctcggaagccgtcgacggcaacaccggcacccgctggtcgtccgcgttctccgacccgcagtggctgcaggtcgacctgggcagcacccaggcgatcacccgggtcgagctgaactgggagaccgcggccgccaaggcgttccagatccaggtgtcggacaacgccgccgcctggaccccgatctactcgacgaccacctcgaccggggggaaccagtcgctgacggtgaacggttccggtcgctacgtccggatgtacggcacccagcggaccaccggctacggctactcgctgtgggagttcaaggtgtacggcggtggcgtcgtcaccccgaccccgtcgaccaccccgagcgggccggccctgcccggtggtggcagcctcggcgcccaggtcaccgtcttcgacccgaccatgtcgagcgcgacgatccaggcccgggcggatgcgatcttcaagcagcaggagaccaaccagttcggcacccagcgcaacctgctggcgttcaagccgggcacctacaacggcctgaacatccaggtcggcttcaacacctcggtgatcggtctcggtcagaacccggacgatgtccggatcaacggtgacatcaccgtggacgccggctggttcaacggcaacgccacccagaacttctggcgctcggtcgagaacatgtcgctgtacccggtctccggcgccgaccggtgggcggtctcgcaggcggccccgttccgccggatggacgtacacggtgacctgaacctggcgccgaacggctacggctgggcgtccggcggctacatcgccgacacccggatcagcggcgtcgagggtcagtactcgcagcagcagtggttcacccgcaacagccggatcggctcgaactccaacgcggtgtggaaccagaccttcgtcggcgtgcagggcgccccggcgcagagcttcccgaacccgccgtacaccacgatcggcaccgccccggtgatccgggagaagccgtacctgtacctcgacggcagcgactacgccgtcttcgtgcccagcctgtcgaccaactcgtccggtgtgagctgggcgaacggcaacaccccggggaccagcatcccgctgaaccagttctacgtggcgaagccgggcgacagcgcggcgacgatcaaccaggcgctggcgcagggcctgaacctgatcttccagccgggtgtgtaccacgtgaaccagacgatcaccgtgaaccgggcgaacaccgtggtgctcggcctcggctacgccaccatcatcccggacaacggggtcaccccgctgcaggtggccgatgtggacggtgtgaaggtggccggcctgctcttcgacgcgggcaccaccaactcggcgaacctgctggtgatcggcccgaacgggagcagcgcgaaccacgcggcgaacccgaccacggtgcaggacgtgttcttccggatcggcggctcgatcgccggtaaggccaccaacagcctgctggtgaacagcaacaacacgatcatcgaccacatctgggcgtggcgcgccgaccacggcaacgccggcacctacggctggaccgtcaacacggccgacagcggcctgatcgtgaacggtcagaacgtgaccgcgtacggcctgttcgtcgagcattaccagaagtatgaggtggtgtggaacggcaacggcggtaggacctacttcctgcagaacgagcagccgtacgacccgccgtcccaggcggcctggcgcagcggcgccaacggttacgccgcgtacaaggtggccgactcggtgaccagtcacgaggcgtggggcctgggcagttactgcaacttcaccgcggactccaccatccactcgaacaacggcttcgaggtcccggtgaactccggggtcaggatgcacgacctgctgaccgtctcgctcggcggggccggcgtgatcgaccacgtcatcaacaacaccggcgccgcggcgcagggcaccgcgaccgtcccggtctatctggccagcttcaactaa

SEQ ID NO: 2430 - DNA, 1431 bp, Actinoplanes utahensis
atgtctgacgctgaactcaacgccgaatctgttgcattccgctccgccctcgaggtggtccggtcggtggagccgcggatcgccgacgcgatcgccaaggagctgaccgatcagcgggagtcgctgaagctgatcgccagcgagaactacgcctcgccggccgttctgctcgccatgggcaactggctgtccgacaagtacgccgagggcaccatcgggcgccggttctatgccggctgccagaacgtggacaccgtcgagtcggtggccgtcgagcacgccaaggcgctgttcggggcgccgtacgcgtacgtgcagccgcactccggcatcgacgcgaacctggtggcgtactgggcgatcctcgccgaccgggtcgaggtgccgtacctgaagaagttcgagaagcggcagatcaacgacctgaccgacgccgagtgggccgagctgcggcaggcgttcggcaaccagcggctgctcggcatgtcgctggacgccggcgggcacctcacccacggcttccggcccaacatctccggcaagatgttcgaccagcggtcgtacggggtggacccggccaccgggcagatcgactatgccgcgctgctggagaccgccaaggagttcaagccgacggtcatcgtcggcggctactcggcgtacccccgcaaggtgaacttcgcgaagatgcgggagatcgccgacgcggtgggcgcgaccttcatggtcgacatggcgcacttcgccggcctggtcgcgggtggcgtgtttaccggcgactacaacccgatcccgcacgcgcacatcgtcaccacgaccacccacaagagcctgcgcggcccgcgcggcggcgccgtgttctgccagccggaactctcctcgcaggtcgaccggggctgcccgatggtcctcggcggcccgctcccgcacgtgatggcggccaaggcgatcgcgttcgctgaggcgcggcggccggagttcgcgacgtacgcccagcagatcgtcaccaacagccaggcgctggccgagggtctgcgccggcgcggcgtccagctggtctccggcggcaccgacaaccacctggtgctgctcgacgtgcacccgttcgggctcaccgggcggcaggccgagcaggcgctgctggacagcggcatcgtcaccaaccgcaacgccattccgtccgacccgaacggcgcctggtacacctccggcatccgggtcggcaccccggccctgaccagccggggcctcggcgtcgccgagatggaccagatcgccgagctgatccacaccgtgctggccggcaccacccccgacccgacgtcgaaggccaagttcaccctcgacccggcgctctccgaaagtatctccaagcaggcgtccgagctgctctcgccgttcccgctctacccgtcggtcaacctgggctga

SEQ ID NO: 2431 - DNA, 375 bp, Actinoplanes utahensis
atgacaccggtgctgatccggcagtggtccctgggtgacgccgatgagctgcgcgttctccgcagagggctgcgggcggagatcggcgacggagagctcttcgagcggatggccgtggtcggcaccgagctggccaccaacgcattgcgccacggctgcccgccggtgacggtgcggctgctggccgagccggcacggctgaccctcgacgtgtccgacggtgatccggcgagcgagccgctgttcggcacccgccggccgttcggtgcgggcgggctggggctgctactggtgcggaccttcgcgcgggacagcggttggtatcgacggggcgcgagcaagcacgtctgggcggtattcgatcatcgggcctga

SEQ ID NO: 2432 - DNA, 813 bp, Actinoplanes utahensis
atgaccgtcacacagacttcgacgaccgtcgaccggtcgacggtgaccagcgccgaaagccccgtggacagtgccgcggaactgctcaacgcgatggccgcgatgcccgccgggcacccgtcccgggccgcgctgcgcgaccgggcgatcgaggcctggctgccgctggcccgccacctcgccaaccgctacgccggccgcggcgaaccgaccgacgacctgatccagaccgccaccgtcggcctgatcaaggccgtcgacaagttcgacccggagcgcggcgtcgacttcgccggctacgccatccccaccatcatcggcgagatcaagcgccacttccgcgaccgcacctggtcggtccgcgttccgcgccggctgcaggagctccgcctcgccatcaccgaggccaacgcgaccctgacccactccctcggccgttcgccgacggtgccggacatcgccacccacctcggcatcagcgaggaggaggtgctggagggcctggagggcgcccgcgcctacaacgcgacgtcgctgtccaccccgatcagcgcggacggcaccaccgagctgggcgagacgctgggcggcgaggaccacgagttcgagctggccgagacccgggtggcgctggctccggcgctggccatgctggacgagcgcgagcagcggatcctgacgctgcgcttctacggcaacctgacccagtcgcagatcgccgaccagatcggcatctcccagatgcacgtctcccgcctgctgaccaaggcgctggtgaagctgcgcggccagctggccgccgagacgctctga

SEQ ID NO: 2433 - DNA, 669 bp, Actinoplanes utahensis
atgccaccttcagccgagcttcccgggttcctccacagcgtcgcgccaattctggaccgctggggatatctggccctcgccggcgtcatcggggtggagagcttcggcgtgccggcccccggtcagacgatcatggtggccgccgcgatctatgccggcgccggccggatgaacatctacgtggtcgccctgatctgtttcgtggccgcggtgctcggcgacaacatcggttactggatcgggttgcgcggcggccgtgcggtggtcaaccggttcgggcgctacatcttcgtcaccccggagcggctggagaaggcggagcagttcttcgcccggcggggcaaccggatcatcgtggtggcccggttcatcgacgggctgcggcagctcaacggcgtgatcgccgggatcacccggatgccgtggcggacgttcctgctgtacaacgcgatcggcgcggcgctctgggtcggctggtggaccacggtgtcgtacctgctgggccagaacctggtgaccatcatcgaccaggcgcaccggtacaagtggccggcgatcgcgctggtggtgctggccgtggcgacctatgtggcgctgcacgtgcggcacatccggcgccggcgcgcccgggccgcggcagcgcagccgcccggcgagaaacccgtgtga

SEQ ID NO: 2434 - DNA, 831 bp, Actinoplanes utahensis
gtgcgaaggttcagcttcgcgggacgtacctgcgtgatcaccggcgcggccggcggcatcggcgcggcgctcgcgctcgaactggcccgccgccggtcggtgctggtcctggtcgacaaggatgcggagggcctggagcgggtcgccgggctggcgcgtgacctcggcgtttcgggcgtcacgacgtacaccgtcgatctgggtgacggcgaggaccgcctggacctcgcggccgaagtctcgtcgcgcctcggcggcgcggatcttctgatcaacaacgccggcgtcaccctttccggcactttcgagcagaaccggctggccgacgtcgagtggctgctggagatcaacctgcacgcggtgatccggatgaccaaggccttcctgccgcagctgctggcccggccgggttcgcacctggtcaacatctccagcctcttcggcctgatcgctccgccgggccaggtggcctacgcgacgagcaaattcgcggtacgcggtttcaccgagtcgttgcgccacgagctcacgccgcgcggggtcggggtgaccgtggtgcacccgggcggggtgcgcaccggcatcgccctgaacgcgcggctcagtggccccgacccggatggtgagcaggccgcgcagaacaggaacttccacgaacgggcgctgaccctgcccccggaggaggcggcccggcagatcgtcgccgcggtgcagtcccgccgcccgcgtctggtgatcacccgggaggcgcgcgccgctgacctgctggtccggctgttaccggcctcgtactggtcgctcagccagcgggtcgcgcgtcgtttcgactga

SEQ ID NO: 2435 - DNA, 1461 bp, Actinoplanes utahensis
gtgctgcgctgggcgatccgggccggcaacctgccggtgctcgggaactggctgcgcagtggcagccacagcctgcggccgtggcacaccgggctgccgtcgaccaccccggcgtcgcaggccggcatcctgcacggcgcgtcccggcagatcccggcgttccgctggttcgagaaggagaccggcaaggtgatggtctccaaccggccgcgggatgccgcggtgatcgaacgccggctcagcgacgggcacgggctgctccgcgacggcggggtcagcatcagcaacgcgttcggcggggacgccgtcaccaacctgctgacgatcagtcacgcggcgctgcccgggcggtcggcacggggctgggcggcgttcatggcctcgccgtacggcttcacccgggccctggtcctcggcgtcgccgaggtcttcaccgagctgcaccaggcccgcctgcagcgccgccggaacgtgcagccgcgggtcagccgctccggcgcctacctcgcgctgcgcccggccgccatgctgctgcgcgacgtgaacatctcgctggtcgccgagcagatggcccgcggcgtcccggtcgtctactgcgacctggtcgactacgacgaggtggcgcaccacgccggcccggcccggccggagtcgatgcgccagctggagagcctggaccggatgctcggcgtgctggaacgactctcgcccgaggcggcccggcgataccacctcgtggtgctctccgaccacgggcagagccagggcgccaccttccggcagcggcacggcgaaaccctcgacgaggtggtggaacggctcaccagcgagccggccgccgcaccccgggagtccgatccggcgccgatcgccgccccgctgctggtgctctcctccgggaacctgtcgctggtctatctggcccggctcccgcaccgggtgctccgggccgagatcgaacagcggtatccgcggctgatcgccggcctggccgcacaccccggggtcggtctggtgatcgtgggcgacgagcacgggccgatcgctttcggtcccggtggcagccaccggctgcgcgacggcaagatcgacggcaaagatccattattgccgtacggtcgtcacgcgcgcgccgacctgctgcggcaccaggagtcggcgcacctgggcgacctcgtggtgatcagctcggtcgacccggagaccgacgaggtggccgcgttcgaggagctcgtcggctcgcacggtggactcggcggctggcagaccgacgcgatgctggtccacccggccgcctggccgatcaccgcggacctgcacgggccggacgcggtgcaccgtcagctcatcgagtggctggtcatgctcgggctccgcgaacaggtcaccccggcgctctccggcatctcagtcgaaacgacgcgcgacccgctggctgagcgaccagtacgaggccggtaa

SEQ ID NO: 2436 - DNA, 1623 bp, Actinoplanes utahensis
atgaccgcgaggatggccgcggtgaccaggctgggcaggccgttgatccggctcgccgggtccagttcgagggcgaccaccatcaccatgacctgggcgatcacgccggacagcatggcgccccagccgcccagcgcggtgatcccgagcagcagcagcgggcgcagcaccgcgcccaccacggcgaccagcaccaccaggccgagcgtgtcgacgatgtcggcgccggccacgccgggcatcagccacagcgtcacggtcaccacgacgaaggtggtgaccgcgctgcgcagcacgccgcgggcccggcccagcactcggcgccaggtgaacagggcacgcacctcggggctcagtggcacgccctcgacgatttcacagccggacacggaccgcgtgtccgcaccctttcggaggagttcggctagcttcgggacggtgcgtgtgcgctcagtactgatgatcccgttcgtcctgatcatggcggcttgtcaagcccccgagaaggcggaccccgccccgcccgtgtcccgggtggtggccggctatttcaccgaatggggcgcctacgggcgcggctaccgggtgaagaatctggtgagcagtggagccgccgggcggctcacccatctgctgtacgccttcggcaaggtggacggtggccggtgcggggtgggcgacccgtacgcggcctacgagaagccgatcgccgcgacggacagcgtcgacggcgcagccgacgcgcccaccgccccgttgcgcggcaacttcgggcagctcaagaagctgaaggcgacccacccggggctgaagatcctgtggtcgttcggcgggtggacgtggtcggccgggttcacccaggcggcccgcgacccggccgcgttcgccaagtcctgccacgacctggtcaccgacccgcgctgggccggcgtgttcgacggcatcgacatcgactgggagtacccgaacgcctgcggtctgcagtgcgacaccagcgggcgcgaggccctggccaaggtgctggccgcgctccgcacggcattcggcgcgggtacgccggtgaccgccgccgtccccggcgacctgaagaagttgcaggcggtcgactactcggcggcggccgcgcaggccacctggctcagtgcgatgacgtacgactatttcggcgccggaaccgccgacaagcagaccgcgccgcattcgccgctgaccggctacccgggcatcccgcgccccggcgcgaccaccgacgcgaccgtgacccagctcctcaaccagggggtgccgccggcgaagctgctgttcggggtcggcttctacgggcggggctggaccggggtgcgcagtcccgcgccgggtgggcgggcgaccggcccggcgcccggcacctacgagaagggcatggaggactaccgggtgctggccgggcgatgcccgccgaccggaacggtgggcggcaccgcgtacgcccgatgcggggtgcagtggtggtcctacgacactccggacaccattcgcgggaaggtcaactatgcgcgcgagcggggactggccggcgtcttcgcctgggagctgtccggtgacaccccggacggccggctgctcaccgccctggccggctga

SEQ ID NO: 2437 - DNA, 1008 bp, Actinoplanes utahensis
atgccagctcggcatcgtcaccgagggtcacgaccacctgcggcccagcgccgacatccggcacgtcgacgaccagctgcgggccaacttcacctgcgcgctcccgtcgacctgcaccgaccaggagctgatgcgccgcgcggtgtccgaggtgcgcaccatgttcgaggtgatccgggccgccatggcgctgcccgcgctgcccccggacccggagccggcggacccgccgagcggctccggcgacctgccggtgaccgaacgaccgctcacctcggtgccccgcgaactggagcacgaggggtacctgacgctcacccaggtacagaacttcttcggctgaccggggctgacggtatgcttccgccgccggttccggtcatgatcgtccggtacgacttcgacgcaccgggcctcactcgggacacctccggcttcggccacacgctgcggatcgtcaccgcccgcggcggccggatccgcaccgtggtccacggcaccggcaccgccctggccttcccggcccgctgcgacaccggcccctgcccgcacgtggcactgcagagccccggcaccgcggatctcaacccgggattgcggaatctggcgtacggcgcggacgtcctgctcgcacccggacagaccagcaagggtgagaacgtcgtgcagaagggctactcgaaaaccagcagccagtacaaactgcaggtggacggcatggccggggcgcccagctgtgtgctggtcgacgtccggcgccccggcctgatccggatggtgcgcagctcggtgaccgccgccgacggccgctggcatgccgtccggtgtgagcgggccggcagccgcttcgagatctatgtggacgatgtgctgcgcggccggacccggatcccggccgatctggaggtggccaacgaccggccgctgagcatcggcggtaagggtgccttccgggacaacgaccagttcaacggcgtactcgacaatgtctgggtccggatcggctag

SEQ ID NO: 2438 - DNA, 438 bp, Actinoplanes utahensis
ttgacggtgcgcatcccggacgaggacgcggccatcgcgaccgctttcgaacatctctacgcgggtctccgccggatcaccccccgggaggagctcagcctcaccgccgcctccaccctggcccggctggaacgctccggcccgcaccggctctgcgagctgcacgcgccggagggcgtcagccaaccggcgatgacccagctggtcacccgtctggagcgggagggcctggccacccggcgcagcgacccggcggacggccgggcggtggtggtgaccatcaccgacgacggccgggcggccgtcacccggcgccgggccgggcgcgcggaggcactctccgacctgctgcgccagctgacggccgaggaccgggcggcgatcaccgccgcgctaccggccctcggccggctgaatgacctgctcacgaaggactga

SEQ ID NO: 2439 - DNA, 1800 bp, Actinoplanes utahensis
atgctccccgtcgaccatccgcgctacaagtgggtcgcgctctccaacaccaccctcggcaacctgctcgcgacgatcaactcgtcgatcgtgctgatctcgctgcccgccatcttcaagggcatcaagatcaacccgctggctccgggcaacgtcagctacctgctgtggatgctgatgggctacatgctggtcaccgcggtcctggtggtcaccctcggccggctcggcgacatgtacggccgggtgaagatctacaacgccggcttcgcgatcttcgcggtcgtctcgatcatcctgtcgatcgacccgttcaccggcagcggcggcgcaatctggctgatcggctggcgggtgctgcaggcgatcggcggcgcgatgctgatggccaactcggcggcgatcatcaccgacgccttcccgccccggcagcgcggcatggcgctcggcgtcaacatcgtctcggcgctggccggctcgttcatcggcctggtcgccggcggcgtgctcgccgaatgggactggcgctcggtcttctgggtgaacatcccgctcggcgtgatcggcgcgatctgggcgtaccggtcgctgcacgacaccggggtccgccggcacgccaccatcgactggtggggcaacgccaccttcgcgatcggcctcaccgcggtcctggtcggcatcacctacggcatccagccctacggcgggcacacccagggctggaccaacccgtgggtgctcaccggcctgatcggcggcgccgtcgtgctgatcatcttcgggatcatcgagacccgggtcgccgaaccgatgttccccctcaagctgttccgcaacgccgccttcaccggcggcaacgtcgccaacctgctggccagcgtcgcccgcggcggcctgcagttcatgctgatcatctggctgcagggcatctggctgccgctgcacggctacgactacgagcgcaccccgctctgggccggcatcttcctggtcccgatgaccatcggcttcctggccgccggcccgctctccggtttcctctccgaccggtacggcgcccgcccgttcgccgcgggcggcctgctcgtgatggccgcgtccttcgccggtctgctgctcatccccggcgacttcagctacccggtcttcgccctgctgatcttcatcaacggcctgggcggcggcctgttctccgcacccaacacgtcgctgctgatgtccacggtcccggccaacatgcgcggcgccgcctccgggatgcgggccaccttcatgaacgccgggcaggtgctctccatcggcgtgttcttctcgctgatggtggccgggctcgccgactccctgccggccagcctgcacgccgggctgaccgcccagggcgttccggccgacgtcgcgacccgggccgccggcctgcccccggtcggcaccctgttcgcggcgttcctcggctacaacccgatcgccgaactcctcggcccgcagaccctggccgcgctcccggccggcaacgcgcagaacctgaccggcctggaattcttcccccggctgatcgccgaccccttccacgacggcctggtcgtcgtcttctggatggcgatcggcatggccgtgctcggcgcgctggcctcgctgatccgccctcagcccgaatcgagcctgcccaccgacggcgccgccgacggccccgacctggtggcgcacgaggccgaactcagcgctgaactcgccgaagcccagccgctccagccggcgacccggatgccggaaccgcgggaagaccccgcgacccgggactga

SEQ ID NO: 2440 - DNA, 714 bp, Actinoplanes utahensis
atgaccgacctggcaccaaccgcaccacccccgtatcccggggccgccgagcgtccgttcgccgacccggccgacccggcgatcgcccgggccgccgcactgttcgagaacatgcagccggccgaggccgccgcggcgctggaaccggtgctcgcggccaatccggagtcacccgccggatggatcctgatggcccgcatccggctggccctcgaccaggtggaaccggcgttcgccgccgcgcaccgggcgatcgagcaggcgcccgaggatccgcgtccgctggccatcgccagccgcgccctgaccctgcagggcaagcacgacgaggcgatgtcgatggcgtaccgcgcggtcatcgtcgaacccaagaaccccctctggcacgaccgggtggcgtgggcgctgctcgccgcggaccggcagctggccgacgcggaacaggcggcgcgtacggcgatcgggctggacccgaacgaagcccactactacttcacgcacggggtggcgctggccgcgttggggcacgtggaccaggcccggcaggcgttgaccacctcgctgcggctggaaccgaacaatccggtggcccgccagcgcctggacatcctgaacggcgacgcggccccggtggtggagaagaagaagcgtggctggaaactcttcggccgcaagggcgactccgtgccgatccgcccggaggaacgcacctga

SEQ ID NO: 2441 - DNA, 1041 bp, Actinoplanes utahensis
gtgaccaccgcccagccgatcgcgatggcccgcctgcagttgcagcggggcgaggcgcaagcggccgccgaactgctggggccggtgctggccgccgaacccgaccacgtgaccgcgctggtcctgatgacccacgcgcagctcgcgctggagaaaccggacctggcgcacgaggtcgcggcccgggcggtgcggtacgcgcccggttcggcggaggcgctgaccgcgctcagccgcaccctgaccgcgctggggcggcacgacgaggcgatcgcgacggcgcaggcggcgacggctcggcagccggagaacccgtaccggcacaaccggctcgcctgggcgctgctcgaacagggtctgcggccggtcgaggcggaacacgccgcccgcgaggcggtgcggctcgacccggacgaggcggacttccggatcacgtacgccatggtcatgaagcagttgaatctgccggagcgcgcgcgggaggcgttgcgggacgcgttgcggatcgcgccggacaatgcgatcgcccggcacgaactggccgctttcgacgtggtgcaccgcaacccgttcgcgctgcgccggctggcccgcggggtgaccgggctggtggcggcactgcgggcggatccgcgtcaggaggcgagccggcatctgctggacgccgcgctgcgacagttcctgacgtacgcggcggtcatgatgggggtgttcgcctacctcgggtggcgcgtggcgggggagtccgccccgtgggcccgggtgctcgccggcgcggctttcctggtgcccgcggcgtacgcgagctatttcgtcgcccggctggaccgggtgctgaaaacgtacctccgggaggtcgtcaatcggcatcgggccgcgagcgtcgccgcggccgtgaccctcgccctgctgctcaccgcgaccgtcgcgccggccgcctggctgccggccctgctcggcctcgcctgcctcgccggtttcatcgtccggctgttgagcctgaccgttaacttaagaaatcgtcgccgcccgccgaagtga

SEQ ID NO: 2442 - DNA, 696 bp, Actinoplanes utahensis
atggttcggttcgtcgagctcagccacgtgatccgggacggcatggtcacctatccgggcctgcccgccccgcggtacgccgagcacctgagtcgcgtcgagtcccgggaccggtacgcgccgggcaccgagttcgccatcgaccggatcaccatggtcggcaacaccgggacgtatctggacagccccttccaccggtacgccgacggcaccgacctggccggcctgcccctggagcggctggccggcctgcccacggtcgtggtgcgcgcggccggcggcccggcgcgcgggatcaccgccgcccaggtggccggcctgccggtggccggtcacgcggtgctgctgcacaccggcggcgaccggcactgggccacccgggactacgcggtcgacgcgccctatctgaccggggaggccgcgcgggccctggtcgacggcggcgcggtgctggtcggcatcgacgcggtcaacatcgacgacatctccgccgaggcccgcggcgaacgcccggcgcacagcctgctgctggccgccgggatcccgatcgtcgaacacctgaccaacctggcggccctgccggtgcacggcgcccagttcaccgcggtgccgccccggctggccggcttcggcacgttcccggtccgcgcgttcgccaccgtcccgatcgtgcccgggccgcgggagcaggggtga

SEQ ID NO: 2443 - DNA, 588 bp, Actinoplanes utahensis
atgtcaggtttcgccgccgcgctgggtctcagtttcgcggtcatcttcgtcgccgagctcggcgacaagtcacagctcatggcgatgaccttcgccacccgtttccggccgttgccggtgctgatcgggatcaccgtggccaccgccctggtccacctggtctcggtcggcatcggctacggtctcggcgcggccctgcccacccactggatctcgctggtggcgggtatcgcgttcctcgcgttcggcgcctggacactgcgcggcgacaagctcaccgacgaggagaagtcgaaggcggaacgctcgaccggttccgcgatcctcgccgtcggtggcgcgttcttcctcgccgagctcggcgacaagacgatgctggcgacgatcacgctggccacccagcacggctggttcggcacctgggtcggttcgacgatcggcatggtggccgcggacgcgctcgcgatcctggtgggccggctgctcggccggcacctgccggagcacatcatcaagtggggcgccgcggcactgttcgctatcttcggcatctggctgatcgtcgagggtgtcgtcggcctttcatag

SEQ ID NO: 2444 - DNA, 1881 bp, Actinoplanes utahensis
atgaagagaatctgggcggccgccattgtggtcgcgctcggtgcggccggcaccgcgaccacctctgcgcaggccgctctgccgcacggcgcgccgaatggcgggcaggcggcttcgcctgatggcgtggcgggaaacaagcaggtgacctcgtcgggcggcgctgcgagcggcgggtcggctgcttcgtcgggcggcgctgcgagcggcgggtcggctgcttcgccgggtggtgctgcgagcggcgggtcggctgcttcgccgggtggtgctgcgagcggcgggtcggctgcttcgctgggcggcgctgtaggcgatggaactgcggcgcagccaggcggcgctgcgggtggtggggtggcgggtctgcggcgggggacgccgaactacacaccgaccgcgattgtctggaatgcctgtacggagttgtcgctgaaggctcaaggagccgaatgcggcatggtcagcgtgccgatggattacgacaatccgggcgggaccaagatcgagctggcggtggcccgggtcaagcacaccgttccggccgctcagtatcaaggggtgatgctggtcaacccgggcggcccggggggtgcggggcggggcatggcgacgctcggcgcgaaggtgcccaacgacgtcggggacgcctacgactggatcgggttcgatccgcgcggcgtgggggccagcaagccgaagctgacctgtgacagtgcctatgccggctatcgccggccggcctacgtgccggtgaccgcggcgctggaggactcctggcatcggcgggccacgaagtatgccgcggactgcgccaaggcgggcgggccgctgctggatcacatgcgcaccgaggactcggtgcgggacatggacagcatccgtaaagcgctcggcgccgacaaaatcaacttctacggcttctcgtacgggacctatctgggccaggtttacgccacccagttcccggaccgggtgcgccggatggtcctggacgggaacgtcaacccgacccgagtctggtaccagtcgaacatcgaccaggacatcgccttcgaccggaacatcaagatctacttcgggtggctggcgaagaacgacaagtcctaccacctggggcggaccgccaaggacgtcgaggcgctgtattaccggcagctcgccgagctgaccaggaaaccggccggcggggtgatcgggccggccgaactgaccgacatcttcctgcagccgggctactacatcttcggctgggagtcggtgggacgcgccttctccaactgggtcgtcaagaaggatccggccggactgaagaagctctacgacgacaacaacccccagacggcgggcgccgacaacaactacgcggtctacctggccgtgcagtgcaccgacgcgccgtggccggcgaagtgggcggactggtcccaggacaactggaaggtgtaccaccaggcgccgttcgagacctggggcaacgcctggtacaacgcgccgtgccggcactgggcggcgaaaccggaccggccggtgcgggtggacggcagcaaggccccgccgattctgctgctcagcgagacgctggacgcggccaccccgtacacgggaagtctggaggttcgacggatcttcccccggtccgtgctggtcgagggcgtgaacgggacgacgcacgccgggtcgctgttcggtgactcgtgtgtcgacgacacggtcgccgcctatctgggcaccggggcgctgccggcccgggtgtccggcaaccactcggacaagcagtgcaagccgctgcagccgccgacgccgggcaagccgccgttgcagcgctccgggcagctgtcggaccgcctccggctccagcagctgatcaacaggcggtag

SEQ ID NO: 2445 - DNA, 201 bp, Actinoplanes utahensis
gtgctcgcgatgggtctgtgtgtttgccgtcgattctgcggtcgcggtgggttccgggtgggcgccgggctgaccgggcagctcagccggtgctgtgagctgcccgggtggcgcgcagggggcggccgggtctgcgctgtttcggtggttccggggttgggcggccggttgctgaccggtgctgccgaccgcgtcggctga

SEQ ID NO: 2446 - DNA, 1227 bp, Actinoplanes utahensis
atgaccaccgcaaccgcacgacagcccgccccgacggtcgtcccggcccgcctgagccggcccgccgcgttcaccgcgatcgccgccatcctggtgacattcgcggcggcgtccgccgtcccgtccccgctctacgtcgtctatcagcatctctggggcttctccccggcgatgctcacggtggtcttcgccgtctacgtggtcgccctgatcgccaccctgctcaccctcggcgcgctgtccgactacatcggccgccgcccggtgctggccggcgcgatcctgctggaggcggtcgcgctcaccctgttcctgactgccggcgacgtcggcaccctgctggccgcccgggtggtgcagggggttgccaccggcgcggcgctcagcacgctgggcgccaccctgatcgacctcaacccggcgcacgctcccggccgggccggtctgatcagcggcatcgcgccggtcgccgggctgggcatcggcgcgttcggctgcggagtgctggtgaaattcgcgccgttccccactcacctggtctatgcgttgctgctggccggcatggtcgtcgccgccctcgcggtggcctggatgccggagacgtccggccggcgccccggcgcggccgcgtccctgatcccgcggctcggcgtcccggcccggctgcgcggtgacctgttcgcgctgatcccgatcatcgtggccagctgggcgctcggtgggctctatctctcgctcggtccgtcggtcgcgtccgactcgttcggcatccacgaccacctggccgggggccttgtggtggcactggtctgcggcaccggagcggtcacatcattcctgctgcgtcaggtggccacaccgcgagtcctgacgatcgccgggtccggcttgctcctcggcggcgcgctggggttcgccggcctcgaaaccggcagcctgcccctggccgtgatcggctcgatcatctccggcgccggcttcggcgccgccgcgctggcttcgttcagcacgctcgcccgcatcgccgagccccacgagcgcggcgagctcctggccgtggcgttgacgatctcctacgccgccctcagcatccccgcggtcatcgccggccagaccgccacccacatcggcctgcacatcaccgccctgtggtacgccgccatcgtcgccgccctggccctactcgccctcgtcgcccagcgcctgcgctcccgctcccgcgcctga

SEQ ID NO: 2447 - DNA, 585 bp, Actinoplanes utahensis
atgtcagttgggtcacctcgccggtcaccgcgccagtcggtgcgggagcgcctgctcgccgccgctgacgagctgttctatgccgagggcgtgcacaccgtcggcatcgatcgggtgatcgagcaggccggcgtcgccaaggcttcgctctacaccgtgttcgggaacaaggacggcctggtccgggcctatctgcacggccggcacgagcagcgccgcgaccggatcatgcggcatgtcgatcagcacaccgacactcgcggccgcctgctcgccgtcttcgactcgctggccgaggcggcggaggttcccggcttccgcggctgcgccttctacaacgccggcgccgaggccgatccgaacggggtcgtccgcgaggaggccaccgccaaccgcgcctggacccgccagctcctcaccaggctcgccgccgaggcggacgcccccgatccggacgctctcgccgcccagttggtcgtcctctacgacggcgccaccgtcggcgcccgccaggacggtcccgccgccgccaagaccgctcgcacgctcgccgaaaccctcctggaggcaaccctcccccattga

SEQ ID NO: 2448 - DNA, 1116 bp, Actinoplanes utahensis
atgccgaacagcctgccaccggcaccaaccgtctgcgggaaagatgcgcgaagtgctcacgccggtgcgacgatcggagagatgaccgcgaccggcgccccggcggctgccacgtcggctgccggcccgccacgccgttggcgccgggggccggtggtggccgccgtgatggtgatcattctcggcaccgagctgatcatcggctggcccgcgctgagcggcgcgatcggccagctccgcgcaccacactgggggtgggtcggcgcggccctggccgccgagatcgtgtcgatgggcacctacgcccggatgcaacgggcgctgctgcgcggcgccggcaagaaggtcagcgtccgtcggcacgtcgcgatggcctatgcggcccactcactgagcgtgacactccccggtggcccggttttctccacaagctttaacttccggcaaatgcggcggtacggcgtgacccccgccgaagcgtcctggtgcatcgccctcagcggtgtcctgtccaccggcgcgctgatcctggtcggctcggtcggcggcctcctcgcccggaacaccggaagctggcgcagcctcgccggatatgccctcggcgcgatcgcggtcaccgccgccgtccggctgctcgccaaacacccgctgtggctcgaccggccggtgcgcgcgctgctcggcagcgtcaacaaggtccggcgccggccgccggaacacggggcggaccggctgttcggcttcgtcacccagctgcgggcgatccgggtccacccggtccacttcctcgtcgcggtactgctggcctgcgccaactggctcttcgacgcgctctgcctgtgggtctgctgcatcgcggtcggggcggaccggatcacgccggtgcacctgctgatcgcctactgcgcggggatggcggcggccagcgtgccggtgatccccggcgggctcggtgtcgtcgacgcggccctgatcctgggactcgtggccggtgggctgaccagcgcgagcgccatcgccgcggtggtcctttaccgggccatcagcttcgtcttcatcatcggcgccggatggctcgtctggctcctgctccggcgccgggccagggccgaatag

SEQ ID NO: 2449 - DNA, 1266 bp, Actinoplanes utahensis
atgccccgcccccggattctcatcgtcggcgccggcttcgccggtcacgccgcggcccgccggctggcccggatcgccggcggtcgcgccgagatcgtactgctcaatccgaccgactacttcctctatctgccgctgttgccggaggtcgcgaccggcctgctggagccgcgccgggtgtcggtgccgctggcccgggacggggtccgggtggtcctcgggcatgccggctcgttcgatctggatgcccggaccgtggagtgggccgatccggagggccgccgtggggtgctcggctaccaccggctggtgctggcgctgggcagtgtgaacaggctgttgccaatcccgggcgtgaccgaatacgcccacggcttccggggtctggccgaggcgctctacctgcgcgaccacctgatccggcagatcgagctggccgcccagtccagcgatccggtggagcggcgtgcccggtgcacgttcgtggtggccggcgccggctacaccgggaccgaggtgacggcgcagggcgcgctgttcacggccgcgctggcggcgtcccggcccctgatccgcgacctgccgcgctggctgattctggacaccgccgaccgggtgttgccgacgctggatccgcggctgtcgcacaccgccgcggacgtgctgcggcggcgcggggtgcgggtgctgaccggggcctcggtccaggaggccggcgcggacggcgttcggctcagcaccggcgagaagatcctcaccaggaccctggtctggtgtgtcggggtgcgcccggaaccgctggtcaccggcctgggcctggccacccgggagggccggctggtcgtcgacgagttcctcaacgtgccgggccgcccggacgtgttcgcctgcggggacgcggccgcggtgccggatgtgctgcggcccggctcgctgaccgggatgaccgcgcagcacgcggtacggcagggccggctggtggcgggcaacatcgcggcgtcgtacgggcaggggcggcgacgcccgtaccgccatcgggatctcggtttcaccgtggatctcggcggctgggcggcggccgccaacccgttcggagtgccgctgagcggggtggtggccaaggcgatgaccaggggttatcacctggcggcgatgcccgggaaccgggtccgggtgacggccgactgggcgctggacgcggccctgtcccgccagccggtgcagttgggcatggtccgcggcagcgcggttccgctccgcggttga

SEQ ID NO: 2450 - DNA, 1545 bp, Actinoplanes utahensis
gtgggcacccctgacgaaccctcggaccccgacgatcccgcaccagcgcacctggcggccggccgcctgggtgccggctccgccgccttcttcggcgtcgccgccgccgcgccgatcgtcacggtggtcacggtgatcccgccggtcctggccgtcggcgccggtccgctcgccgcactcgccgtcgtcgccgtcgcgatcgtcctgttgattttgggtacgccgtacgccaccatgattcgccgccgacccagcgccggagcggtgtatccgcagctcgcccgcggtctcggccgccccgtcgcggtcaccggcggctggctggccctggccgggtaccacgcgatccaattcggtctctacgcgatgctcgggcaggccgcagccccggtgctgcacagctggttcggactgaccgccccctggtgggcggtgaccgccgcgggctgggcgctggtcgggtggtgcggcatgctgcgcatcgagttcgccgccgcggtgctcgccgtcctcaccgtcaccgaggccgcggtgctgaccgggctggccgccgccaacctgctgcgtccggccggcggccggatcgagaccggcacctacctgcccggcgagctgtcccgggtcggtcggccgctgctcggcgtgctgctcgtcgtcgcggtgctcgccttcgccggcttcgaatccaccgccggatacgccgaggaggcccgcaaccggcaccgcaccgccggccgcgccgcccggctggcgatcgggctgctcaccgtgctgctggccggcgtgacctggagcatgatcgttacggccgggccgcgcggggtcgccggccgggccgccgcgcgcggcccggagctgctgttcgcgctggccgacgagcgggtggcgccgtgggcggtgacgctcggccggctggcgctggtggccggcctgcttgccgcgatcatggcggtgcaccacgcgatcgcccgatacctgttcgccctgggccgggagggggtgctgcccggcgtactcgccgatctctcgccacggaccggcgcgccgcgcgccgcctcgctgacccagaccctcgtcgcgggggcggcctcgaccggcgcctacctggccggcgcggaaacctcggcccgcaccgcacgctggctgacggtcggcggcgggctcgccatcctggtgttgttgctgctcaccgcgctggcggcgctgctgcacctgaaccgggagccggctaccgaggggatctgggcccgcttcctcgcgccccttctgtccaccgtgttcctcggggtgctggtccatctcgcggtgctcgacctgccggcgctggtcgggggagggccggcggccgggtgggtgctcggcgggctggcggtgtgcctcgcgatcggcatcggtcatgcgctggtgcttcggtcggtgcggccggtggtgtacgccggcatcgggctgggcggcgccgcactggtggtgaccccgcagaccgccgtgcagatcccgaagcagcgggaccccggcgcgcaccggccggaacgcgtcaaccgttga

SEQ ID NO: 2451 - DNA, 2340 bp, Actinoplanes utahensis
ttggcacaccgccttgaccgggtggcaaatcctcaactgggcgggttgccggccgacagcaatcatgtgctcgccacccagcagctgacggagtttctcgccgtcgtcgccgaccggcccgacgaggccgccgcccagcatgccgccgtcgaatgcgcgatgcgtgcgctcgacgccgacctcgccgtgctgatggtcgacggcggcgtcgcggccgcggtcggcttgcccgtcgtcccggcgtacgccttggccgaggccgccgcgggccgccgggccagcctcgacatcgacggccgggtgtacgcggtaaccctcgcccacctgggcggactcgccccgggcgtcctggtgctcggccgtgagacgccgttcagcatcgaagaggtgtgcctgctccgcggcatggcccgggttctggagctgagcctgcaggcgctgcacctcatcgaggcggaacgccggcaggcggccgagaacgatcggctgatcaactccttgcagcggcgccagcgcctgttcgaggagctcagctcggtacagcgggcgatcgcccggcgcgagccgctgcgccggatcctcgaccagatcgtggcgagcgcggccgacctgctcgacgtggaaatggccgggctgaccgtgctcgacctcgacgatccgagccggaccagcctgatcgccagccagggcgtgcccgaggagggcgtccagcggatgcagtcggtgccggtcgccgcgctcggcgccgccggcctcgcgatcatgggtgatgagctggtcgcgatcgacgactacgcgaactcaccgatcgcggtgccggagatcgtccgggcccggctcaagagtgtggcggctgtgccggtgcacgaggacggggtggtcgtcggcgcgatgttcgtcggctcgttcaccgccgtacgtcactgggatcgtgcttcccaggaaatcttgcaggccttcgccgagcacatcagcctggccatcaccgacgcgcgcacgctgcgcgagatgagccacgccttccacgattcactgaccgggctcgccaaccggaccctgttcaccacccggatggagaacgcgctggccaccgtcggcgccggcggggtgaccgcgctgctggtcgatctggatcggttcaaggtggtcaacgactcgctcgggcacgcggccggcgaccggctgctcgccggcgtcgccgaccggctgcgcgactgcctgcgcaccggcgacaccgcggcccggctcggcggtgacgagttcgccgtgctcatccccggcgtggtcggctcggaagccgcggtgccggtcgcccggcggatcgtggccgccctgcgtgaaccgttcgacctcgacgggcgcgaagtcttcgccagctgcagcgtcggcgtggcctgggccgaggtcggtgaaaccgatgccgacgacctgctggtccgcgccgacctggcgatgttcgaggcgaagaagctcggcaaggaccagtacgcgatcttcgagccggcgatgcgcgaatcgttccagaagcacctgcagatggaggcggacctgcgccgggcggtgctgcggcacgagttcgagctgcggttccagccgatcgtgcggctgcgcaccgaggagatctccgggctggaggcgctggtccgctggcagcatccggaccggggcatgattccgccgctggagttcatcccgctcgccgaggagaccgggctgatcgtgccgatcggcgaatgggtgctgcgggaggcctgccggcaggcggcccggtggaatacgcagcgctccgggcaggcgccgctgacggtcagcgtcaacctgtccgcagtccagctggaacgcgcggacctgccgcaactggtggcggccgcgctggccgacagcgggctgccggcgaaatgcctgatcatcgagttgaccgaatccctactggtggaccaccggccggagacgctgcggcggctcgaggagatcaaggaattgggggtacgcctggccatcgacgatttcggtaccggctactcgtctctcgcctacctgcgtaaattcccggtggacatcatcaagatcgacaagtcgttcgtggacgacatcggcgacatgccggccgcggcggccctcacgctggggatcatccagttggggcaggcgttgcagctgtccacggtcgccgaggggatcgaacacgtgggtcagctcagcgagttggccggcgggaactgcgagctcggccagggttactacttcgccgaaccgctgaccgccgcggcgatggacgacctcctcttcccggcggaggcaccgccggcgagtgagcagaccactgctcacggtgagtaa

SEQ ID NO: 2452 - DNA, 393 bp, Actinoplanes utahensis
gtggatctcgacatcgaccgccgagccgtcgccgtcgtctccgccggcggcatcatcggcgccctgacccgctacgcgatcggcaccgcctggccgcacacccccagcgacttcccctggtccacctgggtgatcaacacctccggctgtttcctgatcggcgtgctcttcaccctgctggcccgcttccgtccaggtcaccgcctcacccgccttttcctgggcacgggcgtcctcggcggctacacgacgttctccaccgccgaggtggacgtcctgcggaccacgccggccatcgccgtgctctacctcggcgccacgatcaccgcggccctgctcgctgtctggatcggcagtgccctcgcctccgtgcccaagggcgccggccggtga

SEQ ID NO: 2453 - DNA, 357 bp, Actinoplanes utahensis
gtgaccgtgctgctggtggcgatcggcgcggcgatcggtgcccccctccgctacgtcaccgaccgctacctccaggtccgctacggcaccgctttcccgtggggcaccctcacggtcaacgtcaccggctcgctgatcctcggcttcgtgctcggcatgccgctgtcccccaccgcgaccgccctgctcggcaccggtttctgcggcgcactcaccacctattccacattctcgtgggagaccctcaccctcacccgccgcggcgaacaggcatccgccctcggctacgtcctgctgagcctgctgtccggcatgggcgccgccaccctcggcaccctcctcgcccgagcactctga

SEQ ID NO: 2454 - DNA, 2199 bp, Actinoplanes utahensis
atggagcacagggggaaagtcaagggaatcgcggcacgcgccgcgatctggagtgcccggcaccgggtgctcgccattctcgggtggatcgccttcgtggccgccacggtcgtcctgagcggacagctcggcacccgccaggccaccggcgccgagcagggcagcggcgattccggccgggccgacaagatcgtcgaggcggccggcttcccggtccagccggcgggcgagatggtgctgatccagaaccggtccggcagcgaccgggcggccgccgccgccgaggtgacccgcacgctgaagtcgttgcacgacgtgaccgacgtgcagccggccatccagtcgccggacggccggtcgacgctggtcagcttcagcatcaccggggacccggagaccgccaaggagcgggtcgggccggcgctcgacgcggtcgcccaggtgcagaccgcgcaccccgacctctacgtcgccgaggccggtgacgccagcggcgacaagctgatcggcgacgagctggacgcggggctgtcccggctctcgatgatgtcgatcccggtcaccctgggcatcctgctggtcgccttcggcgcggtggtggcggcgctgctgccggtcgggctcgccgtgaccgcggtgatcgcggcgatcgggctgatggccgccggcagccggttcgcccacacggtcgacgcgacgacgcacgtgatgctgctggtcgggctcgcggtcggggtcgactactgcctgttctacatccgccgcgagcgtgacgagcgccgtgccggagccgatcccgagcgggccctgatgatcgccgcgcagacctccggccggtctatctggatctccggtctcaccgtgatcgtggcgatggccggcatgttcctcacccgggacaccacgttcatcagcttcggcctcggcaccatcctggtggtcgcgaccgcggtgctcggctcgctcaccgtgctgccggcgctgctctcggcgctcggcgaccgggtcgacgccatcaagatccccggcctgtaccggcggcgcagcgacggccggatgtggaacgcgatgctgcgggtcgtgctcgcccgcccgctgatctccacgctggtcgcggtgggactgctgggcgcactggccgcgccggtcgtcgacatgcggacccggggacagaacattctggacatctctcccaaggcgccggtggtccaggcgttccaggcgatcaacgaggcgttccccagcaagaccagcccggcacaggtggtggtgcaggcctcgaccgttcgcggggagcggttcgacagggcggtggccgacttcaagacggccgtcggccgcagcggcggccggctcgtcgagccgatcgacgtgcgggtcaacccggccggcacggtggcggtcgtctccgtcggactggtcggcaacggggagaacaaagcctcgaccgacgcgctgaaactgctccgcggccaggtcgtgccggccgccttcggtgggctcaccggcgcgaccgtcctggtcagcggtgatgcggcgggcaacgccgacttcaaccaccagatgcagaagagcctgccgtgggtcttcgggttcgtgctcggactggccttcgtgctcctgctggtgtcgttccgctcggtcgtcgtggcgatcaccggggtggtgctgaacctgctgtcggtggccgcggcgtacgggatgctggtcttcgtcttccagtacgggcacttcgacaagcagctcggcttcctgccctcggacgggatcatcaactggatcccgctgttcctgttcgtgatcctgttcgggctctcgatggactaccacgtgttcgtgctcagccggatccgcgagggccacgatcgggggctgccgacccgggaggcgatccgcgagggcgtcgggcgcacggccggggtgatcaccagcgcggcggtggtgatgatggcggtgttcgcgctcttcgcgaccctgccgctgacctcgaccaaggagctcggggtgggcctggcggcggccgtcctgctggacgcgacgatcgtccgggcggtgctgttgccggcggtgatggcgctgctggggcgggccaactggtggctgccgcggtggctggggtggctgccggagatcgcgcacgatgtgccgccggtggcggagacggaggacgagccgcgggcgctggcgccggtgggctga

SEQ ID NO: 2455 - DNA, 645 bp, Actinoplanes utahensis
atgcgggtggtgattgccgacgatgcggtgctgttgcgcgagggactgatccggctcgtcgaggagaacggccacacggtggtggcggccgtcggcgacgggccgtccctcgtcgaagccgtggtggaacaccgtccggacgtctccatcgtggacgtccggatgccgccgtcgcacaccgacgagggcctgcgggcggcggtcgaggcccgcagccgggttccgggcacgccgatcctggtgctttcgcagtacgtcgaggtctcctacgccgatgacctcctggccgaccgccgtggcgcggtcggctatctgttgaaggaccgggtgtcgctggtcgccgacttcctggacggcctgcgccgggtcgccgagggcggcaccgtgctcgaccccgaggtggtcggccagctgctggtccggcgccggcgtgacgatccgctgcgcagcctcaccccgcgcgagcgtgaggtgctgggcctgatggccgagggcatgtcgaacaccgcggtcgcccgcaagatggtggtcaccgagggcgcggtcgagaagcacgtgcgcaacatcttcaccaagctcgatctgcaccaggacgaggagcagcaccgccgggtcctggcggtgctggcctacctgcagacgtag

SEQ ID NO: 2456 - DNA, 1290 bp, Actinoplanes utahensis
gtgcatagtgtcaaggacatgacaagcacccggcgtcacctgcgccagctgggcatcgacacgcagtacgtactgctcggtttccccctcggcctgatcactctcgtgctgtgcctgaccggcttcttcctcggcctcggcaccgcgatcatctggatcggtctgccgatcatggccgggtcgctcgccatgtcccgcggcttcgcccacctggagcggctgcggatcggatcggtgctgggccgcaggatcccgcacccgcattaccggtcgtcccgggagcggggctgggtgcggcggatgttcgccccgctggccgacgggcagtcctggctcgatctggtgcacggcgcgttccggttcattccgagcacgatcgcgttcagcttcgtgctggtctggtggtgcgcggcgctgaccagcatcacctacccggcgtacgactgggcggtgccgcacaccgcggacaacaccgaactgcccgagctgctgggcttcgccgacaacgcgcccacccggatcatcttctacctgatcctcggcgcgttcttcacgctcaccctgtacccggtggtgcgcggcgcggcgctgctcgaggccctgttcgcccggggcctgctcagcggggtcgacgagctgcgccagcaggtggccgatgcgaacgccgcccgcgacgtcgcccagcaccagaaagccgcggccgtctcggccgaggcgaccgcgctgcgccggctggagcgggacatccacgacggcccgcagcagcggctggtccggctcgccatggacctgggccgggccgagcagcagttcgccaccgacccggaagccgcccgggcgaccgtcgccgaggcgctcagccagacccgggaaaccctcgacgagctgcgcgcgctgtcccgcggcatcgccccgccgatcctggtcgaccggggtctgcaggccgcgctgaccgcgctggccggtcgctgcaccgtcccggtggacctggacgcgccggtcttcgagcggctggacccggcggtcgagtcgacggcgtacttcgtggtcgccgaggcgctgaccaacgtggccaagcacagcgacgccaccgaggtgcaggtgagtgtgcagcggatcgccaccggtctgctggtgaccgtttccgacgacggggtgggcggcgcgagtctggccaagggtcacggcctggccggcctcgacgaccgggtgaccgcggccggcggcgtgctcgccgtcgacagcgccgacggggagggaacccgcctgacagccgccctgccgctctga

SEQ ID NO: 2457 - DNA, 1017 bp, Actinoplanes utahensis
atgcgtgctgccgttttcgccgagcccggtcccgcctccgccgtgctgcacctggtcgagcgggagttgccgctggccggggccgatgaggtgcgggtccggatcgtgctgtcggcggtcaacccgaccgacgtcggtacccgggccggccgcggtgtgcccgacggtgtgcgaccgccccgggtgcccaaccaggacggcgccggcgtcgtcgacgcgctcggcgagggcgtcaccgacctggagcccggcgatcgcgtctgggtctgggacgcgggctacggccgggccgacggcaccgcccaggagtacgtggtgctgccccgccgccaggtggtccggatgaacgatgacattccgttcgaggtcggcgcggacctgggcattccggcgctgaccgcgcatcgctgcctgaccgtggccagcgacggaccggcccgcctcggaccgggcgctctggagggtcgcacggtgctggtggccggcggggcgggcgcggtgggcaacgccgcgatccagctggcgaagtggtccggcgcgaccgtgctgaccacggtgagcagcaaggagaagggtgcgctggcggccgccgccggtgccgacgcggtgatcgactaccgcgaggaggacgtggccgcccggattcgcgagctgagcgggaccggtccgcacctgatcgtcgaggtggacaccgccaacctgaccctcgacctggatgtgatcgcgccgggcgggaacatcgcgatctatgtcgccggtgaggtgcgggtgccgttcttcacggcgaacctgaagaatgccagcctcgatttcgtgctcacctacaccaccctgccggaggagaaggcgaacgcggtggcggcggtcgccgaggcggcgaacgcgggcgtcttccgggtcggcgaggagcacggcctgccgatcatccgttttccgctggacggggtggcggcggcgcacgaggccgtcgagaatcatgcggtcggcaaggtggtgatcgacgtgacgcagccctga

SEQ ID NO: 2458 - DNA, 720 bp, Actinoplanes utahensis
gtgcagcacggcggaggcgggaccgggctcggcgaaaacggcagcacgcatgttctcaccctatgtcgccgcgaagccctcagccgatcgcgtgctccgccgaaacaacagcgaaagctccgatttttgtacgccgtcagcatgaccttttcgatcagcgcagtacgcctcagtggcctcagcgccgtgccgaacatgagtaggcacgtcgctgcccgacctctggaggtccgcgtgtacaccgttctcatcgccgacgacgagatcgaccatcgggacctgctggccctcgccctgcgccggttcggctaccacgtggtggccgcctcggacgcggccgaagccctggaggccctgacccggggcggcatcgacgccgccctgatcgacgtccggatgcccggcctgtccggcatcgacctgtgccgccggatccgctgcgatcccgcgctggacgcgttaccgatcatggtgatcagcgcggacgtgcaccaccgccaggtcaccgcggccctgcacgccggggcggacgactacctgacgaaacccttcgcccgggacgagctggtggcccggctgggcgacctgctgcgccggccgggcaccgggacgtcccgctcgacggccgcgtcccgggtcgcgctggccgccgcccggcacgcggtcccggtggcgccggtcatccgtcatcaggaggtccacgttcgacacagcgcttga

SEQ ID NO: 2459 - DNA, 1596 bp, Actinoplanes utahensis
atggaaccggccccgcacggcacctccgcccagctcagcagtcctgtccggtacgggacggccgccgcgcgccgggtgctgctggccaccgtgctcggctccagcctggcgttcatcgacgccaccgtggtcaacctggccctgcccgagctcggccgcggcctgcacgcctcggccgccggtctgcagtggacggtgaacggctacgccctctccctggcctcgctgatcctggtcggtggctcgctcggggaccgcttcggccgcaagcgggtcttcctggccggtgtcgcgtggttcgcgctcgcctcgctgctctgcggcctcgccccgagcatcgagctgctgatcaccgcccgggtcctgcagggcatcggcggcgccctgctcaccccgggcgcgctggccatcctggaggcgtcgttcgcgcccgatgaccgcgcccgggcgatcggcgcctggtccgggctgggcggcatcggcggcgcgctcggcccgttcctcggcggctggctgctccagatcggcagctggcgcctcctgttcctgatcaacgtgccggtcgccgcgctggtcctctgggtcgcgcaccgccacgtgccggagtcccgggatccggccgcggcccgtggcttcgacatcgccggcctgctcaccggtatcgtcggcctgggtggcctgacctacggcttcaccgcctggccggcgcacggcgcgggctccccggtcgtgctgatcccgctggcgctcggcgtgctcgggatggccgcgttcgtcctggccgagcttcgcgcaccgcacccgatggtccccccggagatcttccggcaccgcgccttcaccggcgccaacctggtcaccttcctggtctacgcggcgaacggcggcgtcttcttcctggtcgtggtcaacctgcaggtcgtcgccggctatcccgcactcgccgccggcctgtccatgctcccgatcaccgtgatcatgctcctgctctcggcgcgcggtggcgcactgggccaacggatcggcccgcgcatcccgatgaccgccggccccctggtctgcgccgccgccctgctgttgatgtccaccatcggcccgcacgcgccctacgccacccgcgtcctgcccgcggtcatcctgttcggcctcggcctggccctgctggtcgccccgctcaccgccaccgctctcggcgccctcgacgacgcccacgccggcatcgcctccggcgtcaacaacgccgtcgcccgcgccgccggtctcctcgccgtcgccgtcctacccctggccgccggcctgggctccggctccctgaccgacgccgccgcactccaccccgtgtaccaccacgccatgctgctctgcgccgccctgatgctggccggctccctgaccgccttcctcaccgtccccacccggccacccaccacgtcctccacccccagcccgcactcccccgacagcgccgactccaccccgaccccggccatcaccgccggccgcacccccgccatcccgcaccgctccttctgcgaccccgcctctccccccatccctccccgcgacagccaccccatcccctcatcaccccgctga

SEQ ID NO: 2460 - DNA, 1038 bp, Actinoplanes utahensis
gtggcgcgggagctgccgaagcttcgcgccggcgatcgggtggcggtgttgtcgccgtcattcgcctcgccaggcctcttcccggaacgccacgagcaggcgatccgccgcatccgcgacgacctcggtctggagccggtcgagttccccaccacccgtcgcctcggcgcctcagccgccgaccgcgccgcggacctgaccgccgccttcgcggacccgtcgatccgggccgtgttcgccacgatcgggggcgacgaccagatcaccgtgctgccacacctggatccggcggtgttccaggccgacccgaaaccgttcttcggcttctccgacaacaccaacctgctgaactggctgtggtcgcacggcatcccggcctaccacggcggttccacgatgatgcacctggcccagggcgacggcatcccgccgatccacctggcatccctgcgagccgccctgttcaccggcggcgacctgccgatcacaccgatcgacaccttcagcgaggaggagatcgactggtcggatccccggtcgctgacggaccccctgcccaccgcccccggccccggctggatctggcaccagccgacccgggtgctcaccgccccgacctggggcggcaacctggagatcctccactggaacctggccgccgaccgctggatccgcccggtcgccgactacgccggtcacatcctgctgctggagacctcggaggagatgccccccgccgaggaggtcttccgaatcctccgcaacttcggcgaacgaggccttctgcaccagttccccgccgccctgttcgccaccgcgaaggcgacagtcttcaccagcccccgcccccacccggagcgccagaagtaccgagacgaccagcgcgaggccgtcctgcgagccttcgcgacctatcaccccacagcgatgctcaccttcggcgtggacttcggacacaccagcccccagtgggtcctcccctacggcggccgcctcaccgtcaacggccccgcccggaccatcaccgcccactactga

SEQ ID NO: 2461 - DNA, 723 bp, Actinoplanes utahensis
atgagtgaccttgacgagcacgacagcctgcatcgtctgctcggtggctatctgctgggcggtctcgacgaggccgacaccgaccggctcgacgcgcacctgcacgactgcgccgaatgccgggccgaactggaccggctcgcaccggtcccggaaatgctgcaacacctgccggacgtccggcagctgggcggtgatctcccgccgctcacggtcgctccggccgcgcggccgagtccgcagaacatcgagaatctgctcagccggatgcgggccgagagaacccacaagacccggatggtgcgtacgcggtggctggtcgccgcctcggtcgccgtcctggccgccggcgccatcggctacggcgtgctggtccacgacaacgacgccaccacccagcagtccccgccgctcgcggccgccacgataacggcgaacttcgaaccgaccgccggcggcgccctgcacggccaggccaccctggtcaagaaggcctggggcgtttcggtatcgctgaacatgaccggaatgcagggcaaagccccgttcttctgcatggtcaaacgagccgacggcaccatggaacaggccgccgcctggggtgaaacccccgaacacaccgccaaggtcgatggcgccagctcggtgaccgccaccgacgtccgggcgatcgtcatcaccgacagcgacggaaaagtgctgggcacggcgccggtcacctag

SEQ ID NO: 2462 - DNA, 540 bp, Actinoplanes utahensis
atgaagcgacgggtgagcagccccgacgagcaactgatgaccgcgctctacacggagcactacgcaattctgatcaacttcgtctcgcgatacgtctcggaccggcacaaagccgaggacctggtccaggagacgttgctgcgggcgtggaagcacatcgaccacctcgaccccgaaccgggacgaaccaggtcatacctgctgaccatcgcccgtaacgtggtgaccaacgcatggcgggcggaacaacgccggccccggttggtctccgacgagaccgcggtcaactccgtgccgtcggcggacaatgtggatcaaatggtggagggctggctggtcgcggaagcgatggaacggctctccccggaacaccgggcggtgatacaggccatgtattacgagggacagagcgtggccgacgcggcacgccggctgtcggtgccggaaggcacggtgaaatcgcgcgcctactacgcggtgcgcgcactccgcgccgtcttcgaggagatgggcatgctgcggagcgggggtgcggcatga

SEQ ID NO: 2463 - DNA, 1122 bp, Actinoplanes utahensis
gtgttgaagtcacgccgcggtctgctcgccgccggcctcagcgtcgcggtgatcggcgcgatcggagtcgcctccacactcaacgcgggggccgagcagatcccggacgcggcgcccacggcgagtgtcgccgccgcgcccgccgacctcatcccgccggccaacctgccgtgggggcagcgcccgacccgggtcaagcgcggccgcgacggggcgaacagccgatcgctgcaggccgccgggctcagcgtcgccggcccgtccgagggtgacaacggcacccccgatccggagtacgcgcccaagggccgcagctccaggtccagcttcctgcgcaccgccaagacgtcggtggtgccgcctcccgaaccgtccgccgatccgtccgcaccggcgtccgcctcggcgtccgcgtccgcctccgcaccggcctcggccgacccgtcgacgacccccgggagcaccggcccgacggtgaacttcctctacaacgtcggcgcacaggccgcggtctcggacggcgcctacatcaacctgacgatcaacaagccgaaactggccaagcaggattaccacaccctggccgagctggccgtgcagtccgcggacggcaaccagatcgtcgagatcgggtggaacgtcgaccgggtggtcaacggcgacgacgacccgcacctgttcgtctaccactgggtcaaccggcagacgtcctgctacaacggctgcggcttcgtgcagtacagcaaggccgtggtgcccggcgacacgctcgccgtcgaccagcagaagaaattcggcatccagttctacaacggcggctggtgggtggcgtacgacaccgagtgggtcggctatttcccggccaagctctggggcgacgtctcgttcaccaagagcggtctggtccaggtcttcggcgaggtggccgccgcgtccgacaagccgtgcaccgagatgggcaacggcaagaagtccgacgacaccacgtcggcccggatcggcagcatcgcctacgtcaacgggccgaccgccgacctggtggtccgcagcaccagcgacttttacacggtcaaccagttgagcaaccgcaccttccgctacggcggccccggcagctgttga

SEQ ID NO: 2464 - DNA, 471 bp, Actinoplanes utahensis
atgcccgccaccgccgtccgcctcgaccacctcgccatcgcccggcaattcgccaacgcgcccgaggggtgggtggtgccgccccgcttcgacccggtcgagcggtggtaccaccggctggaggtggccgacgaccacgaggtgtggctgctcacctggctgcccggacagcagaccgaactgcacgaccacggcggctcggccggagcgttccaggtgttcagcggcgtgctcaccgaggacacggtcagcggcccggcggacgcgccccgggtcaccacccgcgacctcggcgagggcgccggccgccggttcggcagccaccacgtgcaccggatcgtgaaccgcgggcccgacccggcgatcagcatccacgtgtacggccccgccctgaccagcatgacgaagtaccggctgagcccggccggcctggagacccgcaccgtcgaacgggccggtgcccagtggtga

SEQ ID NO: 2465 - DNA, 399 bp, Actinoplanes utahensis
gtggtgaccgcggccccgcccggctcccgcggcatcgccgagatcctcgacgaggcccgcacccggctgacccggctggacccgctggagaccgccgccgcggtccgggacggcgcggtgctgatcgacatccggccggccgcgcagcgcgccgagcacggtgagatccccggtgccctgatcatcgagcgcaacgtgctggagtggcggctcgacccgcgcagcgacgcccgcctgccgttcgccgacagctacgaccttccggtgatcatcacctgccaggagggttacaccagcagcctggccgcggccgccttgcaggatctcggcctgcatcgcgccaccgacctggccggcggtttccgggcctggcaggaggccggcctgccgacgatctga

SEQ ID NO: 2466 - DNA, 711 bp, Actinoplanes utahensis
atgaagacctcgccctggagtccgcttcccgacaagcgcccggctcgcgtgcaactcgaccgcgagcagatcatcgacgccgccctgcggatcgtggatgccgagggcgtcgaggcggtgagcacccgccgggtcgccgccgagttcggcaccggcccgtccagcctctacgcgcacgtgtccaacaaggacgagctgttgcggctgatgttcgaccgggtgtgcggcgagatcgacctgcccacgccggatccggcccgctgggcggagcagatccggcagatgatgtgccaggtacacgaggtcctgctggggcacaacgacctggcgcgggtcgcgctggcctcgatccccaacgggcccaacgcgctgcgctgctcggagtggatgatcgggctgctgatcgagggcggggtgtcgccgcggaccgcggcctgggcactcgaccggatcttcctctacgtcaccacggacgcttacgagatctccatctgggtcacccagctgcgtcacctggagctgccgcaggacgaggtggagaagcaggtcaagggcgagatggcgaagcacttcgaggacctgccggccgaccgcttcccgtatctgcggacgcacgcggcggcgatgacctcgggcacctcgcaggagcgcttcgagttcggcctcgacctgctgatcgacggactgacgcgatcggtcgggaaggggtga

SEQ ID NO: 2467 - DNA, 1671 bp, Actinoplanes utahensis
gtgtccgtgacaacgaacagtgttcaaacagaaatccaggcgaccgacacgccgtatcgatatcgttggatcgtcctcttcgtgatcctcgcggtcgaggtgatggacctgctggactcgctggtcaccacgatcgccggcccggtcatccgatccgagctcggcgggtcgtacagcctgatccagtggctcggcgccgcgtacaccctgtccatggccatcggcctgctcaccggcggccggctcggcgacatctacggccgccgccggatgttcctgatcggcgcggccggcttcaccctcgcctcgctcgcctgcgcgctcgccccgatgcccggcttcctgctcggcgcccgcgcggtgcagggcctgttcggcgcgctgatgttgccgcagggcctgggcatgctgcgcgagatgttcgccccggccgagcgcgccaaggcgttcggcgcgttcggcccggtgatgggcctgtcctcggtcggcggtccgatcctggccggctggctggtcgacgccgactacttcgactccggctggcggatgatcttcttcatcaacctgccgctcggcatcttcgccgttttcggcgcgctgcggttcctgcccgagtcgcggctcgaccgggcgccgcggctcgactggctcggcgtgctgttcgccgccggtggcgcgttcctgctgctctaccccctggtgcagggccgcgagctgggctggccggcgtggaccttcgcgatgctggcggtcggcgtgctggccttcggcctgttcgcggtctacgaggcgcggcgcgacaagcgcggcctcgacccgctggtcaccccgagcctgttccgcaagcgcgccttcaccggcggtctggccctgggcctgatgttcttcgcctcgctgatcggcaccagcctggtcttcaccttctacctgcagatcgggctgggctacaccccgctcaaggccggcctgaccacgctgccgcaggcactgggcatggtggccggtttcatcgtggccggcgccgggctggccgagaagctcggccgcaaactgctgcagctcggcaccatcgtgatggtgatcggcacgggggtcttcgccgccaccatccactgggccggctccggcatcacgccgtggcacctgatcccggccctgctgctgctcggcatcggcatgggcctggcgatggcgccgttcttcggcatcgtgctggccggcgtcgacgacgaggagagcggctcggcctccggggcgatcacctcggtgcagcagctcggtggggcgttcggcatcgcggtgctcggcacgatcttcttcgccctgttgcccggcgcggtcgggcaccacgtggacacctcggcggaccggctgcgggccacgctgagcaccgccggcgtgccggccgacgctcagccggcggtgatcgccgggctgcggacctgcctcaccgaccgggtggccgagaccaatccggacgtggtgccgccctcctgccactcggacgcggccgggccggatctgtcgcagtacgtcggcgagcaggtgcgcgccggcttcgaggacaccaccgtacgtacctccgccgtgaccttgatcttgttgttggcggctttcgggctcaccttcctgatgccgttgcagggcaggccggagggcgagggccactag

SEQ ID NO: 2468 - DNA, 546 bp, Actinoplanes utahensis
atgcggcacgtcaaggccatgctcgccctggcggcgctcgctctcacggccggtgggtgcggccgcgagacggtgcggaccgcggcgtcgccgagcccgggcgcgacctggcatctgctgaccacgggcagcccgacaccgagtcccacgccgtcgcggctgaccgcgcggccgtcggcgcccgggctgggcgcgtcggtgtcaccgttccccagctgcacgaagacgttcaccgcgaccgaggcggtgctgatcccggtggacgtgacgccgatcgccggaggcttcaaggtggagtggccccggcagtacggctccaactaccgggtcaccgccgtaccgcagaaactggtcctcggtgcgcagccggagccctcctggaagaacgtgccgcccggcaccggttgcacggtcagcacgacgatcaccgggctggtcccgggcgcggcctacatcgtctggctggacgcgcccaacaccggctacgagcgggacggcacccggcacctgtacagcgggcgctcgggtgtcgtctacccccggtga

SEQ ID NO: 2469 - DNA, 1230 bp, Actinoplanes utahensis
gtggctgtggatcgcggcggatctgatctacatcccgctctactgctacaaggagctctggctgaccgcgatcctctatgtggcgttcctcgccctctgtgtggccgggctgcggtcctggcggcgggcggtgaccgcgtgaggttccggcacggactgatcgtcggcaagttctatccgccgcacgccgggcaccacgccctgatcgaggcggccgccgcggcctgcgaccgggtgaccgtggtggtcgcgccgtcgtcgcgggagagcatcccgctggcggtgcgcctggagtggctgcgcgcggcgcacgggccggacgtccggttcgccggggtctacgacgatcacccgatcgactatgccgacccggccgtctgggacctgcacatggtggtcttccgggacgcggtcggcgccgagccggtggacgcggtgttctcctccgaggcgtacggagcggagctggcccgccggttcggtgccgtcgccgtgccggtcgacccggaccgccgccgggtgccgatctccggcagcgcgatccgcgccgacccgatcgcgcactgggcgcacctcgggccgggtccgcgggcctggctggcccgccgggtgatcgtggtcggcgccgagtcgaccgggaccaccacgacggcccgggccctggcccggcactaccggacccggggcggggtctgggcgtcgaccggctgggtgccggagttcggccgggaactgaccgggcgcaagctcgccgccctgcgccgggtccggcccgaggcgaccgtcttcgacgtcacctgggaccgcgacgacttcatcaccgtggccgtggagcaggccgccgccgaggacgcggtggccgccgcgggctcgccggtggtgttcggcgacaccgacgcgttcgccaccacgatctgggaggagcgctatctcggcagcacctcggcgaaggtcggcgagctggtccgcgatcccgacctctatctgctcaccgatgacgccggggtgccgttcgaggatgacgggctgcgcgacggggagcatctgcggcggtggatgaccgggcggttccgcgccgagctggccgcgcgggacgtgccgtggatcgagctgaccggcggctaccgggagcggctgacgaccgcgatccgggcggtggaccggctgctggccgccggctggcggttcgcaccgccgctaagcccggccgggcaggccgccgaagggtag

SEQ ID NO: 2470 - DNA, 360 bp, Actinoplanes utahensis
atgcaccccgccccccgagtcgacaccaccgtgctggacgccgcggcgctgctcgcgatcgccatgggccgcgcctccgagaccggtctcggcgtccggtcccacccgccccgggtggtcaccggcgccgcggtcgccggcgcctggcgcagcccggacggcacggtcaaactgcagctgcggaccgacgggacgtaccacggtgaggtcgccggccgccgcaaccgtccgagcggcacctaccgcgtcgagggcgccgcgctcgtcctgcacgacgacacgtccggtctgaacaccgcggtccacgtccggcacgagggcgaactggagatggccggccaccgccttctcccggagtga

SEQ ID NO: 2471 - DNA, 606 bp, Actinoplanes utahensis
gtggcgacagtgaagcgcgcaccggccggagcggcggtgctccggaatgacatcaccgtggcgatccgaaacgcggtcatgagtgagctggccgaggtcggttacggccggctctccattgaggcggtggcccggcgggccggcgtgggtaagacggcgatctaccggcgctggtccaacaagctggagatggtacttgagatcatcaccgatgtcgccggtcggaaggtgccggtgcccgacaccggcagcttcgccagcgatctcgacctgctgatgatgatcgtcagccgggcgttgcagcatcgggtcgcttcgcagatcatccccgacctgatggccgaggcggcgcggaacccgcagatcgccgaaaccctgcaacgggtgctccggctgcaccagcagtcggtcggggacaagctggtcggccaggccgtcgcgcgcggcgaactgcccgagggcaccgacgccgacgtcgccgtcgacctcatcctcggcccgctgtactggcggctcgccgtctcccggcagccgatcgacgacgcctacctggagaagctggcggccgcggtcctcggttccctgcgcggtggttcggcaacctaa

SEQ ID NO: 2472 - DNA, 903 bp, Actinoplanes utahensis
atgccagagacagcggttgccgatgccgctaccgggattcccctcaaggaactcgcccggcggcacggcctgagctcgtccgggcgcctgctcggaccgctggagtacgcccgccaggtgtggggttatcggtacttcatcaccgcgcacgccaaggcgaagacggtgtccacgctgggcaccacgaacctcggcacgttgtggcaggtgctcacccccgccatcaacgccctggtgtactacgtcatcttcggtgtcatcatcggcaccggcgcgaacaatccgaacttcatcccgtacctgtgcatcggggtgttcgtcttcggtttcacccagtcgacggtgtcgcagggcgtcaactcgatcaccggcaacctgggcctgatccgggcgctgcacttcccgcgggccagcctgccgctgtccgccgcgctcgtggagatccggaacttcatcaccgccaccggcgtgctgttgatcatcgtgctgctctgccacgagccgatcaccgtccagtggctgctgatcttcccggtcatgctgctgcagtcgctgttcaacttcggcctggccatgggcggcgcccggctcggctccacgttccgcgacatcaagcagctggtcccgttcatcatgcggttctggatgtacggctcggccgtgctctacccggtcacccgcttcacccatgcccatgccctgcaggggtggaagctgcacctgatcgaggcgaacccgatgctggtcttcgtcgagctgtaccggcactcgctgatggagggccaggagctcgtcggcacccccaagatgctgtggatcgagggcgtgatctgggccgtggtcgtgggcaccgccggcttcctgtacttctggcgtggagagaagggttacggccgtggctga

SEQ ID NO: 2473 - DNA, 771 bp, Actinoplanes utahensis
gtggctgacgagcggatccccaccgtcatcgccgatgacgcccacatcgtctacaagatcgtcggggcgatcggcgccaaccaggtcagcccggtctccgcgctcaagcgcctggtcaccaagaccaactcggcgaacgtgcgcgaggtgcacgcggtcaagggcgtcagcttcgtcgcctacaagggtgaagcggtcggcctgatcggcagcaacggctcgggcaagtcgaccctgctgcgtgccgtcgccggtctgctgccggtgcaccggggcgcgatctacgcggccggccaaccgtcgctgctgggcgtcaacgcggccctgatgaacgacctgtccggcgagcgcaacgtcgagctgggctgcctggccatgggcatgaccccggccgaggtcaaggagcgcaagaaggagatcatcgacttctccgggatcaacgagcgcggcgacttcgcctcgctgccgatgcggacgtactcgtccggcatgggcgcccggctgcgcttctcgatcgccgccgccaagcagcacgacgtgctgctcatcgacgaggcgctggccaccggtgacgccaagttccgccgccgcagcgaggcccgggtccgcgagctgcgcgcccaggccggcacggtgttcctggtcagccacagcgagcagtcgatccgggacacctgcgagcgggtcatctggctggagtcggggctgatccgggcggacggcccgaccgaggacgtactcaaggagtacgagacctacatgaagaagtag

SEQ ID NO: 2474 - DNA, 1038 bp, Actinoplanes utahensis
gtgcaggatgtgacggcacggcgacgatgggcagccgttctcgcgctgctggtcgccgcatgcgggatcgccggcgtgaccacgccggccgccgccgctccccggcccctggccgccccgggggagtccggtgacgacggtgagggcggctccaagtccctgctcgacaaactcgacgaggcctccaagggttacgtcacggccagtgccaagctcaagcagtcccgggccgagcagacgaaactggccgccgagctcaagcagctcgacgccgacatgggcccgcggcaggccgcgctgaacaggtacgccgcgcaggcgtacacgatgggccggttgggcccgctgagcgcgctgctcaccgcgaacacctcggccgggttcctggaccgggcccagatgctcggcaccgtggccgccaagcagaccctggcgctcgacgagctgaaggccacccgggccggtcggcagcaggccaaggccgcgatcgaccaggcggtcaccgaccaggcgaaactgaccaaggtgatggccgcccgcaagacccaggccgagcaggcgctgaagaacgccaaccagggcggcgactccggtggtgacaactccggcggcggcagcagctcgaacgcggacaagcccggcggcagcctggccggcggctgcacggtcgacgacccgaccaccaccggctgcatcacgccgcgcctgctgttcgcgatgaagcaggcgcagaaggccggcttcacccactacgtcgcgtgcttccggcatcagaacagtggggagcatccgaaggggcgggcctgcgacttcgccgccgacaagggcggcttcggcggggtggcgaccgggagcagcaagacctacggcaccgacctggcgaactacttcatccacaactcggacaccctcggcgtcctctacgtgatctggttcaaacggatctggttgccgagcagcggatggaaggcgtacagcggggtcggggggacgccctcgacggaccacaccaaccacgtacacctgtcggtcatctag

SEQ ID NO: 2475 - DNA, 1038 bp, Actinoplanes utahensis
atgaccgcacgtccccgccggtggctgatgcttgccctggcgccgctcgtggccaccacgatattcgtggcgcccgtcacgccggcacacgccgcgccgagcggcagttcgtcgacgacaccctcggagggtgacgacggcgacgacctctccgatcagatcgaggcgaccaaccggcggtacgtgaacgccaagctcgcggtcgaggcctcgcagaagaagcagaaggacctcgccacccagatctccgccgcggagaagcgccgcgacgcgctgatcccggaggtcaacgcgatcgcccggcagcagtaccagatcggccagctcaccacggtcggcttcctgctgcgggccgactcgtcgagcgacttcctgcacaaggccatcggtcttgaggagatcaacaagctcaacgacgacaagctgaaggatctgaacaccacgctcgccacgatcaccaacagcaagtcggcgctcgacgccgagctgaagaacgagcagcagcagctctccatccagcagaagcagcacgacactgcggagagccagctcgacctgctcggtggtggcaccggcatcaacaagaccatcaccgccggtttcgtcgacgcgacgtccaaggtcgcggcccccgcgccgcgcaactccagcggcggattctcgcccgagtcctgcaccgtggacgacccgaccaccagcggttgcatcaccaagcgcaccctgcacctctaccaggaggtgaagaaagccggcttcaaccgcttcgtcgggtgccaccgcgacggcggcccgttcgagcatccgaagggtcgggcctgcgactggtccctgcagaagagcggcttctcggtcgcgcacaacagcgacatgatgcggtacggcaacgacctcaccgcgttcctggtacgcaacgccgaccggctcgggatctactacgtgatctggtacaagcagatctggttcccggcgaccaacaactggcacgcgtaccacggcccgagcgaccacacggaccacgtccacgtatcgctgctctga

SEQ ID NO: 2476 - DNA, 2304 bp, Actinoplanes utahensis
gtgatccgtgaacgggcctaccccgtcgacccctggcacatccgggagacccggctggacctggacctgctggcccagtccgagtcggttttcgctctctcgaacggccatatcgggatacgcgggaatctggatgagggtgagccgcacggcctgcccgggacgtatctgaattcgttcttcgagctgcggccgatgccgcacgccgaggcggggtacggcttccccgagtccggccagaccatggtcaacgtcaccaacgccaagctgatgcggctgctggtcgacgacgagccgttcgacgtgcgctacggcgagctgcggtcccacgagcgtgtcctggacatgcgcgccggcaccctggagcgggtggtggagtgggtctccccgtccggccagggcgtgcgggtgcgcaccgtgcggctggtctcgttcacccagcgcgcggtcgtcgccttcctctacgaggtcgagccgttggacggcgccgcccggctgatcctgcagtccgagctggtggccaacgagcagctgccgccgcagagcaaggacccgcgggtggccgcggtgctggagcagccgttgcaggccgaggagatgctggagcagcgctccggtggcctgctggtgcaccacaccaaggtcagcgacctgcgcatggcggccgccatggagcacctggtggagacgccgggccggcacgcgatcaccaccgagggacacgacgactggctgcgcaccacggtcgcctgccgtctggagccggggcagaagctgcgggtggtcaagctcgccgcgtacggctggtcctcgatgcgctcgctgcccgccctgcgcgatcaggtcggcgccgccctggccagcgcccgcctggacggctgggaggggctggtccagcagcagcgcgagttcctcgacggcttctgggaccattcggacgtacgggtcgagggcgacccggaggtgcagcaggcggtccggttcggcctgttccacacgctgcaggccggcgcccgggcggagcagcgcccgatcgggtcgaagggcctgaccggccccggctacgacggccacacgttctgggacgccgagacgttcgtgctgcccgcgctgacctacacccagccgtccgccgcggcagacgtgctgcgctggcggcattcgacgctggacctggcccgggagcgggcgcagacgctggggctgcagggcgcggccttcccatggcggaccatccgcgggcaggagtgctcggggtactggccggccggcaccgcgggcttccacatcggcgcggacatcgccgacgcggtccggcggtacgtgcaggccaccggcgactacgacttcgagcgggaggtcggcctggagctgctggtcgagacggcccggctgtggcggtcgttggggcaccacgaccggcacgggcggttccacatcgacggcgtcaccggtccggacgagtacaccgcggtggtgaacgacaacatctacaccaacctgatggcccagcagaacctgatggccgcggtggacgcctgcaagcggcacccggacctggcgcgccggttcggggtggacgacgaggaggctgcctcgtggcgggatgccgcggcggcggtgcacatcccgtacgaccgcgaactgggtgtgcatcagcagtgcgagggcttcacccggctgcaggagtgggacttcgagaacactccgccggagggctacccgctgctgctcaactacccgtatttcgacctgtaccgcaagcaggtggtgaagcaggccgacctggtgatggcgatgtacatccggggtgacgccttcacgccggaggagaaggcgcgcaacttcgcgtactacgacgcccgcaccgtgcgggactcctcgctgtccgcctgcatccaggcggtgatggcggccgagaccgggcatctggagctggcgcacgactatctgggcgaggccgccctgatggacctgcacgacctgcaccagaacgcgcgggacggcgtgcacgtggcgtcgctggccggttcctggatcgcgctggtcgccgggctcggcgggatgcgcgatttcaacgggcagctgtcgttcgcgccgcgactgcccagccggatcaacaacctggagttctcgctgctctggcggggtctgcggctgcgggtcaacgtgaccgcgagcgaggtcacctactcgctgcgcaacggcggcggctcggcccggctcactctgctgcaccacggcaaggagatcgaggtgacccaggtccgcccggtgaccatggcgatcccggcgcccggctag

SEQ ID NO: 2477 - DNA, 771 bp, Actinoplanes utahensis
ttgtgcggcgggtgcgactacattgggcgcgtgctcggacttccttcccaggtgaccgcctgccttttcgatcttgacggggtgctcacgcagaccgcccttgtgcacagtgccgcgtggaaacaaacgttcgacacgttcctcgaatcgtgggcccggcagcatgatcaagagtttgtgccgttcgattcaggcgccgactatcaccgatatgtcgacggccgtcagcgcgctgacggcgtccgcaccttcctcgcctcccgtggcatcaccctgcccgagggcaccccggacgacgatcccgaccaggagaccgtcaacggcgtcggcaaccggaagaacatcctggtgctgcagaagatcaaggagggcgccgttcaggtctaccccggatcggtggagtacctgaaggcggccaaggcagccggcctgcgccgtgccgtcgtctcggccagcgccaactgcaaggacgtcctggaggcggccggtatcgccgacctcctggaggcccgggtggacggcgtcgtcgcccgggaactgggcctgccgggcaagcccgcgccggacacgttcctgcacggcgcgaaactgctcggcctcgatccggccgcctgcgcggtcttcgaggacgcccaggccggtgtcgccgcgggccgggccggccggttcggtctggtgatcggcgtcgaccgggtgggccaggccgaagcgctgcgggagaacggcgccgacgtcgtggtcgatgacctggccgacctgctcgaccagtaa

SEQ ID NO: 2478 - DNA, 522 bp, Actinoplanes utahensis
atgcctcctgccaccgaacggccacagcgcgtaggctgcagcacggtggaggacaggatcggccagaccgtgcgttcggctccgggtggggagccgagggtcgatgccgcccggccacggcccgtttccccggtgctgctggaccgggcgttcggccacgccgacatcacccttctgcggcacgaggtgacccggctgctgcccgcggtcggggtctccggtgaccgcctctccggttacgtgctcgccatcaacgaggtgatcacgaatgtggtgctgcacgccggcgggcacggccggatcgtgctgcggctggaggcggggtcggtctggtgtgtggtcaccgattcggggccgggcatcccggagggctgtctggacggcgatcttctccccggtacggatgagatcggtggtcgtgggctgtggctggcgcaccagttgtgtgacgaggtgacgacggccacgggcccgatcggcacctcgatcggcctccgaatggatcttgttacggcgagctga

SEQ ID NO: 2479 - DNA, 1296 bp, Actinoplanes utahensis
gtgtccaccgtcgcgctcaaggatgtcagcaaggtttggccggatggcacgctcgctgtggatcgggtgtccctcgatgtgcgcgacggcgagttcatggtgctgctggggccttcgggctgcggcaagtcgaccgtgctccgcatgatcgccggcctggaggatcccaccgagggcgacatcctgctgaacggggagccggtcctcgacgtgcctccgcgcgaccgcagcatcgccatggtgtttcaggatttcgcgctctatccgcacatgacggtggccgacaacatcggattcccgttgaagctttccggcgtcgagccggggtcgcggtccgaccgggtgggcacggtggccggcgcgctcgggatcggcgaggtgctggggcggcggccgagtcagttgtccggcgggcagcggcagcgggtggcgatgggccgggccatggtgcggcggccgggcatcttcctgatggacgagccactctccaacctggacagcggtctgcgcgccgaactgcgggccgagatcaccagcatgacccgggagctcggggtcaccaccatgtacgtgacgcatgatcaggccgaggcgctcaccatggcggaccgggtggcgatcatgcggcgcggggtgctgcaggacctgggcacgccgaccgaggtgtaccggcggccggcgacgctctacgtcgcggctttcctggggtcgccgcggatgaacctgctggaggcccaggtctacgtgcacctggaccggttcgtcgcgttgaacttcggggagcagacgctctatctcggctggacggatccgcggtcgcgggcggtggcccgctaccacggtgagcggatcgtggtgggggtgcgggccgaggcgctcaccccggtgacccccgacacacccggcacggtgttgcacggccggatccggtatctggagcaccacgggcacgaatcgctggcctacctggatgtcggggcgaccgcgatcgtggtcgacgaggtcggcgggccggtgcgcggcccggcgaccgggggtggcgcgttgaagcggctcggcggagccctgcagcggctcacccggtcggcgccggaggaggcgtcggagagcccggtcgcgccggtcagtgtgctgaacgatccgggccggcatcaccgtaagccggccgagctgtcggtgcggctggcgccgtatccggcggtcactccgggccacccattgaccgtggcggtgcagatggacgccgtgcacttctttgacgagcgcggcgaccgcatcgacgtgggctggcgctga

SEQ ID NO: 2480 - DNA, 270 bp, Actinoplanes utahensis
gtggcccggtacctaacgtcgaagtggtccagggcaaaaccgccccggccaccactgaaggagtggatgacagtgacccgccccctcgcgtcacacagcctgacccgcccgcgcgacaaccgcatgatcggcggcgtctgcgccggcctggcccgccgcttcggcctctccaccggcgtcgtccgcctggccttcgtcctgtcctgcctgcttccgggcccgcagttcatcgcctacctggtcctctgggccttgatgcccagcgagtga

SEQ ID NO: 2481 - DNA, 744 bp, Actinoplanes utahensis
atggccaactcaccggatgtcgaagagccgacgacggagtacccggccgtgcccgaggaggcggagccgggtgctccggccgtcccgcaggagcacaggccgagcttcttcgcacggctgctgatcttcatcggcgtcgtcttcgccctgatcgtcgcgtcctgcttcggcctgcgcgcgctgcacgtgctgccctcgttcgacaacccgttcgccgacaagaccaccgaccgcagccagcccgtgctgctgcagtccatgcgcgacctgcaccgctacgtcgcggccgacggcaccttccaggtcatcgtcgacctccagcagaacaaggacaacattcccgacttcctggtcaatcggcgcatcctgttcgtcggctccggcaccgtcgaaacctatgtcgacttcagcgccctctccggtgacgccctcaaggtcgacaacgagaagaagacgatcgagctcaccctgcccccgccgcagcagtcccaggccgcgctcgacatgcagaagagctacgtcgtcgaggaggatcgcggtctgctgaccagcatcggcgacgccttccacagcgacaccgacaaacagcagcgggtgtacgcggcggcccaacagaagatcaccgaggcggccaagtcgagcggcctggaccagcgcgcccagcagaacacgcaggccatgctggagagtctgttcacacggttgggctacacctcggtcaaggtcacgttcaccaacccctga

SEQ ID NO: 2482 - DNA, 1176 bp, Actinoplanes utahensis
atggttgctcgaccgcttgacctgctggatcttgacgacctgctcaccgacgacgaccgcgcggcccgcgccctggcccgccaggtggcgaacgatcatattcgtcccggcgtggcgcagtggtacgagaacggtgatccacccattcgcgatcttgccgtggaattcggcaaggccggattgttcggcatgcatctgaccggttacggcctgcccggggccaccaccatctcgtacggcgtggcctgcatggaattggaagccgccgactccgggatccgctccctggtctcggtccagggctcgctcgtgatgtacgcgatctggcggtacggctccgacgaccagaaggaccggtggctgcccgcgctcgccgccggccggaccatcggctgcttcggcctcgccgagcccgaccacggctccgaccccaccgggatgtccacccgggcccgccgcgacggcgacgactggatcctcgacggggtgaaaacctggatcctcaacgcgccgatcgccgatgtggcggtgatctgggcccgcgccgagaaaggcgtcgccgggttcgtggtgcccaccgacacgcccgggctcaccacccgggcgttccggcacaccatgtcgctgcgtgcggccagcgtcggcgaactcgccctcgacggggtgcggctgccggacagcgcccggctgcccgccgcccgcagcctgatggcgccgctgtcctgcctcaccgaggcccggctcagcatcatcttcggggtgctcggcgcggcccgggactgcctcgacgtgaccctcgactacgccgccgggcgggaacagttcggccggccgatcagcgccttccagctgacccaggcgaaactcgccgacatggcactggaactgcagaaggggttcctgctcgcggtgcacctgggccggatgcgcgacgccgggggcgcaccgctgcggccggaacaggtgagcatcgggaagctcaacaacgtgcgggaggcgttgaagatcgcccgggagtgccggacgatcctgggcggcaacgggatccgcggagagatgccggtcatgcggcacgccgggaacctggagagcgtgctgacctacgaggggacctcggagatccaccaactgtcgatcggccagaaattgaccggtctgaacgctttttcacattag

SEQ ID NO: 2483 - DNA, 297 bp, Actinoplanes utahensis
gtgatcttcaaagcggtccgggacggggccccgtaccctgatcaccacaccacgctgaaagcgtgggcggagatcccgccgcggccgatccggctcgccgatctgatcaccacgaaacgcgagctggcgctggacaagctgctcgccgaggattcgacgttctacggagatcttttcccgcacgtcgtggagtatcagggcgcgctgtatctggaggacggtctgcaccgcgcattacgcgccgcgctccaacagcgcaatcagattcacgctcgtgtattggtcgtggaaggctga

SEQ ID NO: 2484 - DNA, 624 bp, Actinoplanes utahensis
atggagttcgacgaggtgatccgccggcggcggatgatccgggggtacgacgtgtcgcgccccgtgccgcccgaactgatcgacaagatcgtccggcacgggctgcgggcgccgtcggccggcttcgcccaggggtggagcttcctggtcctgtcctcgccggacgactgtgaccgcttctggtcggcgaccactgtcgagcagcacaccgacgcctggctcgcccggatgcggaccgccccgctgatcatcatcgccctgtcgaacaagtccgtttatctcgaccggtatgcggaaagcgacaagggctgggccgaccgggacgagtcccggtggtcggtgccgtactgggacatcgacaccggattcgccgcgctgctgatgcacctgaccgcggtgaacgaggaactcgcctcctgcttcatcgggctgccggcggcgaaggtcgccgacttccgggcggcgttcggggtgccggacgagttcaccccggtgggggcgctcaccgtcggctatccgggggacgacaagaggtcaccgtcactccggcgcggtcaccgtccggtggacgaggtagtgcatcatggccggtgggcagcgggcggcggttcgggacgcggctag

SEQ ID NO: 2485 - DNA, 918 bp, Actinoplanes utahensis
atgacagagacagccgcgaaatccggggtccagtggtcgatcgaggcggatggccggcgcgccgtcctggccgaggtcggaggcacgctgcgcagtttctcgtcgggcggggtggagctgctggacggcttctccgtcgacgagatctccccgggttccgccggccagatcctcgcgccctggccgaaccggatccgggacgggcgctacaccttcggcgagcagacctaccagctggcgctcaccgagccggcccggcacaacgccatccatggcctggtcaactgggcgcgctggcgggccaccgagcacaccgcctcggccgtcaccctggaatacgacctgcccgcccaggtcggctacccgtggccgctcaccctgcggacccgctggtcggtgtcggccgaggggctgcgctgcgcgcaggaggtggtgaacaccggcgacgccgccgcgccgtggggctactccgtgcacccgtacctgcgcctgcccggcgtcagcgtcgaggacaccgtgctcaccgtgccggcccggaccaggatcctggccgacaaccggctgctgccgctcggcgcggtcaaggtggccggcaccgagttcgactacgccgagccgcgccggatcggcaccgcgatcctggacaccacgttcggcgacatcgacttcggcccggacgggctgaccgaggtggtcctggccgacccgtcgtcggacgcgaagatcgtggtctgggccgacgagaagttcaagtactggcaggtcttctccggtgacacgctgcacggcgagcggcaccgccggtccgtcgcggtggagccgatgacctgcccgccggacgcgttccgctccggccgcgacctggtcacgctggcgccgggggagacctggaccaccgcgtgggggatccgcgcctga

SEQ ID NO: 2486 - DNA, 1293 bp, Actinoplanes utahensis
gtgagcgtggtcgaggagaagtcgaaacgctcctggatgatcgacaccacaccgctgcgggtgacgtcgttccgccggatgtgggtcggcaacggcgcgtcgttcttcggtttccagttcaccgcggtggccgtgccggtgcagatgttcgcgatcacgcactcgtcgttctgggtcggcctgctcggcgtcgccggcctggtcccgctgctgatcttcggcctctggggcggcgccatcgccgacgtggtcgaccggcggcgcctgctgctgaccagctccgcgctcacctgggtggtcactctgggcctgctggcgcaggcgatcgcgggggtacgaagtgagcacctgctcctggcgctcaccgcggtgcagtcgatcgggttcgcgatcagctcgccggcccggcagtcgatcatcccgcgcatcgtccccgccgagatggtgcccgcggcgaacacgctgaactacaccaccacgacggccggtggggtgctcggcccgctggccgcgggcctgatcatggggatctggtcgaccggcaccggggtggccgtggcgtacgcggtcgacgccctgctcttcaccgtcaccttctgggccacctggcggctgccggccatcccgccgatcgagccggacgacgccggggagaagcccacggccggcctccgcggcatcgtggccggcctgcgcttcctggtcacccagccggtgctgctgctgtccttcggcatcgacctgatcgcgatggtcttcgcgatgccgcgggcgctgttcccggcggtggccgagacccggttcggcgacagctcggcggtcggctggctgttcagcgcgatcgcgatcggctcggtgctggccgggttcacctccggctggatcagccgggtccgccgccagggtgtcgcgctgaccgccgcggtggtcggctggggcatcgcgatcgccctgtccggcctggcccaccagctctggctggcggttctgctgctcgccgtggccggcgcggccgacctggtcagcgcggtctaccggcagacgatcatgcagaccttcgcgccggaccggctgcgcggccggctgcagggcgtgttcaccgtggtggtggccggcggtccccggctgggtgacctgcgggccggtgccaccgcccagttcacctcggtgaccacctcctgggtggccggcggggtgctcgccgcggtgctggccgtgggcctggcgctggccttcccggcgctgctgcgataccggcccgtcccggatcccgtggccgaccccgaacgatag

SEQ ID NO: 2487 - DNA, 675 bp, Actinoplanes utahensis
atgtctgccgatccgccgtcccccgcggggatgcgccgtgactacaccgagcacccgccgctgctggagggctccctggccgggcactggagcgaccagttcgccgcctggttcgccgacgcgaccgcggccgggctgcccgagccgaacgcgatgatcgtggccacggcggatgcccaggggcgcccgtcggcccggacagtgctgctcaaggggtacgactcgaccggttttgtgtttttcacgaactatgagtcgcgcaagggctcggacgtgcggcacaacccgtacacaagcgtcgtttttccctggtttgcgatgcaacgccaggtgatcgtgaccggggcggtggaacgcgtctcccgcgccgagaccgaggagtatttcgcctcccgtccgcgcggctcccagctcggcgcgtgggccagcccgcagtcgcgggtgctgcccggcccggaggcgatcgacgcgcgcctggccgaggtgatcgagcggttcggcgacggtccggtgccgcccccgccgcactggggtggtctgcgggtgctgcccgagaccgtggagttctggcagggacgcagcagtcgcctgcacgaccggctgcggtatcgcgcagtcggcgagaaccggagcgccgtcgagcgggactggatcgtggagaggctggccccgtga

SEQ ID NO: 2488 - DNA, 1146 bp, Actinoplanes utahensis
atgaatcactcaccgcagccacgtctcccagggagcgccgtgtccgacttcaagccgggactcgagggcgtcatcgcgttcgagaccgagatcgccgagcccgaccgggacggtggcgcactgcggtatcgcggcgtcgacatcgaggatctgatcggccaggtctccttcggcaacgtctggggtctgctggtggacggccggttcggacccgggctgccgccggccgagccgttcccggtgccggtgcactccggcgacatccgggtcgacgtgcagtccgcggtcgccatgctggccccgtactgggggctcgaccagctgctcgacatcaccgacgagcgggcccgccgggacctggcccgggtctcggtgaccgcgctctcgttcgtcgcccaggcggcccgcgggctggggctgccggccgtcccgcagaaggacatcgacaaggccgagaccatcgtggagcggttcatgcgccggtggcgcggcgagcccgacccgcggcacgtcaaagccgtcgacgcgtacttcatctcggccgccgagcacgggctcaacgcctccaccttcaccacccggatcgtcgcctccaccggcgccgacgtggccgcctgcatctcctccgggatcggcgcgctctccggcccgctgcacggcggggcgcccacccgggtgctgcacatgctggaggcggtcgagcgcagcggcgacgccgagggctatgtgaaggatgtgctggaccgcggcgaccggctgatgggtttcggtcaccgggtctaccgcgccgaggacccgcgggcccgggtgctgcgccggatcgccaaggagctcggcgcgccgcgcttcgaggtggccgccgcgctggaggcggccgcgctgaccgagctgcgggaacgcaagccgaagtgcgagctgtggacgaacgtggacttctggtccgccgtggtgctcgacttcgccgaggtgccggtgcacatgttcacctcgatgttcacctgcgcccgggtggccggctggagcgcgcacatcctggagcagaagaagctcggccggatcctgcgccccggcctgcgctacgtcggcccggagccgcgccggccttccgaggtcgagggctggtcccaactcacgcataatgtgtga

SEQ ID NO: 2489 - DNA, 1125 bp, Actinoplanes utahensis
gtgatcgtggctgacatccggatccccgacacgatcaaacccgtcgacggccgcttcggctccgggccgagcaaggtccggccggagggtgtcgaggcgctctccgcggtgtcccgcaccttcatgggcacctcccaccggcagcggacggtcaaggaccaggtcgcccggctgcgccgcgggctcgccgagttcttctcgatgcccgaggggtacgaggtggtcctggccaacggcggcaccagcgcgttctgggagatcgccaccttcggcctggtccgggaccgggcgcagttcgccgagttcggcgagttcggcgccaagttcgtgcaggcggtcaccgacgcaccgttcctggctcagcccaccgtgcaccgggccccgggcgggcaggccgcgttcctgaccgccgaggccggcgtcgacgtctacgccaccgtgcagaacgagacctccaccggggtttccgtgccggtccgccgggtcgcgggcgccgacccgggcgcgctgctgctcaccgacgccacgtccggcggcggcagcctcgacgtcgacctgcgcgagaccgacgtctactacctggccccgcagaaggcgctcggctcggacggcgggctctggctggccctgatgtccccggccgcgatcgagcgggccttcgagatcaaggcctcgaagcggtacatcccgcagttcctcgacctggtcaccgcgatcgagcagtcccgcctggaccagacgtacaacacgcccgcgctggccaccgtcttcctggcggccgagcagctggactggatgaacgcacagggcggcctgtcctgggcggtcaaacgcagcgcggagagcgccgcggcgatctacggctgggccgaccggtcgtcgtacgccgagccgttcgtgaccgatccggcactgcgctccgcggcggtcgccacgatcgacttcaccgacggggtggacgccgccacgatcgccaaggtgctgcgcgccaacgacatcgtggacaccgagccgtaccgcaagctgggccgcaaccagctgcggatcgccctctacccgaccgtcgacccgaccgacgtcaccgccctgaccagctgcatcgactacgtggtggaacggctctga

SEQ ID NO: 2490 - DNA, 687 bp, Actinoplanes utahensis
atgcggccggtacgcttcgtcgccctctccgaggatggacaggccctcgtgctcgccgacgaggtgggccgcctgctggcgctgcccctcgacgaccgggttgccggggtcctcaccgacagccccgcaccgccgagcacggcggtcgcggtgctcgccccggacgtccaggcctcactgtccccgcgggacatccaggcccggatccgctccggcgagtccgccgaggacgtcgcccgggtggccggcgtccccgtcgaccgggtcctccgctacgccggcccggtgctgcaggagcgcgccatgctggcccagcacgcccggcgcacccggctgaagacgtccgactccggccagcccctggccgaggtcgtcgacagccggctcgcccagcacggcatcgacaccgagaagatctcctgggacgcgttccggcgcgaggacggcacctggcggatcgtcgccacctggccgtccggcaaagccaccgcccaggccatctgggacctcgacaagggccgccaggtcgtctccccgcacgacgacatggcgcagtacctgtgcgccgagcgccccacccagatcctcggccaggacccggtccccgagcgcggtggccacggcctgcccggcccggcccgcagcgccgagcccacccgcggcggccacggcctgccccctagctag

SEQ ID NO: 2491 - DNA, 990 bp, Actinoplanes utahensis
atgtcctgttcggcggcggccccgcggcccgcgagtcctcctgaccccgtggcccggccgcgcccctcggcgcggccgcccgcaccctcccgcatcactccccgcggccgccccgcagcttcccgcatcactccggcggccgccccgcacctcccgcatcaccttcccgcggccgcgtcgccgagccttccgctctccccggccccacatcgacccaccccctggcgccgccggtccaccgactcgccggggcggcatcgctccatcgcgttcccgaacgccgtcgctctgctgttcctccccgccgccctgccgctcccccttgtcagcgttgccctgctgttcctccccgccgctccccctgtcaccgtcgccctgctgttcctcccgccgctctgccacgtttccctgtggccgacgccgcgtcgtcctgatgtcacacgccgctccgctacccgttcgaggttcgccctgacccgccttttcgtagccgtcttcccgccgccgccggcccgggacgacctgctccgccgactgccgccggacgcccgttacacgcggccgtcaaaatggcatgtgacgctggccttcctcggcgacgtcgaggaccaccgggtcccggacgtcgccgccgccctgaccaccgtgcccccacgcccggcgttctcgctgcacgctgccgggggcggccgcttcggcccggtgatctgggccggcctcgccggcgacgtgcggccgctggctgacctccgcgagtcggtccgggacgcgctcgccgccgccggtttcgccatcgacccgcggccgttccggccgcacctgacgatctcctaccgctcagcacccggcctgctcgcggcgcttaccgggtacgcgggtccggcctggcaggtgagcgaactggccctggtggagagccgcctcggcaactaccactgccttcagtggttccccgtcagcggcgaccagcacggccccgccccgacatga

SEQ ID NO: 2492 - DNA, 294 bp, Actinoplanes utahensis
atggccggggcacgtgaccagccggtgctgccggccggggcgggtgaccagccggtcctgcgggcctgcccgggtcgggactggttgaccagccgggtcctgtggggtgatcagccggtcttgcaggcttgcccgggccgggatgggttgaccagccgggtcctgccggcctgcccgggcggccgacgcttccgtccttgcggcgctcagccgttgccggccgccggcatcggtggcagcgacggcgcctgggcgggcgtcatgtcggggcggggccgtgctggtcgccgctga

SEQ ID NO: 2493 - DNA, 543 bp, Actinoplanes utahensis
atggcgcaactggtcgtgatctcggcggcgtggatgacgctgctgatcgtgccgtgtgcccggatcctgctccggcgccccgcaaagcgccggcccgagacctcgggccacctgccccggcggcgctcgtcgttccgccgggtccccgccccgggccgggtccctcgcaagggcgccccggcctactgggcccgccgccccggcccgcagacccgtgacctgcgccgcctcgaccgcgaactgccgggcatcgacctgaccggccggttggagtcactgcccccggtgccgatcgagcagctggcctacgacctgcgccgcctggaccggcaacgtcgcagcggcgtcctgcgctcctcggaggcctgcctggccgccatcctgcgcgcctacgacgcccgcctcctgctggcctgccgcgccctcggcgtcgccgaacacctgcaacccttgcagggcgtcgaccgcgagtgcgaacgcctccgggtcgaagaccggctcgaagccgccggtctggtcctccgcgaccatcaggacaactga

SEQ ID NO: 2494 - DNA, 1398 bp, Actinoplanes utahensis
atgcgggcagtgctggacacgacattccgatccctgcgagtccggaactatcgcctcttcgccgtcggtcagctgatcaagctgatcggcgtgtggaccatgttcaccgcccaggactggctggtcctggacctctcccacaactcgccgagcgcgctcggggtggtcaccgccctgcagttcgtcccggtgatgctgctgaccctgtacagcgggcggctcgccgaccggtacgacaaacgcaagctgctgatcgtggcgaacaccgcgttcgcggtcaccgcggtcagcttcgcggtcatcgtcgcctccggcatcgtgcagctctggcatgtcttcctgttcgccctgctgttcggcatcgcgaactcggtcgagacaccggtgcgccaggcgttcgtctccgagctcgtcgagctgccgctgctgccgaacgcgctggccctctccgcggccaccttcaactcggcccggatcggcggcccggcgatggccggcgtgctgctgtcggtgttgtccatccgggtggtgttcctgatcgccaccgtcctggtgatcgccccgatcttcacgtacacccggatgaaccgcgccgaactgctcggcatcgaacgcaaggcacgcggcggcgcccgggtgctggacggcctgacctacgtcggcaagcgccccgacctgctgctcaccatctgcctgatggcggtgatcggcatgatcggcttcaacttcccggtcaccctggccgccctcgcaaagatcaacttccatgccggggcgtcgtcgttcgggctgctcaccaccgctctggcggtcggtgcgctcggcggcgcactggccggcagcggccgccgcacccggcccgggatgtaccgggtgatcggcgccgccctcgccttcggggtgttcgagttcgcggtcgggttcgcccccaccttcctcgtcgcgatggtgctgctggtccccaccggcttcttctccatctacctggcgcaggccgccaaccaccgggtccaaatgggcgtcgacgccgaataccgcggccgggtgatgtcgctgtacgtgctggtcttcctcggcaccacaccgatcggggcgtccctggccggatggtgggggtcgcacttcggggtgccgtccagcatctgggtgggtggtctcgtctcgttcctggcctccggggtggcgctggcctggcagttgcgggccggtggggagcggatcgaggtgcggttgcggccgcggccccggttgcggctgatcccggctcccgctacgccccctgcggtgcccgcggaggccgcgccgcttgcggaggcggaccttccggaggtgccaccgatggcggtacgtcgcgggcaccgccccggtcgcgcccccgaacccgccggtcacgtctga

SEQ ID NO: 2495 - DNA, 432 bp, Actinoplanes utahensis
atgacgacggagcgcacagcggcatcgctggccaagacgctgcgggaagcgatcatccggttcagcaggcgggtccgtcaggcccgcccggtcggggatctgaccttcagtcagctctccgcgctgaccagcctccagctgcacggcgcgctcaccccccgtgagctcgccgacgtcgagcgggtccaaccgccgacgatgacgaagatcgtcggcaagctggaggaccgcgggctcgtggcgcgcacgccgcaccccaccgacgggcgccaggtgatcctggccgccaccgacgagggtcgcgcggtctatacgcagaacgaggacatccgcaacgagtggctggccggccagttggaccggctgacccccgaggaacgggacaccctggcacgcgccgcggagatcatgctgcgcgtcgcccgcggctga

SEQ ID NO: 2496 - DNA, 1443 bp, Actinoplanes utahensis
atgtccacaaccgcagaaactactgcgcggagcgggttcgaccgcttcttcgagataaccaagcgcggctcgacgctgagccgtgagatccgtggcggattcgtcacgttcttcaccatggcgtacatcgtcgttctgaatccgctgatcctggcgggtggcacggacaaggccggcgcgcacctgccgctggccgcgctcgccgcgggcaccgccctggtcgccggtgtgatgaccatcctgatgggcgtcgtggcccgcttcccgctggcgctggccgcgggtctgggtgtgaacgcgctggtcgcctacgagatcgccccgcagatgacctgggccgacgcgatgggcctggtggtgatcgagggtctgctgatcggcctgctggtgctcaccggcctgcggacgatggtgttccgcgcggtcccgacccagctgaagaccgcgatcggggtcggcatcggcctgttcctgatgatcatcggactggtcgactcgggtttcgtgcaccgcgtgccggacgtcgcgaacaccaccgtgccggtcgagatgggtctcggtggcaaactgctgacctggccgaccctcgtcttcgcgatcggcctgatcttcacgctgatcctgttcgtccgcaaggtccgcggcgcgatcctgatcggcatcctgggcagcacggtgctggccatcgtggtggaggcgctcgcccacgtcggctcggtggtgcagaatccgcacggctggtcactgaacgtgccgaagatgccggcccaggtggtcagcacgccggacctgtcgctgctgggtcacttcaacgtgctgggttcgtggcggcacggcggctggctggtcgcgctgatgttcgtcttcacgctgctggtggcggacttcttcgacacgatgggcacgatggtcgcggtcggccaggagggtgaactgctcgacgacgaagggatgccgccgaggacgcgggagatcctgctggtcgactcgctcgccgcggccgccggtggcgcggcgagcgtctccagcaacacctcgttcgtggagagcgcgtccggcgtcggcgagggtgcccgcaccggtgtggcgaacctggtcaccggtgggctgttcctgctggcgatgttcttcgcgccgctggtgcaggtggtcccgttcgaggccgcgtcgaccgcgctggtggtggtcggcttcctgatgatgaccgcggtgcggcagatcgactggaccgactggagcatcgcggtcccggcgttcctgaccatcaccatcatgccgttcacgtattcgatctcgaacggcatcggcgccggcatcctgtcgtacgtggtgctcaaggccgccaccgggagggcgagggaggtgcaccccatcctgtacggggtggccgtgctcttcgtgctgtacttcgcccggggtccgctggagaactggatcctctga

SEQ ID NO: 2497 - DNA, 279 bp, Actinoplanes utahensis
gtgagtgacctgtctcccggtctgagcgtcgtcaccggctcgaaaccacgacccgagccgctggacccgccgatggtcccgttcgcgctcgccggcctggccgcgttcgccgtcgccgcgctcatctgcctgctggccggcgcgcccgaccgctggctgcacaccagcgtggccgggttcctggtcggcatcccgggcctgatcacgatgatcgtccacgaccggaaccggaagcgccgccgggcgctctcccacgcggagttccgcgagatctcctag

SEQ ID NO: 2498 - DNA, 1746 bp, Actinoplanes utahensis
atgtcgcgctccatcacggcccgccggcgcggccagtccggctcgacgaaccattcccagatccgggcgaacaccgctgcggcccgggtggtgacaccgtcgacgtcggcccactgcagatcgttggtcttccaggcgtaccggccggactcggcgatcgtcgcccgggccgccgcgtccggcagcagcgcgcgcatctccgccagctcgtcctcgatccgggtggtcatcgacgtgggtgggatcgccacgaagtccggcaggtacttcgtcgccgagatcagccggaccaggcccgcggcgaacgggtcgtcggcgagccacccggccagcgcccgcgcctgggcgcccggccgcccgccgtcctgctcccgccgcaggacgaccagccggctgaacgtctcggcgagcggcgagagcgcgaaccggctggcccgcagcgcctccggtccgagacggatctgcgtcatggcacgaccttgcggcaatcgccgcaggaatgcaaacccgcggccgtacgggatgacgatgctcgccgtgaccagcgacctttccgccgccccggtgcggcgactgctgagcggccggttcggatggttcctcgcgggtcgggccgtcgacatcttcggcacctcgatgacgacggtcgcgctgtccctgggcgtgctccaggcctccggccgggccaccgacctgggcgtcgtgctcgccaccagcatggtccccacgctggtgctgctgctcgccggcggtgtcctggccgaccgcaccagccgccgtgggctgctcatcgccgccaacgcggtcagcgcggcggccgtcggcgggatcgccgtcgtgctgatcaccggccgctaccacctcgggacggtcgccgggctgtccctggtcagcggggctgccaccgcgttcgcgtcaccggccctgcgcgggatcgtccccgagctcgtcgacgacgctgacctgcagcgggccaacgcgctgctgtccggcaccaggaacggcacccggatcatcgccccggccgtggccggcctgctcaccgtcaccgccggcgggggttgggcgctggccgccgacgcggccagctgtctcgtggcggcggcgctgttcctgcgcttgccgcccgggagccggaccgccgccaccgcacccgggctgggcgccgacttcgcgaccggctggcgggtcttccgctcgatgcgctgggtgatgctgaccagcttctcgtacgcactggtcaacgcgttcgccgtcggcccgtggaacgtgctcggcccgacgatcgtcgccgcgcacgggggcgcgttcggctggggcgcggtgctgtcggtacgcgcggccgggctgttggcgaccagcctggtcgcggtcaagctggtgttccggcgaccgctgcggaccggactgctgctcggcgtcacgtccgcgtccccgttgctggccctcgggctgtccggcgaggcgtggaccgtggccggggcggccttcgtgggtggcatcgggttcacgatcgcgggcgtcacctgggacaccgcgctgcagacccgggtaccgcgggaggcgctgtcccgggtttcgtcgttcgacgacctgttctcgttcatcgcgatcccgttgtcacaggtcgcgatgggaccgctcgccgcggcggcgggcgcgggccgggtggtcgtggtgtgcggcgtggcctacgtcggcgcgtgcctgctcccgttcctgagcccggagatccgccgcggctag

SEQ ID NO: 2499 - DNA, 822 bp, Actinoplanes utahensis
gtgacctccaggactgtcgcccgcgccgcccgactcgaccaggtctgtgccgatgccgtgggggtggcccgtggcgcgatcaccgatgtggacccgaccgacatcggtgagcacctggaggcgatcgccgagggcgatcgtgtcgtgactcacttcttcgagtcccacctggccggttaccgcggctggcgctgggcggtcacggtgacccgggtgccccgcagccggcacgtgacgatctgcgagacggtgctgctgcccgggccggacgcgttgatggcccccggctgggtcccgtggaacgagcgggtccagcccggcgacctgggtgtcggcgacctgatgccgaccgcgccggacgacgaccggctcacccccggctacgtgctcagcgacgacgccgcggtcgaggaggtctcctgggagctcggcctgggccggtcccgggtgatgtccaaggacggccggatggagaccgcccagcggtggtatgacggcgacgccggtccggaggcgccgatctccaccgccgccccgcggaacgcgcgctgcggcacctgcggtttctacctgccgctggccggcacgctgcggcagatgttcggtgtctgcggcaacctgtacgcgccggacgacggccgtgcggtcagcgccgaccacggttgcggcgcgcattcggaagcgctgctggccggcaccgagcagccggtcgacgagctgccgacgatctatgacgacagcgaggtggaggcggtggcggtcagccgcggccacggctcggtcgagtcgggcgagcccgccgaggacttcggccacagctag

SEQ ID NO: 2500 - DNA, 1983 bp, Actinoplanes utahensis
atgccgttgcttcccactctcggacgcaccgtcggcaccggtgtgaaggcggtccgcgtcgtcgtgcgcggctgcgtgcgcggcacggcctgggccacccggcgggtcggcacgatccgggcccgcggcgcggccggcgagatcggcatgatccgactcttcgacctgcacgcggtctcctgcgccggcgacgcgctgatcgcgatcgggctggccggcaccatcttcagcgttccgctcggcgaggcccgcggcaaggtggcgctctacctgctgatcaccatggtgccgttcgcgctgctggcgccggtcgtcggcccgctgctcgaccatttccggcacggccggcggtacgcgctggcggtcaccatgctcggccgggcgttcctggcctacgtgatgtccgatcacctggccggctgggcgctctatccggcggcgttcggggtgctcgcgctgtcccgggcgtacggggtggcccgatcggcggccgtgccgcgcctgctgcccgacggggtcggactgtcccaggtgggcgcgcgggccagcgtctacggcacgttcgccggggcggtggtcgccccgatcggcctgctcgccttccggttcggcccacagtggccgatgcgggtcgccaccctgatcttcatcgtcggcatggtgatcgcgctgcggctgccgccgcgcgccgactccgacccgccggaagccatgccgcgcgcctggcgcaccctgctcggcctgggccgcggcccggaccgcccgctctccggccggctcatcctggccaccctggtcggcagcgccggcctgcgcctgctctacggctacctgctgctcttcctgaccttcgcgatcatggccggggacgtcggcaccggcatcctcggcctgaccgtcggcaacggcaccgcggtcggcatcgtcggcggcgccctggccctcggcacgttcctgtccaccgcggccggcaccggcctgcacatccgccgcccgctcgccctgcaagccggcggcctgatggtcaccgccggcgccgcggtcctcgccgccgtcgtcgccaacctggccaccatcaccctgctggcgctgctcgccgccaccttcagcggcatcgcgaaactcgccgtcgacgccaccatccaggaacgcgtcccggaacgcctgcgcgccaccgccttcgcccactcggaaaccgtcctgatgctcgcctgggtcaccggcggcggcctcggcctgatcccgctcaccggccgcctcggtatcgccctcgccgcgctgctggcgagcctggccgcggcccgcgccggctggtccgcggcccggctccgcggcgaacggttgtccggccggtccgggttcgccgaggacaaccccggcgatccggtcgcggtctccggagacggccgattcgccggtacgccggaagcccccaccaccgcgcccatcccgcccgccccgcggccgtccgccacccacccggaccggcccgccgggcggctcgacgacgaggcggtgttcgacgaggcggccgacccctggccggacgccccgacggtgcccgaccaggccggccacaacccgccggtccagcgccgcaccacccggcccggcccgcccgacgtcgatacccggccgagcgccacgggccccggcacccgcgaccacgacacccggcagagcaccacggggccgggcgcccgtgaccacgacgtccccgccggcccacgcgcggagcatccgctggacacgacgctcgtggacgagccgggccaccgtcgctggtggtcccgccgcaggcccgcgaagaagccgaccaccccgccgcccgcctccccgggcgttccggagccgacgcagcagttcccgaccgaggccccgcccggcccgtccccggcaccgcccggctatcacgtctaccggccctcctcggccggcccgtccaccgggaacggcgactccgaaagcagcgacaacgcgtga

SEQ ID NO: 2501 - DNA, 999 bp, Actinoplanes utahensis
gtggtcccgccgcaggcccgcgaagaagccgaccaccccgccgcccgcctccccgggcgttccggagccgacgcagcagttcccgaccgaggccccgcccggcccgtccccggcaccgcccggctatcacgtctaccggccctcctcggccggcccgtccaccgggaacggcgactccgaaagcagcgacaacgcgtgaacccgctcctgctcgtcaccgcggtgcccgccgaggccgacgccctccgcgccgccctcggcccggccgccaccgccgcgggccacaccaccaccgccgccggccccgggtccaccgccgcgggccacaccaccaccgccgaccccgggtccaccgacgcggcccactccaccgcggatccccacgcgatgcccgatccggctgccgtgccgggccggggcgggggcgcggatccccattcgcttgcggtcgtcgtcgaggcggtcggcgtcgggcccgcggcggccgcggccggtaccgcccggctgctcgcccggcgcccctaccgcgcggtgatcagcgtcggcatcgccggtggcttcccgggccgcgccgcggtcggcgacaccgtcctggccgcccgcacgatcgccgccgacctgggcgccgaatcgccgagcggtttcctgccgatcgaggagttgggcttcggcagcagcaccctgacgatcgatgctgagctgctgcaatcgttgcgggccgcacttccgcacgcgatcaccggcgacatcctcacgctgagcacggtcaccggcaccgcggcgaccaccgcccggctggcgacccgtttcccgcaggcggtcgccgaagccatggagggctacggcgtggcgatcgccgccgccgcggccgccgtcccgttcgccgaactccgcacgatctccaacccgatcggcccccgcgaccgcgccgcctggcgcctggccgacgcgttcgccgccctgcgagccgccgcccccgccctgctcaccctcccctga

SEQ ID NO: 2502 - DNA, 1176 bp, Actinoplanes utahensis
atggacgagatgagcgccgcggcgcgggcccgtttgatcggtgccggctacgccgcccaggggctgggttatgcggcgatcgtcaccgccctgcccgcgttcaaggaccggcagcacctgaccgacggcaaggtttccgcgatcctgctgttcgtctgtgtgaccgcggcgctcggctcggtggtcgccgatcagttggcggcccgctggggcagccggcatgcgctggccggcggtctgttcctggtcggcgccgggttggccgcgaccctggtcggcacgccgaccgtgctcttcgtgacgatccttctgctgtacggggtgggtctcggcatcgtcgacgcctcgctgagcatgcagggggtgctggttcaggcccgcctggggcgcagtgtgatgagccggctgttcgccgcgtacaccgccgccgcgatcgtcgccgccctgctcatgtcgtggtcgctggacaggcatcacggggcgacggtgccgctgggcgccgcggccggctacgccgtgctggtcggcctggccggctggcgcgctttcgaacccggccgcaccgaacgctccagtgccgtccacgacaccggcagccgcgccgtccgccgggtcgtggtggtctgcggcatgctgatcttcacggcgttcctggtggattcggcggtcagcacgtggagttcggtctacctgaaggacagcctgcattcgcgggccgccatggtgccgatcggctacgccgcgtaccaggcgacggtcctggtcagccggctggtcgccgatcacctggtgccccgggccggccggctgacgatggcggtcggtgcgctggcggtctccggggtcggctgcgccctggtcgtcctgctgccgtcgacggccgccgcgatcgccgggttcacggtcgccgggatcggggtgggggtgctggtcccgctggccttctcggcggcgggtgaggcggccgcggagagcagcgacgaggtgatcgcgcgggtcaacctgttcaactacgggggcgccctggtgggggcggtcctgctgggggcgctgtcggagccgatcgggctgcggatcgcgttcctcatcccggtcgccggggtgatcttcacggtgccgctggcccggcagctgctgcacctgacgccggcgccggcaccgcgcccggctccctga

SEQ ID NO: 2503 - DNA, 570 bp, Actinoplanes utahensis
ttgttcgcggcgacctggcgggtggtgcgggcgcgcggggtcgacgggacgacgacccgggcgatcgccgacgaggccgggtgttcgctgagcgtgctggcgcatttcctcggcggcaaggacgacattctggtggcggctcagcgggcggtctacgaccggatcgtggagcgggccttccgcatcggcggggatctcctcgggttggcggcgttgcgcacggcgctggacgcggtgctgccgatcgacgaggagcgggcggccgacgcgcacgtgaatgtggctttcgccggggcggcgttgtcgcatccgctgctggccgagtcgcggcgggggtcacaccgggtgatccggatgcatctgcggacctgcctgcgggaggcccgcgagctgcgggagctgagggccggcgtcgaggatgaggcggtcatcgacgacttcatcatcctggtggagggcagcacgctgctcagcctggtggacggctgggccgaggagggccgggcggaacgcctgacccgcctcgccgacgccttcgtcaaccagctgcggtcacccggccgcggctga

SEQ ID NO: 2504 - DNA, 1344 bp, Actinoplanes utahensis
atgcgtttcccacccggcttccggttcggcatggccacctcggcctaccagatcgagggcgctgccgacgccggcggcaaagccccctcgatctgggacacgttcaccgcgcaaccggggcgggtgcgacacggcgaggacggccgggtcgccatcgaccactatcaccggtatgccgaagacgtcggccacatcgcggacgccggtgtgcacgactaccgcttctcgatctcctggacgcgggcgctggccgaccccggcttctacgaccggctggtcgacgaactgctcgccgccggggtgcggccggtccccacgctgtaccactgggacctgccgcaggacctcgaggaccggggcggctggctgacccgggacaccgcccatcggctcgccgactacgccggcacggtcgcgctgcgcctcggcgaccgggtccggcactggatcacgatgaacgagatgagcgtccagaccctttacgggtacgggttgacctcgcacgccccgggccgcggactcgggctcgaagcgctgcccgtcgcgcatcaccagctgctcgcccacgggctcgcggtacaggtgctgcgcgcccacgacgccggcgcggtcggcatcgccaaccagcacttcccggtgtacgcggcgtccgacgatccggccgacgccgtcgccgccgacatgttccgcgacctgaccaactggaccttctccgacccgatcctgctcggcgactacccggacgagatgatccgcgccggggtgggcgtcgaggagacgcaactcgaccgggacctggcgctgatcggggcgccgctcgacttctacggcgtgaacttctacgaaccgacggcgatcgaagcgccgcgggagggcaaggactattccggcattctcgaagtcgacatcccggaaggaatgccgttctcgccggtgccggtgaaaagcgacgagcgcaccgacttcggctgggcgatcgtgccggcggcgttgaccgaaatcctggtgacgctgaaagagcggtatccattgctgcccccggtcatcgtcaccgagaacggggcgtcgttccacgacgggccgcccggcgaggacgggcgggtgggggatccgcggcggatcgcctacctgcaggcgcatctggaggcggtggcggcggcgatcgaggccggggcgccggtgcagggctactacgtgtggtcggcgttcgacaatttcgaatgggcggccggctacgacgagcggttcgggctcgtctacgtcgaccgggagacgcaggcccggacccgcaaggactcctggtactggtatcgcgacctgatcaggtcagccgcggccgggtga

SEQ ID NO: 2505 - DNA, 1179 bp, Actinoplanes utahensis
atgacgatcactgaagtgccggtgcgtacgcgctggatggtcgcgtacgcgctggccatgatcggggtggcggccggttggttcgggccgatccagatcctgctgcccgagcaggccgctcggctcgcggaggccaccggcggcggcaaggaggcgctgctcgccctggtcaccgcggtcggggcggccgcctcgctggtcgccaacccgatctggggcgcggtctccgaccggatgggctcgcgccggccgatcttcgtggccggcacggtgatcggcgtggcggggcttctcgtcctggccgcggcggacacccgtaccaccatgatcgtgggttgggtgctggtccaggtgggactgaacggaccgctcgccgcgctggccgcgatgatcggcgaccgcgtgccggaacgccagcgcggcacggtcggcgcgctgttcggcgtcgcccagatcgtcggggtcgtgctgggcaccgccctggccgtcgcgagcggcggatacctggcggtggccgtcgcggtgcccgccctcggcgccgccctgctgctcatccaccgggagccggtgctggtcccggaccggaccgcggtgcgctggtcggcgctgctgcggccgggcgccccgttcgcctgggcctggttgatccgcttcctgctcaacctggtcaacgcgctggtgctggtctatctcttctactacctctccgaccgggtcggggtcggcgacgcggccacctgggtgctcatcctcaccgtggtcaacgtggtcttcgccgggatcttcggcttcgccggcggggtgctctccgaccggtgggaacgccgccggatcttcgtcgcggcggccgcggtgatcctggccgccggcaccgtactgctcgccctgatccccgtggtcgccgtggcgatcctggcgtcggtgctggtcggggccggctggggggcgtacgtcgcggtcgacatggcggtgatcacgcacgtgttgccggacgccgagacccgggccaccatgctcggcgtcgccaacatcgccggcaccctgccgcagctgctcgccccggtgatcgccgcgccgatcgtcacccggctcggcggatatcccaccctgtacctgttcaccgcggccgtcgcgctgctcgcactggcctgcctgccccggctcgaagcactgtcctga

SEQ ID NO: 2506 - DNA, 2028 bp, Actinoplanes utahensis
gtgcgtcgcagactgctcgcgggcgtcctggtgctcggcctcaccggtgggctgtccgcgcccgccgaagccgcggtgacctggacgcccgccaacgacctggagggcgcgtgcgtcaccctccaggcgttcaacggatcgactccgctcggctacgtcttcaaggactcggtcggctacggcttcaccggcaccgccgccaaggccgagccgttccggttcgaggccacccagctcggccggtacgtgctgcgcgaccacaccggcgcgccgccgtaccagagcatgctcggctgggtgtgggccggcgactcgtacggcgaccgggccgactggacggtcagctccgccaccgggcgctaccggctggtcagcaccgcgaccggtcagcagatgggccgctacctgggcggactcggcgccggcagtgccaccatggcgctcaccccggccaccggttgcgccgcgatcccggacatcgccaccggggtgggcggcaccccgggaccctccgtcggcgccgacggcaaactcgtcggctggatcgacgcgcacgcgcacatcaccgccggcgaggcgttcggcggatccctgcactgcggtgacgcctatgcggccggcggcgccccggtcgcgctggccggctgcccgtcgcacgccaccctcggctggggcgcgctgctcgaggcgatcatcgcgggcaccgatccgatcaactcctccgaacagggctggccgtcgttcaccgactggccgcagcacgacaccgagctgcacgaggcgtcctacttccgcagcctggaacgtgcctggcagtccggccagcgggtgctcaacgtgctgctggtggcgaaccgggtgatctgtgagctgaccccggtgcacacctcctgcgacgagatggaccagatccgggcccagtccacctatctgcgccggatgcaggactacatcgacgcgcgcagcggcgggccgggcaagggctggttccggctggccaccacgccggccgaggtccgcgcgatcgccgcgcagggcagactcgcggtcaccatcggggtggagaactcggagatcttcggctgccgggagatccgggacgtgccgcagtgcaccaccgcggacatcgaccggggtctcgacgagctgcagggcatgggggtcagcggcttctacccggtgcacaagttcgacaacgcgttcggcggcacccggttcgactccgggctcaccggcgccgcgatcaacgtcggccagttgctctccagcgggcactggtggcaggcgaccagctgcaccggcccgtccgacaatgatcagccgctggtcagtgacgacctggccaagctgctcagcctcggcgtcgggctgccggccggcacgatcctgcccgtctaccccagcggcaagatctgcaacacccgcgggctgaccaccatcggccgttacctgatccagaagatgatcgaccgcggcctgatcatccacatcgaccacatgagcgtgaagaccgcgaacgacgtgctcgacatggccgtgcaggccggttacccgggggtcacctcggtgcacagctgggccgaccgggccctggtcgaccgggtgctgcaggccggcggcttcgtggccggttacgccttcgcggccaccgacgacggccagggcaccggcacgttcctcgacgagtggcgggccaacaacgcactccccaacggcaaccggatcgtcgggtacggggtgggcaccgacgtgaacggcctcggcacccaggccgccccgcggctgaccgccggcgccggcccgctcacctacccgttcgccgggctgaatggcaccaccatcaaccgccaggtgtgggggacccgcacgttcgacctgaacaccgacggcgtggcgcagtacgggctgtacgccgactggatcaccgacctggtccagcaggccggcccggatcgggccaagctgcgggcgcaactgatgcagggcgccgaggcgtacgtcgagatgtgggagaaagcccgtccatga

SEQ ID NO: 2507 - DNA, 822 bp, Actinoplanes utahensis
gtgaatgccgtggcgctctcgctcgcggtctccccgtgccccaacgacaccttcgtcttccacgcgctgatccacggcctggtccccggcgcgcctgcggtcgacctgaccttcgccgacgtcgacgtcaccaacacggccgccgagcagggcgcattcgacctggtcaaggtgagttacgcggcgctgccgtggctgctcggcgactatgagctgctgccctgcggaggcgccctgggccggggctgcggcccgctggtgctgacccgcgacgggcgcaccgacctgaccggcgccaccgtggccgtgcccggcgaccgcaccacggcctacctgttgatgcgcctctggtccgccgagcacccgccggcccggatcgaggtcgtcccgttccaccagatcatgcccggggtggccgccggcacgtgggacgccggcctggtcatccacgaggcccggttcacctaccagcggtacgggttgaccgcgctggccgatctcggcgagtggtgggaatcggacaccggcctgcccattccgctcggtgcgatcctcgccaagcggggcgtcgtcgaccccgccgcggccaccgggtggatccgggactcactgcgccagggctggctcgacccggccgccagccaggacttcatcctggccaacgcgcaggagatggagccggccgtggtccgccagcacatcgagctctacgtcaacgagttcaccctggatctgggcaaggacggactcgccgccgccgacgccctgctcggacgcgcggcggcggcgggtctcacgccagcggtgccgtcgtttctctag

SEQ ID NO: 2508 - DNA, 399 bp, Actinoplanes utahensis
gtgcccacgggtcgagtgaagtggtacgacgcgacgaagggattcggattcgtcaccagtgatgagggcggcgacgtgttcctgcccaagggtgcgctgccggcgggggtcgccgacctgaaaacgggacagcggatcgagttcggcgtcgtggacagccgcaagggcgcccaggcgctcggcgtgaaactgctggacgcgccgccgtcgctggcgctgcgcgacgccgaggcgcgccgccgcccggccgaggagacggccagcatgatcgaggacatgatcaaggtcctggagaacaccgtgcagcccgtgctgcagcgtggccgttacccggacaagaagaccgcggccaagatcgcgcagctgatgcacgcggtcgcccgcgagttcgagctctag

SEQ ID NO: 2509 - DNA, 216 bp, Actinoplanes utahensis
gtgacgggtccgggcgtggccggacctctttcaggaggaggacggaacgtggcgtcgaaggccaagaagcaggagagcccggctctgaaggggcacctccaggtttccgagctggtctcggaccgggccgccgccccgtcgccgttcggcgacgaccagagcttcccgctgccgctggagcgcctgcgcagcctgccggagtcgcagacgcactga

SEQ ID NO: 2510 - DNA, 2001 bp, Actinoplanes utahensis
atggccaccacatttgcggatcaactccggtcgctgcccgacgaggcgctgggcgcgctccttcagctgcgccctgacctggtcgttccggtgcccgccgacatctcggcgctggccgtgcgcgcgcagtcgcgcggctcggtcgcccgctgcctggacgggctggacgagttcaccctgaccatcctcgacgccgcgcgggtcacccgatccgcggacaccgccctcacctcggtcgacgccatcgtggagctggcctccggggtggccgccgacgacgtgcgggtggcggtcgaccggctgcgggtccggttcctgctgcacggcccgccggaggcgctgcaggtggtcgccgcggtcgacgaggtcacctcgccgtatccggccggcctgggacgcccggccgactatctggacgcgcacgccgccgcgctggtcgccgaccgggcgagaatgcgccgcaccgtcctcgccgcgccgcccggcgcccgcgcggtgctggaccggctggccgccggcccgccggtcggttcgctggcccgggacgccgtcgccgagccgatccgatggctggtcgaccagcacatcctggtgcccatctcggaggccggccgcgctccccgcccggatggcgacctggtcgagctgccccgcgaggtgggcctgctgctgcgccgcgagtcgggcccgctgggtccgctgcggccgttcccgccgctgccgcaggcaccggtgcgcgacgcgaaggcggtcgactcggccggcgccgggcagaccatggaggcggtgcgcgcggtcgaggcggtcctggaggcgctcgccgccgagccggccccggtgctcaagaccggcgggctcggcgtgcgcgacctgaaacggctggcccgggtggccggggtggacgaggccggcgcggcgctgctcgtcgaggtggcctacgcggccgggctgctcggcgagtcggagacgtcggcgcaccgggtgcccggcgcggtgcaggacatcttcctgccgaccggggcgtacgacctgtggcgcgcggccggcatggcgcaccgctgggccacgctggcccgcgcctggctgctgatgacccggcagcccggcctggtcggccggcgcgacgagcgggaccggccgatcaacgcgctcgccccggacgccgaacgggccggcgccccgcaggcccggcgggaggcgctggacgcgctggccgacctggaaccgggcgcggcgccggcggtggacgatctgctggcgctgctggcgtggcaggcgccccgccgggcccggggacgcgagctggggcaccgcgacgggtgtgccggggcggctctgctcggggtgaccggcctgggggcgctcacgtcgtacggccggttgctgatcagcgcccccgagctgaccgagagtgacccgctgggtctgcaccccgaggagacgcccgcggacgccgtccgcgccctcgacgtgctgctgcccgcaccggtcgaccacgtgctggtgcaggcggacctgacggtggtggtgcccggcccgccggaaccggagctcgccgccgagctcgacgtgatcgccgagcccgagtcggtcggtggggccagcgtcttccgggtcaccccggccagcgtgcgccgggccctggacgtcggttacaccgccgccgatttgcacgcggtgttccgccgccgatcgcgcaccccggtcccgcagaccctggagtatctgatcgacgatgccgcccgcaggcacggcgggctgcgcagcggctccgccggatcctatctgcgcagcgacgacgaggcgctgatcgccgaggtgctcgccgatcgccgggtgaccggtctggacctgcgccggatcgcgccgaccgtgctggtcagccctcgcccggtggcccggctgctgggtgccctgcgcgaggccgggttcgccccggtcgccgaggacgccggcggcgcggccgtgctgacccggcccaaagcgcggctagctagctag

SEQ ID NO: 2511 - DNA, 324 bp, Actinoplanes utahensis
gtggtcgagcaactgcggcgcggggacatcgcgacccgggcggcccggcgggcgccggtgaccgtgcgggccgcgcagggccaggcggtgcccgggctgaccgcggtgcagcagcacagccaggcgatggcggtgctgcagcaggcggtccgggaccgggcgaaggtctgggtggggtacgtcgactcccacggcgccacgctgtcccgcctggtccggccggtgtcgctgagcgccggctacctgcgcgccgaggacgaacgcggcgagaacacccacacgttcgcgctgcaccggatcaccgcggcggtcaccgaggagtag

SEQ ID NO: 2512 - DNA, 1647 bp, Actinoplanes utahensis
gtgaacggcggaccgctgatcgttcagtcggacaagaccctgctccttgaagtcgatcacccggatgcccaggcctgccggatggcgatcgcgccgttcgccgagctggagcgctccccggagcacgtgcacacgtaccggctgaccccgctcggcctgtggaactcgcgggccgccgggcacgacgccgagagcgtcgtcgacgccctgatcacatattcgcgatacccggtgccccacgccctgctcgtcgacgtcgccgagacgatggaccgctacggccggctgcaactgctcaacgacccggtgcacggcctggtcctgcgggggctcgacaggatcgtgctgctcgaggtgtcgaaatcgaagaagctggccggcatgctcggcgcccggctcgacgacgagaccatcgcggtgcacgcctccgagcgtggccggctcaagcaggcgctgctcaagctcggctggccggccgaggacctggccggttacgtcgacggcgaggcgcacccgatcgagctgagacaggacggctggaccctccggtcgtaccagcaggaggcggtcgacgggttctgggccggcggctccggcgtcgtggtgctgccctgcggcgcgggcaagaccctggtcggcgcggcggcgatggccaccgccaaggcgaccacgctgatcctggtcaccaacacggtggccggccggcagtggaaacgcgaactgatcgcccgcaccacgctcaccgaggaggagatcggcgagtacagcggcgaacgcaaggagatccgcccggtcaccatcgccacctaccaggtgctgaccgcccgccggggcggcaacttcacccacctcgacctgttcggcgcccgcgactggggcctggtcgtctacgacgaggtgcacctgctgcccgcgccgatcttccggttcaccgccgacctgcaggcccgccgccggctggggctgaccgccaccctggtccgcgaggacggccgggagggcgacgtgttctcgctgatcggcccgaaacgctacgacgccccgtggaaggacatcgaggcgcagggctggatcgcccccgccgagtgcgtcgaggtccgcgtcacgctcaccgagcaggagcggatggcgtacgcggtgaccgacgccgaggagcgctacaaggcggccgccaccgcccgcaccaagctgcccgtggtcaaggccctggtcgcccggcacccgcaggagcaggtgctggtcatcggcggcttcctggaccagctgcacaccctcggcgagtacctggacgccccgatcgtcgagggctccaccagcaacaaggagcgggagcggctgttcgacgcgttccgctccggtgagctgcgcaccctggtgctgtccaaggtcggcaacttctccatcgacctgcccgaggcggcggtggcgatccaggtctccggcaccttcggctcccggcaggaggaggcgcagcgcctcgggcgggtgctgcggcccaagggcgacgggcggcaggcgcacttctactcggtggtgtcccgcgacaccatcgacaccgagtacgccgcgcaccggcagcgcttcctggccgagcagggctacgcctacaccatcgtcgacgccgacgacgttctccaggtggactag

SEQ ID NO: 2513 - DNA, 504 bp, Actinoplanes utahensis
atgaaacccaaccagaccgacctggtcggtgaatacctgcacgaggtggacctgcggttgagcggcctgcccctgctgcagcgccgcgagttgctggccgatctggccgcgcacatcgccaccgagcggaccgaccgggacgtgcggtcggaggccgagctgatcgagatcctcgagcggctgggcagccccgaggtggtggcggccgccgcctacgaggaggccggcgcggggacgccgcgcaccgcatccgtcccgccgccgttcgtcgcgccgccgccgttcgccgctccgtcgttcgccgccccaccgccggcgccccggacggctcgaccgccgcggctcctgtggctcttcggagcgctggccgcggtcggcgtgatgctggtcctctgcctggccggcgccctgatggtgagccggagcacgcaggacagcccgccggcggtgaccaccccggtccaggccaccccggcgacgccgaccaccccgtcgacgccttag

SEQ ID NO: 2514 - DNA, 345 bp, Actinoplanes utahensis
atgggagaggcagcgcagctggcgtccgggctcaagcgcggaacgctcgaattttgcgtgctcgcgatggtggagttcgaggatcggtacggcaccgagatcgtccggcggctcgccgaggagcagtccctcgccgcgaccgaggggacgatctatccgctgctgtcccggcttcgccgcggcggcatgctggacagcaagtgggcggagtcgcccagcggcccgccccggcgctactacagcctcaccccgtccgggaagtccgcgctcgagaatttccgcaccgagtgggtgccgttccgtcagaccgtcgaccgtctcgtggggaccggtggagtcgcatga

SEQ ID NO: 2515 - DNA, 1308 bp, Actinoplanes utahensis
gtgaccgaccgcaaacgccggctgagcgtggacctgaccccgctgcgcacctcccgggacttccggctcgtcttcgtcagcggcgcggtgaccagcttcggctcgttcatcagctacgtcaccatcccgtaccaggtggcgaagctgacgaacgacccgctgatggtcggcctgatcggggtctgcgagctggcccccatcctgatcatggcgttcgtcggcggggcgctcgccgactacctcgaccggcggctgctggtccggggcagtgaggccgcgctcgcgctgatctgcggcctgctgctggtcaactcgctgtccgacacgccgcggctgtggccgctctacgtctgcgcgttcctcaccgccgcggtggccgggctgcaacggccggcgatgagcgccatgctgccccggctggtgcgctccgacgaactgccggccgcgatggccctgcagtcactgagcatgcagttcgcccagctgatcggtccgtccctggccgggctgctgatcgccgccctcgacctgcactgggtctacctgttcgacctgttcaccttcgccgtctcactggtctgtctgaccatggtcaaggccgtcccgccgcccgccgaggcggaccgcccgtcgctgcgcagcgtggccgacgggctgcgctacgccgggtcgcggcccgaactgctcggcacctacctggtcgacatcaacgcgatgttcttcggcatgccgtccgcgctctacccgttcctggccgaacggctcggcggcccgcaggtgctcggcctgctctacgccgcgccggcggtcggctcgctgatcgccacggtcggctccggctggaccgcccgggtgcaccggcacggcctcatggtgatcatcgcggccgcgctctggggcgtcgggatcgtcggcgtgggcctgtcccacatgctctggctgaccctgttctgcctggccttcgccggggcggcggacatggtctccggcctcttccggatgatcatctggaatcagaccatccccgaccacctgcgcggacggctcggcgggatcgagatgctgtcgtacaccaccgggccgctgctgggccagctccgctccgggctgatggcgcgcacctcgctcggggtgggcgggtcgatctgggtgggcggcgcgctctgcgtggccggcagcctggcgctggccgcggcgctgcccaggttcgtccggtacgacggggagcacggggtggcactcaaggaggcggccgacgcggagtgggcggccggcgccgaaggccgcgcggcggccgcggccggctga

SEQ ID NO: 2516 - DNA, 489 bp, Actinoplanes utahensis
gtgggattgacgtgggcagagtcctatctgggcaaggtgcgcgcgagcatcggcgacaccgacacgatcttcttcgtcggcgcgcgcaccgtggtcttcgacgagcagggccggctgctgctgatccagcgctcggacaaccaccgctgggccattccggccggcgcgatggagctcggcgagagcatggaggactgcgcggtgcgtgagctgtgggaggagaccgggctgcgggccacctcgctcacgccgtacgcgttctacacggcgtacacgtacaccaacgactacgggcacacctaccagcaggtgctgatgagcttcgtggtgcacagctgggagggcgagctgctgcggcagaccgacgagagcgtggacgccggatggttcgcgctggacgagctgcccggccccaaatcgttcgtgctcgacgaggcgctggccgacctggagaccttcaccaccactaatcggctggtcatgaaatag

SEQ ID NO: 2517 - DNA, 918 bp, Actinoplanes utahensis
atgcgcgcgatctggaaaggtgcggtctcgttcggtctggtgtcgatcgccgtcaagctgtactcggcgaccgaggagaaggacatccgcttccaccaggtacaccgcaccgacgggggacggatcaagtatcagcggacgtgttccgtggacggcgaggcggtcagttacgacgacatcgccaaggggtacgacatcggcggcggagaaatggtgatcttgacggatgaggacttcgcggacctcccgttgagcacgtcccgcgccattgacgtgctggaattcgtgccggccgagcagatcgacccgatcctgttcgccaagtcgtattacctcgagcccgaaggtcaggcggccaagccgtacgtgctgctgcgcgacgcgctgcgggatgccgaccgggtggccatcgtcaagatcgcgatccggcagcgggaacagctcgccaccctgcgggtccgcgagggcgtgctggtgctcaacaccatgctctggccggacgaggtgcgggtgccggagttcggcttcctcgacgacgaggtcaaggcgcggccggccgagctggcgatggccagctcgctgatcgactcgatggccgccgacttccagccggacgagttcaccgacaactaccgggcagcgcttcaggaggtgatcgacgccaaggtggagggccgggaggtggtccagccggaggaggccgaggaggcggcgccggcggcggtcgacctgatggcggcgctgaaggcgtcggtggagcgggccaagaaggcccggggtgaggccgccgaggagaaaccggggaagaaggcggctccggccaagaaggcggctccggccaagaaggcggctccggccaagaaggcggctccccgaaaatcggcggcttcgggaagagccgccaagaagtccgcctag

SEQ ID NO: 2518 - DNA, 906 bp, Actinoplanes utahensis
atgcctgaccggatcccgatccgcctggacggccatgacctggagctgtccaacctcgacaaggtgctgttcccggcgaccggcgtgaccaaggccgaggtgatcgactactacacccggatcgccccggttctgctgccgcatctgcgcgaccgcccggtcacccggatccgctatccgaacggtgtcgagggcgcgcacttcttcgagaagaacaagccggccggcaccccggactgggtgcgcctggtgacgctgcccgtcccggggtccaccaagagccgggagaccgtcgagttcgtggtcgtcgacgaactggccaccctggtctggctggccaatctggccgcgatcgagctgcacaccccgcagtggcgggtcggtgcccacccggacatgctggtcgtcgatctggacccgggggcgccggccgggctgcgcgagtgttccgcggtggcggtgctgatgcgcgaccggctggccgaggacgggatcgccgcgttcccgaagacgtccggcaagaaggggatgcagctgtgctgcccgatctcgggtgcccaggacgccggggtggtctccgggtacgccaaacgggtggccgaggagctggcgcggctggtgccggggtcgatcaccgcgaagatggccaagcagctgcggccgggaaagatcttcatcgactggagccagaacaacgcggccaagaccacggtcaccccgtactccctgcgggccggcccggcgccgaccgcgtcgacgccgctgacctggccggaaaccgaggcgatggccatcggggacgcggaggcccgccagttcaccgcggcggaggcgctggaccgcgcacaaacccacggtgacctgctgaccggcctgctcgagtcgggtcccgccgtgccggtttga

SEQ ID NO: 2519 - DNA, 918 bp, Actinoplanes utahensis
atgcccgagggcgattcacccaccgtcgcacgccggcgcgtccggctcgcgctgcgcgaggcgcgggaaaaggccgatctgacccagctccaggtcgccgacgagatggaatggtcgctcagcaaggtgatccggatcgagaacggtgacgtctcgatctcccccaacgatctgcgcccgctgctcgccttcctcggcatccgggacaggccgacggtcgccgcgctgatcggcgatgcccggatcgcccgcacccggcagcggcaggcctggttccaactgcccgagttccgggagaatctgaccgacgccacccgcaaactcatcgaatacgagcacgaggccgcccagatgcggtcctattcggtctattacattcccggtccgctgcagaccccggattacgcgagagcgttgatgacccggttcgaggacgagctcagtgatgctcagatgagccgccggatcgaggcgcgcaaactgcgccgggaatcgctgctcacccgcgcccagtccggccaggtgcggatcgcggtgatgctcgacgagtcggtgctgcggcgcaccatcggcggcgccacggtcttcgccgcccagttgcgcgagctgcgccggctgatcgacgccgggacgatcaccatgcggatggtgccgttctcgctggacgccgcggtcaccaacaacgccagcttcgacctgctggtgctgggtgagggcgaggtgctctaccgggagaccgggctgagcgacgagatgatcgaggatcgggacgtgacggcgaaacaccgcgcccgctggaacaaggtgtgggacgaggtggccgacgaggccgccacgctcgccttcatcgatcgacagatcaagatcctggagaacccgatcgaggcgtacggtcgtcagcccccgttgccggactga

SEQ ID NO: 2520 - DNA, 459 bp, Actinoplanes utahensis
atggagagccgattgaggatcgccgggcaggcggtacagcccgtcctggtgatgttcccactgggcctgttcgccatggccgttttgttcgatctcgccgatttgctcggggggcctaacatccttggcgcactggcgtactggaacgtcgccgccggactggtcgtcggcgtactggccgcgctggccggggcgatcgacgtgatgttcctgcgccgcccgcaggcgcgccggctgggcgcgctgcgcaccctgatcaacatcggggtgctggtggtcttcgcggtcgtgctgatggtccgcgtccgcgctccggagcgggtggccggcggcggactgttcatgatcgagctgctcgcgctcgggctggccggtttcggcgcctggttcaccagcgagctcgccaacgggcggaccccggcgttcgcccgcgcggcggccggcgcccgcgacttctga

SEQ ID NO: 2521 - DNA, 438 bp, Actinoplanes utahensis
atgagcacacgcacctactacagtgggtcggacgccgaagtcaccgacgctctcttcacctggcacaccgcgccggagtcattgatcttcgccattgcggatctgcggcatgtcgggttggtccagtcgcccgcgcgcacccgtccgtacgctccgcatctcgccgccggcgccctgctggccgtcgccgccgggtggaccctgctcgccgacccgacactctacgtaatcggcttcctcgcgatcatcggcccggtcctcgccttctcctggcgggagcgtcgccgatgggagctccacgcgcagtatcacggcagcgccgtggtcctttactcctccggcgacgtgcgggtgttcaatcaggtcggccgggccctgcgccgagccatggaagatggtcgccgcaccccctggggctacggcctggctgccgcctga

SEQ ID NO: 2522 - DNA, 912 bp, Actinoplanes utahensis
atggctgagggtgactcacccactgtcgcgcgccggcgcgtacggctcgccatccgcgaagcgcgggagcgagccgacctcacccagttgcatgtggctgaggcgatggagtggtcactcagtaaggtaatccggatcgagaacggtgacgtctcgatctccccgaacgatctccgcccgctgctgagcctgctcggcatccgggatcgggccgaggtgaccgcgttgctcgcggacacccggatcgcgcgagccaagcagcgcgcggcgtggtatcagacccccgatttccgggacggcctcaccgacgcgacccgcaagctcgtggagtacgagaacgagtccaccgagatccgttcgtactccatctattacgtgcccgggcatctgcagacgcccggttacgccagcgccctgatgacccgcttcgaggacgagttgagcgccgagcagatcggccgccgcatcgaggcgcgccggctgcggcgggactcactgcttccccgggcggcgtccgggcagctggagatcctggtgatggtggacgagtcggtgctgcggcgcaccatcggcggcccggtcgtcttcgccgagcaactcggtgagctggccggtctcgccaccaacggcgcgatccggatgcggatggtgccgttccggctggacgccgcggtcaccaacaacgccagtttcgaccttctcgccttcggcgagggggaggtgctgtaccgggaaaccggtctcggtgacgagatgatcgaggatcgcgaggccaccgcgaaacatcgcgcacgcttcgacaaggtgtggcacgaggccgctgacgaagacgacacgatcaccttcatccggcaacagataactgccctggaaaatcgcgaccacaaccgcggcgcccgggcgcacacataa

SEQ ID NO: 2523 - DNA, 195 bp, Actinoplanes utahensis
atggaaaacatgaacgcgcccgcatggcgtaagagcagccgctgcggcacgtcgacctgcgtcgaggtcgccaaggtcgacgacaactacatgatccgcgattcgaagaatcccgacgccgccgccctgaccttcacgaaggccgaatgggacgcgttcgtcgagggcgtcaacgcgggcgagttccatttctga

SEQ ID NO: 2524 - DNA, 786 bp, Actinoplanes utahensis
gtgcacagaaatgatcaaaacgaccagggagccgcgctggcggcggagcaaacgctgcgcccacggatcgtgcgtcgaggtcgcgagagtgggcgagctggtcctcatccgggactcgaaggatcccggcggcgcaccactggccttcgaccggcaggcctgggacgccttcctcgccggagtcaaggacgacgaattcggcagagcgtgaaaccccgcccaccggagttgctgggagccgcgggccgagcgcggcatactgcactggtggagggcaaccagcgcgccaccgatccggaccgcttcaccgatctccacgaggcggccgagaccctgctggacgagctcaccgagcgctatcaggtggagcgccgggagacgaaggagccgctcgggctcgacgaggcgctcgcgcggaccgtccggctcatcccccgcaccccgtccgccgcgccgctggccatccagttcaccggcgccggcctgcacctgcgcttcggccggtggtggcgggagtcgctaccgatctgcgactgtgacacctgcgccgaccggcccgggccgctcaccgaccagctgcgtcgccacgccgccgcgctggtcgagggcggcctctgggagcgggtccgccgcgggctgagcggctcctggttcgaggcccgcctgatcggcgccggcgtcaaggccgaccgcgagggcccgctctccgccgccggcgcccgcgaggcccgccgcgacgggttcgccgccgccgtccagtgggggccctggcaggtccgttcctga

SEQ ID NO: 2525 - DNA, 1179 bp, Actinoplanes utahensis
gtgtctagacttctgtccgtgctgggggaaccggagtgggacgtcgcggtcatcggggcgggccccgccgggctggcggccgcgcatgccgccgcgtcgcgaggtgcacgggtggcggtgctggaacgcgccgagcatccgcggtacaagacctgcggcggcggcctgctcggcagttcgctgcggctgagcgcggcacgcctggcctcggtgccggtccgggacacgatctccagcatcacgttcacgctggccgggcgccgtgagttcacccgcgtctcggccgagccgctgatctccctggtccgccgcgacgagttcgaccaggcgtggtgtcgggccgccgagcaggccggcgcagaaatctttccccacacgatcgtccgtacgctggatcagcacgacgacggcgtcatcgtgaccctggccggcggcgaaacgctcaccgcgcgggtggccgtgggggcggacggttcggccgggatcaccggccggcacgtcggcgtgctgctggagcagcaggacctcggtctcgaggtggaactcgcggccacgccgcaggatcaggagcgctggcgcggccgggtgctgctcgactggggtccgctgcccgggtcgtacggctgggtcttcccgaagggcgacgagctcaccgtcggtgtgatcatggagaagggccgcggcgcggacaccaagcgctacctgcgggagttcgtcgagcaggtcggcctgtcgggtcgcccggtgctgcgcgactccgggcatctgacccgctgccgggcggtgagctcgccggtgcgccgcgggcgggtgctggtcgccggggacgccgccgggctgctcgaaccgtggacccgggaggggatcagctacgccatccggtccgggatctgggccggcgagatcgccgccggaagtcgcgatctcgccgcgtacgaccggatcatcgccgccgagctccagccggagatcgtggccgggcgtcgcctgctcggcgtcttcagccggcacccgtcgatcgtgcacacggcgatgtccaccggcctcggctggcgcgccttcagcggtttctgccgcggcgacttctcgatggccggcgccctcggccgccccaccgtgaagaccgccctgcgcctgctcggcagccgcccaccccggccgcagccggtcggtggatag

SEQ ID NO: 2526 - DNA, 372 bp, Actinoplanes utahensis
atggatggccggccggctgtggaaagggttgccgacgcgctgttggccgctctcccggacttcgactacgtgtattccaacaacattgaagcctatgatcggttctcgccgggtttgttcttctgggaggtggtccaggcgacggtccggtcctacctgggtgaccaggacgagccggattggcgcagcaccctcgacttcatggaaagtgccgtccggtccggcagccaggacgagaggaaggcggtcggcttccacttcctgtggaacctgccgaaccgcggcgaccccggacatgacctggtcggcgagctggggccggagctgacccggattctcacccggatgcagcacgggcagccggtcgactga

SEQ ID NO: 2527 - DNA, 2361 bp, Actinoplanes utahensis
gtgcaggccgcccgcacctcgatcaacaaggcgaccgccgcgcgcgccgacgcggacatgaccgcgcaggcggcgcaggacgcggtccggcagtcggcggtcgcgtcgttctggtcgcggatctccggccgggcggcgatcgatgcgcggatcaccgcggccgggatcgccgacccggccgcttcggcgatcgatgtggcttcgggctacgcggcgaccgacagcgacgccgcgatggcggtcgacatcgcgaacaatgcgctgcagatcgccgactcgcaggccaccgccgcgcagcagcacgccgacgacgccgccgcggcggccgcgcacgcgcagcagatggcggacctggccgtggcacaggtcaagccggcgtatgtggcggcgcagaaggcggccgaggcggccaaccgcgcggtccaggccgccaacaccgcgatccaggccgcgaagagcgcagccaaggaggcacagggcgccgtcgacgcggccaaggacgcagcggaggcggccagggacgcgggtaattcggcccaggacgccgcgatcgcggcggcgcaggccggcagcgactcggggacggcgcagcaggcggcgaacaacgccagcggttacgcgagcaaggcgcagcaggcggcgaccaacgcgaacgtgttgtccgggaagatctcggacgtcagcacgaacatcaccaacctgtcgaacagcatctggggcatcgcgcaggcgatgtcggggatcgccaaggatctgaagaacgccgcctgggcgaagtacaacgcggagcaggcggccgccgaggccaaggtcaacgactggatcgacgacaaggccaattggctcaacgaccacgtcttcggtggttcccagatcggcaagggcatcaccgacagcgcggccgggatggccaagggcctgctggtgaccagtagttgcgtcggtggcacgttcctgggcagcgacaacgcggccggtgacgagtggagcgtcccggacgtcagctacctgccgaaatcggacaaggcctgcaacgccctggtcaaggggatcaaggatctcatcctccacccctgggaactgctgcactggagcgattggaaggagaagggctggcagtacaccctcggtgaggtcatcttcgacgttgtcaccatcggcggcaccgacggcctcggcatcttcgcgaagctgggtgagtccggcgcgatccagaccgcgaaagcggcgatcaaggacatcgccaagatgtccgccaaggatctgctcgccggcgccgccaagttcacggtcgacaacctgagcaacgcgatcaaggcgctcggcacggtcgacgtcgcccgtctgctcgaactgtccgggaagatcggcgccaagctcaccttctctccggaggagctggccgcgctgtccaaggccgcggtcaccaagggcatggacgcgatcgaggacaccctgcggaagctgggcagcacacccgtcctgcagggtctgaaggacctcgtcgagcggtgcttcaccccgcacagcttcaccgccgacacccgggtcgtgctcgcggacggctccaccaggcggatcgcggacatcgcggtcggcgaccgggtcctcgccgtcgatccgatcacgtacgtccgccgggccgaaccggtcacggcactgcaccgcgacatcgacaccacgctggccgacgtgaaggtgcgggaccgggccggtcggatcagcgtcatccacaccacgccgggtcacgtgttctgggatcagtcgaacctgcgctgggtcgaggctgcgcggttggcgtccggcacgctgctcgcctcggcggacgcccagcgggtgacggtcgtcgacgtccagaccttcggcggcagtcaaccgatgtacgacctgacggtcgccgccatccactcgttcatggtggtggcgggtcgctcggcggtcctggttcacaacgaacagacggcacgtgcgccgaagcccgatgtggaccacgattaccttaagaccatggtccgttatctgtacaagtcgctcgatctggcgcccgagctgaacatcaccatctacggtgacggcacgaccatggcggcgctcatgaacgagtggaagacgggcgaagcgaccaacggcagcgagcatttgacgaagatccgggacgtgcagaacggactcaccaagttcctcaacacggagggatactggaagaagccgaaaaagggcgagaagaaagtgtggatcgacttcaccacccgtacgtcgaaggacatcgcggtcgccacggaccttctcaaggccgtcaacgactcgctggccaacagctacgtcgacttcagtgattacaaggcgttgctggggtgctga

SEQ ID NO: 2528 - DNA, 1953 bp, Actinoplanes utahensis
atgcaacgacgccgcctgcggtggatcgtaggtctggcggccggcttggccgtcgccgtggcggtgccgggtggcgccgcggtggcggcgccgcgggtgcaggcgccggtggtgcagccgcacgcgctgaccgtccaggaggcgctgcagcaactcctcggcgcggacaccaaggcgccggccgacacaccgatcgacgacgccgacctggatcggatgctgacccaggatctggccgactacgacgcggatccggcggtgcgggccgctgccacggcggtgctggccaccaacgatccggcgcagatcaaggactttctggacaacgggctgccggtctaccgcaaggccgatcagcagcgccagaaggaccaggcggaccacaaccgggtccaggtccaggagtgggccgtctccggcagcccgaccgtgcggcagcgggcgcaggccgctctggactccaacgacaacgcgaagatcgccgcgttcgtggcgaccgggcatgacgccgccgatctggcggacaagcaggatgcgctgaacgcggcgcagcaggccaagctgatccagggccgggtcgagcaaatggtcgccaacggtggctacgaggtgcagaagctcggccaggccgcgctggacagtgaggacccggtggtcatcgccgagttctacaacaccgggtacgcggcggccagcaagcaggacgcggacgcgcagcagcagatcaccgacgcgctcgcggcccggtccaaggcggtcgccgacctgaccgatctggcccagcgggccgcccaggccgcggacgcgcagaagaagatcatccaggcgagtgtcgccgcgacgcaggcattgacctcggcgtcgaacgcgatgggtctggcgaacaaggaggccaagcaggccgactcgatctacgccgcggacatcccgctgcgcaacgccggcaaggcgacgcacaccacggacgtgatgaacctgcggatgcaggcgtgtcaggacgccgtcaccgcccagggatacgccgaccaggtgaccgggcagtccggggtcgcggcgaccgcggcgcagacactggacaagaccggtctgtcgcacaacatcgcgtgggccgacgtgatccaggcgcaggccgatgcgggcacctcggccgcgggggccgcgatgaccgcctgccaggcggcgaccgcgaccgagggcgcgagtcgcacgctggacgcggatcacgccgcgaccgtggatgccaacaacgcggtcaagtatcggcaggccgcggagcgggagcaggcgtcggcggagaagctggccgaccgggcggagaagctggccgcggccgcgcaggccgccgccaccgacgcgcacaaccagcgggtccgggccgagaacgacgcggacagcgcgcaggggcacgccgacaacgccgccgccgactaccaggccgccaagcagcagcaggccaaggcgcgggcggcggcgagtgcggcgatcagccagtcgatcaccgcgtaccaggcggccggccgggcgatcgatcagcagaacatcgtgatcggcaaggccggtgaggccaagaccaagcaggaggacgcgctggccgcgggcgccgcgttcgccggcaaggcgcagcgggccaagacgctgatcgagaaggccaaggccgacgatcagaacaccagctccaaggagttcgcggcgcaggccgccgaggcacacctgctgtccgcggagatggcctgcaagtatccggacaacccgtccgggaacggttgcccgggcaccgcggagatgcagcggctgcgcaatgacgccgcgtccctgagggcgatcgccaacgccgccaagaacgcctccgaccagtcgaagagggacgcgaacgcggcgtcggacgcgtcctcggccgctgccgctgacgcccgccaggccgccgcggctgccgctgccgcggccgctagctag

SEQ ID NO: 2529 - DNA, 1935 bp, Actinoplanes utahensis
atgcagtcttacagcaagccgccggtcgccgacacctcggataggcgcttaccggtcatttgccgggaaggtcgagtatgtccctatgccatagatcaccgtaactgccgacgaacccgagagaagttcttcaggttgcggcccggttgccgatggtcaccggcgggaaggcccgaccggccttcgcgacgaggaggaaatgtggttggggcattgaggtcgctgcgacgtggtctggcgatcgggccggtggttctcgccgccggagccggctgcctgaccggtgccgcaccggccgcggcggcgacaacccccgccgtcgccgcggagcaggtcatcgtctcgctccaggacgcctcgcgcgtcgccggcgtcgaagcactggtacggcgatccggcggaacggtgcaacgggaactgccgatcgtcgacgggttcaccgcgcaggtctcgccggcactggtgacgaccctgcgggcgacggccggcgtacggtcggtgaccgcgaacagcaccggccacctgaaggcggtcgatccggcgctcggctacgacgcgaccaaagacgagggatcgctgtccttcgtccggaacaccatgcacgtcaacgacgcctggaaggccggctacaccggcaagggcgtggacgtcgcgctgatcgactccggggtggccacggttcccggcctgacctccggcaacgtggtgaacggaccggacctgtcgttcgagtcgcagtacgccgatgtccgctaccgtgacaccttcgggcacggcacccacatggcctcgatcatcgccggccgggactcggccggcaccccggcccagtactcggcgagcaccgggttcaccggcatggcccccgacgcccggatcgtgagcctcaaggtcgccgcctcggacggctcggcggacgtgtcccaggtgatcgcggcgatcggctgggtcgcccagcacgctcacgacagcggcctgaacatccgggtcctcaacctctcctacgggaccgacagcacccagtcgtccgtgctggacccgctgtcgtacgcggtcgagcaggcgtggcggcgcggcatcgtggtggtggtgtcggccggcaacgacggaaccacccgggaggaactcgccgacccggcgtccaacccctatgtaatcgccgtcggtgccgaggacccgaagaacaccgccggcgccgccgacgatctgatcccggcgttcgcgcagcgcggtaccggcacccggcacgtcgacgtcgtcgcgcccggcgtccacatcctcggtctccgcgtgcccaacagctacgtcgaccagaacaaccccgcgggacgggtcggcacgcggttcatccgcggcagcggcacctcccaggccaccgccgtcgtctccggcgtcgcggccctgctcgcccagaaatacccggcggccacccccgaccagatcaagtggctgatcaccgcgaaggccaacccgttcccgctggccaagagcatctggcagggcaccggcctggtcgacgtgcacatgtccctcggtctcaacccggccagcgccccggtgcagaacttcaccgccacgaccgggctgggcaccctcgaaggcgcccgcggcagcggacacgtactgatcgacggcatcccgctcaccggcgagaaggacatcttcggccagtcctggaacgtcgccaggacagcctggtccggcggcaccttcaacggcaccacctggaccggcaccggatgggacccgtccaccgccggctggaccgcgccgtcctggaccggctccgactggaccgggcggagctgggccggccggagctgggccggacgcagctgggccgacaacggatgggacggccgcagctgggcgagcaactgctggtacggccggagctgggcctcggacggctgggccgacgcttcctggagctga

SEQ ID NO: 2530 - DNA, 1755 bp, Actinoplanes utahensis
gtgccttctgtgacggacgataagtcgatgcctgtcgttcccccgccggccggttggtccggggccgagcacaccgtgcccacccggccgaccagcatggatccgcaggagctgggcttcacgccgaagcagccgatcggctggctggcgccgctgctgctgctcagcaccggtctgcgcgcgctgctggcgatcctcttcggggcgtacatggacaagcgcgagctgcagaacgcgctggacgccgacttcttcgaccactccgccaccgctgacggcgagatctggctggattacgtcgccgacctcggtgacggcttcgacgcgacgtattcgatcgcctggttgctggcccagccgcggctgaccgtggacggggccgcgctgccccggggccggctgctgctgatgggcggcgaccaggtctatccgctggccagcggcgacggctacgagagccggatgaaggggccctatcgggcggcgctgccggaggcgccggccggcgagccgcggcccacgctgttcgccctgcccggcaaccacgactggtatgacgggctgaccgcgttcctgcgcctgttcgcccgccgcaaagacggattcatcggcggctggcgcaccgagcagcgccggtcctatttcgcggtcaagctgccgaacaactggtggttgttcgcggtcgacgagcagttcggggcgtacatcgacgatccacagctgctctatttcgagaaggccgcccgtgaggtcaccccggatgaccggatcatcctgatgaccccgtctcccacctgggtgaaagcgagaaacgacccggaggcgtacgacgcggtcgactacttcctgcggaccattctcgcgccgacccgggcgcaggtccgggtgctggtctccggcgatctgcaccactacgcgcggtacaccggcgagcaacgcgagctgatcacctgcggtggtggcggagcctatctgctgggcacccacaacctgccggagcaattggtcgtgccgccgcgcgagacgctgacccgcagccgcagcctcagccgggtctacgacctcgcggcccgcttcccggccccggcggcctcccgccggctgggctggggcgctttccgccgggtgccgcggcgcaacgccggcttcgccaccatgctgggcatcatccacacgctgaccatgctggcgatggccggcgcggccagccagggcggcatcatccagcggctgttcagcatcccgctgctgctcatgctggtgctgatcatgctgggcacggtgttgttcgcgaaaccgccgggcgccgcgtcggcgaaacacgcccgccactggatcctcggcgtgctgcacggcctggcccagatcggcctggccgccgccggtgcctgggtctggctgcggctgcccttccaggagtgggcgtggcccggcccgttcgcggtggcggcggtcctctacggtccggtgatcggcctggtggccacccaggtgctcgcgctctacctggtgattgccagcatgttcgacgtcaatttcaacgagttgtacgcgggccagggcatcgaggacgcgaagagtttcctgcggctgcacatcgacgcggccggcacgctgaccatccacccgctgggcgtcgaccggatctgccaccggtggtccgccgacccggacggcgagccgcacgcgccgtggctgcgccccgagcagccgctcgacgtccagcacatcgagccgccgatcatcatcagctga

SEQ ID NO: 2531 - DNA, 393 bp, Actinoplanes utahensis
atgcccgacgatgacgcggcagatccccgcgagctgctggcggcgttcgacgccagcccgtacggcgtcgtgctcggcgatgacctgcgccgccggcggctcgtcttcgaagccctggcgcagagcgaggacgcgatgacccgcgaggtcggcgagcagctcttcaccggcgcgatcgagccgcgcgaagtgctgcggagctcggcctaccgggagttcgtccgcgacgccctggtgcgaggcgagaagatggacatcaaggaattgggcgtacgactggacgcgctcacccggtcgggcgccctgaccggagatctggaacgcgactcccgcgcacaggccgacccgaagccgggcggcaggcggcccgcggacggcgacgaccgccggtga

SEQ ID NO: 2532 - DNA, 1128 bp, Actinoplanes utahensis
gtgaggttctgggtcgacatccccgcggcgcgtggcctgccgtccgcgttccggcggatggagcaggacgcgaaggcggcccaggactacgtgaaggccaacaccgcgttgaattacggccatgggctccttgctcaggctcggggcagtcaccaggcgatcgtcgatcatctgcacacctatctgcatcggatcgaatacgacgtcgccttctgcggcgcggccatgatcacctcggcgttgaactggtacgacaacaccgaccgggagaacgccggaaagctcgacgactcctggccgggcgccaccgtcgatcgcaccgagctcggcccgtactcctacgacaccccgggcggcgcgcaggccttcaccgaccggttcgagccgcaggcccggctgaccgcgctgcccgactacgacaacaccgacgagtatcggtacgcgccggccgtaggggacgccgcgagtcccacctcggggatccgcgacacgatctggggagcgacctggcttgccgcgaagatcggcgtgttcgaccggccgtacgacgtcttcgaggagtggacgaagccactcgccggtgactggactggcgtgcgtcaatgcgccgacgtcttcaacaatgtcgcgctggccgtccgggacatgggtgagaactcgcgatggcacgcgctcggcgtcgacgcggtatggggtggcaacggggccgacgcattgatcgtcaattgctggaccaacggcaagaagatgatcgaatggacgcctttgttgcaggagaccgcggaccgatatcagacctccgcggaagcgatgttcgagatcggcaaggtagtagggtccctgatcatggacctcagcgatgccgcgatggttttcgcggccgcgatgaccggcgccggagggaccccggaggccggtatcggccccctggtcctgggcggtgcgtccctctacgaggcctacaggatgtgggacatcaccaaggagatcatggatctcatggggcgcgcggatgcggccagcagcgcggtcgcctcggcggccggagatctcggcttcatcgggagtctgggcccgatcgccgatcttccgccgacggccaccgtgcccgaccttccgatgcgctag

SEQ ID NO: 2533 - DNA, 435 bp, Actinoplanes utahensis
atgtcgacccagaacctcacgcgtgcccccgatcactggttaccggcttcgctgatgggtatagcccatgaccaatgcgtatggcgtagatccggatcgtactgtcgcatatacgacccaaccgcggctcggatgcgtacagtaactttcgtgcggatgaccttcgaagtcggcgtgaccgaacggcacgttgtcgagttctatttcagcaagttctggggcggcgtcaagatcaccgtcgacggagtcgtcgccttgcgcaccgttcagcttctgtcgttcagcgtggtcaagaggtacaacctcacggtgggcaccagcgaacagcatgccgtcaccatcgagaaacgccgggctctgctcttctccgcattccggcaacagccggtccgcgcctacgtcgacgggacgttggtcgctgaaggcgccgcatga

SEQ ID NO: 2534 - DNA, 843 bp, Actinoplanes utahensis
atgggcatgctgtgcgcggtcagcttcaaccggtatggccgcctctactacctcgacccgggtgagttcagcccgtcggtcggcgaccgggtcttggtcccgaccgatgacggtcccgaggtggcggagtgcgtctggccgccgcaatgggtcagcgaggagaccgacggttttcccaagatcctcggcctggcggtggacgacgatctgcgccgcgacgagctgctccgcaagcgcaaggcggaggccaaggtcgccgccaaaaagttgatcaaggcgcacgagctgccgatgaaggtggtcgccgtcgatcatgtcctggatccggccggggcgaacggggaccggacgacgatctatttcaccgccccgcaccgcgtggatttccggtcgctggtccgtgacctgggtgccaccctgcactgccgggtggagctgcgccagctctccgcgcgggattcggcccgggtgcagggcggcatcggttcgtgcgggcgggatctgtgctgcgccacgttcctcaccgacttcgagccggtcaccatccggatggcgaaggatcaggatctgccgctgaatccgctgcgcatctcgggcgcgtgcggccgtctgatgtgctgcctgaaatatgagcacccgctgtattcgggaagcagcgacacgtatccgcgcccgggcgaacgggtgaagacggccgacggcgccgaggggcgtgtcgtggcccgccacccgccgtcggagtcggtcaccgtccgcgggatcgaggacggccagctgcgccgctgcccggtcgccgacgtctgtggttcacgccgcgcctatgagtcgggcggaaatcagtag

SEQ ID NO: 2535 - DNA, 1896 bp, Actinoplanes utahensis
atgacacccgccaggtcgctggccgccagcgtcgctgcgctcgggttcgcgagcacgctcaccgcgcccctgcccgcgcatgccgcatcgacactcgcccccgccccggcaccgtgccagcaagcccaccgctatgccgcccagtccgaggccgaactgctccgcatcgaacgactcgacctgcgccccacgccgaaccgggatcacggcgccggcctgccacgccacgacagcggcgaacgcccgtcgatcgcccccacggaaagcgccggcgaggtcctgcagcagctcacccccgacgatccggccgccaccgccggcagcggcagcccggacagccccgccgccggagaggacgcggacagcgcggacacatccgacgccacggccatgcccgcaccgggcgtcgtccccgcggcctaccaccccggccaccgcgcccggtccggccttgacgccgccggcaaccgcgacgtccgctggaagcgtgacgccgccggcaaccgcgacgtccgctggcagcgtgacgctgcctacaaccgcgaggtccgctggaggcttgacgccctcgacagcagccacgccgaccgcgacgcccgcatcgagctcggcaaacccggcgccacgggcggcggcgacgccaacggcgacacgaggccggcgaccgccggtgccggcgacacgacacaggtgatcggcggcgtcggggtcggcgacgcccgaagcgtcatgatcgccgacggtccggtgaagtccgccgccgctgcccagaccctggacggccgggtcgccggcgctcccgccgccgagcaggtgttgcagcagacgccgccgacccactccggaccggtcgagcagcacaccgccgccgaacgtctcggcccgatccagaccggcacgacgacgttgtccgcccacgcccgctggaccgacgcgatggcctgcgccgcaaccgccggcgaaacctcccgcgcggcgaccgccctcgaccgggtcacgctgaccggggccaccggcgagctgatccgcgtcccggcgaagtcctctaccatcagcaacaccgccctgaccggccacggcaccaccgcgaaggcggtcgcttcggcaaccgtcagggccgccgagttcaccctggccggcggcgagatccacgtccgggtcctccgcgccccctcgctgcaggtatccatgtcagccgccaccggcggcgaggtccgctatcaacccgcggccgtcgagatctccggcccgcatttcccgcgtacgcggttgagcacggccaccgaccacgcagacatcacggtcagcgacgcagcccggcccacggagtccgccaccgtcccggtcctcccgtcccggggtccggcactgccgtcgatcccgaatctccccgttccctcccccaccaccggccccggttccagtaccggaacctcggcccggtcctccgacaagacctccacccgagccggcaacggacctgacgccggcggaacggttgcccgcggcccggtgttggagagcgctccggccggacaagccctcgtccgtatctccctgggtgacgtccggcaggcatcgaagggccacgccttggccgcccgagccactgccatcaagatcgccgtcctgcgctcccaacactcctcgaaggaccgcggcaaccccggctacgaatcatccgcggtgatcgccaacctgggagtcggcatcctggaagccgccgccgtagcccccgaacaaggcaaacgcaccctggaatccggagtccagggcggcacccttccggtaaccggcccccgctcggccccactgttcatcaccggcgccggcctgctcatcggcggcctctgcgcctttctcctcggcacccgtcgccgccgcccgaccccgtaa

SEQ ID NO: 2536 - DNA, 591 bp, Actinoplanes utahensis
atgcttgcccgtcgccgccgggagtccaagggtcgctatggttcgtcgatgccgttgaacaatccgtggctggccggggacgtgccggaccggcggttgccgaaggaccggcttgaggagcggatccgcaacctgttctccagtcagaacatgggtgtgctcgccactgccggtgggcaggggccggtggccacgccggtgcggtactactcgttggatctggcggtgatgttcacggcgtcgccccggtcgccgaagatgcggaacatcgctgatgacccaagggtgtccttcgggatcttcgcgccgctggtcggcttggccagcagccgaggggcgcagctcttcggccgagcccgggtgctcgggccgggcgaccccgggcaggtgccctactgggaggccttccgctgggagaacgagcacgccgaacgcgggcgtctcctcagcgaaccgccggctgagacgctcgtcgtcctcgacccggaccggatcgtctacaccgaacactggctgcgccgtgacggctacgccccgcgccagatctggcgccgcgccgaccccggaaagccggtgcgacccgggtcttga

SEQ ID NO: 2537 - DNA, 609 bp, Actinoplanes utahensis
atggaccggctcgatcaacttctgaccgttgcggatccgctgctcagccgggtcgatcaactgctcacgtcggtcggtgcgccggccggccacgatgtctggcccgagctgcgccgggtccggttgctacccggcgacgcggtccgcgcggtcgccgccctgcatccggccgcgctggccgacgccgtccccgagctccgcgcacaggcccgggtctgcgcggacaccgctgacgccctgccgctggccaccacctggacgggccacgccgccgaagcttacgaggccacccgccgccgcaccgccgagcagctcaacgtcggccccgacagcctgtcccgccggatgaccgccacggccgacctggccggcgccctgcacgactggatgacgcacacccgcgccgcgctggcctacgccctggccgacagcctgaactccgccgaggctttgacggtcaccgtgagcagcggtttcccgcagcccgcggaaacccgcgccgccgctgccattgccacccacgtgctccgcaccatcgccgacagctacgaccgcgccgagaatctcctcgacgactcctcatctttgacaactccacagtcgacctga

SEQ ID NO: 2538 - DNA, 297 bp, Actinoplanes utahensis
atggaccgcatcgccgaccggatcgaccaggcggccgccgaactgagcaccatcgaccgacgggcgccccacctgctgcccggacccggggcgttcggcgccgacgatgtcggccggcccggccggctcggccaccgcctgcacgagaggtgggccgcggtgctccaggcccgcgccgacgaggcggccggtctgtccgggcgcctgaccgatctggcccagtccgtccgcagcacctcccgggactacagccagactgacgagtccgttcgtcaccgcctgctgcgaggtctctga

SEQ ID NO: 2539 - DNA, 327 bp, Actinoplanes utahensis
atggcccgagagatcgacgagacgtggatcgatgaggcgatcgatcgctaccggcgcgtcgagggcctgcgtgccgagttcgacaaggccgtggcgacgcaccaggtctcggtgcactcacccgaccagaccatcgaggtggtggtcaccgcgaccggcgagatcgtggatgtccgggtgcagggcgagttcgtcaagcgcaccgccgccgagttctcccgtgagctgcgggccgtcatcgccagcgccaccgaggccgcccgctgggctcgtgacaagctgcacgccgaggtcttcggcgcgttccgctccctggaggaccactga

(The sequence listing continues in the following parts.)

The invention claimed is:
1. A mutated comprising DNA the nucleotide sequence of SEQ ID NO.: 16053 and the mutations shown in the Table below:

| Position in SEQ ID 16053 | Nucleotide in SEQ ID 16053 | Mutated Nucleotide |
|---|---|---|
| 7102 | G | A |
| 11919 | G | A |
| 12285 | G | A |
| 12651 | G | A |
| 13511 | G | A |
| 46974 | C | T |
| 62542 | C | T |
| 64957 | C | T |
| 65055 | C | T |
| 65455 | C | T/C |
| 65460 | C | T |
| 65882 | G | A |
| 72685 | A | A/G |
| 72693 | A | A/G |
| 72701 | A | A/G |
| 73373 | C | T |
| 73467 | C | T |
| 76845 | C | T |
| 78965 | C | T |
| 80653 | G | A |
| 85503 | G | A |
| 88269 | G | A |
| 88369 | G | A |
| 89368 | C | T |
| 89901 | C | T |
| 90029 | C | T |
| 91949 | C | T |
| 93427 | C | T |
| 101351 | G | A |
| 103967 | C | T |
| 104063 | C | T |
| 110857 | C | T |
| 112637 | G | A |
| 114499 | G | A |
| 115250 | G | A |
| 115873 | C | T |
| 115983 | C | T |
| 117494 | C | T |
| 119344 | G | A |
| 134489 | C | T |
| 139515 | C | T |
| 146767 | C | T |
| 161035 | G | A |
| 172303 | G | A |
| 176176 | G | A |
| 178880 | G | G/A |
| 180754 | C | T |
| 180925 | C | T |
| 184674 | G | A |
| 190568 | C | T |
| 190644 | C | T |
| 191971 | C | T |
| 193584 | G | A |
| 196028 | C | T |
| 196338 | C | T |
| 214992 | G | A |
| 222841 | G | A |
| 222924 | C | T |
| 228543 | C | T |
| 247200 | C | T |
| 248952 | C | T |
| 253299 | G | A |
| 254551 | G | A |
| 259829 | C | T |
| 268705 | C | T |
| 270822 | G | A |
| 273723 | G | A |
| 276430 | C | T |
| 276561 | C | T |
| 283007 | G | A |
| 283062 | G | A |
| 287132 | C | T |
| 294767 | G | A |
| 295356 | C | T |
| 300028 | C | T |
| 303810 | G | A |
| 313837 | C | T |
| 316698 | G | A |
| 316929 | G | A |
| 325503 | C | T |
| 331088 | G | A |
| 340040 | G | A |
| 342987 | G | A |
| 343915 | G | A |
| 352688 | C | T |
| 353668 | G | A |
| 361019 | G | A |
| 362742 | G | A |
| 375835 | C | T |
| 381358 | G | A |
| 382029 | G | A |
| 391677 | C | T |
| 400166 | C | T |
| 406413 | G | A |
| 409544 | G | A |
| 416199 | G | A |
| 419938 | C | T |
| 425067 | G | A |
| 425419 | G | A |
| 426464 | G | A |
| 438324 | C | T |
| 446368 | G | A |
| 446984 | G | A |
| 447392 | G | A |
| 450492 | G | A |
| 458678 | C | T |
| 459753 | C | T |
| 459833 | A | G |
| 466505 | G | A |
| 474923 | G | A |
| 482599 | G | A |
| 494993 | G | A |
| 500358 | C | T |
| 510408 | C | T |
| 511515 | G | A |
| 512816 | G | A |
| 513902 | C | T |
| 515197 | G | A |
| 518156 | G | A |
| 533618 | G | A |
| 536327 | C | T |
| 542891 | G | A |
| 548989 | C | T |
| 553081 | G | A |
| 553332 | G | A |
| 557884 | G | A |
| 557907 | C | A |
| 567026 | C | T |
| 587166 | A | G |
| 590721 | G | A |
| 602225 | C | T |
| 604184 | C | T |
| 605918 | C | T |
| 621774 | C | T |
| 624361 | C | T |
| 625600 | C | T |
| 626283 | G | A |
| 629283 | G | A |
| 636108 | C | T |
| 648981 | G | A |
| 684062 | Ci | A |
| 702171 | C | T |
| 702650 | C | T |
| 703452 | C | T |
| 706109 | C | T |
| 711168 | G | A |
| 712462 | A | A/G |
| 714678 | G | A |

| Position in SEQ ID 16053 | Nucleotide in SEQ ID 16053 | Mutated Nucleotide |
|---|---|---|
| 714785 | G | A |
| 717602 | G | A |
| 719600 | G | A |
| 724097 | G | A |
| 738525 | C | T |
| 744594 | G | A |
| 746362 | G | A |
| 750285 | C | T |
| 752663 | G | A |
| 763762 | C | C/G |
| 763785 | G | G/C |
| 763792 | C | C/G |
| 763951 | C | C/G |
| 765635 | G | A |
| 766073 | G | A |
| 769289 | G | A |
| 776043 | C | T |
| 780677 | C | T |
| 781916 | C | T |
| 783900 | C | T |
| 786653 | G | A |
| 795572 | C | T |
| 796824 | G | A |
| 798663 | G | A |
| 810530 | G | A |
| 810533 | C | G |
| 810556 | T | T/C |
| 810557 | G | G/C |
| 810563 | C | C/T |
| 810576 | A | A/G |
| 819250 | G | A |
| 829153 | C | T |
| 830171 | C | T |
| 831404 | G | A |
| 838352 | G | A |
| 842068 | G | A |
| 847887 | G | A |
| 861775 | C | T |
| 870304 | G | A |
| 880820 | C | T |
| 897424 | C | T |
| 907842 | G | A |
| 908987 | C | T |
| 921289 | G | A |
| 941088 | G | A |
| 945666 | G | A |
| 959932 | C | T |
| 964504 | G | A |
| 964558 | C | T |
| 970334 | C | T |
| 972781 | C | T |
| 995285 | G | A |
| 1004653 | C | T |
| 1006503 | C | T |
| 1008680 | G | A |
| 1009674 | G | A |
| 1009813 | G | A |
| 1023301 | C | T |
| 1028963 | G | A |
| 1030345 | C | T |
| 1030822 | G | A |
| 1037262 | G | A |
| 1041811 | C | T |
| 1054013 | C | T |
| 1055406 | C | T |
| 1082623 | G | A |
| 1085482 | C | T |
| 1085499 | C | T |
| 1088995 | C | T |
| 1097530 | C | T |
| 1107807 | T | A |
| 1117905 | C | T |
| 1119169 | G | A |
| 1120103 | G | A |
| 1120852 | G | A |
| 1122832 | C | T |
| 1123080 | C | T |
| 1128153 | G | A |
| 1130585 | G | A |
| 1145784 | C | T |
| 1146897 | G | A |
| 1153166 | C | T |
| 1163219 | C | T |
| 1163309 | G | A |
| 1163538 | G | A |
| 1169629 | C | T |
| 1169882 | C | T |
| 1170591 | C | T |
| 1172808 | C | T |
| 1172940 | C | T |
| 1173551 | C | T |
| 1179238 | C | A |
| 1192548 | C | T |
| 1194346 | C | T |
| 1194637 | G | A |
| 1196403 | C | T |
| 1208932 | C | T |
| 1221399 | C | T |
| 1222202 | C | T |
| 1225212 | C | T |
| 1242677 | G | A |
| 1249095 | C | T |
| 1250477 | G | A |
| 1255855 | C | T |
| 1260719 | C | T |
| 1261347 | C | T |
| 1261926 | C | T |
| 1262307 | G | A |
| 1262367 | G | A |
| 1267545 | C | T |
| 1270664 | C | T |
| 1272928 | C | T |
| 1273797 | C | T |
| 1277491 | G | A |
| 1282245 | G | A |
| 1284346 | C | T |
| 1285883 | C | T |
| 1291340 | C | T |
| 1300654 | G | A |
| 1306705 | C | T |
| 1307526 | C | T |
| 1308200 | C | T |
| 1315876 | C | T |
| 1317961 | G | A |
| 1321981 | C | T |
| 1322304 | C | T |
| 1325473 | C | T |
| 1325983 | G | A |
| 1327837 | C | T |
| 1329364 | C | T |
| 1330802 | G | A |
| 1335338 | C | T |
| 1342390 | C | T |
| 1343472 | A | C |
| 1344261 | C | T |
| 1346995 | C | T |
| 1348395 | G | A |
| 1351344 | C | T |
| 1352745 | C | T |
| 1356389 | C | T |
| 1359105 | G | A |
| 1359182 | C | T |
| 1362032 | C | T |
| 1370065 | G | A |
| 1370088 | C | T |
| 1379821 | C | T |
| 1382638 | G | A |
| 1388800 | C | T |
| 1404278 | C | T |
| 1409508 | G | A |
| 1410045 | G | A |
| 1413757 | G | A |

| Position in SEQ ID 16053 | Nucleotide in SEQ ID 16053 | Mutated Nucleotide |
|---|---|---|
| 1415711 | G | A |
| 1415773 | G | A |
| 1418132 | C | T |
| 1419671 | G | A |
| 1420016 | C | T |
| 1428228 | C | T |
| 1428233 | C | T |
| 1435884 | C | T |
| 1438355 | C | T |
| 1440872 | G | A |
| 1443149 | C | T |
| 1450678 | G | A |
| 1453590 | G | A |
| 1454075 | C | T |
| 1455191 | G | A |
| 1463521 | C | T |
| 1473239 | C | T |
| 1474775 | G | A |
| 1482297 | C | T |
| 1494980 | G | A |
| 1502729 | G | A |
| 1514463 | C | T |
| 1525258 | G | A |
| 1533361 | C | T |
| 1545597 | T | T/C |
| 1563822 | C | T |
| 1563854 | C | T |
| 1565818 | C | T |
| 1566866 | C | T |
| 1570236 | G | A |
| 1570636 | C | T |
| 1581033 | T | C |
| 1594972 | G | A |
| 1614616 | C | T |
| 1615586 | C | T |
| 1616152 | C | T |
| 1616981 | C | T |
| 1617561 | C | T |
| 1617928 | C | T |
| 1622589 | G | A |
| 1641656 | C | T |
| 1641711 | C | T |
| 1641953 | C | T |
| 1648653 | G | A |
| 1648676 | G | A |
| 1649444 | C | T |
| 1650400 | G | A |
| 1658589 | G | A |
| 1661376 | G | A |
| 1664324 | C | T |
| 1680524 | C | T |
| 1682349 | G | A |
| 1682842 | C | T |
| 1686608 | C | T |
| 1695571 | C | T |
| 1699167 | G | A |
| 1700705 | G | A |
| 1715788 | T | C |
| 1727072 | G | A |
| 1747963 | C | T |
| 1748448 | C | T |
| 1778278 | C | T |
| 1779396 | C | T |
| 1779723 | C | T |
| 1792608 | G | A |
| 1793069 | C | T |
| 1795610 | C | T |
| 1803172 | C | T |
| 1805902 | C | T |
| 1815104 | C | T |
| 1848170 | G | A |
| 1858054 | C | T |
| 1874864 | G | A |
| 1878368 | C | T |
| 1878456 | C | T |
| 1881797 | G | A |
| 1881821 | G | A |
| 1883780 | G | A |
| 1886024 | G | A |
| 1886177 | G | A |
| 1886499 | G | A |
| 1888003 | G | A |
| 1888277 | G | A |
| 1891012 | G | A |
| 1891205 | C | T |
| 1891493 | G | A |
| 1891608 | G | A |
| 1895230 | C | T |
| 1896121 | G | A |
| 1898465 | G | A |
| 1904126 | G | A |
| 1904415 | G | A |
| 1918600 | G | A |
| 1926767 | G | A |
| 1930239 | G | A |
| 1933689 | G | A |
| 1935111 | G | A |
| 1938524 | G | A |
| 1941158 | G | A |
| 1950155 | C | T |
| 1961896 | C | T |
| 1964247 | C | T |
| 1971635 | A | C |
| 1973884 | G | A |
| 1985968 | G | A |
| 1986215 | C | T |
| 1987891 | C | T |
| 1987907 | C | T |
| 1993612 | G | A |
| 1997079 | C | T |
| 2043866 | G | A |
| 2043889 | G | A |
| 2048938 | C | T |
| 2058063 | G | A |
| 2058998 | G | A |
| 2060664 | G | A |
| 2060796 | G | A |
| 2067415 | G | A |
| 2067911 | G | A |
| 2071535 | G | A |
| 2077305 | A | G/A |
| 2077309 | T | C/T |
| 2077321 | A | G/A |
| 2077324 | G | A/G |
| 2077336 | A | G/A |
| 2077351 | C | T/C |
| 2077353 | A | G/A |
| 2077369 | C | T/C |
| 2077383 | G | A/G |
| 2077384 | C | G/C |
| 2077398 | G | G/C |
| 2077432 | T | C/T |
| 2077603 | A | G/A |
| 2077615 | C | A/C |
| 2077618 | G | A/G |
| 2077636 | T | C/T |
| 2077645 | G | C/G |
| 2077651 | G | C/G |
| 2077652 | A | G/A |
| 2077654 | A | G/A |
| 2077663 | C | A/C |
| 2077669 | G | C/G |
| 2077671 | T | C/T |
| 2077682 | C | G/C |
| 2077688 | G | A/G |
| 2077691 | C | G/C |
| 2077694 | A | C/A |
| 2077697 | G | C/G |
| 2077703 | T | G/T |
| 2077715 | G | A/G |
| 2077724 | A | G/A |
| 2077726 | C | T/C |

| Position in SEQ ID 16053 | Nucleotide in SEQ ID 16053 | Mutated Nucleotide |
|---|---|---|
| 2077730 | G | C/G |
| 2077733 | G | A/G |
| 2077736 | C | C/T |
| 2077742 | G | C/G |
| 2077745 | A | G/A |
| 2077751 | G | A/G |
| 2077762 | T | C/T |
| 2077769 | T | C/T |
| 2077772 | A | G/A |
| 2077775 | G | A/G |
| 2077793 | G | C/G |
| 2077794 | A | G/A |
| 2077795 | C | T/C |
| 2077805 | C | T/C |
| 2080486 | C | T |
| 2086608 | G | A |
| 2096915 | G | A |
| 2098836 | C | T |
| 2099830 | G | A |
| 2126265 | C | T |
| 2131730 | G | A |
| 2135109 | C | T |
| 2136848 | C | T |
| 2144528 | G | A |
| 2147486 | G | A |
| 2154132 | C | T |
| 2154136 | C | T |
| 2188490 | C | T |
| 2191494 | C | T |
| 2199567 | G | A |
| 2208975 | G | A |
| 2212324 | G | A |
| 2212659 | G | A |
| 2230643 | G | A |
| 2235434 | G | A |
| 2250499 | C | T |
| 2259118 | C | T |
| 2260582 | G | A |
| 2266821 | C | T |
| 2271223 | G | A |
| 2273696 | C | T |
| 2277990 | C | T |
| 2291798 | C | T |
| 2293101 | C | C/T |
| 2293102 | G | G/T |
| 2293121 | G | G/C |
| 2293139 | A | A/C |
| 2293157 | G | G/A |
| 2293169 | G | G/C |
| 2293175 | G | G/A |
| 2293176 | A | A/T |
| 2293184 | C | C/G |
| 2293185 | G | G/A |
| 2293187 | A | A/G |
| 2293196 | G | A/G |
| 2293202 | G | G/C |
| 2293205 | G | C/G |
| 2293214 | G | G/C |
| 2293219 | A | A/T |
| 2293220 | G | G/C |
| 2293226 | G | C/G |
| 2293228 | G | G/A |
| 2293234 | A | A/T |
| 2293235 | G | G/C |
| 2293238 | G | G/C |
| 2293244 | G | G/C |
| 2293247 | G | A/G |
| 2293253 | G | A/G |
| 2293268 | G | C/G |
| 2293310 | G | G/A |
| 2293313 | G | G/C |
| 2293316 | G | G/A |
| 2293319 | G | G/A |
| 2293328 | G | G/C |
| 2293337 | G | G/C |
| 2293346 | G | G/C |
| 2293352 | C | C/G |
| 2293367 | G | G/C |
| 2293376 | C | C/G |
| 2293403 | C | C/G |
| 2293463 | C | C/G |
| 2302130 | G | A |
| 2312744 | C | T |
| 2313183 | G | A |
| 2315988 | C | T |
| 2323085 | C | T |
| 2329242 | C | T |
| 2332081 | G | A |
| 2341627 | C | T |
| 2347673 | C | T |
| 2348681 | G | A |
| 2359598 | G | A |
| 2362060 | A | G |
| 2368326 | G | A |
| 2376154 | G | A |
| 2380176 | C | T |
| 2382542 | C | T |
| 2382567 | C | T |
| 2382748 | C | T |
| 2389975 | C | T |
| 2392147 | C | T |
| 2396255 | G | A |
| 2415101 | G | A |
| 2422620 | C | T |
| 2437185 | G | A |
| 2448470 | G | A |
| 2452760 | G | A |
| 2456608 | C | T |
| 2459347 | C | T |
| 2459641 | G | A |
| 2460824 | C | T |
| 2463427 | C | T |
| 2482048 | C | T |
| 2482381 | G | A |
| 2483453 | C | T |
| 2487377 | G | A |
| 2489641 | G | A |
| 2492054 | G | A |
| 2502775 | G | A |
| 2515457 | G | A |
| 2518872 | G | A |
| 2530466 | G | A |
| 2532233 | G | A |
| 2533237 | G | A |
| 2536306 | G | A |
| 2538874 | G | A |
| 2542087 | G | A |
| 2544720 | C | T |
| 2553277 | G | A |
| 2556662 | C | T |
| 2559280 | G | A |
| 2562212 | G | A |
| 2564253 | G | A |
| 2564620 | G | A |
| 2566353 | G | A |
| 2572994 | G | A |
| 2573153 | C | T |
| 2575327 | G | A |
| 2599645 | G | A |
| 2599894 | G | A |
| 2601319 | G | A |
| 2606340 | G | A |
| 2608948 | G | A |
| 2610422 | C | T |
| 2614778 | G | A |
| 2617082 | G | A |
| 2618776 | C | T |
| 2618805 | C | T |
| 2620558 | G | A |
| 2626414 | A | G |
| 2636037 | C | T |
| 2639682 | G | A |

| Position in SEQ ID 16053 | Nucleotide in SEQ ID 16053 | Mutated Nucleotide |
|---|---|---|
| 2642753 | G | A |
| 2644984 | C | T |
| 2651718 | C | T |
| 2652733 | C | T |
| 2653074 | C | T |
| 2653159 | C | T |
| 2653337 | G | A |
| 2655271 | C | T |
| 2655308 | C | T |
| 2657059 | C | T |
| 2658261 | G | A |
| 2659295 | C | T |
| 2663775 | C | T |
| 2670944 | C | T |
| 2671043 | C | T |
| 2672551 | C | T |
| 2676880 | C | T |
| 2677056 | G | A |
| 2677196 | C | T |
| 2678066 | G | A |
| 2679900 | C | T |
| 2686364 | C | T |
| 2687028 | C | T |
| 2688632 | C | T |
| 2694405 | G | A |
| 2701281 | G | A |
| 2712327 | G | A |
| 2720850 | C | T |
| 2728435 | G | A |
| 2731397 | G | A |
| 2735550 | G | G/A |
| 2735576 | G | G/C |
| 2738768 | C | T |
| 2744600 | C | T |
| 2748694 | C | T |
| 2756873 | C | T |
| 2760595 | G | A |
| 2762887 | G | A |
| 2763137 | G | A |
| 2764279 | C | T |
| 2766645 | C | T |
| 2770562 | C | T |
| 2773173 | C | T |
| 2774095 | G | A |
| 2774734 | G | A |
| 2774874 | G | A |
| 2776314 | C | T |
| 2776919 | C | T |
| 2778598 | G | A |
| 2779539 | G | A |
| 2782696 | C | T |
| 2783578 | C | T |
| 2783738 | C | T |
| 2785372 | C | T |
| 2785531 | C | T |
| 2787379 | G | A |
| 2788015 | C | T |
| 2788247 | C | T |
| 2789216 | C | T |
| 2790626 | C | T |
| 2791577 | C | T |
| 2792510 | C | T |
| 2792715 | G | A |
| 2797814 | C | T |
| 2799953 | C | T |
| 2800033 | C | T |
| 2802765 | C | T |
| 2803789 | C | T |
| 2804694 | C | T |
| 2806670 | C | T |
| 2814611 | G | A |
| 2815199 | C | C/T |
| 2816239 | G | A |
| 2821693 | G | A |
| 2838356 | C | T |
| 2841171 | T | T/A |
| 2841177 | C | C/G |
| 2841183 | C | C/G |
| 2841213 | T | T/C |
| 2841228 | C | C/G |
| 2841237 | G | G/C |
| 2841251 | G | G/T |
| 2841255 | C | C/A |
| 2841258 | G | G/T |
| 2841276 | C | C/G |
| 2841293 | C | C/G |
| 2841297 | C | C/A |
| 2841303 | C | C/T |
| 2841306 | G | G/A |
| 2841312 | T | C/T |
| 2841315 | C | G/C |
| 2841322 | A | A/T |
| 2841323 | G | G/T |
| 2841327 | C | G/C |
| 2841335 | G | C/G |
| 2841357 | G | C/G |
| 2841360 | G | C/G |
| 2841369 | G | C/G |
| 2841376 | T | T/C |
| 2841377 | G | T/G |
| 2841384 | G | C/G |
| 2841389 | T | T/C |
| 2841397 | G | G/T |
| 2841398 | A | C/A |
| 2841402 | G | A/G |
| 2841403 | G | C/G |
| 2841409 | T | A/T |
| 2841413 | G | T/G |
| 2841423 | C | G/C |
| 2841444 | G | C/G |
| 2841451 | C | T/C |
| 2841477 | C | G/C |
| 2841514 | G | T/G |
| 2841531 | A | G/A |
| 2841534 | G | C/G |
| 2841536 | T | A/T |
| 2841540 | C | G/G |
| 2841546 | G | C/G |
| 2841552 | G | C |
| 2841554 | T | C/T |
| 2841555 | C | T/C |
| 2841562 | C | T/C |
| 2841563 | A | C/A |
| 2841569 | A | C/A/T |
| 2841575 | C | T/C |
| 2841585 | C | C/G |
| 2841588 | G | C/G |
| 2841594 | G | A/G |
| 2841605 | C | C/A |
| 2841609 | C | C/G |
| 2841617 | T | G/T |
| 2841636 | G | C/G |
| 2841656 | A | C/A |
| 2841660 | G | C/G |
| 2841668 | C | T/C |
| 2841690 | G | C/G |
| 2841700 | G | T |
| 2841701 | C | T |
| 2841708 | G | A/G |
| 2841734 | T | C |
| 2841735 | C | T |
| 2841738 | G | C |
| 2841744 | C | G/C |
| 2841747 | G | A |
| 2841756 | C | G |
| 2841759 | G | C |
| 2841762 | C | G |
| 2841776 | G | T |
| 2841778 | T | G |
| 2841783 | G | C |
| 2841786 | A | T |
| 2841789 | C | T |

| Position in SEQ ID 16053 | Nucleotide in SEQ ID 16053 | Mutated Nucleotide |
|---|---|---|
| 2845157 | G | A |
| 2850318 | G | A |
| 2851372 | G | A |
| 2853353 | C | T |
| 2853817 | G | A |
| 2868405 | C | T |
| 2874011 | C | T |
| 2875055 | G | A |
| 2875488 | G | A |
| 2876911 | G | T |
| 2882407 | C | T |
| 2888545 | C | T |
| 2890510 | C | T |
| 2892791 | G | A |
| 2896239 | G | A |
| 2896828 | G | A |
| 2896833 | G | A |
| 2899845 | C | T |
| 2899865 | C | T |
| 2901123 | C | T |
| 2905469 | C | T |
| 2912026 | G | A |
| 2921100 | C | T |
| 2934976 | G | A |
| 2935134 | G | A |
| 2935223 | G | A |
| 2945715 | G | A |
| 2953167 | C | T |
| 2956464 | C | T |
| 2965167 | G | A |
| 2971031 | C | T |
| 2971761 | C | T |
| 2973653 | C | T |
| 2976296 | C | T |
| 2978371 | C | T |
| 2983351 | G | A |
| 2986416 | C | T |
| 2987675 | C | T |
| 2988967 | C | T |
| 2992035 | C | T |
| 2993614 | A | G |
| 2994097 | G | A |
| 3000921 | G | A |
| 3002748 | G | A |
| 3003382 | G | A |
| 3005352 | G | A |
| 3006201 | C | T |
| 3021497 | G | A |
| 3026718 | C | T |
| 3027132 | G | A |
| 3031683 | C | T |
| 3032969 | C | T |
| 3044082 | G | A |
| 3045579 | G | A |
| 3049857 | G | A |
| 3066905 | C | T |
| 3079916 | T | A/T |
| 3079923 | C | C/T |
| 3079936 | G | A/G |
| 3079950 | A | T/A |
| 3080004 | C | C/T |
| 3080006 | A | T/A |
| 3080035 | C | C/T |
| 3080043 | A | C/A |
| 3080063 | G | C/G |
| 3080084 | C | C/T |
| 3080087 | G | C/T/G |
| 3080098 | C | C/A |
| 3080128 | C | T/C |
| 3080136 | A | G/A |
| 3080160 | C | G/C |
| 3080161 | T | C/T |
| 3080163 | T | C/T |
| 3080183 | T | C/T |
| 3080192 | G | C/G |
| 3080204 | G | C/G |
| 3080237 | G | C/G |
| 3080288 | G | C/G |
| 3080294 | G | T/G |
| 3080316 | C | C/T |
| 3080321 | T | T/C |
| 3080325 | G | T/G |
| 3080326 | C | T/C |
| 3080355 | A | T/A |
| 3080356 | A | A/G |
| 3080357 | A | A/G |
| 3080359 | A | A/G |
| 3080372 | A | A/G |
| 3080375 | A | A/C |
| 3080382 | G | G/A |
| 3080391 | A | A/G |
| 3080393 | C | C/T |
| 3080394 | G | G/A |
| 3080402 | A | A/G |
| 3080406 | A | A/G |
| 3080418 | A | A/G |
| 3080447 | C | C/T |
| 3080465 | T | T/C |
| 3080472 | C | C/T |
| 3080482 | A | A/G |
| 3080485 | C | C/T |
| 3080496 | T | T/C |
| 3082062 | G | A |
| 3084014 | G | A |
| 3087970 | C | T |
| 3089578 | G | A |
| 3090231 | G | G/C |
| 3101153 | G | A |
| 3120006 | C | T |
| 3121040 | C | T |
| 3125035 | C | T |
| 3125407 | C | T |
| 3128098 | C | T |
| 3131738 | C | T |
| 3133651 | C | T |
| 3133766 | G | A |
| 3137673 | C | T |
| 3138173 | G | T |
| 3147694 | C | T |
| 3148142 | C | T |
| 3148342 | C | T |
| 3148452 | C | T |
| 3148777 | C | T |
| 3148960 | C | T |
| 3149335 | C | T |
| 3151547 | C | T |
| 3152279 | C | T |
| 3153365 | G | A |
| 3156844 | C | T |
| 3175067 | G | A |
| 3176311 | C | T |
| 3180510 | C | T |
| 3181134 | C | T |
| 3196810 | C | T |
| 3198674 | G | A |
| 3203788 | G | A |
| 3204764 | G | T |
| 3208464 | G | T |
| 3213080 | C | T |
| 3214059 | C | T |
| 3216019 | C | T |
| 3216133 | C | T |
| 3218109 | C | T |
| 3226281 | C | T |
| 3229241 | G | A |
| 3230387 | G | A |
| 3235932 | C | T |
| 3237109 | C | T |
| 3238700 | C | T |
| 3241279 | C | T |
| 3241643 | G | A |
| 3245145 | C | T |

| Position in SEQ ID 16053 | Nucleotide in SEQ ID 16053 | Mutated Nucleotide |
|---|---|---|
| 3247705 | G | A |
| 3248186 | G | A |
| 3249319 | C | T |
| 3251559 | G | A |
| 3253347 | C | T |
| 3253453 | C | T |
| 3253884 | G | A |
| 3254464 | G | A |
| 3258028 | G | A |
| 3258094 | G | A |
| 3258637 | C | T |
| 3259667 | C | T |
| 3261792 | G | A |
| 3262978 | C | T |
| 3266668 | G | A |
| 3266806 | C | T |
| 3267341 | G | A |
| 3267927 | C | T |
| 3268140 | T | C |
| 3269676 | G | A |
| 3270548 | G | A |
| 3275254 | A | G |
| 3276870 | C | T |
| 3277187 | C | T |
| 3279932 | C | T |
| 3285105 | C | T |
| 3289175 | C | T |
| 3289533 | C | T |
| 3290417 | G | A |
| 3290880 | C | T |
| 3291408 | C | T |
| 3294618 | C | T |
| 3295292 | C | T |
| 3296150 | C | T |
| 3296689 | C | T |
| 3297254 | C | T |
| 3297593 | G | A |
| 3297802 | C | T |
| 3297816 | G | A |
| 3299219 | C | T |
| 3300457 | C | T |
| 3300838 | C | T |
| 3300849 | C | T |
| 3307410 | G | A |
| 3307738 | G | A |
| 3309205 | C | T |
| 3309441 | G | A |
| 3313410 | C | T |
| 3314734 | C | T |
| 3315483 | C | T |
| 3316995 | C | T |
| 3318906 | C | T |
| 3319964 | C | T |
| 3321895 | G | A |
| 3326784 | G | A |
| 3327191 | G | A |
| 3328753 | C | T |
| 3336319 | C | T |
| 3337206 | G | A |
| 3338688 | C | T |
| 3345311 | C | T |
| 3346757 | G | A |
| 3347355 | C | T |
| 3347540 | C | T |
| 3347560 | C | T |
| 3348860 | C | T |
| 3349015 | C | T |
| 3349651 | C | T |
| 3350820 | C | T |
| 3351613 | C | T |
| 3353030 | C | T |
| 3354271 | C | T |
| 3354637 | C | T |
| 3358411 | G | G/A |
| 3358883 | G | A |
| 3361525 | G | A |
| 3363657 | C | T |
| 3368167 | C | T |
| 3368381 | C | C/T |
| 3375301 | C | T |
| 3381507 | C | T |
| 3383846 | C | T |
| 3386322 | C | T |
| 3386914 | G | A |
| 3388650 | C | T |
| 3388663 | C | T |
| 3388840 | G | A |
| 3390202 | G | A |
| 3391187 | C | T |
| 3394129 | C | T |
| 3395838 | C | T |
| 3396692 | C | T |
| 3397717 | C | T |
| 3400152 | C | T |
| 3402866 | G | A |
| 3403044 | C | T |
| 3403253 | C | T |
| 3404959 | C | T |
| 3405078 | C | T |
| 3409620 | G | A |
| 3412544 | G | A |
| 3415574 | A | G |
| 3418558 | C | T |
| 3418906 | G | A |
| 3420004 | C | T |
| 3420345 | C | T |
| 3429994 | C | T |
| 3430020 | G | A |
| 3431269 | C | T |
| 3432683 | G | A |
| 3433788 | G | A |
| 3434662 | C | T |
| 3435439 | G | A |
| 3435661 | G | A |
| 3440357 | G | A |
| 3441404 | C | T |
| 3453288 | C | T |
| 3454769 | G | A |
| 3456480 | C | T |
| 3457161 | C | T |
| 3461043 | C | T |
| 3461116 | G | A |
| 3464902 | C | T |
| 3469479 | C | T |
| 3473066 | G | A |
| 3474749 | C | T |
| 3484337 | G | A |
| 3484696 | C | T |
| 3490633 | G | A |
| 3511395 | C | T |
| 3517523 | G | A |
| 3518338 | C | T |
| 3519210 | C | T |
| 3519280 | C | T |
| 3526212 | G | A |
| 3526229 | G | A |
| 3532172 | C | T |
| 3532281 | C | T |
| 3539856 | C | T |
| 3540438 | C | T |
| 3540952 | C | T |
| 3553678 | G | A |
| 3558780 | G | A |
| 3559503 | G | A |
| 3560298 | T | C |
| 3572036 | C | T |
| 3587529 | C | T |
| 3590513 | C | T |
| 3590937 | C | T |
| 3596971 | C | T |
| 3601304 | C | T |
| 3610733 | G | A |

-continued

| Position in SEQ ID 16053 | Nucleotide in SEQ ID 16053 | Mutated Nucleotide |
|---|---|---|
| 3613460 | C | T |
| 3617806 | G | A |
| 3618063 | C | T |
| 3618082 | G | A |
| 3621113 | G | A |
| 3625554 | C | T |
| 3626449 | C | T |
| 3626548 | C | T |
| 3627377 | C | T |
| 3627686 | C | T |
| 3628977 | C | T |
| 3632788 | C | T |
| 3647003 | C | T |
| 3650159 | G | A |
| 3658514 | C | T |
| 3659174 | C | T |
| 3672218 | G | A |
| 3695232 | G | A |
| 3702963 | C | T |
| 3704185 | C | T |
| 3704278 | G | G/C |
| 3704281 | T | T/G |
| 3704282 | C | C/T |
| 3704293 | T | T/G |
| 3704327 | G | A/G |
| 3704335 | C | T/C |
| 3704338 | C | G/C |
| 3704340 | A | C/A |
| 3704371 | G | C/G |
| 3704386 | T | C/T |
| 3704389 | C | G/C |
| 3704395 | G | C/G |
| 3704404 | G | C/G |
| 3704415 | C | T/C |
| 3704427 | G | A/G |
| 3704428 | C | T/C |
| 3704464 | C | T/C |
| 3704484 | A | C/A |
| 3704485 | C | G/C |
| 3704491 | G | C/G |
| 3704512 | G | C/G |
| 3704519 | A | G/A |
| 3704531 | A | GA |
| 3704534 | G | C/G |
| 3704536 | C | G/C |
| 3704543 | C | G/C |
| 3704544 | T | C/T |
| 3704554 | T | T/G |
| 3704563 | C | G/C |
| 3704573 | A | GA |
| 3704574 | A | G/A |
| 3704577 | G | C/G |
| 3704584 | C | G/C |
| 3704587 | G | A/G |
| 3704590 | G | C/G |
| 3704605 | T | C/T |
| 3704608 | C | G/C |
| 3704617 | T | G/T |
| 3704619 | A | C/A |
| 3704620 | C | A/C |
| 3704629 | C | G/C |
| 3704638 | C | G/C |
| 3704641 | G | C/G |
| 3704647 | C | G/C |
| 3704650 | G | C/A |
| 3704660 | C | A/C |
| 3704662 | G | A/G |
| 3704668 | T | C/T |
| 3704669 | G | A/G |
| 3704670 | T | C/T |
| 3704680 | C | G/C |
| 3704684 | C | G/C |
| 3704686 | G | C/G |
| 3704746 | G | C/G |
| 3704755 | C | C/G |
| 3704767 | A | A/G |

-continued

| Position in SEQ ID 16053 | Nucleotide in SEQ ID 16053 | Mutated Nucleotide |
|---|---|---|
| 3704782 | T | T/C |
| 3704789 | A | VG |
| 3704791 | C | C/G |
| 3704806 | C | C/T |
| 3704815 | T | T/C |
| 3704822 | C | C/G |
| 3704844 | C | C/A |
| 3704851 | A | A/G |
| 3704852 | C | C/A |
| 3704866 | T | T/C |
| 3704869 | C | C/G |
| 3704875 | C | C/G |
| 3704906 | G | A |
| 3706589 | C | C/G |
| 3706625 | G | G/C |
| 3706641 | G | G/T |
| 3706652 | G | G/A |
| 3706655 | C | C/G |
| 3706679 | T | T/C |
| 3706715 | C | C/G |
| 3706735 | C | C/G |
| 3706737 | A | A/G |
| 3706739 | G | G/C |
| 3706784 | C | C/T |
| 3706790 | T | T/C |
| 3706794 | A | A/G |
| 3706805 | G | G/C |
| 3706822 | A | A/G |
| 3706862 | C | C/G |
| 3706926 | G | G/T |
| 3706932 | A | A/C |
| 3706940 | G | G/A |
| 3706945 | G | G/C |
| 3706950 | T | T/A |
| 3706951 | C | C/G |
| 3706958 | T | T/C |
| 3706960 | A | A/G |
| 3706967 | C | C/G |
| 3706983 | C | C/G |
| 3706985 | G | G/C |
| 3706994 | G | G/C |
| 3706996 | A | A/C |
| 3707006 | G | G/C |
| 3707012 | C | C/A |
| 3707013 | A | A/G |
| 3707036 | C | C/G |
| 3711369 | G | A |
| 3713575 | C | T |
| 3724878 | G | A |
| 3724955 | G | A |
| 3727102 | G | A |
| 3727130 | G | A |
| 3727909 | C | T |
| 3732046 | C | T |
| 3733052 | G | A |
| 3740023 | G | A |
| 3741710 | G | A |
| 3744813 | G | A |
| 3750360 | G | A |
| 3756113 | C | T |
| 3762328 | G | A |
| 3763755 | G | A |
| 3764788 | G | A |
| 3771690 | C | T |
| 3775098 | G | A |
| 3775718 | G | A |
| 3776484 | G | A |
| 3783703 | T | C |
| 3786947 | G | A |
| 3788243 | C | T |
| 3798429 | G | A |
| 3799202 | G | A |
| 3799222 | G | A |
| 3802171 | C | T |
| 3806580 | C | T |
| 3825163 | C | T |

| Position in SEQ ID 16053 | Nucleotide in SEQ ID 16053 | Mutated Nucleotide |
|---|---|---|
| 3828141 | G | A |
| 3831054 | G | A |
| 3831114 | G | A |
| 3831589 | C | T |
| 3831701 | G | A |
| 3837175 | G | A |
| 3841387 | G | A |
| 3843222 | C | T |
| 3843509 | G | A |
| 3843815 | G | A |
| 3844238 | G | A |
| 3846121 | G | A |
| 3846452 | G | A |
| 3852914 | T | C |
| 3873931 | G | A |
| 3879758 | G | A |
| 3883035 | C | T |
| 3905636 | C | T |
| 3919216 | C | T |
| 3920191 | G | A |
| 3928659 | C | T |
| 3935704 | C | C/T |
| 3941486 | G | A |
| 3964297 | G | A |
| 3965972 | G | A |
| 3968608 | C | T |
| 3983198 | C | T |
| 3993744 | G | G/A |
| 4002370 | G | A |
| 4004770 | C | T |
| 4006580 | C | T |
| 4006932 | G | A |
| 4013932 | G | A |
| 4014337 | T | C |
| 4017638 | C | T |
| 4019106 | G | A |
| 4020770 | C | T |
| 4025302 | C | T |
| 4027304 | G | A |
| 4034139 | G | G/T |
| 4043320 | A | G |
| 4063459 | G | A |
| 4072648 | C | T |
| 4073198 | C | T |
| 4073446 | G | A |
| 4074524 | C | T |
| 4081747 | C | T |
| 4086210 | A | G |
| 4089001 | C | T |
| 4102977 | C | T |
| 4104004 | C | T |
| 4114649 | G | A |
| 4117981 | G | A |
| 4118234 | C | T |
| 4121337 | G | A |
| 4124406 | G | A |
| 4130087 | C | T |
| 4148633 | C | T |
| 4150599 | C | T |
| 4152842 | C | T |
| 4156366 | G | A |
| 4156524 | G | A |
| 4157742 | Ci | A |
| 4157795 | Ci | A |
| 4158022 | G | A |
| 4160265 | G | A |
| 4170648 | C | T |
| 4186914 | C | T |
| 4187188 | G | A |
| 4192330 | C | T |
| 4192395 | C | T |
| 4194086 | C | T |
| 4196729 | C | T |
| 4205330 | C | T |
| 4218066 | G | A |
| 4220842 | G | A |
| 4231722 | C | T |
| 4251577 | C | T |
| 4253562 | G | A |
| 4255089 | G | A |
| 4268915 | C | T |
| 4284264 | C | T |
| 4285070 | G | A |
| 4286615 | G | A |
| 4299670 | C | T |
| 4302785 | G | A |
| 4302812 | C | T |
| 4312528 | G | A |
| 4312875 | C | T |
| 4314885 | G | A |
| 4314896 | C | T |
| 4314899 | G | A |
| 4316350 | C | T |
| 4318874 | C | T |
| 4319625 | C | T |
| 4324089 | G | A |
| 4325174 | G | A |
| 4325955 | G | A |
| 4327176 | C | T |
| 4328372 | C | T |
| 4329685 | C | T |
| 4329867 | C | T |
| 4331851 | C | T |
| 4331916 | C | T |
| 4334253 | C | T |
| 4335755 | C | T |
| 4340706 | C | T |
| 4343282 | T | C |
| 4347901 | C | T |
| 4352755 | G | A |
| 4360959 | G | A |
| 4361293 | C | T |
| 4362371 | C | T |
| 4365880 | G | A |
| 4376161 | C | T |
| 4376238 | C | T |
| 4378853 | G | A |
| 4395837 | G | A |
| 4396016 | C | T |
| 4402736 | C | T |
| 4406151 | G | A |
| 4414580 | G | A |
| 4414632 | C | T |
| 4420655 | C | T |
| 4433146 | G | A |
| 4438071 | G | A |
| 4440571 | T | C |
| 4440772 | G | A |
| 4443633 | G | A |
| 4444731 | C | T |
| 4446487 | T | C |
| 4463567 | C | T |
| 4463766 | G | A |
| 4467838 | G | A |
| 4474494 | G | A |
| 4481185 | G | A |
| 4486135 | C | T |
| 4487769 | G | A |
| 4490385 | G | A |
| 4496083 | G | A |
| 4499876 | C | T |
| 4503563 | C | T |
| 4504062 | C | T |
| 4517204 | G | A |
| 4524639 | G | A |
| 4524706 | G | A |
| 4529241 | G | A |
| 4529778 | G | A |
| 4531772 | G | A |
| 4532547 | G | A |
| 4532943 | G | A |
| 4533824 | G | A |

| Position in SEQ ID 16053 | Nucleotide in SEQ ID 16053 | Mutated Nucleotide |
|---|---|---|
| 4535251 | G | A |
| 4537480 | G | A |
| 4537859 | G | A |
| 4543587 | G | A |
| 4547764 | C | T |
| 4558815 | C | T |
| 4558914 | C | T |
| 4564648 | G | A |
| 4564991 | G | A |
| 4573497 | C | T |
| 4573536 | C | T |
| 4575408 | C | T |
| 4577334 | C | T |
| 4580403 | G | A |
| 4582642 | T | C |
| 4588387 | C | A |
| 4588663 | G | A |
| 4597434 | C | T |
| 4598262 | C | T |
| 4601247 | G | G/C |
| 4601248 | T | T/C |
| 4603166 | C | T |
| 4611131 | C | T |
| 4614475 | C | T |
| 4616665 | G | A |
| 4617801 | G | A |
| 4619989 | C | T |
| 4621439 | G | A |
| 4626601 | G | A |
| 4630752 | C | T |
| 4649811 | A | A/G |
| 4650590 | C | T |
| 4669551 | C | T |
| 4670815 | G | A |
| 4674426 | G | A |
| 4677968 | C | T |
| 4688341 | C | T |
| 4697092 | C | T |
| 4700003 | G | A |
| 4702254 | C | T |
| 4704691 | C | T |
| 4704704 | C | T |
| 4713174 | C | T |
| 4727776 | G | A |
| 4736024 | C | T |
| 4766839 | C | T |
| 4769655 | C | T |
| 4776927 | G | A |
| 4788381 | C | T |
| 4794373 | C | T |
| 4799012 | G | A |
| 4812357 | C | T |
| 4813704 | G | G/T |
| 4813710 | G | G/T |
| 4813711 | A | A/C |
| 4814060 | C | C/T |
| 4814078 | C | C/T |
| 4814081 | C | C/T |
| 4814082 | G | G/C |
| 4814087 | T | T/C |
| 4818340 | G | A |
| 4820651 | C | T |
| 4821863 | G | A |
| 4852073 | T | T/C |
| 4852080 | T | C/T |
| 4852093 | T | C/T |
| 4852131 | G | A/G |
| 4852238 | T | C/T |
| 4857271 | T | T/C |
| 4852348 | G | G/A |
| 4852373 | T | T/C |
| 4858842 | C | T |
| 4859921 | G | A |
| 4860949 | G | A |
| 4872907 | G | A |
| 4879205 | C | T |
| 4886810 | C | T |
| 4889101 | G | A |
| 4891956 | C | T |
| 4896797 | C | T |
| 4903124 | G | A |
| 4904325 | A | A/G |
| 4904344 | C | C/G |
| 4904345 | C | C/T |
| 4904355 | A | G |
| 4904359 | G | G/C |
| 4904360 | T | T/C |
| 4908341 | C | T |
| 4908687 | C | T |
| 4911304 | C | T |
| 4916472 | C | T |
| 4920831 | C | T |
| 4924034 | C | T |
| 4924484 | C | T |
| 4927068 | C | T |
| 4927798 | C | T |
| 4929941 | C | T |
| 4930693 | C | T |
| 4932671 | C | T |
| 4933447 | T | T/C |
| 4948234 | G | A |
| 4950870 | C | T |
| 4951932 | C | T |
| 4953821 | C | T |
| 4978515 | G | A |
| 4981742 | C | T |
| 4984320 | A | G |
| 4987021 | G | A |
| 4987606 | G | A |
| 4991441 | G | A |
| 4992870 | G | A |
| 5014441 | C | T |
| 5016187 | C | T |
| 5016773 | C | T |
| 5025119 | G | A |
| 5030757 | C | T |
| 5053257 | C | T |
| 5056010 | C | T |
| 5056241 | C | T |
| 5058845 | C | T |
| 5058850 | C | T |
| 5060436 | C | T |
| 5061245 | C | T |
| 5062621 | C | T |
| 5063656 | C | T |
| 5063753 | A | A/G |
| 5063759 | T | T/G |
| 5063766 | C | C/T |
| 5063772 | A | A/G |
| 5063775 | T | T/C |
| 5063777 | A | A/G |
| 5063883 | T | T/C |
| 5063900 | G | G/A |
| 5063967 | T | C/T |
| 5063994 | C | C/G |
| 5063997 | T | C/T |
| 5064000 | G | C/G |
| 5064054 | C | C/G |
| 5064140 | T | A/T |
| 5064188 | G | G/C |
| 5064199 | G | A/G |
| 5064223 | T | C/T |
| 5064318 | G | G/A |
| 5064363 | G | G/A |
| 5064364 | C | C/G |
| 5064368 | T | C/T |
| 5066806 | C | T |
| 5079654 | C | T |
| 5080712 | C | T |
| 5080760 | G | A |
| 5083716 | C | T |
| 5085149 | C | T |

| Position in SEQ ID 16053 | Nucleotide in SEQ ID 16053 | Mutated Nucleotide | Position in SEQ ID 16053 | Nucleotide in SEQ ID 16053 | Mutated Nucleotide |
|---|---|---|---|---|---|
| 5087053 | C | T | 5530664 | C | T |
| 5089288 | G | A | 5537010 | G | A |
| 5095356 | C | T | 5540526 | G | A |
| 5096131 | C | T | 5541233 | C | T |
| 5099106 | C | T | 5543634 | C | T |
| 5099331 | C | T | 5545010 | C | T |
| 5099501 | C | T | 5545574 | G | A |
| 5104316 | C | T | 5548499 | C | T |
| 5104896 | C | T | 5557711 | G | A |
| 5105840 | C | T | 5574966 | C | T |
| 5107273 | C | T | 5576016 | C | T |
| 5107438 | G | A | 5579654 | C | T |
| 5110964 | G | A | 5582215 | C | C/T |
| 5111341 | G | A | 5590781 | T | T/A |
| 5111525 | G | A | 5590796 | C | C/T |
| 5113971 | C | T | 5590809 | T | T/C |
| 5114926 | C | T/C | 5590810 | G | G/A |
| 5114933 | C | T/C | 5590823 | G | G/A |
| 5116995 | G | A | 5590828 | A | A/G |
| 5117622 | G | A | 5590847 | G | G/T |
| 5126463 | G | A | 5590861 | G | G/C |
| 5128522 | G | A | 5590867 | A | A/C |
| 5131328 | G | A | 5590868 | A | A/G |
| 5132598 | C | T | 5590886 | G | A/G |
| 5133033 | C | T | 5590889 | T | C/T |
| 5134996 | G | A | 5590903 | A | G/A |
| 5136119 | C | T | 5590909 | G | T/G |
| 5139533 | C | T | 5590910 | C | G/C |
| 5141709 | G | A | 5590912 | G | T/G |
| 5147647 | C | T | 5590918 | G | A/G |
| 5158997 | C | T | 5590923 | A | G/A |
| 5171223 | G | A | 5590927 | T | G/T |
| 5189948 | C | T | 5590933 | G | A/G |
| 5196838 | C | T | 5590945 | C | G/C |
| 5203530 | G | A | 5590960 | T | C/T |
| 5204859 | C | T | 5590961 | C | T/C |
| 5213315 | G | A | 5590972 | T | C/T |
| 5216015 | G | A | 5590978 | T | C/T |
| 5221083 | C | T | 5590981 | G | C/G |
| 5229965 | G | A | 5590987 | T | C/T |
| 5233924 | G | A | 5590993 | C | G/C |
| 5246591 | G | A | 5591002 | G | G/A |
| 5247914 | C | T | 5591008 | T | C/T |
| 5253451 | C | T | 5591026 | C | G/C |
| 5255901 | C | T | 5591035 | C | G/C |
| 5259871 | G | A | 5591054 | C | A/C |
| 5270798 | G | A | 5591063 | T | C/T |
| 5277822 | G | A | 5591065 | C | G/C |
| 5280936 | C | T | 5591069 | A | A/G |
| 5283902 | G | A | 5591074 | A | G/A |
| 5292603 | C | T | 5591077 | C | A/C |
| 5309793 | G | A | 5591092 | A | G/A |
| 5317263 | G | A | 5591095 | G | C/G |
| 5323245 | G | A | 5591098 | T | C/T |
| 5323289 | C | T | 5591115 | G | A/G |
| 5323708 | G | A | 5591158 | G | T/G |
| 5326705 | G | A | 5591179 | G | T/G |
| 5339380 | G | A | 5591220 | C | G/C |
| 5349635 | C | T | 5591226 | A | G/A |
| 5350111 | G | A | 5591268 | T | C/T |
| 5356868 | C | T | 5591361 | C | G/C |
| 5363828 | C | T | 5591442 | G | A/G |
| 5385564 | C | T | 5591445 | C | T/C |
| 5391456 | G | A | 5591457 | G | C/G |
| 5404805 | G | A | 5591458 | A | C/A |
| 5415953 | G | A | 5591466 | G | C/G |
| 5416207 | C | T | 5591469 | G | A/G |
| 5419045 | C | T | 5591472 | C | G/C |
| 5438747 | G | A | 5591476 | A | A/G |
| 5457995 | G | A | 5591496 | G | C/G |
| 5465469 | C | T | 5591499 | A | C/A |
| 5481386 | G | A | 5591505 | G | C/G |
| 5485106 | C | T | 5591508 | T | G/T |
| 5500846 | G | A | 5591520 | A | G/A |
| 5514802 | C | T | 5591532 | C | T/C |
| 5516464 | C | T | 5591541 | C | T/C |

-continued

| Position in SEQ ID 16053 | Nucleotide in SEQ ID 16053 | Mutated Nucleotide |
|---|---|---|
| 5591553 | G | A/G |
| 5591562 | G | T/G |
| 5591565 | G | C/G |
| 5591571 | A | G/A |
| 5591577 | A | C/A |
| 5591596 | C | T/C |
| 5591598 | G | C/G |
| 5591607 | C | T/C |
| 5591613 | T | C/T |
| 5591632 | C | A/C |
| 5591635 | G | G/T |
| 5591640 | T | T/C |
| 5591643 | C | C/T |
| 5591654 | A | A/C |
| 5591656 | A | A/G |
| 5604643 | G | A |
| 5612009 | C | T |
| 5626626 | C | T |
| 5629121 | C | T |
| 5631426 | C | T |
| 5636810 | G | A |
| 5657449 | C | T |
| 5659036 | G | A |
| 5692125 | C | T |
| 5694507 | C | T |
| 5696833 | C | T |
| 5698190 | C | T |
| 5705110 | C | T |
| 5708625 | C | T |
| 5709728 | C | T |
| 5724677 | C | T |
| 5727195 | C | T |
| 5728510 | C | T |
| 5732980 | C | T |
| 5738712 | G | A |
| 5738846 | C | T |
| 5745077 | C | T |
| 5751489 | C | T |
| 5751716 | C | T |
| 5753910 | C | T |
| 5755351 | C | T |
| 5756752 | C | T |
| 5756803 | C | T |
| 5760058 | C | G |
| 5760301 | C | T |
| 5763377 | C | T |
| 5764363 | C | T |
| 5765100 | C | T |
| 5765446 | C | T |
| 5767623 | C | T |
| 5779664 | C | T |
| 5780052 | C | T |
| 5781808 | C | T |
| 5783477 | G | A |
| 5788208 | C | T |
| 5790337 | C | T |
| 5791404 | C | T |
| 5793414 | G | A |
| 5795059 | C | T |
| 5795465 | G | A |
| 5799803 | G | A |
| 5803395 | C | T |
| 5803716 | G | A |
| 5805398 | G | A |
| 5805735 | G | A |
| 5807160 | C | T |
| 5809295 | G | A |
| 5810587 | G | T |
| 5811908 | C | T |
| 5813504 | C | T |
| 5813556 | C | T |
| 5834083 | C | T |
| 5842153 | G | C |
| 5843698 | T | T/C |
| 5843724 | C | C/A |
| 5843727 | C | C/T |

-continued

| Position in SEQ ID 16053 | Nucleotide in SEQ ID 16053 | Mutated Nucleotide |
|---|---|---|
| 5843751 | G | G/A |
| 5843752 | G | G/C |
| 5843766 | A | A/G |
| 5843783 | A | A/G |
| 5843786 | G | G/C |
| 5843787 | C | C/G |
| 5843795 | G | G/C |
| 5843796 | T | T/A |
| 5843797 | G | G/T |
| 5843804 | C | C/G |
| 5843810 | C | C/T |
| 5843818 | T | T/C |
| 5843819 | T | T/G |
| 5843831 | C | C/T |
| 5843863 | G | G/T |
| 5843878 | C | C/T |
| 5843881 | G | G/T |
| 5843888 | G | G/A |
| 5843890 | G | G/C |
| 5843897 | C | C/G |
| 5843899 | G | G/T |
| 5843902 | C | C/T |
| 5843942 | C | C/T |
| 5843965 | G | C/G |
| 5843980 | C | C/G |
| 5843981 | C | C/T |
| 5843987 | C | C/G |
| 5843988 | C | C/T |
| 5843992 | C | C/T |
| 5857131 | C | T |
| 5858663 | C | T |
| 5879695 | G | A |
| 5880188 | T | T/C |
| 5880203 | G | G/C |
| 5880223 | C | C/T |
| 5880241 | A | A/C |
| 5880306 | C | C/T |
| 5880307 | T | T/C |
| 5880349 | A | A/T |
| 5880412 | G | G/A |
| 5880421 | C | C/T |
| 5880430 | A | A/G |
| 5880517 | T | T/C |
| 5882826 | G | A |
| 5887657 | G | C/G |
| 5887660 | G | C/G |
| 5887684 | T | C/T |
| 5887693 | T | C/T |
| 5887696 | G | C/G |
| 5887718 | G | G/A |
| 5887732 | G | G/C |
| 5887734 | G | G/A |
| 5887765 | A | A/G/C |
| 5887771 | G | G/C |
| 5887774 | G | G/A |
| 5887775 | C | C/T |
| 5887784 | T | T/C |
| 5887792 | T | T/C |
| 5887810 | G | G/C |
| 5887813 | G | G/C |
| 5887816 | G | G/C |
| 5887820 | G | G/C |
| 5887824 | C | C/G |
| 5887831 | G | G/C |
| 5887837 | C | C/T |
| 5887843 | C | C/G |
| 5887892 | G | A/G |
| 5887931 | G | G/A/C |
| 5887937 | G | G/C |
| 5887938 | C | C/G |
| 5887942 | C | C/G |
| 5887945 | G | G/C |
| 5887951 | G | C/G |
| 5887960 | G | G/C |
| 5887969 | G | G/C |
| 5887970 | C | C/G |

| Position in SEQ ID 16053 | Nucleotide in SEQ ID 16053 | Mutated Nucleotide | Position in SEQ ID 16053 | Nucleotide in SEQ ID 16053 | Mutated Nucleotide |
|---|---|---|---|---|---|
| 5887971 | A | A/G | 5895115 | C | G/C |
| 5887974 | G | G/T | 5895118 | A | C/A |
| 5887975 | C | C/T | 5895127 | C | G/C |
| 5887977 | T | T/A | 5895130 | C | G/C |
| 5887982 | C | C/A/T | 5895137 | A | T/A |
| 5887988 | G | G/T | 5895142 | T | C/T |
| 5887990 | C | C/G | 5895147 | G | C/G |
| 5888003 | A | A/C | 5895181 | C | T/C |
| 5888004 | A | A/G | 5895254 | A | G/A |
| 5888005 | A | A/G | 5895280 | T | C/T |
| 5888026 | C | C/T | 5895283 | G | C/G |
| 5888050 | G | G/C | 5895298 | C | G/C |
| 5888053 | G | G/C | 5895299 | G | A/G |
| 5888056 | G | G/C | 5895319 | C | G/C |
| 5888083 | G | G/C | 5895328 | C | T/C |
| 5888092 | C | C/G | 5895334 | C | T/C |
| 5888095 | C | C/G | 5895340 | G | C/G |
| 5888102 | G | G/A | 5895346 | G | G/C |
| 5888103 | T | T/C | 5895349 | C | T/C |
| 5888122 | C | C/T | 5895358 | C | T/C |
| 5888143 | G | G/C | 5895361 | C | G/C |
| 5890782 | G | G/C | 5895370 | C | C/T |
| 5890839 | T | C/T | 5895391 | C | T/C |
| 5890849 | T | A/T | 5895436 | G | C/G |
| 5890851 | C | G/C | 5895437 | A | G/A |
| 5890863 | C | G/C | 5895439 | C | G/C |
| 5890864 | G | A/G | 5895493 | G | C/G |
| 5890869 | G | T/G | 5895496 | G | C/G |
| 5890872 | C | T/C | 5895505 | C | T/C |
| 5890893 | C | T/C | 5895529 | T | C/T |
| 5890899 | C | T/C | 5895532 | C | G/C |
| 5890906 | G | A/G | 5895577 | G | C/G |
| 5890908 | G | G/A | 5895580 | C | G/C |
| 5890914 | C | T/C | 5895628 | T | C/T/G |
| 5890920 | C | G/C | 5895629 | T | CT |
| 5890923 | C | T/C | 5895661 | C | C/G |
| 5890926 | C | G/C | 5895847 | C | C/G |
| 5890971 | C | C/T | 5895878 | G | G/A |
| 5890992 | C | C/T | 5895898 | C | C/T |
| 5891058 | G | C/G | 5895899 | A | A/C |
| 5891061 | G | C/G | 5895915 | A | G/A |
| 5891070 | C | T/C | 5895949 | C | T/C |
| 5891094 | T | C/T | 5896081 | C | G/C |
| 5891097 | C | C/G | 5896085 | C | T/C |
| 5891100 | C | C/T | 5896090 | C | T/C |
| 5891121 | C | T/C | 5896115 | C | C/T |
| 5891142 | G | G/C | 5896120 | A | A/G |
| 5891145 | C | C/G | 5896123 | G | G/C |
| 5891148 | G | C/G | 5896126 | T | T/C |
| 5891187 | G | G/C | 5896147 | T | T/G |
| 5891220 | G | G/C | 5896148 | T | T/C |
| 5891247 | T | T/C | 5896154 | T | T/C |
| 5891250 | C | C/T | 5896156 | G | G/C |
| 5891263 | T | T/C | 5896159 | G | G/C |
| 5892300 | C | C/T | 5896246 | T | T/C |
| 5892304 | A | A/C | 5896279 | C | T/C |
| 5892312 | C | C/G | 5896312 | A | A/G |
| 5892330 | C | C/T | 5896324 | A | A/G |
| 5892370 | A | A/G | 5896333 | G | G/A |
| 5892413 | C | C/T | 5896381 | G | G/C |
| 5892414 | T | T/C | 5900925 | C | C/G |
| 5892456 | A | A/T | 5900943 | G | G/T |
| 5892519 | G | G/A | 5900949 | C | C/A |
| 5894264 | G | A | 5900955 | C | C/T |
| 5894322 | G | A | 5900958 | C | C/G |
| 5894986 | A | A/G | 5900965 | T | T/C |
| 5894989 | T | T/C | 5900971 | G | G/C |
| 5895041 | G | G/A | 5900972 | C | C/G |
| 5895043 | C | C/G | 5900997 | C | C/T |
| 5895049 | C | C/G | 5901000 | C | C/T |
| 5895054 | T | T/C | 5901015 | A | A/C |
| 5895058 | G | G/C | 5901034 | C | C/A |
| 5895073 | C | C/G | 5901048 | C | C/T |
| 5895100 | G | G/C | 5901050 | G | GA |
| 5895106 | C | G/C | 5901057 | C | C/T |
| 5895108 | T | C/T | 5901068 | G | G/A |

| Position in SEQ ID 16053 | Nucleotide in SEQ ID 16053 | Mutated Nucleotide |
|---|---|---|
| 5901071 | A | A/G |
| 5901078 | G | G/T |
| 5901099 | C | C/T |
| 5901123 | T | T/A |
| 5901135 | G | C/G |
| 5901172 | G | A/G |
| 5901186 | G | G/A |
| 5901195 | T | T/C |
| 5901204 | G | G/A |
| 5901219 | C | A/C |
| 5901342 | T | C/T |
| 5901345 | T | T/G |
| 5901346 | T | T/C |
| 5901354 | C | C/G |
| 5901615 | C | T/C |
| 5901617 | G | C/G |
| 5901660 | C | C/G |
| 5901664 | T | T/G |
| 5901669 | C | A/C |
| 5901673 | T | A/T |
| 5901675 | C | G/C |
| 5901679 | C | C/T |
| 5901688 | C | T/C |
| 5901689 | T | A/T |
| 5901690 | G | C/G |
| 5901698 | C | A/C |
| 5901712 | G | A/G |
| 5901713 | T | A/T |
| 5901714 | T | T/C |
| 5901719 | G | G/C |
| 5901726 | G | G/C |
| 5901729 | C | C/G |
| 5901732 | C | C/T |
| 5901733 | G | G/A |
| 5901738 | C | C/G |
| 5901752 | C | C/T |
| 5901757 | G | G/A |
| 5901764 | T | C/T |
| 5901767 | C | G/C |
| 5901771 | G | C/G |
| 5901790 | C | G/C |
| 5901791 | G | C/G |
| 5901793 | G | A/G |
| 5901807 | G | C/G |
| 5901824 | G | A/G |
| 5901826 | G | GA |
| 5901830 | T | T/G |
| 5901840 | A | A/C |
| 5902914 | C | T |
| 5905708 | G | A |
| 5925008 | C | T |
| 5925517 | G | A |
| 5926357 | G | A |
| 5928875 | C | T |
| 5930205 | C | T |
| 5933164 | G | A |
| 5947433 | C | T |
| 5957471 | G | A |
| 5960825 | C | T |
| 5961809 | T | G/T |
| 5961866 | T | T/A |
| 5970914 | C | T |
| 5975910 | A | G/A |
| 5975911 | A | G/A |
| 5975926 | A | G/A |
| 5978267 | C | T |
| 6005749 | C | T |
| 6009383 | G | A |
| 6010024 | C | T |
| 6026234 | C | T |
| 6033950 | C | T |
| 6042035 | C | T |
| 6050103 | C | C/T |
| 6050112 | A | C/A |
| 6050115 | G | G/C |
| 6050116 | C | C/G |
| 6050118 | G | G/A |
| 6050509 | G | A/G |
| 6050536 | G | G/C |
| 6050556 | G | C/G |
| 6050557 | C | A/C |
| 6050584 | T | T/A |
| 6050694 | T | T/C |
| 6050727 | A | G/A |
| 6050730 | G | C/G |
| 6050769 | G | G/A |
| 6050820 | A | A/C |
| 6050822 | T | T/C |
| 6050824 | C | C/T |
| 6050947 | T | C/T |
| 6050949 | A | G/A |
| 6050952 | T | T/C |
| 6050958 | G | A/G |
| 6050965 | A | C/A |
| 6050971 | T | C/T |
| 6051079 | A | A/G |
| 6051571 | G | A |
| 6072579 | C | T |
| 6074412 | G | A |
| 6075058 | G | A |
| 6083188 | C | T |
| 6085177 | C | T |
| 6090298 | C | T |
| 6094419 | C | T |
| 6095825 | C | T |
| 6098808 | C | T |
| 6099142 | C | T |
| 6099801 | C | T |
| 6100131 | C | T |
| 6100928 | C | T |
| 6114598 | C | T |
| 6129757 | G | A |
| 6151020 | G | A |
| 6157309 | C | T |
| 6157376 | C | T |
| 6178150 | G | A |
| 6188180 | C | T |
| 6191683 | G | A |
| 6207945 | G | A |
| 6216366 | C | T |
| 6230439 | A | G |
| 6251389 | G | A |
| 6251652 | G | A |
| 6255100 | G | A |
| 6264179 | G | A |
| 6265855 | G | A |
| 6267856 | G | A |
| 6278700 | G | A |
| 6281103 | C | T |
| 6282875 | C | T |
| 6286620 | C | T |
| 6288364 | C | T |
| 6291716 | C | T |
| 6297821 | C | T |
| 6303632 | G | A |
| 6306219 | C | T |
| 6309112 | G | A |
| 6322894 | G | A |
| 6328731 | C | T |
| 6331035 | G | A |
| 6338677 | G | A |
| 6339429 | C | T |
| 6344180 | C | T |
| 6346415 | C | T |
| 6361477 | C | T |
| 6362282 | G | A |
| 6366940 | C | T |
| 6368217 | G | A |
| 6369699 | G | A |
| 6375315 | G | A |
| 6381431 | C | T |
| 6401947 | G | A |

| Position in SEQ ID 16053 | Nucleotide in SEQ ID 16053 | Mutated Nucleotide | Position in SEQ ID 16053 | Nucleotide in SEQ ID 16053 | Mutated Nucleotide |
|---|---|---|---|---|---|
| 6403645 | C | T | 6858684 | G | A |
| 6437676 | C | T | 6883984 | C | T |
| 6439389 | G | A | 6884717 | G | A |
| 6450624 | C | T | 6890659 | G | A |
| 6454248 | C | T | 6892977 | G | A |
| 6454843 | C | T | 6898871 | C | T |
| 6456678 | C | T | 6902839 | A | T |
| 6456912 | C | T | 6911746 | G | A |
| 6459047 | G | A | 6916561 | G | A |
| 6460584 | T | C | 6916943 | C | T |
| 6471884 | G | A | 6927456 | G | A |
| 6485358 | C | T | 6960103 | G | A |
| 6499172 | G | A | 6961070 | C | T |
| 6500551 | G | A | 6968534 | C | T |
| 6507389 | C | T | 6973392 | G | A |
| 6517707 | C | T | 6987945 | G | A |
| 6525706 | G | A | 6993597 | G | A |
| 6538378 | C | T | 6995391 | C | T |
| 6542765 | C | T | 6996621 | C | T |
| 6543445 | C | T | 6999127 | C | T |
| 6543579 | C | T | 6999520 | C | T |
| 6545779 | C | T | 6999817 | C | T |
| 6550507 | C | T | 7000264 | C | T |
| 6553219 | G | A | 7002458 | G | A |
| 6553546 | G | A | 7003486 | G | A |
| 6553589 | G | A | 7003496 | G | A |
| 6555594 | G | A | 7004068 | C | T |
| 6556192 | C | T | 7009952 | C | T |
| 6560301 | C | T | 7010119 | C | T |
| 6561416 | G | A | 7010712 | C | T |
| 6563658 | C | T | 7015917 | G | A |
| 6564054 | C | T | 7019067 | C | T |
| 6564511 | C | T | 7019437 | C | T |
| 6564827 | C | T | 7020227 | C | T |
| 6567102 | C | T | 7021026 | C | T |
| 6567313 | C | T | 7023202 | C | T |
| 6568360 | C | T | 7024113 | C | T |
| 6569524 | C | T | 7026584 | C | T |
| 6569696 | G | A | 7028273 | C | T |
| 6570943 | C | T | 7028622 | C | T |
| 6572188 | C | T | 7029812 | C | T |
| 6572441 | C | T | 7031076 | C | T |
| 6580904 | G | A | 7040546 | C | T |
| 6581219 | G | G/A | 7053643 | C | T |
| 6589934 | C | T | 7065316 | C | T |
| 6595494 | C | T | 7075215 | C | T |
| 6604343 | C | T | 7098642 | C | T |
| 6615272 | C | T | 7099792 | C | T |
| 6617190 | G | A | 7100617 | C | T |
| 6619058 | C | T | 7101023 | C | T |
| 6622561 | G | A | 7103392 | C | T |
| 6629950 | C | T | 7104098 | C | T |
| 6632292 | C | T | 7109594 | C | T |
| 6656015 | C | T | 7110600 | C | T |
| 6669477 | G | A | 7110641 | C | T |
| 6690831 | C | T | 7112833 | C | T |
| 6690855 | G | A | 7116801 | C | T |
| 6696960 | G | A | 7135624 | G | A |
| 6705369 | G | A | 7135635 | G | A |
| 6716231 | G | A | 7146220 | G | A |
| 6729998 | G | A | 7160415 | C | T |
| 6734341 | C | T | 7161529 | G | A |
| 6758247 | G | A | 7162249 | G | A |
| 6759384 | C | T | 7165660 | C | T |
| 6767085 | G | A | 7176091 | G | A |
| 6769984 | C | T | 7177869 | G | A |
| 6780798 | A | G | 7185280 | G | A |
| 6801699 | G | A | 7186525 | C | T |
| 6805336 | G | A | 7211965 | G | G/C |
| 6805990 | G | A | 7211966 | A | A/T |
| 6808471 | C | T | 7211975 | C | C/T |
| 6818998 | G | A | 7211983 | G | G/T |
| 6830990 | G | A | 7211992 | G | G/T |
| 6843179 | C | T | 7211994 | G | G/A |
| 6847192 | G | A | 7212006 | T | T/C |
| 6854404 | C | T | 7212047 | C | C/G |

| Position in SEQ ID 16053 | Nucleotide in SEQ ID 16053 | Mutated Nucleotide |
|---|---|---|
| 7212067 | T | T/A |
| 7212068 | G | G/C |
| 7212075 | G | G/C |
| 7212088 | A | A/T |
| 7212097 | T | T/C |
| 7212113 | T | T/C |
| 7212121 | G | G/T |
| 7212122 | T | T/C |
| 7212142 | T | T/C |
| 7212144 | C | C/G |
| 7212151 | T | T/G |
| 7212156 | G | G/C |
| 7212180 | C | C/G |
| 7212182 | G | G/C |
| 7212183 | T | T/C |
| 7212206 | T | T/C |
| 7216330 | G | A |
| 7218939 | G | A |
| 7219494 | G | A |
| 7224067 | G | A |
| 7228023 | G | A |
| 7240925 | G | A |
| 7241497 | C | T |
| 7264121 | G | A |
| 7266647 | G | A |
| 7283171 | C | T |
| 7294161 | A | G |
| 7303836 | C | T |
| 7310019 | G | A |
| 7314132 | C | T |
| 7314146 | C | T |
| 7319151 | G | A |
| 7319658 | G | A |
| 7321495 | G | A |
| 7329181 | G | A |
| 7330808 | G | A |
| 7362245 | C | T |
| 7369374 | C | T |
| 7371536 | C | T |
| 7377855 | C | T |
| 7384932 | G | A |
| 7385124 | C | T |
| 7386113 | G | A |
| 7389303 | C | T |
| 7394213 | C | T |
| 7394997 | C | T |
| 7400636 | C | T |
| 7401592 | C | T |
| 7422484 | G | A |
| 7446288 | G | A |
| 7451085 | C | T |
| 7452627 | C | T |
| 7453489 | C | T |
| 7453910 | C | T |
| 7460642 | C | T |
| 7462223 | G | A |
| 7484067 | C | T |
| 7490770 | G | A |
| 7492384 | G | A |
| 7498836 | G | A |
| 7511194 | G | A |
| 7517188 | G | A |
| 7518982 | C | T |
| 7524203 | G | A |
| 7525798 | C | T |
| 7546077 | C | T |
| 7583090 | G | A |
| 7588792 | C | T |
| 7598819 | G | A |
| 7600514 | G | A |
| 7604996 | G | A |
| 7607903 | G | A |
| 7622689 | G | A |
| 7627683 | G | G/T |
| 7630530 | G | A |
| 7639840 | G | A |
| 7641043 | G | A |
| 7646004 | G | A |
| 7648704 | G | A |
| 7652691 | G | A |
| 7654254 | G | A |
| 7655513 | G | A |
| 7662521 | G | A |
| 7671626 | C | T |
| 7672126 | G | A |
| 7687061 | G | A |
| 7689723 | G | A |
| 7714246 | C | T |
| 7718521 | G | A |
| 7719226 | G | A |
| 7719430 | G | A |
| 7720998 | G | A |
| 7731353 | G | A |
| 7733376 | G | A |
| 7736672 | C | C/T |
| 7740086 | C | T |
| 7740896 | G | A |
| 7765137 | G | A |
| 7772239 | G | A |
| 7789263 | G | A |
| 7790304 | G | A |
| 7801751 | G | A |
| 7802623 | T | T/C |
| 7802638 | T | T/C |
| 7802639 | C | C/T |
| 7802682 | A | T |
| 7809752 | G | A |
| 7809834 | G | A |
| 7823754 | C | T |
| 7825882 | G | A |
| 7832540 | G | A |
| 7838339 | C | T |
| 7841392 | C | T |
| 7841997 | C | T |
| 7842274 | C | T |
| 7844241 | G | A |
| 7855301 | C | T |
| 7864327 | G | A |
| 7874843 | C | T |
| 7883195 | A | G |
| 7889441 | G | A |
| 7909245 | G | A |
| 7912017 | A | G |
| 7917279 | G | A |
| 7926998 | G | A |
| 7931764 | G | A |
| 7934819 | G | A |
| 7948630 | C | T |
| 7963950 | G | A |
| 7967045 | G | A |
| 7969374 | G | A |
| 7984213 | G | A |
| 7984254 | G | A |
| 7985275 | G | A |
| 8009877 | C | T |
| 8026754 | C | T |
| 8036245 | C | T |
| 8042744 | G | A |
| 8051051 | G | A |
| 8053700 | C | T |
| 8062905 | A | T |
| 8062911 | C | T |
| 8075410 | C | T |
| 8077440 | G | A |
| 8087405 | G | A |
| 8094018 | G | A |
| 8095401 | G | A |
| 8096270 | C | T |
| 8122172 | G | A |
| 8123295 | G | A |
| 8123721 | G | A |
| 8136640 | C | T |

-continued

| Position in SEQ ID 16053 | Nucleotide in SEQ ID 16053 | Mutated Nucleotide |
|---|---|---|
| 8161493 | C | T |
| 8165695 | A | A/T |
| 8165703 | A | A/G |
| 8165704 | C | C/G |
| 8167086 | G | A |
| 8171741 | G | A |
| 8179169 | G | A |
| 8181933 | G | A |
| 8186618 | C | T |
| 8193241 | C | T |
| 8195170 | C | T |
| 8195310 | C | T |
| 8199221 | G | A |
| 8202704 | C | C/T |
| 8205853 | G | A |
| 8212158 | C | T |
| 8212583 | G | A |
| 8214951 | C | T |
| 8221459 | G | A |
| 8227017 | G | A |
| 8233448 | C | T |
| 8237580 | G | A |
| 8239310 | G | A |
| 8240439 | G | A |
| 8241289 | G | A |
| 8243590 | G | A |
| 8247542 | G | A |
| 8248207 | C | T |
| 8256006 | G | A |
| 8263792 | G | A |
| 8267543 | G | A |
| 8272330 | G | A |
| 8273351 | C | T |
| 8278809 | G | A |
| 8282707 | G | A |
| 8298405 | T | T/A |
| 8298413 | C | C/G |
| 8302281 | G | A |
| 8311927 | T | C |
| 8323622 | C | T |
| 8325049 | G | G/C |
| 8325050 | A | G/A |
| 8325073 | C | C/G |
| 8325095 | G | G/C |
| 8325096 | G | G/T |
| 8325102 | C | C/G |
| 8325109 | T | C/T |
| 8325115 | C | G/C |
| 8325118 | C | C/G |
| 8325121 | G | G/C |
| 8325127 | G | G/C |
| 8325133 | C | G/C |
| 8325203 | T | T/C |
| 8325210 | A | G/A |
| 8325277 | C | C/G |
| 8325286 | C | C/G |
| 8349257 | G | A |
| 8351616 | G | A |
| 8355565 | C | T |
| 8355924 | C | T |
| 8363036 | G | A |
| 8364757 | C | T |
| 8365293 | G | A |
| 8368404 | G | A |
| 8378911 | G | A |
| 8379977 | G | A |
| 8380006 | C | T |
| 8381094 | G | A |
| 8384806 | G | A |
| 8389000 | C | T |
| 8389283 | A | G |
| 8393915 | G | A |
| 8396831 | G | A |
| 8397563 | G | A |
| 8402662 | G | A |
| 8411820 | C | T |

-continued

| Position in SEQ ID 16053 | Nucleotide in SEQ ID 16053 | Mutated Nucleotide |
|---|---|---|
| 8413318 | C | T |
| 8414872 | C | T |
| 8431655 | T | T/A |
| 8441210 | C | T |
| 8449495 | G | G/A |
| 8453858 | G | A |
| 8463714 | G | A |
| 8466767 | G | A |
| 8491536 | G | A |
| 8497636 | C | T |
| 8506267 | G | A |
| 8509227 | G | A |
| 8515828 | G | A |
| 8529144 | G | A |
| 8544731 | G | A |
| 8546526 | C | T |
| 8556565 | G | A |
| 8559522 | G | A |
| 8560241 | C | T |
| 8567608 | C | T |
| 8572238 | C | T |
| 8576774 | G | A |
| 8582623 | C | T |
| 8589455 | C | T |
| 8589459 | C | T |
| 8595339 | C | T |
| 8610015 | C | T |
| 8622039 | C | T |
| 8631175 | G | A |
| 8640526 | C | T |
| 8646416 | G | A |
| 8647802 | G | A |
| 8648408 | G | A |
| 8655581 | C | T |
| 8658688 | G | A |
| 8668191 | C | T |
| 8668196 | G | A |
| 8669919 | G | A |
| 8674137 | C | T |
| 8678961 | G | A |
| 8682722 | G | A |
| 8690364 | C | T |
| 8691972 | C | T |
| 8699652 | G | A |
| 8699708 | G | A |
| 8709561 | C | T |
| 8720459 | G | A |
| 8731485 | G | A |
| 8737851 | G | A |
| 8737859 | G | A |
| 8742265 | C | T |
| 8743148 | C | T |
| 8754468 | G | A |
| 8754501 | G | A |
| 8759529 | G | A |
| 8761290 | C | T |
| 8769464 | T | C |
| 8792629 | G | A |
| 8793001 | C | T |
| 8809351 | C | T |
| 8813761 | C | T |
| 8813866 | C | T |
| 8816396 | G | A |
| 8821923 | G | A |
| 8825490 | G | A |
| 8828064 | C | T |
| 8841828 | G | A |
| 8842797 | G | A |
| 8843541 | G | A |
| 8845199 | T | C |
| 8848419 | G | A |
| 8849052 | G | A |
| 8854017 | C | T |
| 8854256 | G | A |
| 8858030 | G | A |
| 8859328 | G | A |

-continued

| Position in SEQ ID 16053 | Nucleotide in SEQ ID 16053 | Mutated Nucleotide |
|---|---|---|
| 8860995 | G | A |
| 8861382 | G | A |
| 8871894 | C | T |
| 8872344 | C | C/T |
| 8875526 | G | A |
| 8881555 | G | A |
| 8889242 | Ci | A |
| 8893686 | G | A |
| 8894581 | G | A |
| 8896018 | G | A |
| 8901982 | G | A |
| 8902511 | G | A |
| 8902844 | G | A |
| 8902903 | G | A |
| 8907784 | G | A |
| 8927137 | G | A |
| 8929703 | G | A |
| 8931762 | C | A |
| 8934108 | G | A |
| 8937518 | C | T |
| 8943513 | C | T |
| 8943676 | C | T |
| 8944024 | C | T |
| 8945415 | C | T |
| 8946251 | C | T |
| 8948806 | G | A |
| 8950622 | C | T |
| 8951908 | C | T |
| 8953417 | G | A |
| 8955117 | G | A |
| 8956021 | C | T |
| 8956608 | C | T |
| 8958843 | C | T |
| 8959688 | G | A |

-continued

| Position in SEQ ID 16053 | Nucleotide in SEQ ID 16053 | Mutated Nucleotide |
|---|---|---|
| 8974326 | G | A |
| 8979884 | C | T |
| 8982938 | G | G/C |
| 8982956 | G | G/C |
| 8982975 | G | G/C |
| 8983002 | G | G/A |
| 8983053 | C | C/T |
| 8983087 | G | A/G |
| 8983088 | G | G/C |
| 8983102 | A | G/A |
| 8983134 | G | G/C |
| 9008254 | C | T |
| 9028349 | G | A |
| 9029056 | C | T |
| 9045846 | G | A |
| 9049564 | C | T |
| 9052240 | C | T |
| 9052265 | G | A |
| 9053107 | G | A |
| 9058239 | G | A |
| 9060181 | C | T |
| 9064090 | C | T |
| 9072129 | C | C/T. |

2. A microorganism comprising the DNA of claim 1, wherein said microorganism is *Actinoplanes utahensis*.

3. A method for producing Acarbose comprising the steps:
   a) cultivating the microorganism of claim 2 to produce Acarbose; and
   b) harvesting said Acarbose produced by the microorganism.

* * * * *